United States Patent 11,931,406 (FLAVIVIRUS VACCINE) - sequence listing, part 66

SEQ ID NO: 23077 - RNA, 9873 nt, Artificial Sequence
  derived and/or modified CDS sequence (opt6) from DENV-3__GQ199891__SS-prME
acaucauuaugcuuaaugaugaucuuaccagcagcacuagcauuucacuuaaccagcagggauggggaaccuaggaugaucguuggcaaaaacgaaaggggaaaaucucugcuuuucaaaacagcuagcgguauuaacaugugcacacuaauagccauggaccuaggcgaaaugugugaugauacagucaccuauaaauguccacauaucacugaaguggaaccggaggauauugacuguugguguaacuuaacaagcacuuggguaacuuaugguacuugcaaucaagcaggggaacaucggagagauaagcggagugucgccuuggcuccacacguagguaugggcuuagauacaagaacacaaacguggauguccgccgagggggcauggcgacagguugaaaagguugagacaugggcacugaggcaccccggauuuacaauauuagcgcuauucuuagcucauuauauuggcacaucauuaacucaaaaagcagucaucuucauuuuacuaaugcuagucacuccuaguaugaccaugagauguguaggaguaggaaauagggauuuuguugagggacuaucuggggcaacuuggguggacgugguauuagaacaugggggaugugucacaacuauggcaaagaauaaacccacucuagauauugaauugcagaaaaccgaagcaacacaacuugcuacccucagaaaacuuugcauugaagggaagaucacaaauauaacaacagauucuagguguccaacgcagggcgaagcagugcuaccggaggagcaagaccagaauuacgucugcaaacauacauauguagauagagguuggggaaaugguuguggucuguuuggcaaagguagucuagucacaugugcuaaauuucaguguuuagaaccaauagaagggaaaguaguacaauaugaaaaccuuaaauacacuguaauaauaacaguacacacaggggaccaacaucaagugggaaaugaaacacaaggcguuacagcagagauuacgccacaagccaguacaacugaagcuauuuuaccagaauaugggacacuaggacuagaauguaguccccggaccggcuuggauuuuaaugaaaugauauuacuaacaaugaaaaauaaggccuggaugguacauagacaaugguucuuugaucuaccacuuccauggacuucgggugcaaccacagaaacaccaaccuggaaucgaaaagaacucuuaguaacuuucaaaaaugcacaugcuaagaaacaagaaguaguaguacuggguucgcaagagggugcuaugcacacggcuuuaacgggagcaacugaaauacaaaauucaggagggacaucaauauuugcuggucacuugaaaugucgucuaaaaauggacaaauuagaacuaaaaggcaugucauacgcgaugugcacuaauacauuuguguugaagaaagaaguuucugaaacacagcauggaacgauacucauaaaagucgaguauaaaggggaagaugucccauguaaaauaccauucucuacugaggacggccaaggcaaggcgcauaacggcagacuuaucaccgcgaauccaguaguaacgaagaaagaggaaccugugaauauugaagcagaaccgccguuuggagaaucuaacaucguuauaggaauaggagacaaugcacucaagauaaacugguacaaaaaggggucaucaauagggaagauguucgaagcaacggccagaggggcgagaagaauggcuauauugggggauacagcuugggauuuugggagcguagguggaguacuaaacucucuaggaaaaaugguacaucaaauuuucggcagugcguacaccgcauuauuuagcgguguguccuggguaaugaaaauugguauaggaguucuacuaacuuggauagguuuaaacagcaaaaauacaucaaugucuuucaguugcaucgcaauuggcauuauuacucucuauuuaggagcagucguacaggcggacaugggaugcgucauaaacuggaaggguaaggagcuuaagugugguucuggaauauuuguuacaaaugaaguucacacauggacugagcaauauaaguuucaagcggacucaccgaagcguuuagccaccgcaauagcuggagcuugggaaaauggcgucuguggaauaaggucaacaacaaggauggagaacuuauuauggaagcaaauagccaaugaguugaauuauauacuaugggagaacaauauuaaacuaacaguaguggucggcgauauaauaggagugcuagagcaaggaaaacgaacauuaacaccacagcccauggaguugaaauauucguggaaaacaugggguaaggcgaaaaucguaaccgcagaaacacaaaauucaaguuucaucaucgaugguccaaauacaccagagugcccgucugcuucucgagcuuggaauguaugggaaguggaggauuacggcuuuggaguuuucacaacgaacauauggcuaaaacuaagggagguuuauacacaacuaugcgaccauagacugaugucagcugcugugaaagaugaacgcgcuguucaugcagauaugggguauuggauagaaagccagaaaaauggcagcuggaaacuagaaaaagcaucccucauagaagugaaaacauguacauggccaaaaucccauacauuauggaguaacggaguauuagaauccgacaugaucauaccaaagucuuuggccgggccaauuucucaacauaacuaccgaccaggauaccauacgcaaacagcaggaccauggcaucucggaaaacuugaauuagacuucaauuauugcgaaggaaccacggucguuauaacagagaacuguggaacuagagguccgucacuuagaacuacaacuguuaguggcaaauuaauucaugaguggugcuguagaagcugcacauuacccccacuuagguauaugggcgaagauggauguugguaugguauggaaauacguccaauuagugaaaaagaagaaaacaugguuaaaagucuaguuucagcagguagcggugagguagauaauuucaccauggguguccuaugcuuggcuauuuuauucgaagaaguuaugaggggaaaauucggaaagaagcauaugauagcggggguauuuuucacauucguucuguuauuaucaggucagauaacauggcgagauauggcucauacuuuaauaaugauugggucuaacgcuucagaccguauggggaugggugucacguaucuagcucucauagcaacguuuaaaauucaacccuucuuagcucuuggcuucuuuuuaaggaaacucacaaguagggagaaucuauuacuggggguagggcuagcaauggcaacaacgcuacagcucccagaggauauagagcagauggcuaaugguaucgccuuagggcuaauggcccuuaaauuaauaacucaauuugaaaccuaucaauuauggacagcauuaauuucguuaacuuguuccaacacuauauuuacauuaacaguagcuuggagaacagcaacccuuauucuagcaggaguaucucuuuuaccaguuugucaaaguucuucgaugagaaaaacugacugguuaccuaugacgguagcagcuaugggaguaccaccuuuaccguuauuuauauuuucauuaaaagacacccuaaaaaggagauccuggccguuaaacgaggggguaauggccguggggcucguaaguauacucgccaguucacuccuucggaaugacgucccaauggcggguccacuuguagcugguggacuacugauugcgugcuacgugauaacuggaacuucugcugaccuuaccguagaaaaggcugccgauguaacaugggaagaggaagcagaacaaacaggaguaucacauaauuugaugauaaccguugaugaugacgguacaaugagaauaaaagacgaugaaacagagaauauucuuacgguucuauugaaaacagcauuauugauuguaucgggaauauucccauauucgauacccgcuacauuauuaguguggcacacuuggcaaaaacaaacucaaagaagugguguguugugggauguaccauccccgccagaaacacaaaaagcugagcuugaagaggguguuuaucgaauaaaacaacaaggcauauucggcaaaacacaaguaggcguaggugugcaaaaagaggguguuuuucauacaauguggcauguuacacgaggggcaguauuaacauauaauggcaaacgucuggaaccaaacugggcaagugugaagaaagaccugaucucguaugguggcggcuggcguuuaucugcacaauggcaaaagggugaggagguacagguuauagcaguagaaccuggaaagaaucccaaaaauuuucaaacuaugccgggaacguuucagacuaccacuggggaaauuggugcgauagcguuagacuucaaaccagggacaagcggaagucccauaauaaaucgagagggaaaggugguaggacucuaugggaacggaguugucacuaaaaacggcggauacguuagcggcauagcucaaacaaacgcagaaccugauggaccaacgccagaguuagaagaggaaauguucaaaaagagaaauuugaccaucauggaccugcauccgggaagcgguaagacucggaaauaucuaccagcgauaguaagagaagcaauaaaaaggagacuuaggacuuugauauuagcacccacuagagugguugcagcugaaauggaagaggcgcuaaaaggguugccaauccgcuaccagacuacggccacaaagucagaacauacaggacgcgaaauaguagauuugaugugucacgcuacuuuuaccaugaggcuccuaaguccgguucguguaccaaauuauaacuugauuaucauggaugaagcucacuucacugacccugcaucgauagcagcaagaggguauauaucgacaagaguagguaugggagaggcugcagcaaucuucaugacagcaacgccgccagguacagcagaugcauuuccgcaaagcaaugcgccaauucaagaugaagaaagagauauuccagaacgaaguuggaacagcgguaacgaguggauuacugauuuugcugguaaaacuguaugguucguaccuagcauaaaagcaggaaacgauauagcgaacugcuuacgaaagaaugguaagaaaguuauacaauuaucgagaaaaacauuugacaccgaauaccagaaaacuaaauuaaacgauugggauuuuguaguuaccacagacauaucagaaaugggcgcaaacuuuaaagcggacaggguaauagauccaagacguugccucaaaccaguaauccuaacagacggacccgaacgagucauauuggcugguccuaugccagugacagcagcaucugcagcacaacgucgggggagagucggaaggaauccacaaaaagagaaugaccaauacauauucacuggucaaccucuaaacaaugacgaagaucaugcacacuggacggaggcaaagauguuacucgacaauauaaacacaccggaagguauaauuccggcuuuauuugaaccggaaagagaaaaaucugcugcuauagauggcgaguaccgccuaaagggcgagucaaggaagacuuucguagaacuuaugagaaggggagacuuacccguuuggcuggcccauaaggucgcuucagaaggcauuaaguauacagaucggaaauggugcuucgacggccaaagaaauaaccaaauacuggaagagaauauggaugucgaaaucuggacaaaggagggagagaaaaagaaauugagaccucgauggcucgacgcccgaacauauagcgauccacucgcauuaaaagaguucaaagacuuugcagcugggagaaagagcauugccuuggacuuagucacugaaaucggaagagugccaacccauuuagcucaucgaacaagaaaugcucuggauaauuuagugaugcuucacaccucggaacauggcggcaaagccuacaggcacgcgguggaagaacugcccgaaacuauggaaaccuugcuacuccuaggauugaugauauuacuuacaggaggggcgaugcuguuuuuaauaucaggaaaggguauaggaaaaaccucgauuggucuuauuugcguaauagccaguagcgguaugcuuuggauggcggagauaccuuuacaauggauagcaagugcaauaguacuagaauuuuucaugaugguccuacuaauaccagaaccugagaaacaaagaacgccacaagacaaccaauuagcauacguagugauuggcauauuaacauuggcagcgauaauagcagccaacgaaauggggcuacuugagacaacaaagcgagaccucgggaugaguaaagaacccggugucgucucuccaacgucauaccuggauguggaccugcacccugcgagugcuuggacauuauaugccguggcuacaaccguaaucacaccaaugcuacgacauaccauugagaacucuacggccaaugugagccuagcagcuauugcaaaucaagcgguuguguuaauggggcuagauaaaggauggcccauaaguaaaauggaucucggaguaccacuguuagcacugggaugcuacucucaaguaaacccccuaaccuuaacggccgcuguucuacuuuuaauuacacauuaugcaaucauuggacccggacuacaggcaaaagcaacacgagaagcccagaaaagaaccgcagccggaauuaugaaaaacccuacuguggauggcauaaugaccaucgauuuggauccuguuauuuacgacucaaaauucgaaaagcaacuaggacaaguuaugcucuuagucuugugugcaguucaacuguuauuaaugaggacauccugggcacucugugaggcgcugacacuagcuaccggacccauaacaaccuugugggagggcagcccuggcaaauuuuggaauacaacuauugcagucaguauggcaaauauuuuucgaggcagcuacuuagccggugcugguuuagccuuuaguauaaugaaaucggucggaacaggaaaacgaggcacuggcucgcagggcgaaacauugggagaaaaauggaagaagaaacucaaccaacugucacgaaaagaauuugaccucuacaagaaaagcggaauaacagaaguggaucgaacugaagcaaaagaaggacuaaaaagaggagaaauaacucaccaugccguaagccggggaucagcgaaacuacaaugguucguagaaagaaauaugguaaucccggaaggacgaguuauugaccugggauguggaagagggggauggagcuauuauugugcgggacucaagaaagugacagagguucgaggauacacuaagggagguccaggacaugaagaaccuguaccaaugagcacauacgguuggaacauagucaaauuaaugucugguaaagacguuuucuaucugccacccgaaaagugcgauacuuugcucugcgacauuggugagucuagucccucgcccacaguugaagaaucucgcacaauacgaguucuaaaaaugguagaaccguggcuaaagaauaaccaguucuguauuaaaguuuuaaaucccuauaugcccacagucauugaacauuuagaacguuuacaaaggaaacaugggggcaugcuagugagaaacccucuuagcagaaacaguacacaugaaauguauuggauaaguaacggaacgggaaacauaguagcaaguguaaacauggucagcagacuguuacuaaauagauucacaaugacacaccgaaggccaacuauagagaaagaugucgauuugggcgcagguacaaggcacguaaacgcugaaccagaaacuccgaacauggacgugauaggggagaggaucaaaagaauuaaagaagaacacaauuccacauggcacuaugacgaugaaaacccauacaaaacuugggcauaucacgguucauaugaaguaaaagcgaccggaucagcgucuucaaugauaaaugguguuguaaaacuacucacaaagccaugggacguagugccuauggugacacaaauggccaugacggauacuacaccauuuggacaacaacgcguuuucaaagaaaaaguugauacucgaaccccaaggucuaugccuggaacucggaggguaaugggaauuacggcagaauggcuguggaggacacuuggucguaacaaaaagccacgccuuuguacgagagaagaauuuacgaagaaaguaagaacuaacgcugcuaugggcgcgguuuuuacagaagaaaaucaaugggacagcgcaaaagcugccguagaagaugaggacuuuuggaaauuagucgaccgagaacgagaauuacauaaacuaggaaaaugcgggagcuguguauauaauaugauggguaaacgggagaaaaaguuaggcgaauuugguaaagcuaaagggucgcgagcuauaugguauauguggcugggcgcaagguaccuagaguucgaagcguuaggauuccucaaugaggaccauugguuuagucgugaaaauucuuacucgggaguggagggagagggacuacauaaauugggauauauucuacgugauauauccaagauccccggcggugcuauguacgcagaugauaccgcgggaugggauacgcgaauuacagaagacgaucuacauaacgaagagaaaauaacucaacaaauggauccugagcacagacaauuagcaaacgcaauauucaaacuuacauaccaaaauaaaguaguaaaaguucagcgaccaacaccuacuggcacugugauggauauaauaucaagaaaagaucaacgugguucuggacaagugggaacauauggauuaaauaccuuuacaaauauggaagcacaacucauucggcaaauggaaggugaaggaguacugagcaaggcagaucucgaaaauccacauuugcccgagaaaaagauaacccaauggcuggaaaccaaagguguugaacgacuaaaacgaauggcaauaucuggcgacgauugugugguaaaaccaaucgacgauagauucgcaaacgcacuguuagcacuaaacgacauggggaaaguaaggaaagacauaccacaauggcaaccuucgaagggauggcaugacuggcaacagguuccuuucuguagucaccauuuucacgaacugauaaugaaagauggacgaaaguuaguaguaccaugcagaccucaagacgaacuaauuggucgggccagaauaagucaaggcgcggguuggucccuuagagaaacagcaugucucggaaaggcauacgcgcagauguggucacuaauguauuuccauagaagagauuuacggcuggcaaguaaugcaauaugcucggcuguacccguucacuggguuccaacuuccagaacuaccugguccauacaugcucaccaucaguggaugacuacugaagauaugcuuacuguauggaacagaguguggauugaagauaauccuuggauggaggauaaaacgccuguuacgacuugggaaaacgucccauaucucgguaaaagagaagaucaauggugugguucgcucauagggcugaccaguagggccacuugggcucagaacauaccaacagcuauccagcaagugcggucucuaauaggaaaugaagaguucuuagacuacaugccgucgaugaaaagguucagaaaggaagaagaaucagaaggugcaauuugguaa

SEQ ID NO: 23078 - RNA, 9873 nt, Artificial Sequence
  derived and/or modified CDS sequence (opt6) from DENV-3__FJ898443__SS-prME
acuagcuuauguuuaaugaugauacuaccagcugcacuagcuuuucaccuaaccagcagagacggagaaccaaggaugauaguaggcaaaaaugaacgcgggaaaaguuuauuauuuaaaacagcgucggggauuaauauguguacacuaauugcaauggaccuaggagaaaugugcgaugacacaguaacauacaaauguccccauauaacagaaguggaaccagaagauaucgacugcugguguaaccuaacaaguacauggguuaccuacggcacgugcaaucaagcgggagaacacagacgugacaaacgaaguguagcauuggcgccgcacgucgggauggggcuagacacucgcacucaaaccuggaugagcgcugaaggagcuuggaggcaaguugaaaaaguagaaaccugggcguuacgacauccaggauucacaauacuagcauuauuuuuggcucacuauauuggaacaagucuaacacaaaaagccguaauauucauacuauuaauguugguaacaccauccaugaccaugagauguguaggagugggaaacagggacuuuguagagggacuuagcggugcaacguggguagauguaguauuggaacauggaggaugcgugaccacuauggccaaaaauaaaccaacacuagacauagaauuacagaaaaccgaagcaacucagcuagcuacccugaggaaauuaugcauagaggggaaaaucacaaauauaacaacagauucgagauguccaacacaaggggaagcuguauuaccugaggaacaagaccaaaauuauguuugcaaacauacuuacguugauagaggaugggggaauggaugugguuuauuugggaaaggaucguuaguuacaugugcgaaauuccaaugucuugaaccgauagaggguaaaguaguacaauaugaaaaccuuaaauauacagucauaauuacuguucacacgggugaucaacaccaaguaggaaaugagacacaaggagugacugcagaaauuaccccucaagcgucaacgaccgaagcaauuuuaccugaauacggaacucuagggcuagaaugcagucccagaacuggacuagauuuuaacgaaaugauauuacuaacaaugaaaaauaaagccuggaugguacacagacagugguucuuugaucugccauuaccuuggacuucaggcgccacuaccgaaacaccgaccuggaacagaaaagaacuauuagucacuuucaaaaaugcucaugcaaagaaacaagaaguuguagucuuagguagucaggagggggcuaugcacacagcauuaacuggugcaacagaaauucaaaauucaggcgguaccagcauauuugcaggacauuuaaaaugcaggcuaaaaauggauaaauuagaguuaaaagguaugucauaugcaauguguacaaauacauuuguucucaagaaagaaguaucagagacgcagcauggcaccauauuaauaaaagucgaauauaaaggagaggauguucccuguaaaaucccauucaguacggaggauggccaagggaaagcacacaacggucgauugaucacugcaaacccaguaguaacgaagaaagaagaaccgguuaauaucgaagcagagccaccuuucggagaaagcaauauuguaauaggcacaggagauaacgcacuaaaaauaaacugguacaagaaagguagcaguauugguaaaauguuugaagcaaccgcacggggcgcgcgaagaauggcaaucuuaggugauacagcaugggauuuuggcagcguaggaggcgugcuaaacagucuagguaaaaugguccaucaaauauucgggagugcguauacugcauuauucagcggaguuucuugggucaugaaaaucgguauaggagugcucuuaacuuggauaggacuaaauucgaagaauaccucaaugucuuucaguuguauugcgauagggauaauuacguuauaucugggagcugugguucaggcagauaugggaugcguuauaaacuggaaagguaaagaauuaaaaugcggcucggguauauuuguaacaaaugaaguucacacauggacagagcaauacaaauuucaagcugauagcccgaaaagacuugcaacagcgauugcgggcgcgugggaaaauggggucuguggcauccggagcacuacccgcauggagaacuugcuauggaaacaaaucgcuaacgaacucaacuauauucuaugggagaauaacauaaaacuaacugugguagugggagacauuauaggagugcuugaacaagggaaaaggaccuuaaccccacaaccaauggaauuaaaauacucauggaaaacguggggaaaagcaaaaauuguaacggcugaaacacaaaauucaucauuuauaaucgauggaccaaacacaccugaaugcccuucugccaguagagccuggaaugucugggagguugaagacuauggguucggaguauuuacgacaaauauaugguugaaacuccgugagguauacacacagcuuugugaucaucguuuaaugucagccgccguaaaggaugagagagcaguucaugcggacaugggauacuggauagagagccagaaaaauggcaguuggaaguuagaaaaagcuagucugaucgaaguaaaaacaugcacauggccuaaaagccacacgcuaugguccaauggaguccuugaaagcgacaugauaauuccaaagagccucgccggaccaauuagucaacacaacuaucgaccuggauaccacacgcaaaccgcggguccguggcaucucgguaaguuggaacuagacuucaauuacugugagggaacgacagucguaauaacagagaauugcgggacaagaggaccaucccugagaacaacaacgguuuccggcaaacucauacacgagugguguugccgaagcuguacacugccaccauuacgguauaugggggaggacgguuguugguaugguauggaaauaaggccaaucucggaaaaagaagagaauaugguuaagucucuaguaagcgccgggucuggaaagguggacaacuucaccaugggcguauuaugucuagccauauuauucgaagaaguaaugagggguaaauucggcaagaaacauaugauagccgggguauuuuucacuuucguacuacuguuaagcgggcaaauaacauggagagauauggcucauacauugauaaugauaggcucaaaugcgucugacaggauggguauggguguaacauaucuagccuuaauagcaacauucaaaauucagccauuccuugccuuaggguucuuucuaagaaaacuuacaaguagagaaaauuuacugcuggguguuggccuggcaauggccacaacccuucaacucccggaagauauugagcagauggcuaacggaauagcauuaggucuaauggcguuaaaauugauuacgcaauucgaaacuuaccaauuauggaccgcucuaauaucacuaacauguucaaauacaauauuuacauuaacuguagccuggaggacagcgacguuaauacuggcgggcguuucuuuacuuccagucugccaaagcucuagcaugagaaaaacggacuggcuaccaaugaccguagcagccauggguguaccuccacucccuuuauuuauauuuucacuaaaagacacacucaaaagacggucauggccacuaaacgaaggagucauggcuguuggucuagucaguauccucgcauccagucuccucagaaacgauguaccuauggcggguccacucguagcaggaggauuauugaucgcaugcuaugucaucacagguacgagugccgaccucacaguagaaaaagcagccgaugucacgugggaagaggaagcugagcaaaccggaguaucacauaaucuaaugauaacgguagaugacgauggcacaaugcguauaaaagacgaugaaaccgaaaacauucuaacagugcuacuaaaaacagcguuauugauaguaucagguauauuuccuuacucaauaccagcaaccuuauugguuuggcacaccuggcaaaaacaaacgcaacggucaggcguuuuaugggaugugcccucgcccccagaaacacaaaaagcagaguuagaagaagguguguaucggauaaaacaacagggaauauuuggcaaaacucaaguagguguagguguccagaaggaagguguauuucacacuauguggcacguaacaagaggugcaguucuaaccuacaauggaaagagguuggaaccgaauugggcauccgugaagaaagacuugaucucauauggcggaggauggagguuaagugcucaauggcagaaaggggaagaagugcaagugaucgcgguggaaccagguaaaaauccuaaaaauuuccagaccaugcccgggacuuuccaaacgaccaccggggaaauuggagcuaucgcccuagacuucaaaccgggcacaucuggcagcccuauaaucaacagagaaggcaaaguggugggccuguacggaaauggaguagugacgaaaaauggaggauauguuucgggaauagcgcagacuaaugcagaacccgauggacccacuccugagcuugaggaagaaauguuuaagaagcgaaaucugacuaucauggaucuccauccuggaucuggcaaaacuagaaaauauuugccggcgaucguuagggaagccauaaaaaggagacuaagaacguugauucuugccccaacuagggucgucgcagccgaaauggaggaagcauuaaaaggucuaccgaucagguaccaaacuaccgcaaccaaaucagaacacaccggccgagagauaguagaucuaaugugucacgcaacauuuacuaugcguuuauuaaguccuguucggguuccaaacuauaauuugauaaucauggaugaggcucauuucacugacccggcauccauugcagcgcgaggauacauuucaacgaggguggguaugggcgaagccgcagcaauauucaugacagcuacgccaccaggaacggcugaugcauucccccagucuaacgcaccuauacaagacgaagaaagagauauaccagaacgcuccuggaacucggguaaugaauggauuacagauuuugcggguaaaacaguaugguucgucccgucaauuaaagcgggcaaugacauugccaacugcuugagaaagaacgguaagaaaguaauucaacuuaguaggaaaacauuugauacagaguaucaaaagacaaaguuaaacgauugggacuuuguagucaccacagauauaagcgaaaugggugcaaacuucaaagcugaucggguuauugacccgaggcgaugccuaaaaccuguuauacuaaccgacggaccggagcgaguaauauuggcgggcccaaugccgguaacugcagccucagcagcucagcgaagagggagaguuggaagaaauccccaaaaagagaaugaucaauacaucuucacgggacaaccauuaaauaacgacgaagaccaugcucauuggacagaagcaaaaaugcuucuugacaauauaaacacgccugaaggcauaaucccugcuuuauuugaaccugaaagagagaaaucugcugcaaucgauggagaauauaggcugaaaggugaaucaaggaaaacguuuguagaguuaaugagaagaggagauuuaccugugugguuagcacauaaaguagcuagugagggaauaaaauacacagacagaaaaugguguuuugacggucaaagaaacaaccaaauauuagaagaaaauauggauguagaaauuuggacgaaggaaggagagaagaagaaauuacgaccuagaugguuagaugcuagaacuuauuccgauccucuugcauuaaaagaauuuaaggauuucgcagcugguaggaaaucaauagcauuagaucuaguuacugagauuggaagggugccgacacaucuagcgcauagaacucgaaacgcucuagacaacuugguuauguugcauacuucggagcacggaggaaaagcauacagacacgccguggaagaacugccggaaacgauggagacauuacugcuacugggauugaugauuuuauuaacagggggagcaaugcucuuuuuaauaucaggcaaagggauuggaaagaccucaaucggacuuauauguguaauagcaucgucugguaugcuauggauggcggaaauuccccugcaauggauugcguccgcaauagucuuagaguucuuuaugaugguccuucucauuccagaaccagaaaaacaaaggaccccacaggauaaucaguuagcauacgucguaaucgggauacuaacgcuggcagccauuaucgcagcaaacgagauggggcuauuagaaaccacuaagcgagauuuagggaugagcaaagagccagggguuguaucaccaaccaguuaucuagacguagaucuccauccugcaucugcauggacccuauacgcaguagcaacaacaguaauaaccccgaugcuacgacauacaaucgaaaacagcacggcaaaugugagccuagcugcaauugcaaaucaggcaguaguucucaugggucuagacaagggguggcccaucucaaaaauggaccucggugugccauuauuagcacucggcuguuauucacaaguaaacccuuugacccuaacugcagcuguauuacuauugauuacacauuaugcuauuaucggacccggauugcaagcuaaagcaacgagggaggcucagaaaagaaccgcugcgggcauuaugaaaaauccaacaguagacgguaucaugaccauugaucuagaucccguaauuuacgauagcaaguuugaaaaacaacuaggacaaguaauguuacucguucugugugcaguacagcuccuccuuaugaggacaucaugggcauuaugugaggcgcuaacacuugccacugggccaauaacuacacucugggaaggcucaccugguaaguuuuggaacacaaccaucgcaguguccauggcuaauauauuuagaggaagcuaccuagcgggagcagggcuugcauuuucgauuaugaagucaguuggcacaggaaagcgagguacugguagucagggcgaaacacuuggcgagaaauggaaaaugaaauuaaaucaauuaaguagaaaagaauuugaccuauacaagaaaucaggcauaaccgaggucgaccgcacugaagccaaagaaggacuuaaaagaggagaaauaacucaucaugccguaagucgaggaucugcuaaacuccaaugguuugucgaacgaaauaugguaauucccgaaggaagggugauagaucuagggugugguagagguggguggaguuacuauugugcugggcugaagaagguuacagaaguaaggggcuauacuaagggagggccaggacaugaggaaccggucccgaugucuaccuaugguuggaauauuguuaaauuaaugucaggcaaggaugucuuuuauuuaccuccugaaaaaugcgauacauuauugugugacauuggugaaaguucaccaucuccaacaguagaggaaagccgcacuaucagagugcuaaaaaugguagaaccuuggcuuaaaaacaaucaauucuguauuaaaguccuuaacccguacaugccaacuguuauagaacaucuagaaagauuacagcgaaaacaugggggcauguuggugcgaaaucccuuaucgagaaacucaacucaugaaauguacuggauuucaaauggcacaggcaacauaguagcuucaguaaacaugguaucacguuuguuacuaaaucguuucacaaugacacaccgaagacccacaauagaaaaggauguugaucuaggagcuggaacgcgucaugucaacgcggagcccgaaacaccgaauauggaugugauaggagagcgcauuaaaaggauuaaagaagaacauaauucaacauggcauuaugacgacgaaaacccguacaaaaccugggcauaucacgggucguacgaaguuaaagccacaggaucagcgaguuccaugauaaacgggguagucaaacuauuaacuaagccgugggauguaguaccaaugguuacacaaauggcgaugacagauacuacuccauuuggacagcaacgcguauucaaagaaaaagucgauacaaggacgccaaggaguaugcccggaacucguagggucaugggaauuacugccgaaugguuauggagaaccuuaggccguaauaagaaaccaagguuauguacccgcgaagaauuuacuaagaaaguucggacuaacgcagcaaugggagccguauuuaccgaagaaaaucaaugggauagugccaaggccgcagucgaagacgaagauuuuuggaagcuaguagacagagaacgugaauuacacaaauuaggaaaaugcgguagcuguguuuauaauaugauggguaaacgggagaagaaauuaggagaauuugggaaagcaaaaggcucgcgcgcuauaugguauauguggcuuggcgcaagauaccucgaguucgaagcucuuggauuuuuaaaugaagaucauugguuuaguagagaaaacucauauagcggaguugaaggagagggccuacacaaauuaggauacauauuaagagacauaucaaaaauacccgggggagcaauguacgcagacgauaccgcgggaugggauacgcguauaacugaggaugacuuacauaacgaagagaagauaacccaacagauggauccagaacaucgucaacuggcaaacgcaauauucaaguuaacguaucagaacaaggugguuaaaguucaacggccgacucccacugguaccguuauggauauaauaagucgaaaagaccaaagaggaaguggccaaguugguaccuaugguuuaaauacuuuuacgaauauggaagcucaauugauaaggcagauggaaggggagggaguacucaguaaagcagauuuagagaauccacaucuaccagaaaagaaaauaacccaauggcuggaaaccaagggcguugaaaggcuuaaacgcauggcuauaaguggcgaugauugcgucgucaaaccaauugacgauagauucgcaaaugcauuauuagcacuuaacgacauggggaaagugagaaaagacauuccucaguggcaaccauccaaagguuggcaugacuggcaacaaguuccauuuuguucacaccauuuucaugaacuaauuaugaaggauggucggaaacuuguugucccuuguagaccacaagaugaguugaucggcagagcaaggauuagccaaggggcaggcuggucauuaagagagacugcauguuuagguaaggcuuaugcacaaauguggagucucauguauuuccauagaagagaucucagacuugcuucaaaugcaaucugcucagcaguaccuguacacuggguuccuacaucucgaacuacauggucuauacacgcgcaccaucaauggaugacaaccgaggacaugcuuacgguauggaaccguguauggaucgaagacaacccguggauggaagauaaaacuccugugacaacaugggaaaacguacccuaccugggaaaacgagaggaccagugguguggaucgcuuauuggccuaacaucaagggcaacuugggcccaaaauauccccacggcaauacagcaagugagaucuuuaauuggaaacgaagaguucuuagauuauaugccuaguaugaagagauuuaggaaagaggaagaacuagaaggugcaaucugguaa

SEQ ID NO: 23079 - RNA, 9873 nt, Artificial Sequence
  derived and/or modified CDS sequence (opt6) from DENV-3__FJ898444__SS-prME
accucauuguguuuaaugaugauccuacccgcagcacuagcuuuucaccuuacaagccgagauggagaaccaaggaugauuguagguaaaaacgaaaggggaaagagcuuauuauuuaaaaccgcguccgguauuaacaugugcacauuaauugcaauggaucuuggugaaaugugcgacgauacuguaaccuacaaauguccacacauaacggaaguugagccagaagauauagauugcuggugcaacuuaacaucaacuugggucacguauggaacauguaaucaagcuggagaacauaggcgagauaaaagauccguagcacuugcaccgcauguuggaaugggauuagacacgaggacccaaacauggauguccgcagaaggcgcguggagacaagucgaaaaagucgaaacaugggcuuugcgacaccccgguuucacgauuuuagcucuguuuuuggcucauuauauaggaacaaguuuaacacaaaaaguaguaauauucauccuauuaaugcuagugacaccauccaugaccaugagguguguagggguagguaacagagacuuuguggaggggcuaaguggggcaacuuggguugacguagugcuagaacauggcgggugugucacaacaauggcuaaaaacaaacccacacuagauauagaacuacagaaaacugaagcaacucaacuagcaacacucagaaaauugugcauugaaggcaaaauuacgaauauaaccacugauaguagaugucccacacaaggggaggcaguucucccugaagaacaagaucaaaacuauguauguaaacacacguauguugaccggggguggggaaauggauguggauuauucggcaaaggcucucuaguaacuugcgcaaaauuucaaugcuuagaaccaauagaggggaaaguuguacaauaugaaaaccuaaaauauaccguaauaauaacgguccauacaggagaccaacaucaaguaggcaacgaaacgcaaggaguaacggcugaaauuacaccccaagcaucuacaaccgaagcuauccuacccgaauaugguacacuaggauuagaaugcucuccgcgaacaggguuagacuuuaacgagaugauccuacuaacaaugaaaaauaaagcauggaugguacauagacaaugguucuuugacuugccauuaccauggacaucuggugcgacaaccgaaacacccacauggaauaggaaagaauuacuuguaacauuuaaaaacgcucacgcuaagaaacaagaggugguagugcuagguucccaagagggagcuaugcacacagcacucacuggagcaacggagauacaaaacucaggcggaacaucaauauucgcaggccauuugaaaugccgccuuaaaauggauaaacuugaacuaaaagguaugagcuaugcgaugugcaccaacacauucguacucaagaaagaaguauccgagacacaacaugguacaauacuuauuaaaguugaauauaaaggcgaagaugccccauguaaaauuccguucagcacggaggaugaacaaggcaaagcacauaauggaagguugaucacugcuaacccaguuguaacuaagaaagaagaaccgguaaacauagaggcagagccgcccuuuggugaaagcaauauaguaauugguauaggagauaacgcuuugaaaauaaacugguauaagaaaggaucaucaaucggaaaaauguuugaggcuacagcucgaggugcuagacgaauggcaauauugggggacacagccugggauuuugguagcgugggagggguauuaaauuccuuagguaaaaugguccaucagauauucggcuccgcauauaccgcacuguuuucggguguaagcuggguaaugaaaauaggaaucggaguuuuauuaacauggauuggauuaaacaguaaaaauacaaguaugagcuucucauguauugcgauagggauaauuacguuguauuuaggcgcgguaguacaagcagauauggguugugucguuaacuggaaaggaaaagaacuaaaaugugguucagguauauucgucacgaaugagguucauacauggacugaacaguacaaauuucaagcagacucuccuaaaagauuggcaacugcgauugcgggugccugggaaaauggaguaugcgguauaagaucuacgaccagaauggaaaaccuucuguggaaacagauagcuaacgaauugaauuacauacuaugggaaaauaauauaaaacuaaccguuguaguaggugauauaauagguguacucgaacaaggaaaaagaacccuaacaccgcaaccuauggaacuaaaauauagcuggaaaacuuggggcaaagcuaaaaucguuacugcagaaacgcaaaacucgaguuuuaucauugacggcccaaauacgccagaauguccaagugcuagccgagcuuggaacguuugggaaguggaggauuaugguuuugguguauuuacgacaaacaucuggcuaaaacugagagaagucuauacacaauuaugugaucaccgacuuaugucugcugcagugaaagaugaaagagcaguucacgcggauaugggauauuggauagagucucagaaaaaugguaguuggaaauuagaaaaagccucauugauugaagugaaaacauguaccuggccaaaaucccauacacuauggucaaauggcguguuagaaucggauaugauuauacccaaaucauuggcggguccuauaucgcaacauaacuaucggccgggguaccauacacaaaccgcaggcccauggcaucucgggaaauuagaauuggauuucaacuauugugaagggacuacugugguaauaacagagaacugugguaccagaggaccgagcuugcguacaacuacugucucagguaaauuaauucacgaauggugcugucgcucuuguacacuaccuccuuuaagguauaugggugaagacgggugcugguacggcauggaaauacgccccauaagugaaaaagaagaaaauaugguaaaaucucuggucucagcugguaguggagaaguggauaacuuuacgaugggaguacuauguuuagcaauacuguuugaagagguaaugagaggcaaauucggcaagaaacacaugauugccgguguauucuuuacuuucgugcuauuauugucagggcaaauuacguggcgggacauggcacacacauuaauaaugauaggaagcaacgcaucagauagaaugggcaugggaguaacguaucucgcauuaauagcaacguuuaaaauucaacccuuucuagcgcuaggauucuuccuaagaaaacuaacaagucgggaaaaccuacuucugggaguaggacuggccauggcaacuacgcuacaacucccggaagacauagagcagauggcaaauggaaucgcgcuggggcuuauggcacuaaaacuuauuacgcaguucgaaacuuaucaacucuggaccgcguugauaucauuaacguguagcaauacaauauucacucucacugucgccuggagaacugcaacucuaauauuagccgguguuucauugcucccuguaugucaaucaaguagcaugcgcaagacugauuggcuaccaaugaccguagcggcaaugggagugccaccauuaccgcucuuuauauuuuccuuaaaagauacacucaaaagacgcaguuggcccuugaacgaaggaguaauggccgucggcuuaguaucgauccuggcuucuucgcuacucagaaaugauguuccaauggcgggcccgcucguggcuggagguuuauuaauugccugcuauguuauaacggguacaagugcagauuugaccguagagaaagcugcagauguaacuugggaagaagaagcugaacaaaccgggguuagccacaaucuaaugauuacaguagaugaugauggaacaaugagaauuaaggaugaugagaccgaaaacauuuuaacuguccuuuuaaaaacagcacuauuaauagugucggguauuuuuccguauagcauccccgcaacguuguuaguauggcacaccuggcaaaagcaaacccaaaggaguggaguguuaugggaugucccaagcccaccugaaacgcaaaaagcagaacucgaagaagguguuuaucgaauaaaacagcagggaaucuuuggaaaaacacaaguuggaguagggguccaaaaagaaggggucuuccauacuauguggcauguaacgcgaggagcaguacugaccuauaacggcaagcgauuggagccuaauugggcaaguguuaagaaagaccuuauuucauacgggggagguuggaggcuaagcgcacaguggcaaaagggggaagaagugcaaguaauagcuguagaaccaggcaaaaaucccaaaaacuuccagacaaugccaggcacauuucaaaccaccacaggggaaauaggugcaauagcucuagauuucaaaccugggacuucaggcucaccgauaaucaacagggaagguaagguugucggucuauacggaaacggaguugugacuaaaaacgggggauacgucucgggaauagcucaaacaaacgccgaaccagaugguccgacaccugagcuagaggaagaaauguuuaagaagaggaaccucaccauuauggauuugcacccugggaguggcaagacuagaaaauaccuuccagcaauaguuagggaagcaauuaaaagaagacucagaacuuuaauccuugcacccacacggguuguggcggcagaaauggaagaagcucuuaaggguuuaccuauacgguaucaaacuacagcaacaaaaucugagcacacugggcgcgagauugucgaccuaaugugucaugcuaccuuuacuaugaggcuauuaaguccaguuagagucccaaacuauaaucucauuauuauggaugaagcacauuuuacagaccccgccagcauugccgcaagaggcuauaucucaaccagaguagggaugggagaggcugcggcaauuuuuaugacggcgacacccccaggaacagcugaugcauuuccacaaagcaacgccccaauacaagaugaagaacgagauaucccggaaagauccuggaauagugguaaugaauggaucacagacuuugcaggaaaaacaguaugguuuguaccaucgauaaaagccgggaaugauauagccaauugcuuacguaaaaacggcaaaaagguuauacaacuguccagaaagacuuuugauacagaguaucaaaagacuaaguuaaaugauugggacuuuguagucacaacugauaucagugaaaugggugcaaauuuuaaagcggaccguguuauugauccccguagaugucuaaaaccagucauacuaacagauggcccugaaaggguuauauuagcagggccuaugccaguuacagccgcguccgccgcacagaggagaggcagaguuggaagaaacccgcaaaaagaaaaugaccaauauauuuucacgggucagccuuuaaauaaugacgaagaccaugcacauuggacggaagccaagaugcuguuggacaacauaaacacuccugagggaauaauuccggcucuauuugaaccagaaagggagaaaagcgcagcuauugacggagaguacaggcuaaaaggagaaucccgcaaaacauuuguugagcugaugcguagaggggauuuaccuguauggcuggcauacaaaguagcaucugagggaauaaaguauacagacagaaaaugguguuucgacgggcaacgaaacaaucagaucuuagaggagaauauggacguggaaauuuggaccaaggaaggugagaagaagaaauuacgcccaagauggcucgacgccagaaccuauucugacccauuagcacucaaagaguuuaaagauuuugcugcuggcagaaaauccauagccuuggaucuaguuacugaaauaggcagaguacccacgcacuuagcccaccgaacgcgaaacgcuuuagauaauuuaguuauguugcauacaagugaacaugguggcaaagcauaccgccacgcaguagaagaauugcccgaaacgauggaaacguugcuacuuuugggucuaaugauccuacuaacuggaggagcuauguuauuucucauaucugggaaaggaauugggaaaaccucuauuggcuuaauauguguuaucgcgaguagcggaaugcuauggauggcugagauaccucuacaauggauugcgagugcaauaguucuugaauuuuucaugaugguacuauuaaucccagaaccagaaaaacaaagaacaccacaagauaaccagcuugccuaugucguaauuggaaucuugacgcuagcagcgauaauagcugcaaacgaaaugggccuauuagaaaccaccaaacgggauuuaggaauguccagagaacccggcgucguaucuccaacaucguaccuugacgucgaucuucacccugcaucagcguggacuuuguaugcugucgcuacaacagugauaacuccaaugcuacggcauacaauugaaaacaguacagccaacgucuccuuggcugcuauugcgaaccaagcgguuguauugaugggacuugacaagggauggccaauaucgaaaauggaucuaggcguaccccuuuuagcucuagguuguuauagucaaguuaauccacuaacauuaaccgcagcuguacuucuucucauaacccacuaugcuaucauuggcccaggccuucaagcaaaggcgacacgugaagcacagaaaagaacugcugcagguauaaugaagaauccaacugucgauggaauuaugacaauugauuuagacccuguaauauacgacucaaaguuugagaaacaauuaggccagguuauguuacuuguauuaugcgcaguacaguuguuacugaugcgcacgucgugggcacuaugcgaggcacuaacgcucgcgaccggaccaauuacaacguuaugggaaggaucaccugguaaauuuuggaacacaacaauugcuguuucaauggcaaacauuuuuagggggucauauuuagccggugcaggauuagcguuuaguauaaugaaaucaguuggcacaggaaaaagaggcacgggaagucagggagaaacacuuggggaaaaguggaagaagaaacuaaaccagcuaucucgaaaggaauuugauuuauauaagaagucagguauuacagaaguagaccguaccgaagcaaaagaaggauugaagaaaggugaaaucacucaccacgcaguaagucguggcucagcaaaacuccaaugguuuguagagagaaacaugguaauaccggagggacgagucauugauuuagguugcggccgaggaggcuggucguauuauugugcagguuugaagaaagugacagaaguccgagguuacacuaaaggaggaccaggacacgaggaaccaguaccgaugucuacguaugguuggaacauaguaaaguugauguccgguaaagauguguuuuaucuuccgcccgaaaaaugugauaccuuguuaugugauauuggagaauccagucccucaccgacaguugaagaaagcaggacgauucguguccuaaaaauggucgagccauggcucaaaaacaaccaauuuuguauuaaaguucuaaauccuuacaugcccacagugauagaacacuuagaacgauuacaaaggaagcauggaggcaugcuuguaagaaauccacugagccgaaacucaacccaugaaauguacuggauuucuaaugggacaggaaauauaguagcgaguguaaacaugguaucgcggcuacuuuugaauagauuuacuaugacucauaggagacccacuauagaaaaagaugucgaccucggagcaggaacuaggcacguaaacgcagagccugaaacacccaacauggaugugaucggggaaaggauaaagaggauaaaagaggaacacaacucaacguggcauuacgacgaugaaaauccauauaagacuugggcauaucaugguucguaugagguaaaagcuaccgggucggcgucaaguaugauaaauggagucgugaaauuauuaaccaaaccuugggacguaguuccgaugguuacucaaauggcaaugaccgauacaacaccguuuggacaacaaagaguauuuaaggaaaaaguagauacacggacuccaaggccaaugccaggcacucgcaggguaaugggaauaaccgcagaauggcuauggagaacauuaggucgaaauaaaaagccaagacuuugcacaagagaagaauuuaccaagaaggucaggaccaaugcagccaugggggcgguuuucacugaagaaaaucaaugggacuccgcaaaggcggcuguugaagaugaggauuuuuggaaacugguagauagagagagagaauuacauaaacuugguaagugugguucaugcgucuacaauaugaugggaaaacgugagaagaaauuaggagaauuuggaaaagcaaaaggaucacgugcuauuugguacauguggcugggggcacgauauuuagaguuugaggcccuaggauuucuaaaugaggaucauugguucaguagggaaaacucuuauucagggguugaaggagaaggccugcacaaauuaggcuauauauuaagagacauaaguaaaauaccggguggugcgauguaugcagaugacacugcagguugggauacccggauaacagaagacgaccuucauaaugaggagaaaauuacucaacaaauggauccagaacaucgccaauuagccaacgcaauauuuaaauugacauaccaaaauaaagugguuaaaguccaaagacccacacccacgggcacaguuauggauaucauaucccggaaggaccaaagagggucuggacaagugggaacuuacggauuaaacacauucacaaauauggaggcacaguuaauacgacaaauggaaggugagggcguacuaagcaaagcugaccuagaaaauccacacuuacccgagaagaaaauaacccaaugguuagaaacuaaaggaguggaaaggcuuaaaagaauggcuauuucuggugaugacuguguaguuaaacccauagacgauagguuugcaaaugcacuauuggcucuaaaugauaugggaaagguucggaaagauauuccacaauggcaaccguccaaagguuggcacgacuggcagcagguaccuuuuuguucucaucauuuucacgaacucauaaugaaagacggaagaaagcuaguaguuccuugucgaccgcaggaugaauuaauagggagagcuagaauaucacagggcgcaggauggagccugagagaaacugcauguuuagguaaagccuacgcccagauguggucccuuauguacuuccacagacgugauuuaagauuagcaaguaacgcaauauguucugcaguaccaguacauuggguccccacauccagaacgaccuggucuauacaugcacaccaccaguggaugaccacagaggauauguuaacaguauggaauagaguauggaucgaggauaaucccuggauggaagauaagacaccuguaacgacuugggagaacgugccauaccucggaaaacgugaagaucaauggugugguucacuuauuggacugaccaguagagcaacuugggcacagaauauaccuacugccauacagcaaguccggucuuuaaucggaaaugaagaguucuuagauuacaugccuucaaugaaaagauuuaggaaagaggaagaaucagagggagcgauuugguag

SEQ ID NO: 23080 - RNA, 9873 nt, Artificial Sequence
  derived and/or modified CDS sequence (opt6) from DENV-3__FJ898445__SS-prME
acgagucuauguuuaaugaugauccuaccagcagcauuagccuuucaucucacuuccagggauggugagccuagaaugauaguagguaaaaacgaacgaggaaaaucguuacuauuuaaaacugcuucaggaauaaacauguguacacuaauugcaauggaccuaggggaaaugugugaugauacagucacguauaaaugcccacauaucacugaaguugaaccugaagauauagacuguuggugcaauuuaacaagcacguggguuacguacggaacaugcaaccaagcaggcgaacaucggcgugauaaaagaucagucgcacuggcgccgcacguaggaauggguuuagauacuaggacacaaacauggauguccgccgaaggggcauggagacaaguagaaaaaguagaaacaugggcccuaagacauccaggauuuacuauucuugcacuauuuuuagcgcauuauaucgggaccucacuuacucaaaaagcgguaaucuucacacuacuaauguuaguaaccccuucaaugacuaugagguguguggggguaggaaacagagauuucgucgaaggacuaucaggagcuacauggguagaugucguacucgaacacggcgguuguguaacuacgauggcgaaaaauaaaccuacgcuggacaucgaguuacagaaaacagaggcuacacaauuagcuacacuuaggaaauugugcaucgaagguaaaauuacuaauauaacaaccgacuccagauguccgacacaaggagaggcgguauuacccgaggaacaagaucaaaacuacguuuguaaacacacuuacgucgaucgagguuggggaaauggauguggccuguuuggaaaaggaagccucguaacgugcgcaaaauuucaaugccucgaaccaauugaagguaaaguaguacaguaugaaaauuugaaauauacgguaauuaucaccgugcacacaggugaucagcaccaagugggaaaugaaacgcagggaguuaccgcugaaauuacgccacaagcuaguacaacagaagcaauucucccugaauaugguacgcugggcuuagaaugcucaccuaggacuggucuagauuucaaugagaugauacuccuuaccaugaaaaacaaagccuggaugguacauagacaaugguucuuugauuugccgcuaccauggacaagcggagcuacuaccgaaacaccaaccuggaaucgaaaagaguuauugguaacauuuaaaaaugcucaugcgaagaaacaagaagucguaguuuuaggaucacaggagggugcgaugcacacugcucugaccggagcaacugaaauucaaaacagugggggaacaucaauauucgcaggccaccuuaaaugccgccuuaaaauggauaaacucgaauuaaaaggcaugucauacgcaaugugcacuaacacuuuuguuuugaagaaagaaguaucugaaacacaacaugggacaauacuuauuaaaguagaguacaaaggagaagacguacccugcaaaaucccauuuagcacagaagauggacaagggaaagcacacaauggacgacuaauaacugcaaacccugucguuacaaaacgagaagaacccguuaacauugaggcugagcccccguucggagaaucaaauauaguuaucggaauuggagauaaugcguuaaaaaucaauugguauaagaaaggcucaaguauaggaaaaauguucgaagcgacagccaggggugcacgucgaauggcaauacuaggugacacggcaugggacuuuggcagcguaggaggagugcucaauucguugggaaaaauggugcaccaaauauucggcagcgcuuauaccgcccucuucucuggagugaguugggucaugaaaauagguauagggguucuuuuaacauggauagggcuaaacuccaaaaauacaucaaugucauuuagcuguauagcaaucgguaucauaacccuguacuuaggugcuguaguacaggcugauaugggauguguuauaaauuggaaagguaaagaacuaaaaugcgggucagguauauuugucacaaaugagguccacacguggaccgagcaauacaaauuccaagcugauagcccaaaaagauuggcuaccgcuauagcaggagcuugggaaaauggaguuugcgggauucguaguaccacucggauggaaaacuugcuguggaaacaaauagccaacgagcucaauuacauacuaugggaaaauaacaucaaauuaacagucgugguaggagacauuauaggaguacucgaacaaggaaaaaggacuuuaacaccacaaccuauggaauuaaaauacucuuggaaaacauggggaaaagccaagauuguaacagcagaaacacaaaauucuaguuucauaauagacgguccuaacaccccagagugucccagcgccucgcgcgcuuggaaugugugggagguagaagauuauggguucggaguuuuuacgacuaauauauggcuuaaauuacgggagguauacacucaacuaugugaucacagguuaaugagcgcagcgguaaaagaugaaagagcaguacaugcggacaugggauauuggauggaaucacagaaaaauggcucuuggaaacuugaaaaagccucacuaauagagguaaaaacauguacauggccgaaaagucauacuuuauggucaaauggaguauuagaaucugauaugaucauaccaaaaaguuuggccggaccgaucagucaacauaauuauaggccgggauaucauacgcagacugcaggaccauggcaucuaggaaaacuggaacuggauuuuaauuauugugaaggaaccacaguuguaauaacugaaaacugcggcacuagaggaccgucauuaagaaccaccacgguuucaggaaaacuaauacacgaauggugcuguagaaguugcacucuuccgccucuacgauauaugggagaagauggcuguugguaugggauggaaauccguccuauuagcgaaaaagaagaaaauaugguaaagagcuuaguaucagcgggcuccggcgaagucgauaauuuuacuaugggcguacucuguuuagccauacucuuugaagaggucaugagggggaaauuugggaagaagcauaugauagccggagucuuuuucacuuuuguauugcuauuaagcggccagauaacguggcgugauauggcacacacacucauaaugauagggaguaacgcuagcgacagaaugggcaugggaguaacuuaucuggcgcuaaucgccacauuuaaaauucaaccauuucucgcguuaggguucuuucuuagaaaauugacaucuagagaaaacuuacuauuaggaguuggacuagcaauggccacgacucuacaauuaccggaagauauagagcagauggcgaaugguauagcucucggguuaauggccuuaaaauuaaucacacaauucgagaccuaucaacuauggacagcgcuuaucucacuuacaugcucuaacacaaucuuuacacugacuguagcuuggagaacagcaacuuuaauccuagcgggugucuccuuauuaccggugugccaaaguucaagcaugagaaaaaccgacugguugccuaugacuguggcggcaaugggcguaccaccucuaccacuuuucaucuuuagucuaaaagauacauuaaaacguagaucuuggccauuaaacgaggguguuauggccguugggcuaguaucaauacuugcuaguagccuucuaagaaaugauguaccgauggccggacccuuaguagcaggcggccuauuaauagccuguuauguaauaacaggaacgagugcagauuuaaccguugaaaaagcagcagacguaacaugggaagaggaggcagaacaaacuggaguuucacauaaucucaugauaacaguagaugaugauggaacaaugcguauuaaagaugaugaaaccgagaauauuuuaacagugcuccuaaaaaccgcccuccuuauuguaucaggcaucuuuccuuacucaauaccggcaacucuacuuguuuggcauacauggcaaaaacaaacacaacgaucgggaguccugugggauguaccaaguccuccggaaacccaaaaagccgaauuggaagaaggaguuuaccguauuaagcaacaaggaauauuugguaaaacucaagugggaguagguguacagaaagaaggcguuuuccauacaauguggcauguuacuaggggagcugugcugacauauaauggcaaacgacuggaaccaaauugggcuagcguuaagaaagauuuaauuagcuauggugggggauggagacucucggcgcaguggcaaaaaggcgaagaaguacagguuauagcaguugaaccaggcaaaaaucccaaaaauuuucagacaaugccagguacauuucaaacuaccacuggcgaaauuggagcaaucgcauuagauuuuaaaccagggacaagcgggagucccauaauaaauagggaagggaaagucguaggacuuuacgguaacggcguugucaccaaaaacgguggauauguaucugguauagcgcagacaaaugcagaacccgacgguccaacgccagaacuagaagaagaaauguuuaagaaaagaaaccucaccauaauggauuugcauccuggaucuggaaagacccgaaaauauuugccugccauagugcgagaggcgaucaaaagaaggcugagaacuuugauuuuagcuccaacaagaguaguugcugcugaaauggaggaagcauugaaaggacuaccuauacgauaucagacaaccgccacaaagagcgaacauacuggacgugaaauuguagaucuaaugugccacgcuacauuuacuaugcgauuauugucaccuguacgaguaccuaauuauaaccuaauaauuauggaugaagcacauuucaccgaucccgcaaguauugccgcgaggggauacaucuccacacgcgucggcaugggagaagcagcugccaucuucaugacggcaacaccacccgguacugcggacgcguuuccacaaucuaaugcgcccauacaggaugaagaaagagauauacccgaaagaucuuggaacucugggaaugaguggauaacagacuucgcuggcaaaacagucugguuugucccaucgauaaaagccggaaacgacauagcuaauugucugaggaaaaaugguaagaaaguuauacaguuaaguagaaaaacguuugauacggaauaucagaaaacaaaacuuaaugauugggauuuuguugucacuacugauauuagugagaugggugccaacuucaaagcugaccguguuauugacccacgcagaugucuaaagccuguuauauuaacugauggcccugaacgaguuauucuagcaggaccgaugccugucacggcggcaucagcugcucaacgccgugguagggucggaaggaacccacaaaaagaaaacgaucaauacaucuuuaccggccaaccccucaauaaugacgaagaucacgcacauuggaccgaagccaaaaugcuacuagacaauauaaacacgccugaaggaauuauuccugcucuguucgaaccagagagagaaaaaucggcagccauugacggagaguaucgguugaaaggugaaagcagaaagaccuuuguagaacucaugcgacgaggugauuugccagugugguuggcauauaaaguagccucagaggguauaaaauauacugauaggaaaugguguuuugauggacaacgaaacaaccaaauacuagaagagaauauggaugucgaaauauggacuaaagaaggcgagaagaagaaacuacguccucgcuggcuugaugcccggacauauagugauccauuggcguugaaagaauuuaaagacuucgcggcaggucguaaauccauagcccuggauuuagugacggagauagggagaguuccaacccacuuagcucaccguacuagaaaugcacuagauaaccuaguaaugcuucacacaagugaacauggaggaaaggcauacagacacgcuguagaggaauugccagaaacaauggaaacuuuacuuuuacuagggcuuaugaucuuacucacgggaggggcaaugcuguuccuaauuucgggaaaagguauuggaaaaacauccauugguuuaauaugcgucauagcuucuagcggcaugcuauggauggcggagauuccacugcaauggauagcaucugccauaguccuagaguucuuuaugaugguucuauugauacccgaaccagaaaaacaacguacaccucaagauaaccagcuggccuauguaguaauagggauauuaacucucgcggcuauuauugcugcgaacgagauggguaugcuagagaccacuaaacgugauuuggguaugucgaaagagccagggguugcgaguccgacauccuaucucgaugucgaccuacacccugcaucggcuuggaccuuauaugccguggcaaccacggucauaaccccaauguugaggcauaccauagagaacagcaccgccaacguaagccucgcugcuauagcaaaucaagcuguaguccucaugggacuagauaaaggauggcccauaucaaagauggacuuggggguaccuuuauuggcucucggauguuauucccaagugaacccauuaacgcugacugcagccguuuuacucuuaauaacucacuacgcaauaauaggaccuggcuuacaagcaaaggcuacuagagaagcgcagaaaagaacggcugccgggauuaugaaaaacccaacuguggauggaaucaugacaauagaccuugacccuguuauauaugacucuaaauucgaaaaacaauuagggcaaguaaugcuauuagucuuaugcgcaguucaacuacuauugaugcgaacaucaugggcguugugugaagcccuaacucucgcuaccgguccaauaacgacccuaugggaagguaguccagggaaauucuggaauacaacgauagcuguuucaauggcgaacauauucagaggcaguuaucuugcaggcgcaggacucgcauuuaguauuaugaaaaguguuggcacugguaagagaggaacaggcucacaaggugaaacacuuggugaaaaauggaagaagaaacugaaucaacuaagucgaaaggaguucgauuuauacaagaaaucuggcauaacugagguagauagaacggaagcuaaagaaggauuaaaacggggagaaaucacacaccaugcggucucaaggggcuccgcuaaacuacagugguuugucgagagaaauaugguaauacccgagggaagagucauagacuuagggugcggccgaggaggaugguccuacuacugcgccggguuaaagaaagugacugagguuagagguuauacgaaagggggaccaggacaugaggagccgguucccaugucuacguacgguuggaacauaguaaaauuaaugucgggcaaagauguauuuuaucugccgccggaaaaaugugacacucuacucugcgacauuggcgaaagcagcccgucuccuacaguugaagaaucucguaccaucagaguacuaaaaauggucgaacccuggcucaaaaacaaucaguuuuguauaaaaguguuaaaucccuauaugccaacaguaaucgaacauuuagagagguuacaacgcaagcacggaggaaugcucguacggaauccacucuccagaaacucuacgcaugagauguacuggauaaguaauggcacagguaacauagucgcuucggugaauaugguaucuagguuauuacuaaacagguuuacaaugacacauagaaggccuacaaucgaaaaggacguagaucucggggcggguacaagacauguaaacgcagaacccgagaccccaaacauggauguuauuggggaacgaauaaagcgcauuaaagaagaacacaauaguacauggcauuaugaugaugaaaauccauauaaaacaugggcauaucauggaaguuaugaggugaaggcaacaggaagcgcaucuuccaugauaaauggcguggucaaguuguugaccaaaccaugggaugucguacccaugguuauacagauggcgaugaccgacacaacgccauuuggacaacaacgaguuuucaaagaaaagguagauacccgcacuccaagaucuaugcccggaacuagaagaguaaugggcauaaccgccgaauggcuauggagaacgcuaggucggaauaaaaagcccagacuaugcacccgugaagaauuuaccaggaagguucggaccaaugccgcaaugggugcuguuuucacugaagaaaaucaaugggauagcgcaaaagcugcgguggaagaugaagauuuuuggaagcuaguggacagagaaagagaacuucacaaacugggaaaaugugguucguguguauauaauaugaugggcaagcgugagaagaaauugggggaauuuggaaaagcuaaagggucaagagccauaugguacauguggcuaggugcacgguaccuugaguuugaagcucuuggauuccucaaugaagaucacugguucaguagagaaaauaguuauucaggcguggaaggagagggucugcauaaacuuggguacauauugcgugauauuucaaagauaccaggaggugcuauguaugcagaugacacagcagguugggauacacguauaacagaagaugaucuacacaaugaagaaaagauaacccagcaaauggaccccgaacaucgucaauuagcaaaugccauuuuuaaauuaacuuaccagaacaaaguagucaagguccagagaccaacacccacagguacgguaauggauauaaucucacggaaggaccaaaggggaucgggacaaguagguacguacgggcuaaauaccuuuacuaauauggaagcacaguugaucagacagauggaaggagagggaguauuauccaaagcagaccuagagaauccccacuuaccggagaagaaaauaacacaauggcuagagacaaaaggagucgaaagacuuaaacgcauggccauaagcggagaugacuguguuguaaaacccauugaugaccgauucgcgaacgcacuauuagcgcuaaaugauaugggaaaaguaagaaaagacaucccucaguggcaaccgucaaaagguuggcaugacuggcagcaggucccauucugcagucaccacuuucaugaauugaucaugaaggacggaagaaaacuugugguuccguguagaccacaggacgaauuaauagggagggcaaggauuucccaaggagccggauggucacuacgagaaacugcaugucucggaaaagcauacgcccaaauguggucauugauguacuuccauagaagagaucuacguuuagccucaaaugcaauaugcuccgccguuccaguucacugggugccaacgagcagaaccacauggagcauccaugcucaucaccaauggaugacaacggaagauaugcuaacuguauggaaucgugucuggauugaagauaauccuuggauggaggauaagacgccgguuacaaccugggaaaacguacccuauuuaggaaagagggaagaucaauggugcggcagucuaaucggguugaccucgagggcgaccugggcgcaaaauaucccaacggcuauacagcagguuagaucguugaucgguaacgaagaauuucuagacuauaugccuagcaugaaaagauucagaaaagaagaagagagugaaggugcuauaugguaa

SEQ ID NO: 23081 - RNA, 9873 nt, Artificial Sequence
  derived and/or modified CDS sequence (opt6) from DENV-3__GQ868571__SS-prME
acgucccuuugucugaugaugaucuuaccagccgcucuugcauuucacuuaacgucaagggauggugaaccgaggaugauuguaggcaaaaaugaacgcgguaaaucuuugcuguuuaaaacugcgagugguauaaacaugugcacccuaauugcaauggaccuaggggaaaugugugaugauacaguuacauauaaaugcccucauauaacggaaguggaaccagaagacauagacugcugguguaaucuuaccucaaccugggucacuuacgguacuugcaaucaagcaggagaacauagaagggacaaacguagcguggcacuagccccucauguagggaugggacuggauacgagaacacaaacauggaugagcgcugaaggagcguggagacaagucgaaaaaguugaaacaugggcauuacgacacccaggauucacuauacuagcauuauuccucgcccauuauaucgguaccucucuaacgcaaaaagcuguaauuuucauauuguuaauguuaguaacaccgagcaugaccaugcguuguguaggagucggaaaccgugacuuuguugaaggguuauccggggcaacuugggucgauguaguccuugaacacggaggaugcgugacaaccauggcgaaaaacaaaccaacacuugacaucgaauuacagaaaacugaagcaacacaacuagccacacuacguaaauuaugcauagaagguaaaauaacaaauauuaccacggacaguagaugucccacacaaggugaagcaguccucccagaagaacaagaccaaaauuacguuuguaaacacacauauguugacagaggcuggggcaacggaugcggauuguucggcaaagguucauugguaacaugugccaaauuccaaugucuagaaccaauagaagguaaaguaguacaauaugaaaacuugaaauauacggugaucaucacgguucauaccggcgaccaacaucaagucggaaaugagacccaaggcguaacugcagaaauaaccccgcaggcuucaaccacagaagccauacuuccagaguauggcacgcuaggacuugaauguaguccccggacuggcuuagauuucaacgaaaugauuuuacuuacaaugaaaaauaaagccuggaugguacauagacaaugguucuuugauuuaccguuacccuggacgagcggagcaacuacggaaacaccgacauggaacagaaaagaacuuuuaguaacauuuaaaaaugcccacgcaaagaaacaagagguuguuguauuaggcagucaggaaggagcaaugcauaccgcuuuaaccggcgcaacggaaauccaaaauuccggugguacaucaaucuuugcuggacacuuaaaauguagacuaaaaauggauaaacuagaacucaaaggcaugucguaugccauguguacgaauaccuucguguugaagaaagaagucucggaaacacagcacggaacaauucucauuaaaguagaguauaaaggugaagaugugcccuguaaaauaccguuuaguacggaggauggacaagggaaagcacacaacggaagacuaauuacugcaaacccuguaguaacuaagaaagaagaacccgucaacauagaagcugaaccaccauucggagaauccaauauuguaauaggcauuggugauaacgcauugaaaauuaacugguauaagaaaggaaguucaauuggaaaaauguucgaagcgaccgcacguggggcacgaagaauggcaauauuaggugauacugcuugggauuucggaagcguuggugguguucuaaauagucuuggaaaaaugguacaccaaauuuuuggaagugcuuacacagcgcuauuuucgggagucagcugggucaugaaaaucggcaucgguguacugcuuaccuggauaggacuuaauagcaaaaauacuagcaugucguucucuuguauagcaauugguauaauuacuuuguaccuaggugcaguuguccaagcugauauggguugcguuaucaauuggaaaggcaaagaacuuaaaugcggcucaggcauuuucguuacgaaugaaguacacacauggacugagcaauauaaauuucaggcugacuccccgaaaaggcuugcaaccgcaauagcaggagcaugggaaaaugguguaugcggaauacguuccacuacgaggauggagaauuuauuguggaaacagauagcaaaugaacuaaacuacauacuuugggaaaauaacauaaaacuuacggucguuguuggugacauuauaggcguacuagagcaagggaaacguacacuuacuccccaaccaauggaguuaaaauacucauggaagacuuggggcaaagcuaaaauaguuacugcggaaacccaaaacuccucauucauuauugacgguccaaauacaccugaaugcccaagugcuucccgagcuuggaacguaugggaaguugaggauuacggcuuuggaguauuuacaacaaacauaugguugaagcugagagaaguuuacacacagcugugcgaccaucgauuaaugucugccgcaguuaaagacgagcgugccguccaugcagacauggguuauuggauugagagucaaaagaacggcucauggaaguuggaaaaagcgagcuugauagagguaaaaacaugcaccuggccaaaaagucacacguuauggaguaauggaguguuggagucggacaugauaauaccaaagucauuagcaggaccaaucucccagcacaacuauagaccuggguaccacacgcaaacagccgguccauggcaccuggguaaacuagaacucgacuucaacuauugugaggguacaacuguaguaaucacugaaaauuguggaacaagaggaccuuccuuacguacaacgacuguaucagguaaacuuauucaugaauggugcuguaggaguuguacauuaccaccauuaagauacaugggugaagacggaugcugguaugguauggaaauaagaccaauaagcgaaaaggaagagaauaugguaaaaucacucguaucugccggaaguggugagguggauaauuucaccaugggcguccuuugucuggcaauauuguucgaggaagugaugagaggaaaguucgguaaaaagcauaugauagcggggguauuuuucacuuucguacuacuacuuuccggacaaauaacguggagagauauggcacauacacucauaaugauuggcucaaaugcguccgauagaaugggcaugggcguaacguaccuggcacuaaucgcaacuuuuaaaauucaaccuuucuuagcuuuaggauuuuuccuacguaaacugacuucacgagaaaauuuacuccucgguguagguuuagcuauggcgaccaccuuacaacuaccagaagauauagagcagauggcaaacggaauugcauuaggccucauggcauuaaaacugauaacacaauuugaaacuuaccaguuauggacggcauuaauuucacuaacuuguaguaauacuauauucacauuaacuguugcauggagaacggcgacauuaauacuagccggggugucucucuuacccguaugucaaagcaguuccaugcguaaaacagauuggcuaccaaugaccguugcagcaaugggugugccucccuuaccacucuucaucuuuucccuuaaggacaccuuaaaacgcagaaguuggccucuuaaugaaggcgucauggcggucggucuggucaguauucuagcgagcagcuuauuaaggaaugauguaccgauggcagguccccuaguugcgggaggacuccuaauugcauguuacgugauuacgggaacgagugccgacuuaacaguugaaaaagccgcagauguaacaugggaagaagaggcagaacaaacuggagucagccacaauuuaaugauaacugucgaugaugauggcacaaugagaauuaaagaugaugagacugagaauauauugacggucuugcuaaaaacagcacuucuaauaguuaguggcauauuuccuuauucaauuccagcaacguuauugguuuggcauacuuggcaaaagcagacccaaagaaguggagucuuaugggacguuccuaguccucccgaaacccaaaaggcagaauuggaggaaggaguguaccguauaaaacaacagggcauauucgguaagacacaagugggaguaggaguacaaaaagagggaguauuccacacgauguggcauguaacaagaggagcuguacuaacauauaauggcaaacgucuggaaccaaacugggccuccgugaaaaaggacuuaauaucauacggaggagguuggcgacuuuccgcacaguggcaaaaaggagaagaagugcaagucauagcaguagaaccaggcaaaaauccgaaaaauuuccaaaccaugccugggacauuucaaaccacuacuggggaaauuggagcaauagcauuagauuucaaaccugguacaaguggaaguccaauuauaaaucgugaagggaaaguaguuggguuauauggcaacggcgugguaacuaagaauggagguuauguaucaggaauagcucaaacaaaugcugaaccggacggaccgacaccagaguuagaagaagagauguucaagaaacgaaaucuaacaauaauggauuuacacccagggagcggaaaaacaaggaaauaucuaccagcgaucguuagggaagcaaucaaacggcgucuccgaacacucauacuagcccccacuagggucguagccgcugaaauggaagaagccuugaaaggauuaccaauuagauaucagacaacugcaacaaaaucggagcacacuggaagagaaauaguagaucuaaugugccaugcaacauucaccaugaggcugcuaucuccaguuagagugccaaauuacaaccuaauaaucauggaugaggcucacuuuacugaucccgccaguauugccgcaagaggauauauauccacccgcguuggaaugggugaagcagcagcgaucuucaugacugcuacaccaccgggaaccgcagacgcuuuuccucagagcaacgcgccgauucaagaugaggaaagagacauuccggagcgcuccuggaacucuggcaacgaauggauuacagacuucgcuggaaaaacagugugguuuguacccucgauuaaagcaggaaacgauauugcaaacugcuuacguaaaaauggcaagaaagugauucaacucaguagaaaaacauuugauacagaauaccagaaaacuaaguuaaacgacugggauuuuguaguaacaacagacauuucagaaaugggcgcaaacuuuaaagcggauagagugauagacccaagaagauguuugaaaccugugauacuuacggacgggccugaaagggucauacuggcugguccaaugccuguuaccgcagcuucagcagcucagcguagaggccgcguaggaagaaacccccaaaaagaaaacgaucaauauaucuucacaggacaaccucuuaacaaugacgaagaccaugcgcauuggacagaagcgaaaauguuauuagacaacauuaauacaccagagggcauaauaccagcguuauuugaaccugagagggaaaaauccgcugcaauagauggagaauacagguugaaaggugagaguaggaaaacauuugucgaacuaaugcgaagaggagauuugccaguuugguuggcccacaaaguagcuucagaagguauuaaauacacugaccgaaaaugguguuuugaugggcaacgaaacaaccagauccuagaagaaaauauggauguugaaaucuggacaaaggaaggugagaagaagaaauuacgaccaagaugguuggacgcgcggacauauagcgauccccuagcccuuaaagaauuuaaagacuuugcggcuggacgcaaauccauagccuuagaccuaguuacagaaauaggucggguaccgacccaccuagcucacagaacuaggaaugcauuggauaacuuagucaugcuucauacaucugaacacggaggaaaagcguaucgucacgcgguagaagaauuacccgaaacuauggagaccuuacuauugcuaggacugaugauacuacuaacaggcggugccaugcuuuuucuuauaucuggcaaaggaaucggaaaaacgaguauuggauugauuuguguaauagcauccagugggaugcuguggauggccgagauacccuuacaauggauagccuccgcuaucguacuggaguucuuuaugaugguauuacuuauaccagaaccagaaaagcaacgaaccccacaggauaaccaauuagcauaugucguaaucgguauacuaaccuuggccgcuaucauagcagcaaaugaaaugggcaugcuagaaacaaccaagagagaccuggggauguccaaggagccgggcgucguuaguccuaccaguuaucuugaugucgaucugcaccccgccagcgcguggacacucuacgcaguagcgaccacaguaauaacuccaaugcuuagacacacaaucgaaaacaguacagcgaauguaucuuuggccgccauagcuaaccaagcuguuguuuuaaugggacuugauaaaggcuggcccauaaguaaaauggaccuaggugugccucuacucgcuuuaggauguuauagccagguuaacccauuaacccucacggcugcagugcuuuuacuaaucacucauuaugcaaucauagggcccggguuacaagcuaaagccacucgagaggcacagaaaagaacugcugcaggaauaaugaaaaacccaacuguagauggaauaaugacaaucgauuuggacccuguaauuuacgacagcaaauuugagaaacagcuaggacaaguaaugcuacucguguuaugcgccguccaacuacucuuaaugcgcacaucaugggccuugugcgaggcuuugacgcuagcgacaggaccaauaacuacuuugugggaagggaguccaggcaaauuuuggaacacaacaauagccgucagcauggccaacaucuuuagaggaucauauuuagccggcgcgggccuagccuuuucaaucaugaaaucaguggguaccgguaaacgcggcaccgggucgcaaggugaaacacuuggggaaaaauggaagaagaaacuaaaucaauugucgcgcaaagaauuugaucucuacaagaaauccgggauuacugaggucgauagaacagaagcaaaggaaggccucaaacggggcgagauaacucaccaugccguaucaagagggucugcaaaauuacagugguucguugaacgaaacaugguaauucccgaaggacggguaauagaucugggauguggaagaggaggcuggaguuacuauugcgcuggacugaagaaagucaccgaagugcguggauacacuaaggguggcccaggacaugaagaacccguaccuaugucuacuuacgguuggaacauuguaaaacuaaugucuggaaaggauguauuuuauuuaccgccggaaaagugugauacccuacugugugauauuggcgaaaguagcccaucgccuaccgucgaagaaagucgaacaauacgcguacugaaaauggucgaaccauggcuaaagaacaaccaauucuguauaaagguuuuaaauccuuauaugccaacuguuauugagcauuuagaaagguuacaaagaaaacacggggguaugcugguacgaaauccguuaucaagaaauucgacgcaugagauguacuggauuagcaauggcacugguaacauuguagccaguguaaauaugguuucacgccuauuauugaacagauuuacaaugacacauaggagaccuacaauugaaaaagacguggauuuaggagccgguacucgacauguaaaugccgagccagagacaccgaacauggauguuauaggugaaagaauuaaaagaauuaaagaggagcauaacucuacuuggcacuaugaugaugagaacccauacaagacaugggcuuaucacgggucuuaugaaguuaaggcuacuggguccgccuccucaaugauaaauggaguaguaaaauuguugacaaagccaugggacguaguaccuaugguaacacaaauggcuaugacagauaccacgcccuuuggccaacaaaggguuuucaaagaaaagguggauaccagaacaccgaggucaaugccgggaacgagaagaguaaugggaaucacagcggaaugguuauggcguacacucggacggaauaagaaaccccgucuuugcacgagagaagaguucacaaagaaggugagaacaaaugcagcuaugggugccguauucacugaagaaaaucaaugggacucagcaaaagcagcgguugaggaugaagauuucuggaagcucguugaccgugagagagaauugcauaaacucgggaaauguggauccuguguauacaacaugaugggcaaacgagagaagaaacuaggcgaauuuggaaaagccaagggaucuagagccauaugguacauguggcuaggagcaagauauuuagaauuugaggcccuaggauucuuaaacgaggaccauugguucucgagagaaaauucguacaguggagucgagggagaaggccuacauaaguuaggguauauauuacgcgacauaucaaagaucccaggaggcgcuauguacgccgaugacacagcuggcugggauacaaggauuacggaggacgaccuacauaacgaggagaaaauuacccaacaaauggacccugaacauaggcaauuggcuaacgcaauauucaaacuuacauaccaaaacaaaguugugaaaguacaacguccaacuccuacuggaacgguaauggacauaauuucaagaaaagaucagcgaggaucuggacaagucgguacauaugguuugaacacauuuacuaacauggaagcacagcuuaucagacaaauggagggugagggaguacuaagcaaagcagauuuagaaaacccacacuuaccagagaagaaaauaacacaauggcuagaaacgaagggaguggaaagacuaaaacggauggcaauuucaggugaugauuguguaguaaagcccauagacgaucgguucgcaaacgccuuauuagcauuaaacgauauggguaaaguccguaaagacauaccccaauggcaaccgucuaagggcuggcaugacuggcaacaagugcccuucuguucccaccauuuccaugaacugauaaugaaagaugggagaaaguuaguaguacccugcagaccgcaagacgaauugauugguagagcccgaauaucacaaggcgcagguuggucauuaagagaaacagcaugcuugggaaaagcguacgcgcaaauguggagcuuaauguacuuccaucgucgugauuuacgccuagcaucaaaugcgauauguagcgccguaccuguacauuggguacccacaucaagaacuacauggucuauacacgcacaucaucaguggaugacaacagaagauaugcuuacaguauggaaucgaguuuggauagaagacaacccauggauggaagacaaaacuccaguuacuacgugggaaaauguuccauaucuaggaaagcgagaagaccagugguguggcagcuuaauagggcucacaagcagagccaccugggcacaaaacauaccuacagcaauacagcaaguaagaucuuuaaucggcaacgaagaguuccuagauuauaugccaucuaugaaaagguuucgaaaggaagaagaaucagaaggagcaauuugguag

SEQ ID NO: 23082 - RNA, 9873 nt, Artificial Sequence
  derived and/or modified CDS sequence (opt6) from DENV-3__GU131951__SS-prME
acuucucuaugccugaugaugauacuaccagcugcacuggcguuucacuuaacuucaagagacggagaaccaaggaugaucgucgguaaaaacgaaagaggaaaaucgcuacuauuuaaaacagcaagugguauaaauauguguacacuuauagcaauggaucugggugaaaugugugaugauacagucacguacaaauguccacacauuacggaaguugaacccgaagauauugacugcugguguaauuugacaucaacauggguaacguacggcacuuguaaccaagcuggggaacacagaagagauaaaaggucgguugcacuagcaccucacguggguaugggucuagauacacgaacgcaaacauggaugagugcagaaggggccuggagacaaguagagaaaguugaaacgugggcuuugcgacacccagguuucacaauuuuagcauuguucuuagcgcacuauauugguacaaguuuaacccaaaagguagugauuuuuauacuauuaaugcuugugacucccucaaugaccaugcguugugucggaguaggaaauagagacuuugucgaaggucuuuccggugccacuuggguagaugugguccuagaacacggcgguugcguaacuacaaugucuaaaaacaaaccgacccuugauauugaauuacagaaaacggaagccacccaauuggcuacucuucgaaaauuauguauugaaggaaaaauaaccaacauaacaacggauucuagaugucccacccagggcgaagcuguguuacccgaagaacaagaccagaacuacguuugcaaacacacauacguagauagggggugggguaauggauguggacuauuuggcaaagguagcuugguuacgugugcaaaauuccaaugucuagaaccaauugaaggcaaaguuguacaauacgaaaaucuuaaguauacagucauaauaaccguacauacaggcgaccaacaucaaguagggaacgaaacucaaggaguaaccgcugaaauaacaccgcaggcuuccacuaccgaagcaauucuucccgaauauggaacccugggucuugaauguaguccccgcaccggauuagauuuuaaugaaaugauuuuacuuacuaugaaaaacaaagcauggaugguucaucgucaaugguucuuugauuuacccuuaccauggaccucaggggcgacuacugagacacccaccuggaauaggaaggaauuguuaguaacuuucaaaaaugcgcaugccaaaaagcaagaaguagucguauuagguagucaggaaggagcgaugcauaccgcauuaacaggagcuacagaaauucaaaauuccgggggcaccucaauuuuugcgggacaucuuaagugcagauuaaaaauggacaaauuagaguugaaagggaugucauaugccaugugcacgaacacauucguacucaagaaagaaguaagcgaaacacaacacgggacuauuuuaaucaaggucgaauacaaaggugaagacgugccaugcaagauuccguucucuacugaagacggucaagggaaagcacauaacggccgauugaucacugcuaauccagucguuacaaagaaggaagaaccgguaaauauagaagcugaaccaccauuuggugaaagcaacauaguaauaggaaucggcgauaaugccuuaaaaauaaacugguacaagaaagguucuucaauaggaaaaauguuugaagcgacagcucgaggugcacgaaggauggccauauuaggagacacagcaugggacuuugggagcgucggcggaguacuaaauagccucggcaaaauggugcaccaaaucuuugguucagccuauacugcucuauuuucaggaguuucuuggguaaugaaaaucgguauaggaguucugcuuacauggauuggacuaaacagcaagaacacgucaaugagcuucagcuguauagcgauaggaauaauaacccuauaucuuggcgcgguaguacaggcggauaugggcugcgugauaaauuggaaagguaaggaacuuaagugcggaagugguauauuugucacaaacgaagugcauacauggacugagcaauauaaauuucaggccgauuccccaaagcgacuugccacagcaauugcaggggcaugggaaaauggcgucugcgguauaagaagcacaacucgaauggaaaaucuacuauggaagcaaauagcaaaugaauuaaauuauauauuaugggaaaauaacauaaaauuaacuguagucgugggagauaucauugguguguuagaacaagguaaaagaaccuugacuccucaaccaauggaacuuaaauacagcuggaaaacguggggaaaagcgaaaauagucacugcagaaacacaaaauucaucuuucauuauagaugguccgaacacaccggaauguccgucugcaucuagggcauggaacguaugggaaguugaagacuaugguuuuggaguguuuaccacuaauauaugguugaaacuuagagagguguauacucaauuaugcgaucauagauuaaugagugcagcaguaaaagacgagagggcugugcacgcagauauggguuauuggaucgaaucucaaaagaauggaucauggaaguuagaaaaagcgucccuaaucgaaguaaaaacaugcacuuggccuaaaucacacacgcuuuggucaaaugggguucuugaaagcgauaugaucauaccgaaaagccuagcaggacccauaucacaacacaauuaucgcccuggguaucauacccaaacggcggggcccuggcaucuuggcaaauuagaacuggacuuuaauuauugcgagggcacuacaguagucaucacugaaaauuguggcacacgagguccuucacuucgaacaacaacgguuaguggaaaacuaauacaugaauggugcugcagaucguguacacugccaccauuaagauauaugggggaagacggauguugguaugguauggaaauaagaccuauaucagaaaaagaggaaaauauggugaaaagccuuguaucggcuggaucuggugaagucgauaauuucacuauggguguguuaugucuggcaauauuauuugaagagguaaugcgagggaaauuugguaagaaacauaugauagcgggcguauucuucacauuuguucucuuauuauccggccaaauaacauggagagauauggcacauacucuuaucaugaucggaaguaaugcaagugaucggaugggaaugggcguaacauaucuggcccuaauagcaaccuuuaaaauucaaccauuccuagcgcucgguuucuuucuacguaaauuaacgucgagagaaaacuuacuccuuggagucgggcuagcuauggcaacgacccuucaacuaccggaagauauagaacagauggccaauggaauugcuuuaggcuugauggcccugaaacugauaacucaauuugagacauaccaauuauggacugcccuaauaucucucacaugcucuaauacuauauucacccucacgguagcauggcgcacggccacuuuaauauuggcuggggucucuuuauuacccgucugccaaaguucauccaugcggaaaacugauuggcuaccaaugacuguagcggcuaugggcgucccuccacuaccuuuauuuauauuuagucuaaaagauaccuuaaagagacgaucguggccuuuaaacgaagguguaauggcagucggucuugucaguauuuuagcuagcaguuuacuaagaaaugauguuccuauggcaggaccucuaguagcaggaggucugcuuauugccugcuaugugauaaccgguacgucagcugaccuuacagucgaaaaggcggcagauguuacuugggaagaagaagcagagcaaacgggaguuagccauaauuuaaugauuaccguggaugacgacgggacgaugcggauuaaggaugaugaaacagaaaacauacuaacuguguugcuaaagacagcccuacuaauaguaucugggauuuucccauauucuaucccagcaacucuauuaguauggcauacguggcagaaacaaacccaacgaucaggaguauugugggauguucccaguccaccagaagcacagaaagcagagcuggaagaagguguuuauaggauaaaacagcaaggaauuuuugggaaaacacaaguugguguuggaguacaaaaagaaggaguuuuucauaccauguggcaugugacgagaggcgccgugcuaacguauaacggaaaacgguuagaaccaaauugggccaguguuaaaaaggauuuaauaucauacggaggcggguggagguuaagugcgcaauggcaaaagggggaggaaguacaaguaauagcgguagaaccaggaaagaaccccaaaaauuuucaaacgaugccagggacguuucaaacaaccacuggugaaauaggggcaauagcgcucgauuucaagccaggaacaucugggagcccaauaauaaaccgagaaggaaaaguugugggucucuacggaaaugguguaguaacuaaaaauggagguuacgucucaggcauugcacaaacaaacgcggaaccugauggcccuaccccggagcuagaagaagaaauguuuaagaaaagaaaucuaacgaucauggaccuccauccagguucuggcaagacgagaaaguauuugccugccaucguccgagaagcuauuaaaagacgcuugcguacuuuaauccuugcgccgacacgggucguagcugcagagauggaagaagcccuuaaaggauuaccaauaagguaucaaacaacugccacaaaauccgaacauacaggaagggaaauaguagaucugaugugccacgcaacauucacgaugagacuauugagcccagugcgaguuccgaacuacaaccuaauaaucauggacgaagcacacuuuaccgaccccgcuucuauagcagcccgugguuauauuucgacuagaguggguaugggugaagcagcagcaaucuuuaugacugccacuccucccggaacagcagacgcauuuccacaaagcaaugcaccaauacaagaugaagaacgugacaucccggaaagaucauggaauaguggaaacgaauggauuaccgauuucgcuggaaaaacaguuugguuuguuccuucaauaaaagcagggaacgacaucgccaacugucuaaggaaaaaugggaagaagguaauacaauuaucuaggaaaacuuuugacacugaauaucaaaagacgaaacuuaaugauugggauuuuguaguaacuacagacauaucagaaaugggggcuaacuuuaaggcagaccguguuauagacccgagacggugucugaagccagucauacugacugauggaccggaaagagucauccucgcuggaccaaugccuguaacagcagcuagcgcagcacaaagacgagguagaguagguagaaauccgcaaaaagaaaacgaucaauauauauucacuggacaacccuugaacaaugaugaagaucaugcacauuggacagaagcuaaaaugcuacuagacaacauuaauacaccagaagguauaauaccagccuuauuugaaccagaaagggaaaaaucugcggcaauagauggugaauauagguuaaaaggcgaaucccgaaaaacguuuguugaauugaugagacggggugaucuaccagucugguuagcccauaaggucgcaucugaagggauaaaguauaccgacaggaaauggugcuucgauggucagagaaauaaucaaauacuggaggaaaauauggacguagaaauauggacuaaagaaggugaaaagaagaaauuaagacccagaugguuagaugcccguacguauucggaucccuuagcccuaaaagaguucaaagauuuugccgcaggaagaaaaaguauugcacuagaucuagugacugaaauuggaagggugccuucccaccuagcucacaggacgaggaaugcucuggauaaucuuguaaugcuacauacuucggaacacggaggcaaggcauaccgacacgcaguagaggaauuaccugaaaccauggaaacauuacuucuauugggccuaaugauacugcugaccggcggggccaugcucuuuuugauauccggaaaagggauagguaaaaccuccauuggccuaauuugugugauagccaguucuggcauguuauggauggcugaaauuccuuuacaauggauagcauccgcgaucguuuuagaguucuuuaugaugguacuauugauaccggaacccgaaaaacaacgaacgccucaagacaaucaauuagcuuacguuguaaucggaauccucacccucgcugcgauuauagcagcaaacgaaaugggcuuauuagagacaaccaaaagagacuugggaaugucuaaggaaccgggugucguuucccccacuucauaucuugauguugauuuacauccagcgucagcuuggacacuauacgcaguagcuaccacagugauaacuccaauguugcgucauacaauagaaaauuccacugcaaauguaucauuagccgcuaucgcaaaucaagcagugguucuaauggggcuugauaaaggauggcccauuagcaagauggaccuaggaguaccgcuucuugcauuagggugcuauucacaagucaauccacuaacguugacagcugcuguucugcuguuaauuacucauuacgcaaucauaggaccaggguuacaagcgaaagcuaccagggaagcucaaaagcgcacggccgcgggcaucaugaaaaacccgacgguggaugggauuaugacaauagaucuagauccagugauauaugacucuaaguuugaaaaacaacuuggacaagugaugcucuuaguauugugugcgguacaacuacuucuuaugagaacaaguugggcauuaugugaggcucugacguuagcgacagggccuauuacaacguuaugggagggaaguccuggaaaauuuuggaauaccacuaucgcaguuucuauggcuaacauuuuucgagggucauacuuagccggugcaggauuggcguuuuccauaaugaaaucagucggaacuggcaaacguggaaccggaucucaaggagagacacuuggagaaaaguggaaaaagaaacucaaucagcuuucucguaaagaguucgaccucuauaagaaaucaggcauaaccgagguugaucgaacagaggcaaaagaaggguuaaaaagaggagaaauaacacaccaugccguaucucgagguagugcuaaauuacaaugguuuguagagagaaacaugguaacuccagaaggcagggucaucgaucuaggcugcggaagaggcggauggagcuauuauugcgcaggauugaagaaaguaacugaagugagaggguauacaaaaggcggaccuggccacgaagaaccaguaccaaugucuacuuacggauggaauaucguaaaguuaaugucggguaaggauguguucuacuuaccaccugagaaaugcgacaccuuacugugugauauaggugaaucaucaccuuccccaauaguagaagaaucacgcacaauccgaguacuuaaaaugguagaaccuugguuaaagaauaaccaauuuuguauaaagguacuuaacccuuacaugccuacugugaucgaacaucuggaaaggcuacaacgcaaacauggagguaugcucgucagaaauccacucagccgaaauucaacccaugaaauguauuggaucucuaacggaacggguaauauaguagcaagugucaacaugguaucucgccuacuauugaacagauuuacaaugacgcaucgacguccaacgaucgaaaaagauguagacuuaggggcaggcacaagacaugucaaugcugagccagaaacuccuaauauggauguaauaggcgaacgcauuaaaagaauaaaagaagaacauaauaguacuuggcacuacgacgacgagaacccauauaagaccugggcguaucauggcaguuacgaaguaaaagcaaccgguagcgcuucuucaaugauaaaugguguuguuaaacucuuaacuaaaccaugggauguugugccaaugguaacccaaauggcuaugaccgauacuacgcccuuuggacaacagcguguauucaaggaaaagguagacacucguacuccacggucuaugccgggaacuagaagaguaauggggauaacugcagaauggcuauggaggacccuaggucgaaauaagaagccuagacuguguaccagggaagaguucacuaagaaagugaggaccaaugcagccaugggagcagucuuuacagaggaaaaucaaugggacucagcaaaagcagccguggaagaugaagacuuuuggaaauuaguagaccgagaacgagaauuacacaaacucggaaaauguggaucaugcguguacaauaugaugggaaaaagagagaagaaacucggagaguuuggaaaagcuaaagguucucgagcaauuugguauauguggcuaggagcgagguaccucgaguucgaagcauuaggauuuuuaaaugaagaucacugguuuucaagagaaaauuccuacucaggcguggaaggagaggggcuacauaaacuuggauauaucuuaagagauauuucgaaaaucccaggcggugcaauguaugcugacgacacagccgguugggacacaagaauaacugaggacgaucugcacaacgaagagaaaauaacacagcaaauggacccugaacaccgacaguuagcaaacgcuauauucaaacuuaccuaccaaaacaaaguagucaaagugcagcgaccuacgccuacugggacuguuauggauauaaucucgcgcaaggaccaaagaggaucaggucagguagggacguauggucuaaacacuuuuaccaauauggaagcucaguuaauaagacaaauggaaggagagggcgugcuuucuaaggcagaucuagagaauccacaccuuccugagaagaaaaucacucaaugguuagagacgaaaggaguggaacgguugaaaagaauggcaauuucaggagaugacuguguaguaaaaccaauagaugauagauuugccaaugccuugcuagcucucaaugacauggguaaagugaggaaggauauuccacaauggcagccaagcaaaggcuggcacgauuggcaacaaguaccauucuguagccaucacuuucacgaacuaauuaugaaagacgggagaaaauuagucguuccuugucgaccgcaagaugagcuaaucgguagagcccguauuagucaaggggcaggauggucacuucgagagaccgcgugucuagguaaagcguacgcacaaauguggucccucauguauuuccaucgacgagauuuacggcuagcaagcaaugcaauuuguuccgcuguuccaguucauuggguaccaacaagucgcaccacauggucgauacaugcucaucaucaauggaugaccaccgaagacaugcucacagucuggaacagaguguggaucgaagauaacccauggauggaggacaagacaccuguaacgacgugggaaaacgugccauacuuagggaagagggaagaucaaugguguggaucacuaauaggacuuacuagccgagcgacuugggcacaaaacaucccuacagcgauccaacaaguuagaaguuuaauugguaaugaagaauuucucgauuauaugccguccaugaagagguuuagaaaagaagaagaaucagaaggagcaauuugguag

SEQ ID NO: 23083 - RNA, 9873 nt, Artificial Sequence
  derived and/or modified CDS sequence (opt6) from DENV-3__GQ868572__SS-prME
acuucucucugucugaugaugauacugccagcugcacuggcuuuucacuugacgagucgggauggagaaccgaggaugauaguagggaaaaaugaacggggaaaaucauuacucuuuaaaacagcaagcgguauuaauauguguacauuaauugcaauggauuuaggagaaaugugcgacgacacgguaacuuacaaauguccgcauauaaccgaaguagaaccagaagacauagauuguuggugcaaucuuacauccacauggguuaccuacggcaccuguaaccaagcuggcgaacaucguagggauaaaagaucgguagcacuggccccacauguaggaaugggcuuagacacacgaacacaaacauggaugagugcagaaggugcauggagacaaguggaaaaaguagaaacgugggcacucagacaucccggguuuacuauucuggccuuauuucuagcacauuauauaggcaccagccuaacgcaaaaagcaguaauauuuauauuacuuaugcuaguuacgccaagcaugacaaugaggugcgucggaguggguaauagagauuucguugaaggcuuaagcggugcaacuugggucgacguaguacuagaacauggaggcugcgugacaacaauggccaaaaacaaaccaacucuggacaucgaacuacagaaaacggaagcuacccaacuagcuacuuuacgcaaauuguguauagaaggaaaaaucaccaauauuacuacugacucccgaugcccaacccaaggagaagccguccucccagaagaacaagaccaaaauuauguauguaaacacacauauguggauagggguuggggcaauggauguggucuauuuggcaaaggauccuuagucacaugcgccaaauuccaaugcuuagaaccaauagaaggcaaaguaguccaauaugagaaucuaaaauacacgguuauaauaacaguacacacaggagaccaacaucaaguaggaaaugagacacaagguguaacagcagaaauaacgccccaagcaucaacuacugaagccauccuaccugaguacggaacccucggauuggagugcaguccacgaaccgggcuagauuucaaugaaaugauacuacuaaccaugaaaaauaaagcauggaugguacaccgucaaugguucuuugauuuaccacugccuuggacgaguggagccaccaccgagacuccgacauggaauaggaaagaacuacugguaacauucaaaaaugcccacgccaaaaagcaagaaguaguaguguuaggaucucaagaaggagccaugcacacagcucuaacuggggcuacugaaauccaaaacagcggcgggacaaguauuuuugccggacaccuaaaaugucgucucaaaauggacaagcucgaguuaaaagggauguccuaugcaauguguacaaacacuuucguucuaaagaaagaaguuucggaaacucaacauggaacaauuuuaauuaaaguagaauauaaaggcgaagaugucccuuguaaaauacccuuuuccacggaagacggacaaggaaaaguacacaauggacgucuaauuacagcaaacccugugguaaccaagaaagaagaacccguuaacauagaggcagaaccgccauuuggugagagcaauauugucaucggaauuggagauaacgcccuuaaaauaaacugguacaaaaagggauccucaaucggaaaaauguucgaagcaacagcgcgaggagcucgaagaauggccaucuuaggggacacugcaugggacuuugguucaguaggugguguccuaaauucauuagguaagaugguacaucaaauuuuuggcucugcuuacacagcccuauuuucuggagucaguuggguaaugaaaauagguauagguguuuuauugaccuggauuggacuuaacagcaaaaacacuucgaugucauuuaguugcauagcaauagguaucauaacacuauaccuaggcgcaguagugcaggcugacaugggaugugugauaaauuggaaagguaaagagcucaaaugcggaagugguaucuucgucacaaaugaagugcacacauggacagagcaauacaaauuccaagcagauaguccgaaaagguuagcuacggcgauugcgggugcaugggaaaaugguguuugcgguauaagauccacaacacgcauggagaaucucuuguggaagcaaaucgcaaaugagcugaauuacauuuugugggaaaauaauauuaaguuaaccguagugguaggcgauaucauaggaguacucgaacaagguaaacguaccuuaacaccacaaccaauggaacuaaaauacucauggaaaacaugggguaaagcuaagauagugacagcugaaacacaaaauaguucguuuauuauagacggacccaauaccccugaaugcccuucagcauccagagcuuggaacguaugggaaguagaagacuacggguuuggaguauuuacuacgaauaucuggcugaaauuacgggaaguauacacacaacuaugugaccaucgcuuaaugagcgcagcaguuaaggaugaaagagcgguacacgcugacauggguuauuggauagaaagucagaaaaauggaucuuggaaacuagaaaaggcuucacuaauugagguuaaaacuugcacguggccuaagucucauacccuuuggagcaacgggguacucgaaagugauaugaucaucccaaaaucccuggcuggaccuauuagccaacacaauuaccgcccaggcuaccacacacaaacugcuggaccguggcauuuaggaaaguuagaauuagacuucaacuacugugaaggcacuacggucguuaucacagaaaacuguggcaccaggggaccuaguuuacggacuacaaccguaucaggcaaacuuauccaugagugguguugucgaagcuguacuuuaccgccuuuaagauacaugggggaggauggauguugguacggaauggagauuagaccaauauccgaaaaagaggaaaauauggucaaaagucuuguauccgcugguagcggcgaaguagauaacuucacaaugggggucuuaugucuagccauacuguuugaagaagucaugagaggaaaauucgggaaaaagcauaugauagccgggguauucuuuacauucguauuacuuuuauccggccaaaucacuuggcgcgacauggcacauacuuugauaaugauagguucaaacgcaagugauagaaugggaaugggcguaacauauuuagcuuuaaucgcaaccuuuaaaauucaaccuuuucucgcacuuggguuuuuccucagaaaacuaaccucaagagaaaacuuauugcuaggaguagguuuagcaauggcaaccacacuucaacugcccgaagacaucgaacaaauggcaaaugggauagcucuuggauugauggcauuaaaacuaauaacacaauucgagacauaccaguuauggacggcgcuuauuagucuuacuuguaguaauacuauauuuacguuaacaguugccuggagaacggccaccuugauauuagcaggcgugucucugcuucccguuugccagagcucuagcaugcggaaaacggauuggcuacccaugacaguugcugcuaugggaguaccgccacucccucuguucauauuuaguuugaaggauacauuaaaacgacgaucuuggccccugaaugagggugucauggccguagggcuaguaucaauucucgcuaguucauugcuccgaaaugauguaccaauggccggcccucucgucgcaggaggccuucuaauagcgugcuauguaauaacuggcacuucagccgaucuuacaguagaaaaggcagcagauguuacuugggaagaagaagcagagcaaacugggguaucucauaauuugaugauaacugucgaugacgacgggacuaugcggauuaaagaugaugaaacugagaacauuuugacaguauuacuaaaaacggcguugcucaucgugagugguaucuucccauacagcauaccagcuacauuacugguuuggcacacauggcaaaaacaaacucaacguagcggagucuuaugggauguaccgucgccaccugaaacacagaaggccgaauuagaagaagggguauauagaaucaaacagcagggcauuuuuggaaaaacacagguggguguuggggugcaaaaagaagggguuuuucacacuauguggcacguuaccagaggggccguuuugacauauaauggcaaaagguuagaaccgaauugggccucugucaagaaagaucuuauuucguauggaggcgguuggagguuaucagcccaguggcagaaaggagaggaaguucaagugauagcuguagagccagggaaaaaucccaaaaauuuucagacaaugccaggaaccuuccagacaacaacuggugagauuggggcaauagcauuagacuuuaaaccaggaacaagcggaucaccaauaaucaaucgugaagggaaagucguaggccucuaugggaacggcgugguaacgaaaaauggcggcuauguaagcggaauugcgcaaacgaaugcugagccagaugggccuaccccggaacuagaagaggaaauguuuaagaaaagaaaucucacaauaauggaucuucaucccggaucaggaaaaacaagaaaauaucucccggcuaucguacgugaagcuauaaaaagaagauuaagaacucuuauucuugccccaacacgcguagucgcagcugaaauggaagaggcacugaaaggacuaccaauccgcuaccaaaccacugcaacaaaaagcgaacauacgggaagggagauuguugauuuaaugugucacgcaaccuuuacaaugcggcugcugucuccgguuagaguuccuaauuauaaucuuauaauuauggaugaagcacacuuuacagauccagcaaguauugcugcucgcggcuacauaagcaccagggucggaaugggggaagcugcagcaaucuucaugaccgcaacuccaccuggaacggccgaugcauuuccucaaucuaaugccccuauucaggaugaagaacgagauauaccagaaagaucauggaauaguggcaaugaguggauaaccgauuucgcagggaaaacuguuugguuuguaccaaguauaaaagcagguaacgacaucgcgaacugucucagaaagaauggaaagaaagugauucaacuuaguagaaagacauucgauacagaauaucagaaaacuaaguuaaaugacugggacuuugugguaacgacggacauaagcgaaaugggagcgaauuuuaaagcggaucgaguaaucgauccacgaagaugucugaaaccugucauacuaaccgacggucccgaacgaguaauccuugcgggacccaugccaguaacagcagcaagcgcggcgcaaagacguggcagagucgggcguaauccucagaaagaaaacgaucaauauauuuuuaccggacagccacuuaacaaugacgaggaccaugcccauuggacagaagcuaaaaugcuauuagauaacaucaacacuccagaagguaucauuccggcccuauuugaacccgagagagaaaagagugcagcuauagauggggaguaccgucuuaaaggagaaagcagaaaaaccuuuguugaauuaaugcguagaggcgaccuccccguauggcuagcacauaaaguugccagcgaagguauaaaauauacggaccguaaaugguguuucgauggccaaagaaauaaccaaauuuuggaagaaaacauggauguagaaaucuggacgaaagaaggugagaagaagaaacugcguccaagaugguuagacgcaagaacguacagcgacccccuugcauuaaaggaauuuaaagauuucgcagcgggccgcaagucaauugcauuagauuuaguaaccgaaauuggaaggguccccacacaccuagcacaccggacacggaaugcucuagauaacuuaguuauguugcauaccucagaacacggaggcaaggcuuauagacacgcagucgaggagcuaccagagacaauggagacacuucuucuauuggggcuaaugauauuguuaacggguggagccauguuauucuuaauaucgggcaaaggaauagggaaaacgucaaucggcuuaauauguguuauagcaagcucuggaaugcuauggauggccgaaauaccacuacaauggauagcaucggcaauuguccuugaauuuuucaugauggugcuccucauaccugaaccggaaaagcaacguacaccacaagauaaccaacuggcuuaugucgugauuggaauacucacgcucgcagcuauaauagcggcaaaugaaaugggauuacuugaaacuacaaaaagagacuugggaaugaguaaagagccugguguggucucuccuacaucauaccuggauguugaucuacacccggcaucagccuggacacuguacgccguugcuacuacaguaauuacaccgaugcuuagacauacgauagaaaacaguaccgcgaacguuucucuggccgcaauagcgaaucaagcuguaguauugaugggccuugauaaaggauggccgauaagcaaaauggaccucggaguaccccuauuagcauuaggaugcuauagccagguuaacccuuuaacacuuacagcugcuguucuacuucuaauaacucauuacgcaauuauagggccagguuugcaagcaaaagcuacaagagaagcacagaaaaggacugcugcagggauuaugaaaaauccaaccguagacgguauuaugacuauagauuuggauccuguaauauaugacuccaaauucgaaaaacagcugggucagguaaugcuacuuguacuuugugcaguacaacuacucuuaaugcguacgucgugggcacuuugcgaagcucuuacacuugcuacaggcccaauaacuacgcuuugggaagggucacccggaaaguuuuggaacacuaccauugccgugucaauggcuaacaucuuuagaggcaguuauuuagcaggggcaggucuagcuuucucuauaaugaaaucaguuggaacagggaagagagguaccggaagucaaggagaaacgcuaggagaaaaauggaagaagaaacuuaaucaacucucacguaaagaguucgauuuguauaagaaaucaggaauuacugaaguggaccgaacggaagccaaagaaggucuaaaaagaggcgaaauaacacaucaugcagucaguagggguuccgcuaaacuucaaugguuuguagagagaaauauggugauacccgagggaagagucauagauuugggauguggcagagguggcugguccuacuauugugccggucuaaagaaaguuacagagguuagaggauacacgaaagguggaccuggacaugaagaaccuguaccuaugaguacguauggauggaacauagugaaacuaaugucaggcaaggacguguucuaucuaccaccagaaaagugcgauacacuauugugugacauuggagagaguuccccaagcccaacuguagaagaaucgcguacaaucagaguccucaaaaugguagaaccuugguuaaagaacaaucaauuuuguaucaaagugcuaaaucccuauaugccgacggugauagaacaccuagagagauuacaaaggaaacauggagguaugcucguucgcaacccacugucaagaaacuccacacacgaaauguauuggauauccaacggcacaggaaauauaguugcaucgguaaauaugguaucaaggcuguuacuuaaccgcuucacaaugacucauagacgaccgacuaucgagaaagaugucgaucucggagcaggaacucgacauguuaaugcagaaccagaaacuccaaauauggacgugauaggggagcguauaaaacggauaaaggaagaacauaacucgacuuggcacuacgaugaugaaaauccauauaaaacuugggcauaccauggaucauacgaagugaaggcaacggggagcgcaaguucaaugaucaacggaguuguaaagcuccucacuaaaccuugggacguuguuccaaugguaacacaaauggccaugacggauacuaccccauuuggucaacagagagucuuuaaagaaaaaguagauacuagaacaccaagaucaaugcccggaacgagaagaguaaugggaauaacugcagaaugguuauggcguacccuagguagaaauaagaaaccaagauuguguacacgagaagaguucacaaagaaaguaagaacgaaugcugcaaugggggcuguuuuuaccgaggaaaaucagugggauucagccaaagcagcaguagaagaugaagauuucuggaaguuaguggacagagaacgggaacuucauaaacucgguaaaugcggcucaugcguuuauaauaugaugggaaaaagagagaagaaacuuggcgaguuugggaaggcaaaaggaucacgcgcuauaugguacaugugguuaggagcgagauaucuugaguucgaagcacuaggcuuccucaaugaagaccauugguucagcagggaaaauucuuauaguggagucgagggcgaagguuuacacaaacuggguuacauauuaagggauauaucaaaaaucccagggggugcaauguacgcugaugauacggcuggaugggauacccggauuacugaagacgaucuucacaaugaagagaaaauaacccaacaaauggacccagaacacagacaacucgcuaaugcaaucuuuaaauugacauaucaaaacaaaguggucaaagugcaacgcccaacaccuacagggacuguaauggacauaauuucuagaaaagaccagagaggaucgggucaaguaggaacauauggcuugaacacauucacaaauauggaagcucagcuaauaagacagauggagggugaagguguacugagcaaagcagaucuagaaaauccucaucuaccugagaagaaaauuacucaguggcuugaaacuaaaggaguugaaagauuaaaacgaauggccauaagcggcgacgauugcguugugaaaccuauagaugauagauucgcuaaugcucuacuagcccucaaugacaugggcaaaguaagaaaggauaucccacaauggcaaccaucgaaaggcuggcacgacuggcagcaaguuccauuuugcagucaccauuuucaugaguugauaaugaaggauggacguaaauuaguugucccauguaggccucaagaugaacuaaucgggcgagcucguauuucacaaggagcuggauggucgcugagagaaaccgcuugcuuaggaaaagcauacgcccagauguggucgcucauguauuuucacagacgagaucuucgauuggcuaguaacgcaauuuguucagcggugccagugcacugggugccaacaucaagaacuacuuggucaauucaugcucaucaccaauggaugacaacugaagacaugcucacuguuuggaaucguguuuggaucgaagacaacccauggauggaggauaaaaccccuguuacuacgugggagaaugucccauaucuagguaaaagagaagaucaauggugcgguucacucauaggacuaacgucucgugcaaccugggcacagaauauucccacugcaauacaacaggucagaagccuaauuggaaaugaggaguuuuuagauuacaugcccucgaugaaaagauuucguaaagaagaagaaagcgaaggugcuauuugguaa

SEQ ID NO: 23084 - RNA, 9873 nt, Artificial Sequence
  derived and/or modified CDS sequence (opt6) from DENV-3__GQ868573__SS-prME
acaucauucugccuaaugaugaucuuaccggcugcucucgcguuucaccuaacaaguagagauggagaaccaaggaugauuguugggaaaaacgaaagaggaaaaucccuacuguucaaaacggcaucgggaauuaauaugugcacucuaauugcgauggaucucggagaaaugugugacgacacgguuacauauaaauguccacauauuacugaaguugaaccagaagauauagauuguugguguaaucuaaccaguacuuggguaacauauggaacaugcaaucaagcaggagaacauagaagggauaaacgaucaguugcgcuggcaccacaugucgggaugggcuuagacaccagaacacaaacauggaugucagcagagggcgcauggcgacaaguagaaaaagucgaaacgugggcgcuacgacaucccggauuuacuauacuagcucuauucuuagcacauuauauaggaacgagccugacucaaaaagcgguaauauucauauuacuaaugcuuguuacaccgucaaugacaaugagauguguaggaguagggaaccgagacuuuguagaagguuuaaguggagcaacuuggguugauguaguacuagaacacggcggaugcguuacuaccauggccaaaaauaaaccaacacuagauauugaacuacagaaaacugaggcaacucaacuugcaacacugcguaaacuuugcaucgaaggaaaaauuacuaacauaacuacggacagccgaugcccaacacagggcgaagcaguguugccugaagaacaagaucagaacuauguuuguaaacacacauacgucgauagaggaugggguaacggcuguggcuuauucggaaaagggucauuaguuaccugugcaaaguuccaaugcuuggagccaaucgagggaaaaguaguacaauaugaaaaucuaaaguauacaguaauuauaacaguucauacuggugaucagcaccaagucgggaaugaaacacaaggcguaaccgcagaaauaacuccacaagcauccaccacugaggcuauucuuccagaauaugguaccuuaggacucgaauguucaccacguacugguuuagauuucaaugaaaugauucuauuaacuaugaagaauaaagcguggaugguccauagacagugguucuuugauuuaccauuaccguggacaucaggggcaaccacugaaacccccacuuggaaccgaaaagaguuauuagugacguucaagaaugcucaugccaagaaacaagaaguuguaguauugggaucacaagaaggcgcuaugcauacugccuuaacgggcgcgacggaaauccagaauagugggggaacauccauuuuugccggccaucuuaaauguagauugaaaauggauaaacuagaauuaaaagggaugucguaugcaauguguacaaauacguuuguauuaaagaaggaaguaucugaaacacaacauggaacaauucuaauuaaaguagaguauaaaggcgaagauguaccuuguaagauaccauucucuaccgaagacggucagggaaaagcacauaacggucgccucauuacagcuaaucccguaguaacaaagaaagaggaaccuguuaacauugaggcugaaccuccguuuggagaaaguaauauaguaauugguauuggugauaacgcauuaaaaauaaauugguacaagaaaggcucaaguauugguaagauguucgaggcaacugcaaggggugcuaggagaauggcaaucuuaggagauacugcgugggauuucggaagcgugggcgggguuuuaaacucucuaggaaaaaugguacaccaaauuuucggaagcgccuauacagcuuuauuuucggggguaucaugggugaugaagauuggaaucgguguccugcuaaccuggauaggccucaacaguaaaaauacuucaaugucauuuuccuguaucgcaauuggaaucauuacucuuuauuuaggcgcgguaguucaagcugauaugggcuguguaaucaacuggaaagggaaagaacuaaaaugcgggucaggaauuuucguuacaaaugaagugcauacauggaccgagcaauacaaauuucaagcugacuccccaaaaagguuagcuaccgcuauugccggcgcuugggagaacgguguuuguggaauaagaaguacaacgagaauggaaaauuugcuuuggaagcagaucgccaaugaauugaacuacauccuaugggaaaacaacauaaaacuuacagugguugucggcgacauaauuggaguauuagagcaagguaaaagaacucuaacgccucaacccauggaauuaaaauacagcuggaaaaccuggggaaaagcaaaaaucgugacagcugaaacucaaaacagcucauuuauaauugauggucccaauacacccgaguguccauccgcgucgcgagcuuggaauguaugggaaguagaagacuauggauucggaguguucacuacuaauaucuggcuaaaacuucgugaaguauacacgcaacugugugaucauagauuaauguccgccgcuguuaaagacgaacgagccguacaugcagacaugggcuacuggauugaaagucagaaaaacgggucauggaaacuggagaaggcaucuuuaauagaaguaaaaaccuguaccuggccaaaaagccauacacuuuggucaaaugguguucuagaguccgacaugauuauuccaaaaucauuagcaggacccauuucccaacauaauuacagaccugguuaucauacacaaacggccggaccauggcaccuaggaaaauuggaacuggauuucaauuacugugaaggaacgacagucguaauaaccgaaaauuguggaaccagggggccaaguuuacgaacuacuacagucucagguaaacuuauucacgaauggugcuguagaucauguacucucccgccacuccgauauaugggcgaagacgguugcugguauggcauggagauaagaccuauuagcgagaaagaagaaaauaugguaaagagcuuaguaucggcgggaaguggggaaguagauaacuucacuaugggaguauuauguuuagcgauacuuuucgaggaaguaaugcgaggcaaauuugguaagaaacauaugauugcuggaguauucuucacuuucgucuuauuguuaagcggacagaucacauggcgagacauggcgcacacauuaaucaugauaggaaguaacgcaucagauaggauggggaugggaguaacauauuuagcacucaucgcaacauucaaaauucaaccauuucucgcucuuggauucuuuuuaagaaaguuaacaagucgugaaaauuuacuuuuagguguagggcuugcgauggcaacgacccugcaacuuccagaagauaucgaacaaauggcaaacggcauugcgcuuggccucauggcuuuaaagcugaucacacaauucgaaacauaccaauuauggacugcccuuauuucgcuaacgugcuccaacacuauauuuacccuaaccguagcuuggcgaacugcaacauuaaucuuggccggcgucucgcuauuaccugucugucaauccucguccaugcgaaagaccgauugguuaccaaugacagucgcagcgaugggacuacccccauuaccauuguucauauucucuuuaaaagauacucuaaaacggaggucuuggccgcuaaacgaaggcguuauggcgguuggucucguaagcauacuugcaagcaguuugcuacguaacgaugugccuauggcagguccauuaguagcuggaggccuauugauugcauguuaugugauaacggggacgagugcugauuugacaguugaaaaagcagcggauguaacgugggaggaagaagcggaacaaacuggaguaagucauaaucugaugauuacuguagaugaugauggaacuaugagaauuaaagaugacgaaacagaaaauauacucacaguacuguuaaaaaccgcgcuuuuaaucguaucuggaauuuuuccuuauucaauuccugcaacuuuacugguauggcacacuuggcagaaacaaacucaacggaguggugugcuaugggauguaccuucaccgcccgaaacacagaaagcugaauuagaagaagguguauauaggaucaaacagcaaggaauuuuugguaaaacgcaagucggagucggaguacagaaggaaggaguauuucacacaauguggcauguaacacggggagcgguucucacauauaaugguaaacgacucgagccuaacugggccagcguuaagaaagacuuaauaagcuauggagguggauggagacuuagcgcccaauggcagaaaggagaagaagugcaaguaauagcuguugagccuggcaaaaaucccaaaaacuuccagaccaugccaggaacauuccaaacuacaaccggcgagauuggagccaucgcacuugauuucaaaccaggcacaucaggaucaccgauaauaaaccgagaaggaaaaguuguuggauuauacgguaacggaguagugacgaaaaacggugguuacguaucagguauagcccagacuaacgcugaaccagauggcccgaccccagagcuagaagaagagauguuuaagaaacggaaucuaacaauuauggaccuccacccggguagcggcaaaaccagaaaguaucuacccgcuaucguuagagaagcaauaaaaagacggcuccgaacuuuaauauuagcaccgacaagggucgucgcagcagagauggaagaggcuuuaaaaggguugccgauaagguaucaaacaacugcaaccaaguccgagcacaccggacgcgagauaguagauuuaaugugucaugcaacauucacaaugagacuacuaucuccaguuagaguaccuaauuacaaucugauuauaauggaugaagcucauuuuacagauccagccaguauugccgccagagguuacauaagcacgcguguagguaugggggaagcagcagcuauauucaugaccgcaacgcccccaggaacugcugaugccuucccccaaucuaaugcuccaauucaagaugaagaaagagauauuccagaaaggaguuggaacucagguaacgaauggauaacagacuucgccgggaaaacaguaugguuugucccaucuauaaaagcggguaaugauauagcaaacugucuacguaagaauggcaagaaagucauacaacuguccagaaaaacauuugauaccgaauaucagaaaacuaaacucaaugacugggacuucgugguuacaacggacaucagugaaaugggagcaaacuuuaaggcugaucgcguaaucgacccuaggcgauguuugaaaccaguaauacugacugauggaccugaaagaguuauacucgcuggacccaugcccguuaccgccgccucugcggcacaaagacggggcagaguaggacgcaacccccaaaaagaaaaugaccaauacauuuucacuggacaaccauuaaacaaugaugaagaucaugcccauuggacugaggcgaagaugcuacuagacaauaucaauacgccagaaggcauuaucccugcucuauuugaaccggagcgagaaaagagugcggcuauagauggggaauaucgcuuaaaaggggaaucgaggaagacauuuguagaacugaugagacggggagaucuaccgguauggcucgcacauaaaguggcaucagagggaaucaaauauacggauagaaaaugguguuucgacggacaacgcaacaaccagauucuagaggagaauauggacguagaaauuuggacuaaagaaggagagaagaagaaacuuagaccacguuggcuagaugccagaaccuacuccgacccacucgcauuaaaagaguuuaaggacuuugcagcaggucgcaaaucaauagcccuugacuuaguuacugaaaucggaaggguuccaacucauuuagcacauagaacacgaaaugcuuuggacaacuuagugaugcuucauacgucagagcauggaggaaaagcauaucgacaugcuguggaagaacuaccugaaaccauggagacauuauuauuacuaggcuuaaugauacuccucaccggaggggccaugcuuuuccuuauuuccgggaaaggaauuggaaagacaaguauagguuuaauaugugucauagcuucaagugggauguuguggauggccgagauuccguuacaguggauagcaucagcaauaguacuugaauuuuucaugaugguccugcugauuccugaaccagaaaagcaaaggacuccacaagauaaucaauuagcauacgucguaauagguauucucacgcuggcggccauuauagcugcaaaugagaugggacuucucgaaacaacaaaacgcgacuuagguauguccaaagaaccaggaguaguaucacccacaucguaucuugauguagauuuacaucccgcaagugcauggacauuguaugcagucgccacaacagucauaacacccauguuaagacauacaauagaaaauaguacagcaaauguuucucuagccgcgauugccaaucaagcuguagugcuaaugggauuggauaaagguuggccuauaucuaaaauggaucuagguguaccucuacuagccuuaggguguuauucccagguuaauccguuaacacucacagcggcaguacuacuucuaaucacacacuacgcgauaauaggacccggcuuacaagcaaaagcaacgagagaagcacaaaagcguacggcagcuggaauuaugaaaaauccuacuguagaugggauuaugaccauagauuuagauccaguaauuuaugauucaaaauucgaaaaacaacuaggacaagugauguuguuggugcucugcgcugugcagcuacuuuuaaugaggacuucaugggcucuaugugaagcauuaacauuagcuacgggcccaauaacgacuuuaugggaaggaagcccaggcaaauucuggaauacaaccauagcaguuuccauggcuaacaucuuccgugggucuuauuuggcuggagcaggacuagcauuuaguaucaugaaaucaguaggcacuggcaagagaggaacugguucucaaggggaaacccuaggggaaaaguggaagaagaaacuaaaucaauuaagucgaaaagaguucgauuuguauaaaaagagcggcauuacugaagucgacagaacagaagcuaaagaaggucuaaaaagaggggagauaacccaccacgcaguaucaagagguucagccaaacuacaaugguuuguagagcggaacaugguaaucccagaagggagaguuauagaucugggaugcgguagagggggauggagcuacuacugugcuggucucaagaaaguaacugagguucgaggauauacaaaaggggguccaggacaugaagaaccuguuccuaugagcacuuauggguggaacaucguuaaacugaugucugguaaagauguguuuuaccuuccuccagagaagugcgauacacuucuuugcgauauaggagaauccucuccgucaccuacgguggaagaaagcagaacuauuagaguucugaaaaugguagaaccauggcuuaaaaacaaucaguucugcauaaaaguucugaaucccuacaugccaacaguaauugagcacuuagagagauugcagagaaaacaugguggaaugcuuguacguaacccauuaaguagaaauaguacucaugaaauguauuggauaucaaacggcacaggaaacauaguagcauccgucaauauggucucuagauuacuauugaaucgauucacaaugacacauaggagaccgacuauagaaaaggacgucgaucuaggcgccgguacaagacauguuaacgcugagccagaaacgcccaacauggacgugauuggggaacggauaaaacgcauaaaagaagaacauaauucaacauggcauuacgaugacgagaacccuuauaaaacuugggcauaucacggcaguuaugaagucaaggccacaggcagugcuaguaguaugauaaaugggguagucaaauugcuaacuaaaccgugggacgucguucccauggugacacaaauggcaaugacugauacuaccccauucggacaacaacgagucuuuaaggagaaaguagauacacgcacaccaaggucaaugccagggacgagaagaguaauggguauuacagcagaauggcuguggcgaacguuaggacgcaauaagaaaccacguuuaugcacaagagaagaauuuacuaaaaagguaagaaccaaugcagcaaugggugcuguuuucacugaagagaaccagugggacucagcuaaagcagccguugaagaugaagacuucuggaaauuaguggaucgugaaagagaacuccauaaauuaggaaaaugugguaguuguguguacaauaugaugggcaaaagggaaaagaaguuaggcgaauuuggaaaagcaaaaggaagcagggcaauaugguauaugugguuaggagcccgauacuuggaauuugaggccuuaggauucuuaaaugaagaccacugguuuucuagagaaaauagcuauucagguguagaaggcgagggauuacacaaacucggcuauauuuuaagggacauuucuaaaaucccggguggcgcaauguacgcagacgauaccgccgggugggacaccaggauuacagaagaugacuuacacaaugaggagaagauaacacaacaaauggauccagaacaucgccagcuagcuaacgccauuuucaaauugacauaccagaacaaggucguuaaaguccaaaggccaacuccuacggguacugugauggauauaauaaguagaaaagaucaaagagguuccggccagguaggaaccuaugguuugaauaccuuuacuaacauggaagcacaacucauucgacagauggaaggggaagggguauuaucaaaggcagaucuagaaaacccacaucuucccgagaaaaagauaacucagugguuagaaacgaaggggguggaacgccuaaaacguauggcuauaagcggagacgauuguguggugaaaccaauagaugacagauuugccaaugccuuacuggcucuaaacgauaugggaaaaguccgaaaagauauuccgcaauggcaacccuccaaaggguggcaugacuggcaacaaguuccuuucugcucacaucauuuucacgagcuaauaaugaaggaugggcgcaaauuaguaguuccaugcagaccccaagaugaacuuauagggcgcgcaaggauuucacaaggcgccggauggucauugagagaaacggcuugccuugguaaagcauaugcucaaauguggagccuuauguauuuccaccgaagagauuuaagauuagcuuccaaugcgaucuguucagcugugccuguacauuggguucccacgaguaggaccacuuggucaauacaugcacaccaucaguggaugacaaccgaagacaugcucacggucuggaaucgcguauggauugaagauaaucccuggauggaggacaaaacuccggugacuacuugggaaaauguaccauaccugggcaagcgagaagaccaauggugcggaucgcuuauuggccugacuucaagagcaaccugggcacagaauauuccaacugccauucaacaaguacgaucacugauaggaaacgaagaauuuuuagauuacaugcccagcaugaaaagauuucguaaagaagaagaaucagaaggagcaauuugguga

SEQ ID NO: 23085 - RNA, 9873 nt, Artificial Sequence
  derived and/or modified CDS sequence (opt6) from DENV-3__GQ868574__SS-prME
acuucguugugcuugaugaugauucuaccagcugcucuugcauuucaccucaccucgcgagauggugaaccucgcaugauuguugguaaaaacgaacgaggaaaaaguuuacuuuuuaaaacggcauccggaauaaacauguguacacuuauagcaauggauuugggagaaaugugugacgacaccguaacauauaaaugcccacauauaacagaaguagaaccagaagauauagacugcugguguaaccuaacaaguacauggguuacuuacggaaccuguaaucaagcgggagaacauagaagggauaaacguaguguagcacuagcaccgcauguugguaugggacuagauacgagaacacaaacauggaugucagcagaaggggcauggcgucaaguagaaaaaguggagacuugggcacucagacauccuggauucacuauucuagcuuuauuucuugcacauuauaucggaacaucacuaacucaaaaagcaguaauuuuuauacuccuaauguuagucacaccaagcaugaccaugagauguguugguguaggaaaucgugauuuugucgagggacuaucaggggccaccuggguggacguuguccuagaacacgguggaugcguuacuacaauggcuaaaaacaaaccaaccuuagauauagaauugcagaaaacagaagcuacucaauuagcuacuuuacgcaaauuaugcauagaggggaaaauaacaaauauuacaacugacaguagauguccgacgcaaggagaggcaguucuaccagaagaacaagaucagaauuacgugugcaaacauaccuauguagacagagguuggggaaacggaugcgggcuauucggcaaaggcagucucgucacuugugcaaaauuccaaugucucgagcccauugaagguaaaguagugcaauacgagaaucuaaaauauacagucauuauaacagugcauaccggagaucaacaucaaguagguaacgaaacacaaggaguaacagcugaaauaacgccucaagcaagcacaacggaagcaaucuugcccgaauacggaacuuuggguuuagaauguucgcccagaacaggacuagauuuuaacgaaaugauccuauuaaccaugaaaaauaaagcguggaugguucauagacaaugguucuucgaccuaccgcuacccuggacaucaggcgcaaccacagaaacaccuacauggaaucgaaaagaacuacuggucacauuuaaaaaugcacacgccaaaaagcaagaaguaguaguacuagggagucaggaaggggccaugcacacagcauuaacaggagccacugagauacaaaauucagggggaaccagcauuuuugcaggccaucucaaaugccgacuaaagauggauaaauuagaauuaaaaggcaugagcuaugccaugugcacuaauacguucgugcucaagaaggaagucucagaaacacaacacgggacaauacucauaaagguagaauauaagggugaggacgugccauguaaaauaccauuuuccaccgaggauggacaagguaaggcccacaacgggagguuaauaacggcaaauccaguagugaccaagaaagaggagccugugaauaucgaagcugaaccaccauuuggcgaaucaaacauaguaaucggaauaggggacaacgcucugaaaaucaacugguauaagaaagggucaaguauagggaaaauguuugaagcaacugccaggggugcccguagaauggcaauauuaggggacacagccugggacuucgguucagugggaggcgucuuaaauucauuagguaaaaugguacaucaaauauuuggcucagcuuacacagcgcuauucucaggggugucaugggucaugaagauagguauaggggugcuguugacauggauaggccucaauaguaaaaauacauccaugucauuuucauguauugcaaucggaauaaucacguuauauuuaggugcugucguucaagcagauaugggaugcguaaucaauuggaaagggaaagaauuaaaaugcggaucagguauuuucgugaccaaugaagugcauacuuggacagaacaguacaaauuucaagcagauucuccuaaaagacuggcaacagcuauagccggugcaugggaaaacggagucugcggcaucaggucgacaacucguauggagaaccuccuguggaaacaaauugcaaaugaauuaaacuauauuuuaugggaaaacaauauuaaacuaacgguagucgucggggauauaauaggcguuuuagaacaaggcaaaaggacucuaacgccucagccuauggaguuaaaauacucauggaagacuugggguaaagcuaaaauuguuacugcugaaacccaaaacucgaguuucaucauagacgggccaaacacuccugagugccccuccgcaucucgcgcauggaaugugugggagguagaagacuacggcuuugguguguuuacuacuaacaucugguuaaaacuccgggaaguauauacacaacugugcgaucauagacugaugagugccgcagucaaggaugagagagccguucaugcugacaugggguauuggauagaaagccagaaaaaugguucauggaaacuugaaaaagcaucuuugauagaagucaagacguguaccuggccuaaaucccacacucuauggagcaacgggguucuugaaucugauaugauaauuccaaaaucuuuagcgggucccauuagccagcauaacuauaggccgggauaucacacacaaacagccggcccauggcaccucggaaaguuagaacucgacuuuuccuacugugaaggaacuacuguuguuauaacggaaaauugcgggaccagggggccuuccuuacgaacaacaacuguaagcggaaaguugauacacgaaugguguuguagaucuugcacacuaccacccuuacgauacaugggugaagaugguuguugguacggaauggaaauaagaccaauaucugaaaaagaagaaaauaugguuaaaucccuuguuucagccgggaguggagaaguagauaauuucacuaugggaguauugugcuuagccauacuuuuugaggaagucaugagggggaaauuuggcaagaaacacaugauagcgggaguauucuuuaccuuuguuuuauugcucucaggccagauaacauggagagauauggcucauacacuaauuaugauuggaaguaacgcuagcgauagaaugggaauggguguuacauauuuggcguuaauugccacauucaaaauucagccuuuucuugcauuaggcuuuuucuugcgcaaauugacgucuagagaaaauuuacuauuaggcguuggacuagcgauggcgacaacacugcaauugcccgaggacaucgagcaaauggcaaacggaauugcucuaggccuuauggccuugaaguugaucacccaauucgaaacguaucaguuauggacugcauugauuaguuuaaccugcaguaacaccauuuuuaccuuaacaguggcauggcguacugccacauugauacucgccgguguaagccuauuaccggucugucagucaucaucaaugcguaagacugauuggcuuccuaugacuguugcugcuaugggaguacccccacuuccgcuguucauuuuuagucuaaaagacacauugaaacguagaucuuggccucuaaaugaaggcguaauggcaguaggauuaguaucuauauuggcuucuucguuacuaaggaaugacguuccaauggcagggccccuaguagcaggcggacuucuaaucgccuguuacgucaucacgggaaccagcgcggauuuaaccguagaaaaagcagcagacguaaccugggaagaagaagcugaacaaacaggaguuagucacaauuugaugauuaccguagaugaugaugggacuaugagaauaaaggacgacgaaacugaaaacauacugacaguacuauuaaaaacagcucuuuugauuguuucagggauauuccccuacagcauaccagcaacacuacugguguggcauacguggcaaaaacaaacucaaagauccgggguauugugggacgugccuucucccccggaaacacaaaaagcugaacuagaagaaggcguguacagaauuaaacaacaagguauuuucgguaaaacgcaaguuggagucggaguacaaaaagaaggcguuuuccacacaauguggcacgugacuagaggcgcuguacuaacauauaacggaaaaagguuggaaccaaauugggcaucagucaagaaagacuugauuucuuauggggguggauggcgacugucggcucaguggcaaaaaggggaggaggugcaaguuauugcaguagaaccggguaaaaauccgaaaaauuuccaaacaaugccagggacuuuccaaacgaccacaggugaaauaggugccaucgcacuggauuuuaagccgggaacaucugguucaccgauaaucaaucgagaaggaaaaguaguaggcuuauacggaaacggagugguuaccaaaaauggaggguacguaucugggauugcgcagacgaacgcugaaccagaugggccuaccccugaauuagaagaagagauguucaagaaacggaacuuaacaaucauggaucugcauccaggcagugguaagacuagaaaauauuugccagcaauagucagagaagcaauuaaaagaagauuacggacuuuaauacucgcaccaacacguguuguagcugcagaaauggaggaggcuuugaaagguuugccaauaagauaucaaacaacggcgaccaaauccgaacacacagguagagaaauuguagauuuaaugugucaugcaacauuuacgaugagacuacuuucaccgguaagaguaccuaacuauaaucuaauuauuauggaugaagcacauuuuaccgaucccgcaagcaucgcagcacgaggcuacauauccacaagagugggaaugggagaagcagcagcgauuuucaugacugcaacacccccaggaacagcugaugcuuucccucaaucuaaugcaccgauucaagacgaggagagggauauuccugaaagaagcuggaacagugggaacgaguggaucaccgauuucgcggggaaaacgguaugguucgugcccucaauuaaagcagguaacgauauagcuaacugucucaggaaaaauggcaagaaaguaauucaauuaucgcguaaaacauucgacacugaauaucaaaagacuaaacuuaaugauugggauuuugucguuacaacggacauauccgaaaugggcgcuaauuuuaaagcugacagagugauugauccaagacgaugccuuaaaccagugauucucacugauggcccggaaagggugaucuuggccgggccaaugccugugacagcugcauccgcugcgcaacgacggggucgcguggguaggaauccucaaaaagagaaugaucaauacauuuuuaccggucaaccauuaaauaaugacgaagaucaugcgcauuggacagaagccaaaauguuacucgauaacauuaacacaccagaagguauaauuccugcccucuucgaacccgaacgggagaaauccgccgcaauagauggcgaauaucgacuaaaaggugaauccagaaaaacuuucgucgaacuaaugagaagaggggaucuuccuguuugguuggcucauaaaguagcaucagaggguauaaaauauacagaucgaaaguggugcuucgauggacagaggaacaaucaaaucuuagaagaaaacauggacguggaaauauggacgaaggaaggugagaagaagaaacuaaggccccgguggcuugaugcacguaccuacagugauccacuagcuuugaaagaauuuaaagacuucgcagcuggccgaaaaucuauugcauuagaucuaguaacugagaucggacgagugccuacacauuuagcacaucgcacacgaaacgcauuagauaauuuggucaugcuacacaccucagaacacggagguaaagcauauaggcaugcaguagaagaacucccagaaacgauggaaacccugcuacuccucggccuuaugauauuauuaacagguggggccaugcucuuuuuaauaucugguaagggcauugggaaaacuucaauaggguuaauauguguaauagcaagcucggguaugcuauggauggcagaaauucccuuacaauggauagccagugcuauaguucuggaguucuuuaugaugguguuacuuauaccagaaccggaaaaacaaagaacaccacaggauaaccaacucgcauacguaguaauagguauacuaaccuuagcugcuauaauagcagcaaacgaaauggguauguuagaaacuacgaagcgcgauuuaggcaugucgaaggaacccggaguagcaucaccgacaucauaccucgauguggaccuacaucccgcuagcgccuggacacucuaugcugucgccacuacagugaucacuccaaugcuucgccauacuaucgaaaauuccacugcuaacgucucucuagcagcgaucgcuaaucaagcggucguauuaaugggauuagacaagggguggccuauaucuaagauggaucugggaguacccuuacuggcgcuaggauguuauagccagguaaacccucuaacccuaacggcugcuguauuauuacuuauaacccauuacgcuaucauuggaccuggucuucaggcaaaagcaaccagagaagcucagaaacgaaccgcagccggaaucaugaaaaacccaacuguagauggaauuaugaccauagauuuagauccaguaaucuacgacagcaaauuugaaaaacaauuaggucaaguaaugcuucuaguucuaugugcaguacaauuacuauuaaugcgaacaucuugggcgcuaugcgaagcauuaacacucgcuacaggaccgauaacaacccuaugggagggauccccuggcaaauuuuggaacacaacgauagcaguuucgauggcaaauauuuucagagguaguuauuuggcaggggccggccucgccuucaguauuaugaaaagcguggguacgggaaaacgaggaacugggucacaaggagaaacuuuaggagagaaauggaagaagaaauuaaaucagcuaucacgcaaggaguuugaccuguauaagaaaaguggaauuacugaagucgaccgaacggaggcaaaagagggccuuaaaagaggggaaauuacccaccacgccguaaguagggguagcgcuaaacuucaaugguuuguagaaaggaauauggugaucccggagggacguguaauagaucugggauguggacgaggaggaugguccuacuauugcgcggggcuaaagaaagucacugaaguaaggggauauacaaaaggaggcccaggacacgaagaaccaguuccaaugucaacuuacggguggaacauagucaaacuaaugucaggcaaagauguauuuuaucuaccaccagagaagugcgauacacuuuuaugcgauauuggagaaucaaguccaagcccgacuguagaggaaucaagaacgauccggguauugaagaugguagaaccguggcucaaaaacaaucaauuuuguaucaaagucuuaaauccauacaugcccacaguuauagaacauuuagaacggcuacaacgaaaacacggcgguauguuaguacgaaacccuuugucgagaaacucuacacacgaaauguacuggaucuccaaugguacuggaaacauuguugcaaguguuaauauggucagucgacuguuacuuaaucgauuuacgaugacucauagaaggccaaccauagaaaaagacguagaccuaggagcugggacaagacacgucaaugcagaaccagaaaccccaaauauggacgucaucggagaacgaauuaaaagaauaaaagaagaacacaacucuacuuggcauuaugaugaugagaauccauauaagacaugggcguaccauggaucguaugagguaaaggccacagggagugccagcucuaugauaaacggaguggucaaauuauugacuaagccuugggacguuguaccgaugguuacucagauggcaaugacagauacaacacccuucggacaacagcgcguguuuaaagagaaaguugauacuagaacaccuagaaguaugccagguacacggagaguaaugggaauaacagcagaauggcucuggagaacucuagggcgaaacaagaaaccucgucuguguacuagagaagaguuuacaaagaagguaagaaccaacgcagcaaugggugcaguauuuacagaagaaaaucaaugggauucugcuaaagcagcaguagaagacgaagauuucuggaagcuaguagauagagaacgggaguuacacaaguuagguaaaugugguucuuguguguacaauaugaugggaaaaagggagaagaaguuaggugaguuuggaaaagcuaagggaagccgugcaauaugguauaugugguuaggcgcacgauaccuagaguucgaagcauuaggauuuuuaaaugaagaccacugguuuucacgugaaaauucuuauagcggggucgaaggagagggguuacacaagcuagguuacauacugcgagauauuuccaagaucccgggcggugcaauguacgcagaugacacagccggcugggacacacgcauaaccgaagaugaucuccauaacgaagagaaaauuacccaacagauggacccugaacacaggcagcuugcgaaugcaauauuuaaacuaacauaccagaauaaaguaguuaaagugcaacgaccaacaccuacagguacggucauggacauuauaagucguaaggaucaacguggcagcggccaaguaggaacuuaugguuuaaacacuuuuaccaauauggaagcucaguugauaaggcaaauggaaggagaaggugugcuaagcaaggcggacuuagaaaauccccauuuaccagagaagaaaaucacacaaugguuagaaacgaaaggcguagaaagauuaaaacguauggcaauaaguggagacgacuguguaguaaaaccuaucgacgaccgcuucgcuaaugcauuguuagcauuaaacgauaugggaaaagugaggaaagacauaccccaauggcaaccuucaaaaggauggcacgauuggcaacaagucccuuuuugcucacaucauuuucaugaguuaauaaugaaagauggaagaaagcuaguaguacccugucgcccgcaagacgaguuaaucgggagagcgcguaucucacaaggcgcuggcuggucccuaagagaaacagcaugcuuggguaaagcauacgcccaaauguggucauugauguacuuccacaggagggaucuacgacuagccucgaaugcuauuuguagugcuguuccgguccauugggucccuacgucccguacuacuugguccauacaugcgcaucaucaauggaugacaacugaagauauguuaaccguuuggaauagaguuuggaucgaagacaaccccuggauggaagauaaaacaccagucacuacaugggaaaauguacccuaucuaggaaaaagagaagaucaauggugugguaguuuaauuggucugacaagucgagcuacgugggcucaaaacaucccaacugcuauucaacaaguuaggagucuuaucgguaaugaagaauuucuggauuauaugcccucaaugaaacguuuucgcaaggaagaggaaagugaaggagccauuugguaa

SEQ ID NO: 23086 - RNA, 9873 nt, Artificial Sequence
  derived and/or modified CDS sequence (opt6) from DENV-3__GQ868575__SS-prME
accucgcuaugucuaaugaugauacuacccgcagcuuuagcauuucauuuaaccucgagagauggagagccgagaaugauuguggguaaaaaugaacgagggaaaucgcuucuauuuaaaacggcaucagggauaaauaugugcacauugauagcaauggaccuaggagaaaugugugaugacacugucacauacaaauguccgcacauaacagaaguggaaccagaagacauagacugcugguguaaccucacuagcaccuggguuacuuauggcacauguaaucaagcgggugaacaccggagagauaaaaggagcguugcauuagcgccccacguuggaauggguuuggauacaaggacucaaacguggaugagugcugaaggugccuggcgucaaguugaaaaaguagaaacaugggcacucagacaccccggcuucacgauacuugcauuauuccuggcccauuacauagguacaucauuaacccaaaaagccgucauauuuauacuauugaugcuuguaacacccaguaugacuaugagaugcguugggguuggaaauagagauuucguagaaggccuaucaggggccacguggguugacguuguacuagagcacggugguugcgucacaacuauggcuaaaaauaaaccuaccuuagacauagaauuacagaaaacagaagcgacacaauuggcaacauugcguaaacucuguauagagggaaaaauaacaaauauaacuacggauaguagguguccuacccaaggcgaagcaguccuaccugaggaacaagaucaaaauuauguauguaagcauacauacguagauagaggaugggguaacggauguggauuguuugggaaagguagucuuguuaccugugcuaaguuucaaugucuggagccaauagaaggaaaaguaguacaauacgaaaauuuaaaauauacuguaauaauaacaguucauacaggugaucaacaucaaguugggaaugagacccaaggagugacggcugaaaucacuccucaagcaaguaccacugaagcaauauuaccugaauaugggacccuuggauuagaauguucccccagaacaggucuugacuucaacgagaugauauuacuuacuaugaaaaacaaggccuggaugguacauagacaaugguucuucgaucuacccuuacccuggacguccggagcaacuacugagacccccacauggaauagaaaagaacuauuagucacguucaaaaacgcacaugccaagaaacaagaagugguuguacuagguagucaggagggugcaaugcacacugcccuaacaggagcgacugaaauacaaaauuccgggggaacaucuauuuuugcgggacauuuaaagugcaggcucaaaauggacaaacuugaauuaaaaggaaugucuuacgccauguguacuaauaccuuuguacucaagaaagagguaucggaaacacaacauggcacuauucugauaaaaguagaguacaaaggugaagacguaccguguaaaauaccauuuuccaccgaagauggucaagguaaagcccauaauggaagguugauaacggcuaaccccgucgugacaaagaaggaagaaccuguaaauaucgaagcggagccaccauuuggagaaucuaacauaguaaucgguauuggagauaaugcauugaagauuaauugguacaagaaaggcucgucaauaggcaaaauguuugaagcgacggcuaggggcgcacgaagaauggcaauacugggugacacggcgugggauuucgguucaguaggagguguccucaauucacucggaaaaaugguucaucaaauauuugggucugcauauacagcguuauuuucuggagucuccugggucaugaaaauagguauuggugugcuauuaacuuggaucggauugaacagcaaaaacacgucuaugucauucagcugcauagcaauuggaaucauuaccuuauauuuaggugcaguaguacaagccgauaugggaugcgucauuaauuggaaagguaaggaauuaaaauguggaucugggauuuuuguuaccaaugagguacauacuuggacggagcaguauaaauuucaagcagauucccccaagagacuagccacagcuauagcaggggccugggagaacggaguuugcggaauuaggucaacaacaaggauggagaaccuccucuggaaacaaauagcaaaugaacucaauuauauucugugggagaacaauauuaaacuuacuguuguaguaggugacauaauagggguauuggaacaaggcaaacgaacguuaacaccucaaccgauggagcuaaaauacagcuggaaaaccuggggaaaagcgaaaauugucacagcagaaacccagaacuuuucuuuuauaaucgauggaccuaauaccccagagugcccaucggcuucaagggcauggaauguuugggaaguagaagauuauggcuuugggguauuuacaacaaacauuuggcugaaauugagggaaguauauacgcaacuuugugaucauagacuuaugucugcagcuguaaaagaugagcgagcaguacaugcagauaugggauauuggauagaaucacaaaagaaugggaguuggaaacuugaaaaagccaguuuaauugagguuaaaaccugcacauggccuaagagucacacccuauggucgaauggugugcucgaaucggacaugauaauaccgaagucauuggcagguccaauuagucaacauaacuaccgaccugguuaccacacccaaacagcaggaccauggcauuuggguaaauuagaauuagauuucaauuauugugaagggacgacagugguuauuacagaaaauugcggcacacgcggcccgaguuuacguacuaccacuguaucaggaaaacuuauacaugaauggugcuguagaaguuguaccuuaccuccucuucgauauaugggagaggacgggugcugguauggcauggaaauacgaccaauuagugaaaaggaagaaaauaugguuaaaucuuuagucagcgcaggaagcggcgaaguggauaacuucacaaugggcgucuugugucuugcaauacuguuugaagaaguuaugagaggaaaauucggcaaaaagcacaugauagcgggaguauucuuuaccuucguacuauuacucagcggucaaauuaccuggagggacauggcucauacauugauuaugauuggcagcaaugcgucugauaagauggggaugggagucaccuauuuagcauuaauagcaacuuuuaaaauucagccauuucuugcauugggauucuuucuacgaaaauugacaagcagagaaaauuuauuauuagguguagguuuagcuauggcuacaacuuuacaguuaccggaagauauugaacaaauggcaaaugguauagcguuaggacuuauggccuugaaacuaaucacacaauuugaaaccuaucaguuguggacugcacuuauaucguuaacauguucaaacacuauuuuuacgcuaacaguagcauggagaacagcaacucuaauucucgcuggggucucacuguuacccguaugccaaagcaguuccaugcgaaaaaccgauuggcuaccaaugacaguagccgcaaugggcguaccaccccugccuuuauuuaucuucgguuuaaaggauacauuaaaacguagaucuuggcccuuaaacgaaggagucauggcaguagguuuaguaucuauucucgcaucgaguuugcuaagaaacgaugucccaauggcaggaccacuuguagcaggaggucucuuaauugcguguuaugucauuacuggaacuucggcagauuuaaccgucgaaaaagcggccgacgugacaugggaggaagaagcagagcaaacaggcguaucccauaaccuuaugauaacuguugaugacgaugggacaaugcgaauuaaggacgacgaaacugaaaauaucuuaacaguccuauuaaaaacagcauuauuaauagucucaggaauuuuuccguauaguauuccagcaacuuuauuaguguggcauacauggcaaaaacaaacucagcguucggggguucuuugggacguuccaucgccgcccgaaacgcaaaaagcagaauuagaggaaggaguuuaccggauaaagcaacaggggauauuugggaagacgcaaguaggaguuggcguucagaaagaaggaguauuucauaccauguggcaugucacgagaggagcaguacuaacuuauaauggaaagcgguuagaaccaaauugggcgucaguaaagaaagaucugauaucauacgggggagguuggagacucucagcgcaauggcagaaaggagaagaaguucaaguaaucgccguugaaccgggcaaaaaucccaaaaauuuucaaacuaugcccggaaccuuccagacgacaacaggagaaauuggagcaaucgcgcuagacuucaagcccggaaccucagggagucccauuauaaaucgagaggguaaaguaguaggauuauaugguaacgggguaguaacaaagaauggaggcuacgucucaggaauagcacaaaccaacgcugaaccggacgguccgacacccgaacuagaggaagaaauguucaagaaaagaaauuuaacuauaauggaucugcaccccgguucggggaagacaagaaaauacuuaccggcaaucguuagggaagcuaucaagagaagauuaagaacucucauacucgcaccaacacgagucgucgcggccgaaauggaagaggcucuaaagggacuaccuauaagauaucagacaacagccacaaaaucugaacacaccggaagagaaaucguugauuugaugugucaugcgaccuuuacaaugcgacuguuauccccuguucgugugcccaacuauaauuugauaaucauggacgaagcacacuucacggauccugccucaauugcugcgagaggcuauauaucaacuagagucggaaugggugaagcagcagcuauauuuaugaccgcgacuccaccuggaacagcagaugcuuucccgcaaucaaacgcuccgauucaggacgaggagagggauauuccugaacgaucauggaacucaggaaacgaauggauuacagauuucgcugggaaaacugucugguuugugcccagcauuaaggcaggaaacgacaucgcuaauugcuugcgaaagaauggaaagaaaguaauucaauugaguagaaaaacguuugauacugaauaucagaaaaccaaauuaaacgauugggauuuuguagucacaacagauauuagugaaaugggagcuaauuuuaaggcagaucguguuauagauccaagacguugucuuaaaccaguaauauuaacagauggacccgaacguguuauuuuagcagguccuaugcccguaacagcagcuucagcagcccaaagacguggcaggguagggcgaaacccucagaaagaaaacgaucaguacauauuuacaggacaacccuuaaacaaugaugaagaucaugcacacuggaccgaagcuaaaauguuguuggacaauaucaauacaccagaaggaauuauaccagcauuauuugaaccagaaagggaaaaaucugccgcuauagauggagaauaucgacuaaaaggagaaucacgaaaaaccuucguugaacuaaugaggcgaggagaccuaccaguaugguuagcucauaaagucgcuagcgagggaauaaaauauacagaucgaaaauggugcuuugauggucagcgaaauaaccaaauuuuagaggaaaauauggauguagaaaucuggacaaaggaaggagagaagaagaaacuucguccaaggugguuagacgcaagaacuuacucggauccgcuagcucuuaaagaauuuaaggacuuugcugcuggucggaaauccauagcucucgacuuaguuacugaaaucggaagagucccuacucaucucgcucaucguacuagaaaugcucucgauaaucuaguuaugcuucacacguccgaacauggagguaaagccuaucgccacgcuguugaagaacuaccggaaacaauggaaacacuccuacucuugggacucaugauacuucucacagggggugcaaugcuguuccuuauaagcgggaagggcauaggaaaaacaucaauaggccuaauauguguuauugcaaguagcgggauguuauggauggcagaaauaccacuacaguggauagcauccgcuauaguacuugaguucuuuaugaugguucuucugauuccugaaccggagaaacaacgaacgccucaagauaaccagcuugccuauguaguuaucggcauacuuacuuuggccgcaauaauugcugcgaaugaaaugggacuguuagaaaccacuaaacgagaccuuggaaugucaagagagccuggaguaguaagcccaaccagcuauuuagacguugauuuacauccugcuucugccuggacauuguacgcaguagcgacaacuguaauuacacccauguuaagacauacgauagaaaauuccacugcaaacguaucauuagccgcuauagccaaccaagccguaguauuaaugggguuggauaaaggcuggccuaucagcaaaauggacuuaggagucccacuucuagcuuuaggcugcuauucccaagucaauccacucacucuaacugcagcuguccuguugcucauaacucauuaugcaauaauaggaccaggauuacaagcuaaggcaacccgcgaagcucagaaaagaacugcugcaggcauaaugaaaaauccaacaguugacggcaucaugacuauagaucuagacccuguuaucuaugacucaaaauuugaaaaacagcuaggacaagugaugcuauugguccuuugugcuguacaacugcuucugaugagaacaagcugggcauuaugcgaggcucugaccuuagcuacgggaccgauuacgacacugugggaagguuccccagguaaauuuuggaauacaacuauugcgguaucaauggcaaacaucuuuagaggaaguuauuuagcuggagccggauuagcuuuuucaauaaugaaauccguuggaaccggcaaacguggcaccggcucacaaggcgagacgcuuggugaaaaauggaaaaagaaauuaaaucaacugucaaggaaagaauuugauuuauauaagaagucugguauaacugaagucgaucggacugaagcuaaagaaggccuaaaaaggggagaaauaacucaccaugcugucucaagaggaucagcaaaacuacagugguucguugaaaggaacauggugaucccggaagguaggguaauugaucuaggauguggacgaggagguugguccuauuacugcgcuggacucaagaaagucacagaaguucgaggguauacgaaaggugggccaggucaugaagaaccagugccgaugagcacuuaugguuggaauauagucaaacuaaugucagguaaagauguuuucuauuuaccgcccgaaaaaugugauacgcucuuaugcgacauuggcgagaguucgccaucaccuacaguggaagaaagucggacaauaagaguucuuaagauggucgaaccaugguugaaaaauaaucaauuuugcaucaaaguacuaaaccccuauaugcccacgguaauugaacacuuagaacgauugcaacggaaacacggagggaugcucguaagaaauccgcucagccgcaacucaacgcaugagauguauuggauuucaaacggaaccggaaauauaguggcaucaguaaacaugguuaguagacuacucuuaaauagauucacgaugacacacaggcgaccgacaauagaaaaagauguggaucuaggggcagguacacgucauguaaacgcggaaccagaaauaccuaacauggacguaaucggcgaacgaauaaaacgcaucaaggaggaacacaacagcaccuggcacuacgaugacgaaaaucccuauaaaacaugggcauaucauggaucguaugagguuaaagcaacgggaucagcuuccuccaugauuaauggaguaguaaaauuacuaacuaagccuugggauguuguuccaauggucacgcaaauggcgaugacggacacuacgccauucggucagcaacgcgucuuuaaagaaaaagucgauaccagaaccccucgaucgaugccagggacgagaagaguuaugggaauaacggcagaaugguuauggcgaacucuaggucgaaauaaaaagccaagacuuugcacgcgcgaagaguuuaccaagaaaguucgaacaaaugcagcgaugggagcuguguucaccgaggaaaaccaaugggauuccgcgaaagcggcggucgaagaugaagacuuuuggaaauuaguugauagagaacgcgaguugcauaaacuugguaaauguggaucuugcgucuacaacaugauggguaagagggaaaagaaacuuggggaauuugggaaagcaaagggaucaagagccauuugguacauguggcuuggagcccguuacuuggaauuugaagcucuaggguuccucaaugaggaucacugguuuucacgugaaaauagcuacucggguguggagggagaaggacuucauaaauuaggauacauuuuaagggauauaucgaaaauaccugggggagcaauguacgcggacgacacagcaggaugggauacgagaauaacagaagacgaccuacauaaugaggagaaaauuacccaacagauggacccggaacaccgccaacuugcgaacgcaauauucaaacuaacuuaccaaaauaaaguaguuaaggugcaacgaccaacuccuaccggaaccguaauggauaucauaucucgaaaagaucagcgugggucaggacaaguagggacauauggauuaaauacuuuuacaaacauggaagcucaacuuauucgacagauggagggagagggaguacugucuaaggcagaucuagaaaauccccaccuaccagagaaaaagauaacucaaugguuagaaacaaaaggcguagaacgacucaagagaauggcaauuucgggugacgauuguguuguuaaaccaaucgaugacagguucgcgaaugccuuacuugcauuaaacgacaugggaaaaguaagaaaagauauuccccaauggcaaccaaguaaaggauggcacgauuggcagcaagucccuuucuguucacaucauuuucacgaacuaauaaugaaggacggacguaagcuaguuguuccuugcagaccccaggacgaacuaaucggcagagcgaggauaucucaaggcgcggguuggagucuuagagagaccgcaugucucggaaaagcguaugcacagauguggucgcuaauguacuuucauagacgugaccuacggcuagcaaguaaugcuaucuguagcgccguuccaguacauuggguuccaacgaguaggacgacauggucaauacacgcacaucaccaguggaugacgacggaagacauguugacaguuuggaacagaguuuggauagaagacaauccauggauggaagauaagacacccguaaccacaugggagaacgugcccuaucuagguaaaagagaggaucagugguguggcucccucauaggauuaacuucgagagcaacaugggcacaaaauauucccacugcgauacagcaaguacguaguuuaauuggaaacgaagaauuucuggacuauaugccgucaaugaaacgauucagaaaagaggaagaaucagaaggagccauaugguag

SEQ ID NO: 23087 - RNA, 9873 nt, Artificial Sequence
  derived and/or modified CDS sequence (opt6) from DENV-3__GU131953__SS-prME
acgucguuaugucugaugaugauauuaccugcagcuuuggcauuucaccuuacaagucgugauggggaaccacgaaugauagugggcaaaaaugaacgggguaaaaguuuauuauuuaaaacggcuaguggcauaaauaugugcacauugauagccauggaccucggggagaugugcgacgauacugugaccuacaaauguccucauauaacggaaguugaaccagaagauaucgauugcugguguaauuugaccagcaccuggguaaccuacggaacuuguaaucaagcuggagaacauagacgcgacaaacggucaguugcgcuagcaccccauguagggaugggacuagacacucgaacacaaacguggaugagugcagaaggagcauggcgccaaguggaaaaaguugaaacuugggcgcuucggcaccccgguuuuaccauucuugcauuguuuuuggcacauuacaucggaacaagucugacacaaaaagcaguuauauuuauauuacuuaugcuugugacacccucaaugacgaugagguguguuggagucgguaaucgggauuucguagaaggacuuuccggagccacauggguagacgugguccuugaacauggaggcugcguaacaacuauggccaaaaauaaaccgacacuugauauagaacugcagaaaacugaagcgacccaauuggcaacccuacgcaaauugugcauagaagguaaaauuacuaacauaacaacagauaguagaugucccacacaaggagaagccgucuuaccugaagaacaagaccaaaauuacguauguaaacacaccuacguugaccgaggcugggguaacggaugcggguuauuuggcaaagggucacuugucacuugugccaaauuucaauguuuggaaccaauagaaggcaaaguagugcaauacgagaaucuaaaauauacagugauuauuaccguacacacaggugaucaacaucaaguaggcaacgagacacaaggcguaacugcggagaucacaccacaggcaucaacuacagaggcgauuuuaccugaauacggaacguuaggguuagaauguucuccaagaaccggcuuagauuuuaaugagaugauucuauuaacaaugaaaaacaaagcguggaugguccacagacaaugguuuuucgaucuaccacuuccauggacauccggagcuacgacagaaacccccaccuggaauagaaaagaguuacugguaacauuuaaaaacgcacaugcuaaaaagcaagagguugugguguuagguucucaggagggagcaaugcacaccgcauuaaccggagcuacggaaauucaaaacuccggaggaacuucuaucuuugcaggccaucugaaaugcagauugaaaauggacaaauuagaauugaaagguaugucuuaugcaauguguacgaauacauuuguucucaagaaagaaguaagugaaacacagcauggaacuauauuaauuaaaguagaauauaaaggcgaggacgugccauguaagaucccuuucucgacagaagacggucaggguaaggcacauaacggaaggcuuauuaccgcuaauccgguuguaacgaagaaagaagaaccuguaaauaucgaagccgaaccaccguuuggagagaguaacauagugauagguauaggcgauaacgcacuaaagauaaacugguauaaaaaggguucgaguauugggaaaauguucgaagcaaccgccagaggggccaggagaauggcgauucuaggagauacagcuugggacuucggauccgugggaggaguacucaacucacuaggaaaaaugguccaucaaauauucggaagugcuuacacagcucuauuuaguggggucagcuggguaaugaagaucggaauaggcguauuacuaacauggauugguuuaaacaguaagaauacuucaaugaguuuuaguugcaucgcaaucgguauaaucacgcuuuaccucggagcuguggugcaagcggacaugggaugugucauaaacuggaaggguaaggaguugaaguguggcagcgguauuuuuguuacuaaugaaguccauacauggacagaacaauauaaauuccaagcggacucacccaaaagacuugcaaccgcuauugcuggcgcuugggagaacggaguaugcgguauucgaucuacaacucggauggagaaucuacuguggaaacaaauagcuaaugagcuuaacuacauauugugggaaaauaauauaaaauuaacagucguuguuggagauaucauuggaguccuugaacaaggcaaacgcacauuaacaccacagcccauggagcugaaguauucauggaaaacauggggaaaagcaaaaaucguaacggcagaaacacagaacaguucauucauaauagauggacccaacacaccugaaugcccuucugcaaguagggccuggaaugugugggaggucgaagacuacggauuuggaguuuucaccacgaauauaugguuaaaacuaagggaaguuuauacucaauuaugugaccaccgccucaugagugcggcgguaaaagaugagcgagcaguacaugccgauaugggauacuggauugagagucagaaaaaugguucuuggaaauuagagaaagcgucuuugaucgaaguaaaaacauguacuuggccgaaaagccacacacuauggucgaaugcaguccuggaauccgacaugauaauuccaaaaucuuuagcagguccgauaucccaacauaacuauagaccaggauaucauacacagacagcagguccauggcacuuggguaaauuggaauuagacuucaauuacugugagggcacuaccguuguaauaacagaaaacuguggaacaagaggaccgucauuaagaacuacaacagucucaggaaaauuaauucaugaauggugcugccgaagcugcacacuuccaccucuuagauauaugggggaagaugggugcugguauggaauggaaauacgcccgauaucugaaaaagaagaaaauaugguuaagucauuagucagcgcaggaaguggagaaguugauaauuuuacuaugggggugcugugcuuagcaauucuuuuugaggaagugaugcgaggaaaauucggcaagaaacauaugauagcuggaguauucuuuaccuucguccuccuacuuagugggcaaaucacauggagagacauggcucauacacuaauaaugaucggaucaaacgcuucagauagaauggguauggguguaacauaucucgcguugauugcgacauuuaagauucagccauuuuuagccuuaggauucuuucuacguaaauuaacaaguagggaaaauuuacuucugggagugggguuggcaauggcaacuacacugcaguuacccgaagauauagagcaaauggcaaacggaauugcucucggucuuauggcacucaaacuuauaacccaauuugaaacguaccaguuauggacagcucugauaagucugaccuguucaaauaccauuuuuacuuuaaccguugccuggcguacagcuacgcucaucuuagcaggggugagcuuauugccuguaugccaaaguaguucaaugagaaagacugauuggcuaccaaugacaguggcagcgaugggagucccuccucuaccguuguuuaucuucucauugaaagauacuuugaaaagaaggaguuggccucuuaaugaaggcguuauggcaguagguuuaguaaguauacucgcgaguucucucuuaagaaacgacguaccaauggcugggccucuaguagcuggaggauuauuaauugcauguuacguaauaacaggaacauccgcagauuuaacagucgaaaaggcagccgacguuacaugggaagaagaggcggagcaaacgggaguaagucauaacuuaaugaucacuguugaugaugacggaaccaugagaauaaaagacgaugagacggaaaauauuuuaacaguacuccuaaagacugcucuacucauagugucuggaauuuucccauauaguauaccggcuacacuguuagucuggcacaccuggcaaaaacaaacucagcgaucaggagucuugugggacgugccgucaccuccggaaacacaaaaagcggaacuggaagaaggagucuacagaauaaaacaacaaggaauuuucggcaaaacacaggucgguguagguguacaaaaagagggaguuuuucacacaauguggcaugucacgcgcggagcaguguugaccuauaaugguaaaagacuagaaccuaauugggcaaguguaaagaaagaccuuauaucauauggcggaggguggagacuguccgcucaauggcaaaaaggagaggagguccagguaauugcuguggaaccgggaaagaauccgaaaaauuuucaaacuaugccaggaacguuucaaacaacaacaggcgaaauaggagcuaucgcguuagauuuuaaacccgggacaucaggguccccgauaauuaaccgagaaggcaagguaguaggguuauaugggaacggaguugucacaaagaacgggggauacguuagugguaucgcacagacuaacgcggaaccugaugguccaacgccagaauuagaagaagagauguuuaagaaacgcaaucuaacaauaauggaucuacauccuggcagcgguaaaacuagaaaauaucuaccggccauaguuagggaagcuaucaaacgaagguugagaacgcucauauuggcuccaacaagagugguagcugcugaaauggaagaggcuuuaaagggauuacccauucgauaucagaccaccgcaaccaaaucagaacauaccgguagggaaauaguagaucuuaugugucacgcaaccuuuacuaugcgauugcuaucaccagugagagugccaaauuauaaucuaaucauaauggacgaagcacauuuuaccgaucccgcuaguauugcugcuagaggauauauaucaacgagagucggaaugggugaagcggcugcaauuuuuaugaccgcaacaccaccgggcaccgcugaugcauucccacaauccaacgcaccaauccaagaugaagaaagagauauacccgagaggucuuggaacucugguaacgaguggauaaccgacuucgccgggaaaacuguuugguucguuccuuccaucaaagcaggaaacgauauagccaauugucuacgaaagaacggcaagaaagucauacaguuaagcagaaaaacuuuugauacagaauaccagaaaacuaaacuaaacgauugggauuucgugguuacuacggacauaucugaaaugggcgcgaacuuuaaagcagacagagucauugauccuagaagaugccucaagcccguaauacugacggaugguccugaaagagugauauuagccgguccaaugcccguaacagcagccagcgcagcgcaacgacgggggaggguaggacggaacccucaaaaagaaaaugaucaauacauauuuacuggucagccacugaacaaugaugaagaccaugcccauuggacagaagcaaaaaugcuauuagacaauaucaacacuccagaagguauaauaccagcucuuuuugagccagagagagagaagucagccgccauagauggugaauaccgccucaaaggagaaucucgaaagacauuugucgaguugaugagacgaggugaucuacccguauggcuugcccacaagguggcgagugaagggauuaaauacacagauaggaaauggugcuuugauggccaaaggaauaaccagaucuuggaagaaaauauggacguggagauauggacgaaggagggugagaaaaagaaacuucggccuagaugguuagaugcaagaacuuauucagauccucuugcauuaaaagaauuuaaagauuucgcugcagguaggaaaucaauagcccuugaccuuguuacugagauuggacgagugccaacacaccuggcacauagaacuagaaaugcuuuagauaacuuaguaauguuacauacgagcgagcauggagggaaagcauacagacaugccguagaggaacucccagaaacaauggagacauuauuauuauuagggcuaaugauacuccuaacagguggagcuaugcucuuuuuaauuucgggaaaagguauaggaaaaacaaguaucggacuaauuugcguaauagccaguucugggauguuauggauggccgaaauaccccuacaauggauugcuagcgcaauaguccuagaguuuuucaugaugguccucuuaauacccgaaccugaaaagcaacgaacuccacaggacaaucaacucgcauauguuguuaucgggauacucacccuugcagcaauaaucgcagcuaacgagauggguuuacucgagacaaccaaaagagauuuggguauguccaaggagccaggugucguaucaccaacaagcuaccucgacguagauuuacaucccgcuagugcguggacacucuaugcaguagcgacaacaguaauuacaccaauguuaaggcacaccauagaaaacuccacagcaaauguuucguuagcagcuauugcgaaucaagcaguaguacuaaugggccuagacaaagguuggccuaucucaaaaauggacuugggaguaccauuauuagcauuggguugcuacagccaaguaaacccuuuaacuuuaacugccgcaguucuccuauuaauuacacauuaugcaauaauagguccggguuugcaagcuaaagcaacucgagaggcacaaaaacguacugcugcaggaauaaugaaaaaccccaccguugacgggaucaugaccauagaccuagacccgguaaucuaugauucuaaguucgaaaaacaacucgggcaagucaugcuauugguauuaugcgcuguucagcugcuacugaugagaacguccugggcacuuugugaagccuuaacuuuagcgacaggaccgauuacaacuuugugggagggaagcccagguaaguuuuggaacacaacgaucgcugugucaauggcuaacauauucagagguagcuauuuggcuggugcaggacuggcguucagcauaaugaaaucaguuggaacugguaaaagaggaacagguucucaaggagagaccuugggggagaaauggaaaaagaaauugaaucaauugagucggaaagaauuugaccuauauaaaaagucaggaauaacagagguugaucguaccgaagcaaaagaaggucugaaacgaggggaaauaacacaccaugcgguuucaagggguagcgcaaaacugcagugguuugucgagagaaacaugguaauaccggaaggccgugucauagauuuggguugcggaagagggggaugguccuauuauugcgcaggccugaagaaaguaacugagguuagaggguacaccaaaggcgggccaggucacgaagaaccgguuccaaugucaacauaugguuggaauauugugaaauugaugucaggaaaggaugucuucuaccuucccccugaaaaaugugauaccuuacuaugugauauaggagaaaguaguccaaguccgaccguagaggaaagccgaacaauuagaguucuuaagaugguggaacccugguugaaaaauaaucaauuuuguauaaaagugcuaaauccguacaugcccacuguaaucgaacaucuagaacgacuacaaagaaaacacggcggcauguuaguacggaauccccuauccagaaauaguacucacgaaauguauuggauuucaaacggaacuggaaacaucguggcuaguguaaauaugguaucccgacuacuucuaaaccgcuuuacaaugacucauagaagaccaacuauagaaaaagacguagacuuaggugcaggaacacggcaugugaaugcagaacccgaaacaccgaauauggauguuauaggagagcgcauaaaacgaauuaaagaggaacauaacagcacguggcauuacgaugaugaaaauccguauaagacaugggcauaucacggcucauaugaagugaaggccacaggaucagcgaguuccaugauaaauggcgucgucaaacuacucacuaaaccuugggauguaguuccaauggucacucagauggccaugacagauacgacacccuucggacagcagcggguuuucaaagaaaaaguugacacuagaacuccucgaagcaugccaggaacacguagagugauggaaauuacagcggagugguuauggagaacucuaggaagaaauaagaaaccuagacuauguacacgugaagaauuuacuaagaaaguuaggacaaacgcugcaaugggagcuguauucacagaagaaaaucaaugggauuccgcuaaggcggccgucgaagaugaggacuuuuggaaacuugucgaccgugagcgcgaauuacacaaacucggcaagugugguucuuguguauauaauaugaugggaaaaagagagaagaaacuaggugaauuugguaaagcuaaagguagcagagcaauuugguauauguggcuuggggcaagauaccuggaauuugaagcccucggcuuucucaaugaggaccacugguuuagucgugaaaacucauacaguggaguagaaggggaaggguuacacaaguuaggcuacauccuaagagacauaucaaaaauaccaggaggugcgauguaugcagaugauacggccgguugggauacacguauaacugaagaugacuuacacaacgaagagaaaauuacacaacaaauggauccagaacaucguuuauuagcuaaugcgauauuuaagcuaacuuaucagaacaaaguaguaaaaguccaacgaccuaccccgacugguacgguuauggauauaauaucgcgaaaagaucaaagaggcaguggucaaguugguacauauggacuaaacacuuucacaaacauggaggcgcaguuaauuaggcaaauggaaggagaaggaguacugucaaaagcagauuuagaaaauccacaucuaucugagaagaaaguuacacaaugguuggagacaaaagguguugaaaggcuaaaaagaauggcaauuucuggggacgacugcguuguaaaaccaaucgaugaucgcuuugcaaacgcccuacuagcucuaaaugacauggguaaaguuagaaaagauauaccucaauggcaaccuaguaaaggguggcacgacuggcagcaaguuccguucugcagccaucauuuucacgaacucauuaugaaagacggacgaaaauuggucguuccgugcaggccccaagaugaauugauaggcagggcccgcauuucccagggugcaggaugguccuuaagggaaacagcuugccugggaaaggcuuacgcacaaauguggucauuaauguacuuccaccgaagggaucuuagauuggcuagcaacgccaucugcucggccguuccgguacauuggguacccacaucaagaacuacaugguccauccaugcacaucaucaguggaugacuacagaagauaugcuaacaguauggaacagaguauggaucgaggacaaucccuggauggaagauaaaacacccguaacaacaugggaaaauguuccuuauuuaggcaaacgcgaggaccaauggugcggaaguuuaaucggccuaacaucacgggcgacaugggcccaaaacaucccaacugcaauccagcagguaagaaguuugaucggcaaugaggaguucuuagacuacaugccaucaaugaaaagauuuagaaaggaggaagaaagugagggagcaauaugguaa

SEQ ID NO: 23088 - RNA, 9873 nt, Artificial Sequence
  derived and/or modified CDS sequence (opt6) from DENV-3__GQ868577__SS-prME
accaguuuaugcuugaugaugauucuuccugcggcuuuagcauuucacuuaacaucucgggacggagaaccgcguaugauaguuggcaaaaaugaaaggggaaaaaguuuacuauucaaaacggcuaguggaauaaauaugugcacuuugauugccauggacuuaggagaaaugugugacgauacgguaacauauaaaugcccacauaucacagaaguagaaccggaagauauugacugcugguguaaucuaacgagcacauggguuaccuacggaacaugcaaccaggcaggagaacacaggagggauaaaagaucaguagcacuugcgccccauguaggaauggggcuugacacacguacccaaacuuggaugagugcagaaggagcuuggagacaagucgaaaaaguagaaacaugggcacuaagacacccaggauuuacuauccuagcauuauuccuugcacacuacauuggcacaucguuaacccaaaaaguuguaauuuuuauccuuuugaugcuagugacucccucaaugacaaugcguugcguugguguaggcaauagggauuuuguugaagguuuaucgggagcaacaugggucgacguaguauuagaacauggggguugugugaccacuauggcgaaaaacaaaccuacacuggacauagaacuucaaaagaccgaagcaacucaauuagcaacauugagaaaacuguguauugaaggcaaaauaacaaacauaacaacagacagcagaugcccaacacaaggggaagccguucugccugaagaacaagaucaaaauuauguuuguaaacauacauaugucgauagaggcuggggcaacgguugcggccuauuuggaaaagggaguuuaguaacuugugcaaaauuucaaugucuagaaccaaucgaagguaaagucguccaauaugaaaauuugaaauauacugucauaauaaccgugcauacgggagaucaacaccaagucgggaaugaaacucaaggaguuacagcagaaauuacaccucaggcuucaaccacagaagcuauauuaccggaauauggaacccuaggacuggaauguaguccgaggaccggacuagacuuuaaugaaaugauauuauuaacgaugaaaaauaaagcguggaugguacauagacaaugguuuuucgauuuaccccucccuuggaccaguggagcaacaaccgaaacuccaacguggaaccgaaaagaacuauuaguaacuuucaaaaaugcacacgccaagaaacaagaaguggucguauuaggaucccaagaaggggccaugcacacagcacuaacuggagcuaccgaaauccaaaauucaggagggacaucgaucuucgcuggucacuugaaauguagacuaaaaauggacaaacuagaacuuaaaggaaugaguuaugcgaugugcaccaacaccuuuguauuaaagaaagaaguaucugaaacacagcauggaacuauucucaucaagguugaauauaaaggugaagaugugccaugcaaaauaccuuuuucuacagaggacggacagggcaaggcccauaacggaagauuaauaacagcaaauccugucguaaccaagaaagaggaacccguaaacauugaagcagaaccuccuuuuggggagucuaauauaguaaucggaauaggggacaacgcucuuaaaaucaacugguauaagaaaggaaguucuauaggaaaaauguucgaagcaacggcucgaggcgcaagaagaauggcaauacucggagauacggcgugggacuucggaagcguaggugguguucuaaauucauuaggaaagaugguccaucaaaucuuugggucagcauacacugcacuguucucaggagugagcuggguaaugaagauaggcaucggagugcucuuaacguggauaggucucaauucuaaaaauaccucaauguccuuuaguugcauagcaauagguauuaucacucuauaucuaggugcagucguacaagcagauauggguuguguuauaaauuggaaaggcaaagaacugaaaugcgggucggguauuuucgucacgaaugagguccauacauggaccgaacaauacaaguuucaggcagacagcccaaagagacuagccacugcaauagcgggugcaugggagaauggcguauguggaauacgcagcacaacuaggauggaaaacuuauuauggaagcaaauagcuaacgaguuaaauuacauuuuaugggaaaauaacauuaaauuaacaguugucgugggcgacauuauaggcgugcuugagcaagggaaaagaacacugacaccgcaaccaauggaacuuaaauacucguggaaaaccugggggaaggcgaagauaguuacugccgaaacucagaacucgucguucauaaucgacgguccuaauacgccagaaugucccucugccagucgugccuggaacguuugggaaguggaagauuauggcuucggaguuuucacuaccaauauauggcuuaaauuaagagaaguguauacucaauuaugcgaccaccgguuaaugagugcagccguuaaggaugaaagagcagugcacgcagacauggguuauuggauagaaucucagaagaacggaucauggaaacuagaaaaggcuucccuaauagaagucaaaaccuguacguggccuaaaucacacacuuuauggucuaacggaguauuagaaucugacaugauaaucccaaaaucauuagcaggaccaauuucccaacacaauuauagacccgguuaccauacgcaaacagcuggaccauggcaccuugggaaauuagaguuggauuuuaacuauugcgaggguacuacaguuguaauaacagaaaacuguggaacgagaggcccuagccuaaggacaacaacggucaguggcaaacucauacaugaaugguguugcagaucauguacacuuccgccccuucguuacaugggagaagacgguugcugguauggaauggaaauuagaccuauaucugaaaaggaagagaauauggugaaaagccuaguuuccgcaggauccggggaaguagauaauuucacaaugggcguauuauguuuagcuauuuuguuugaagagguaaugagaggaaaguuuggcaagaaacauaugauagccgggguauucuuuacauuuguucuacuucuuucuggacaaauuacuuggagggacauggcacauacgcuaauuaugauaggguccaacgccucggaucgcaugggaaugggaguuacuuaucucgcguugauagcaacauuuaaaauccagccauuuuuagcccucggauucuuucugagaaaauugacgucgagagaaaauuuauuauuaggugugggccuugcaauggcuacaacacuacaacuccccgaagauauugaacaaauggccaauggcaucgcacucggguuaauggcacuaaaacucauuacgcaauucgaaaccuaucagcuauggaccgcacuaauuucacuaacauguaguaauacaauauucacuuugacuguugcguggagaacagcaacacuuauccuagccggugugucacuacucccuguuugucagucaucaagcaugcgaaaaacagacugguugccuaugacuguagcggccaugggugugccaccacucccguuguucauauuuucauuaaaagacacccugaaaagacggucauggccucugaaugaagguguaauggccguugguuuaguaaguauuuuagcuucgucauuauuaaggaacgaugucccgauggcagguccucuagucgcaggcgggcuacucaucgcauguuauguaaucacaggaacuagcgcugaucuaacaguagaaaaagcagcugauguuaccugggaagaagaagcggaacaaacagggguaucccauaaucuaaugauuacaguugacgaugaugguaccaugaggauuaaagacgacgaaacagaaaauauccugaccguacuacuuaagacagccuuauuaaucguaagcggaauuuuuccauacucuauaccagcuaccuuacuuguuuggcauacguggcagaaacaaacucaacgcagugguguucuaugggaugugccaaguccaccagaaacacaaaaagccgaacuagaggaaggaguuuauagaauaaagcaacaaggaauauucgggaagacacaagucggcguaggaguucaaaaagaaggcguauuccauacgauguggcauguuacacgaggagcuguucuaacuuauaauggcaaacgauuagaaccuaacugggcuucuguuaagaaagauuugaucagcuauggaggcgguuggcgccuauccgcgcaauggcagaaaggagaggagguacaaguuauugccguagaaccggggaaaaacccuaaaaauuuucaaacaaugccaggcacauuccagacaacuacgggagaaauaggagcuauugcucucgacuuuaaaccaggaacaucgggaaguccgauaauuaacagagaggguaagauuguuggauuauauggaaauggggucgucacgaaaaacggugguuacguuucggguauugcacagaccaacgcugaaccagacggaccaacaccugagcuagaggaagagauguuuaagaaaaggaauuuaacuaucauggauuuacauccgggaucaggcaagacgagaaaguaucuaccugcaauaguucgcgaggcaauaaaacgucgccuacgcacuuuaauacuggcuccuaccagaguugucgcggcugagauggaagaagcacugaaaggauuacccauuagauaucaaacaacagcaacuaaauccgaacacaccgguagagaaauaguggacuuaaugugccaugccacguucacuaugagauuacucaguccaguuagggugccaaauuauaaccuuauaauuauggacgaagcacauuuuacggauccagccagcauugcagcaagagguuauaucucgacuagggucgguaugggagaagcggcagcuauauuuaugacugcaacaccaccaggaacggcggacgcauucccucaaagcaaugcucccauacaggaugaagaacgugauauaccugaaagaaguuggaacucugggaacgaauggaucacugacuucgcuggcaaaacgguuugguucguaccgucgauuaaagccgguaaugauaucgcuaauugucuacguaaaaaugguaagaaaguaauacaacucucuagaaaaacguucgacaccgaauaucagaaaacgaagcuaaacgacugggauuucgugguaacuacagauauaucugaaaugggagccaauuucaaggcagaucguguaauagauccaagaagauguuugaaaccaguaauuuuaaccgacgggccggaaagaguuaucuuggcagguccgaugccaguaacagcugccuccgcagcacaacgaagaggucgaguuggacgcaacccgcaaaaagaaaacgaccaauacauuuucacuggucaaccacuaaauaacgacgaggaucaugcucauuggaccgaagcgaaaauguuacuugauaauauaaauacgccagaaggaauaauucccgcguuguucgaaccugaacgcgagaaaagugccgccauugauggagaguacagauuaaaaggagaaagccgaaaaacguucguggaacuaaugcggagaggggauuuaccaguguggcucgcuuacaaaguagccucugaagggaucaaguacacugauagaaaaugguguuuugauggacaacgcaacaaucaaauucuggaagaaaauauggacguagaaauauggacgaaggaaggugagaagaaaaagcugagaccaagauggcuagacgcgaggaccuauagcgaccccuuagcuuuaaaagaguucaaagauuucgcagccggucgaaaaucaaucgcauuggauuuagugacagaaauaggaagaguuccaacucacuuagcccaucggacgcgaaacgcucuagacaaucugguaauguugcacacaucagagcacggaggaaaggccuaccgacacgcuguugaagaauuaccugaaacaauggaaacauuacuucuacugggcuugaugauuuuauuaacagguggcgcuauguuauuucuaauuuccggaaaggguaucggcaaaacauccauaggauuaauuugcgucauagcaaguucggggaugcuauggauggcugaaauuccacuacaauggauagccagugcaauuguauuagaguucuucaugaugguuuuauuaauacccgaaccugaaaaacagcgcacaccgcaggauaaccaguuggcguacgucguaauaggcauucuaacauuagcagcaauuauugcagcgaaugaaaugggacuucucgaaacuaccaaaagagacuuagguaugaguaaggaacccgggguaguaucaccaacaaguuaucuugacguagaccuucacccggcaagugcguggacguuguaugcaguagcaacuacaguaaucacaccaaugcuaaggcauacuauugaaaauucaaccgcuaacguuucccuagcugccaucgcaaaucaagcaguuguauugaugggacuagacaaaggcuggccgauuaguaaaauggaucuaggagugccccuuuuagcucuagguugcuauucucaaguaaauccacugaccuuaacugcagcugugcuucuccuuauaacccauuaugcgaucauaggaccuggucuacaagcaaaagcaacaagagaagcacaaaaacguacagcugcugggauaaugaagaacccuacugucgacggaauuaugacaauugaccuagacccaguaauauaugacucaaaguuugaaaaacagcuugggcaagugaugcuguuaguacuaugcgcgguucaauugcuacugaugcgcaccucaugggcauuaugugaagcccucacucuugcgaccggaccaauaacgacuuuaugggaaggaucaccuggaaaauuuuggaacacuacaauugcaguuaguauggccaauaucuuuagaggcuccuauuuagcuggugcaggauuagcauucagcauaaugaaaagcguugggacaggaaaacgaggaacuggcagucaaggagaaaccuugggagagaaauggaagaagaaacuaaaucaguuaucgcgaaaagaauuugaucuuuacaaaaagaguggaauuacagaggucgaucggacugaggcuaaagaagggcuuaaacgaggugagauuacucaccacgcagucucacggggaucagcuaaacuacaaugguucgucgaaagaaacaugguaauaccagaaggcagaguaaucgauuuaggaugcggacggggugguuggucauauuacugcgcuggacuaaagaaaguaacagaagucaggggauacacaaaaggcgguccuggucaugaagaaccuguacccauguccaccuacggauggaacauaguaaaauugaugagcgggaaagacguauuuuaccuaccgccagaaaaaugugauacccuacuaugugauauuggagaaucaagcccaagucccacuguugaagaaucgcgcacaauaagaguacucaaaaugguagaaccuuggcuuaaaaauaaucaguucugcauaaaaguauugaaucccuacaugccuacgguaauugaacauuuagaacgauuacaacgaaaacauggugggauguugguaagaaacccacuaucuagaaacuccacucaugagauguauuggaucucgaacgguacgggcaacauaguagccagugugaauaugguuucucgauuacuucucaacagguuuacgaugacacaucguagaccaacuauugagaaggacguugauuugggugcgggcacucgacauguaaaugcagagccagagacgcccaacauggaugucaucggagaaaggauaaagagaauaaaggaagaacauaauucuacauggcauuacgaugaugagaauccauauaaaaccugggcauaccacggaucguaugaagucaaagcaacggggucagccagcagcaugaucaacgguguaguaaaacuauuaacaaagcccugggacguugucccaaugguuacacaaauggcaaugacagacacuacuccuuucggucaacaacgcguuuucaaagaaaaggucgauacgcggacuccacgaaguaugccaggaacgaggcgaguaauggggauuaccgcugaauggcuuuggagaacauuaggacgcaauaaaaagccccgucuauguacaagagaagaguucacgaagaaaguuaggacaaacgcagcaaugggugccguguucacugaagaaaaccaaugggacucagccaaagcagcggucgaagaugaagauuuuuggaaacuuguugauagggaacgcgaauuacauaaacuugguaaauguggaucgugcguuuacaacaugaugggaaaacgugagaagaaacuaggcgaguucggaaaggcuaaaggguccagagccauuugguauaugugguuaggggcacgauaccuugaauuugaagcacuaggauuuuuaaaugaggaccacugguucuccagagagaauagcuauaguggaguugaaggcgaagggcuacacaaguugggguauauacuucgcgauauaagcaaaauaccagguggagcgauguaugcugaugauacagcuggcugggacacgagaauaacagaggaugacuuacacaacgaagagaaaauuacacaacaaauggaccccgaacauaggcaguuagcgaaugcgauauuuaaacucaccuaccagaacaaaguagucaaaguacagcgaccuacacccaccggaacggucauggauauaauaucacguaaagaucaaaggggaucugggcagguuggaacuuacggauuaaacacauuuacgaacauggaggcacagcucauacgucaaauggagggggaagguguuuuaagcaaagcugaccuggaaaauccacacuugccagagaagaaaauagcacaguggcuagaaaccaaaggcguagaaagacuuaagagaauggcgauaucaggcgaugacuguguagugaaacccaucgaugauagauuugcuaaugcacuacuggcacuuaacgauauggguaagguccggaaggacauaccucaauggcaaccuuccaaaggcuggcaugacuggcaacaaguucccuuuuguagucaucauuuucaugaguugauaaugaaagauggccguaaauuagucguaccaugucguccacaggaugagcuuauagguagagcaagaauuucacaaggugcaggcuggucauuaagagaaacagcaugucugggcaaagcauacgcccaaaugugguccuuaauguacuuucacaggagagaccugcgacuugccucuaacgcaauuuguucugccguucccguacauugggugcccacauccaggacuacuuggucaauacaugcacaucaucaauggaugacuacggaagacaugcuuaccguauggaauagaguauggauagaggauaauccauggauggaaaauaaaacaccgguuacaacuugggaaaacgugccauaucugggcaaacgagaagaccagugguguggauccuugauuggacuuacaucucgugcuaccugggcacaaaacauucccacagcaauacaacaaguuagaagucuaauaggaaacgaagaauuucucgacuacaugccgucaaugaaacguuuucgcaaggaagaagaguccgaaggagcaaucugguaa

SEQ ID NO: 23089 - RNA, 9873 nt, Artificial Sequence
  derived and/or modified CDS sequence (opt6) from DENV-3__GU131954__SS-prME
acaaguuuauguuuaaugaugauccuuccugcagcauuggcuuuucaccucacuuccagagacggagaaccacggaugauaguuggcaaaaaugaaagagguaaaucauuguuauuuaaaacagcauccggaauaaauauguguaccuugauagcuauggaucucggagaaaugugugacgauacggugacauacaaaugcccgcauauaacagaaguagaaccagaagauauagauugcuggugcaaccuaacgucuacgugggugacuuacgggacuuguaaucaagcuggagaacauaggagagauaaaaggaguguagcauuagcaccgcaugucggaaugggucuagauacccgcacacaaacauggaugagcgcggaaggggcuuggcgacaggucgaaaaaguagaaacgugggcacuaagacaucccggauuuacaauucucgcucuuuuucuugcacacuauaucggaacuucacuaacccagaaaguggucauauucauucuacuaauguuagucacuccgucgaugacaaugagaugcguaggagugggaaaccgagauuuuguugaaggucuuagcggggcaaccuggguagacguagucuuagaacacgguggauguguuaccacuauggccaaaaacaaaccuacacuggauauagaauuacagaaaacugaagcuacacaauuggccacccuacggaaauugugcauugaaggaaaaauuacaaauauaacuacagacaguaggugcccaacacaaggugaagcaguuuuaccugaagaacaagaccaaaacuacgucuguaagcauacguaugucgaucgcggauggggaaauggaugcggauuauuugggaaagggagcuuaguaacaugugcaaaauuccaaugucucgaaccaauugaagguaaaguaguucaguaugaaaauuuaaaauacaccguaauaauaaccguucauacgggagaccaacaucaaguaggaaaugaaacacagggaguaacagcugaaauuacgccacaagcaaguaccacugaagcuaucuuaccugaauauggaacacuaggauuagaaugcuccccuagaacuggauuagauuucaaugaaaugauauuauuaacuaugaagaacaaggccuggaugguccacagacaaugguucuuugaucucccccuuccauggaccaguggagccacaacagaaacaccuaccuggaauagaaaagaacuucuuguuacauuuaaaaacgcacacgccaagaaacaggaaguaguagucuuaggaagccaagagggagcaaugcacacugcauugacaggagcaacagagauucaaaauagcggaggaaccucaauuuuugcuggacauuuaaaaugcaggcuuaaaauggacaaauuagaacuaaaaggaaugaguuaugccaugugcacgaacacauucguacuaaagaaagaggugucagaaacacaacaugggacgauauuaauuaaaguggaauacaaaggcgaagacgugcccuguaaaaucccauuuagcacggaggacgggcaaggaaaagcacauaauggccgccuuauuacugccaacccggugguaacaaagaaagaagaaccuguuaacauugaagcggagccacccuucggugaaucuaauaucguaauaggaaucggugacaaugcacuaaaaauaaauugguacaaaaagggaucaucaauuggcaaaauguuugaagccacagcucgcggggcccgaagaauggcgauucuaggagauacagcaugggauuuuggcagugucggagggguucuaaauucacuugguaaaaugguacaccaaauauucggcucugcauauacagcccuauucucaggcgugaguugggugaugaaaauaggaauaggaguucuucuaacguggauuggacuaaauaguaaaaacaccaguauguccuuuaguugcauugcaauugguaucauaaccuuauacuugggggccguggugcaagcagauauggguuguguaauaaauuggaaagggaaagaacuaaaguguggaucuggaauuuuuguuacgaacgaaguacauacauggacagaacaauacaaauuucaagcagacucacccaaacgauuggcgacagcgauagcaggcgccugggagaauggugugugcggcauacgaucaacuaccagaauggaaaaucuauuauggaaacaaauugcaaaugagcuuaacuacauacuaugggaaaacaacauuaaguuaacaguuguuguuggggauauaauagguguguuagagcaaggaaaacguacucuuacuccucaaccaauggaauuaaaauauucuuggaaaacguggggaaaagcgaaaaucguaacagcagaaacucaaaauucgucuuucauaauugauggaccuaacacaccugaaugccccucugcaucccgugcuuggaacgucugggaaguugaagauuaugguuucgggguguuuaccacgaauauaugguuaaaguuaagggaagucuauacucaacuaugugaucaucgccugaugucagcagcaguaaaggaugagagggcuguacaugccgacaugggcuacuggaucgaaucucagaaaaacggaucguggaaauuagaaaaagcaucucugauagaagugaaaacuugcacauggcccaagagccauacucuaugguccaauggugucuuagagucagauaugaucauaccuaaaaguuuagcugguccaauuucacaacacaacuaccgacccgguuaccauacacaaacagcuggacccuggcaccuaggcaaauuagagcucgacuuuaauuauugugagggcacaacaguaguaauaacagaaaacugcggcacaagaggaccaucacuaagaacaacaaccguaucugguaaauuaauucacgaguggugcuguagguccuguacacuaccaccuuugagauauaugggagaagauggaugcugguacgggauggaaauaagaccuaucucagaaaaggaagaaaacaugguaaagucacuuguaagugcaggaucgggugaaguugauaauuuuacaauggggguccugugccuugcuauacuauuugaagaaguaaugagaggcaaguucggaaagaagcauaugauugccgguguguucuuuaccuucguacuucuccucaguggacaaauaaccuggagagauauggcacauaccuugaucaugaucggaucgaaugccuccgauagaauggguauggggguaacguaucucgcccuuauagccacauucaaaauccagcccuuucuagcacuaggauuuuucuugcgaaagcucaccucaagggaaaauuuacuucuggggguaggacuagcaauggcuacgacauuacaauuaccugaggacauugaacaaauggcuaaugggauugcacugggacuaauggccuuaaagcuaauuacgcaauuugaaacguaucaacuuuggacagcguuaaucagucucacauguaguaauacaauauuuaccuuaacaguagcauggaggaccgcaacccucauacuugcggguguuucgcucuuaccagucugucaaagcucaaguaugagaaaaacagacugguuaccuaugacaguagcagcaaugggaguaccuccccuaccacuauuuauauuuagccuaaaagauacguugaaacgaaggucauggccacuuaaugaaggaguaauggcaguaggacuuguuagcauucuagcuuccucguuauugcgaaaugacgugccuauggccgggccucuagucgcaggcggcuuacucaucgcauguuaugucauaacaggaacaagugcggauuuaaccguugagaaagcugcugacguuaccugggaagaagaagccgaacaaacaggaguuagucacaaucuuaugaucacgguagaugaugacgggaccaugcggauuaaagaugaugaaacugaaaauauacuaacuguuuuacuaaagacggcauugcuuauuguuuccggcauauuccccuauuccauuccagcgacucucuuagucuggcauacguggcaaaaacagacccaacgaaguggaguauuaugggauguaccaucuccuccagaaacccagaaagcggaguuggaggaaggugucuaucgcauaaagcaacaaggaauauuugguaaaacccaaguaggagugggaguacagaaagaaggcgucuuccacacaauguggcacgucacucgcggagcaguauugacguauaauggcaaacguuuggagccaaauugggcuuccgucaagaaagaucuaauaucauacggcggcgguuggcgauuaagcgcacaauggcagaaaggugaagaaguacaaguuauagcaguagaacccgguaaaaacccuaaaaauuuccaaaccaugccagggacauuucagacgaccacaggagaaaucggagccauugcucuugacuucaaaccuggcacaagcggaucuccaauuauuaaucgugaggguaagguugucggucuauacgguaauggaguaguuaccaaaaacgguggguauguaagugggauugcgcaaacaaaugcagaaccugauggaccuaccccagaacuagaggaagaaauguucaagaaacgcaaucuaacgauaauggauuuacacccaggcucaggaaaaacucgaaaguacuuaccagcuaucgucagagaagcaauaaagaggagacuuagaacuuuaauacucgccccaacucgcguagucgcugccgaaauggaagaggcuuuaaaagggcuuccaauacgauaucaaacuacagcuacuaaauccgaacacacugggagggaaauuguagauuugaugugucacgcaacauucaccaugaggcuucucuccccaguuaggguuccuaauuacaaccuuauuauuauggaugaagcacacuuuacugauccagcaaguauugcugcuagaggguauauaaguaccagaguuggaaugggagaagcugcagcaaucuuuaugacggcgacuccaccaggaacagccgaugcuuucccgcagucaaaugcuccgauccaagaugaagaaagggacauucccgaacgaaguuggaacuccggaaaugaguggauaacugacuuugcagguaagacaguaugguucguuccuucaauaaaagcgggaaaugauauugccaacugucuucgaaagaacggcaagaaaguaauucaauuaucacguaaaacauucgacacggaauaccaaaagacgaaacuaaaugacugggauuucguaguuacgacagacaucagugagaugggugcaaauuucaaagcagaccgcguaauagauccccgccguugccuaaagccagugaucuuaacugacggaccagagcgagucauccuagcaggaccuaugccaguaacugcagcaagugcggcacaacgacggggcaggguaggcagaaauccucagaaagaaaacgaccaguauauauuuacgggccaaccacuaaauaaugacgaagaucaugcacauuggacggaagcaaaaaugcugcuagauaauaucaauacuccugaaggcauuauaccagcuuuguucgaaccagaaagggagaagucggcggcaauagacggagaauaccgcuugaaaggagagaguagaaaaaccuucguugaacuaaugaggagaggggaucugccaguaugguuagcauauaaaguggcaagugagggaauaaaauacacagaucggaaauggugcuucgacggucaaagaaauaaucaaauacuagaggaaaacauggauguugagauuuggaccaaagaaggcgagaagaagaaauuaaggccaagaugguuagaugcaaggacauauagcgacccguuagcccuaaaggaguuuaaagauuucgcagcaggcagaaaaaguauugcgcuagauuuagucaccgaaaucgguagaguuccaacccaccuagcucaucgaacuaggaaugcauuagauaaucuaguaaugcuacauacguccgagcauggcggcaaagcauacagacacgcaguggaagaauugccagaaacaauggaaacuuuacuacuauuagguuuaaugauauuacuaacgggcggaguaauguuauuucuaauaucugguaaagguaucgguaaaacaaguauaggauuaaucugugucaucgcuaguagcggaauguuauggauggcugaaauuccucuacaauggauagcgucugcaauuguauuagaguucuuuaugaugguuuuauugauaccugaaccagaaaaacaaagaacaccacaagacaaccaguuggccuaugugguuaucgggauucuuacgcucgccgcaauaauagccgcaaacgagaugggacuucuggaaacaaccaaaagagauuugggcaugacaaaagagccuggcgcgguauccccaacgucuuaucucgacguggaucuucauccugcuagugcauggacgcuuuaugccguagcuacaacagugauaacaccuauguugcgucauacuaucgaaaauuccacagcuaaugucucuuuggcagcgauugcuaaccaagcaguaguacucaugggucuagacaaaggauggccaauaagcaaaauggaucucggagucccacuauuagcgcugggauguuacucacaagucaauccgcuaacccuaaccgcagcuguucugcuacugauuacacauuaugcaauaaucgggccuggacugcaagccaaagcaacgagagaggcucagaaaaggacagcggcagguauaaugaaaaauccgaccguagaugguauuaugacgauagauuuagacccaguaauauacgauaguaaauuugagaaacaguuaggucaaguaauguuauuaguacuaugugcgguacaacuccuauuaaugagaacaaguugggcacugugugaggcuuugacauuagcgacaggaccgauaacuacucuaugggaaggaaguccagggaaguucuggaauacaaccaucgccgucuccauggcgaacauuuucagaggaucauaucuagccggugcgggccuugcuuuuagcauaaugaaaagugucggaacaggcaaacgggguaccggaucucaaggugagacauuaggugaaaaauggaaaaagaaacuuaaucaacucuccaggaaggaguuugaucucuacaaaaagucagguauaaccgagguugauaggacagaggcuaaagaaggccuaaaacguggggagauuacacaccaugcgguuagccgaggaucagcgaaguugcaaugguuuguagagaggaacauggugauuccggagggucgcgucauugacuuaggaugugggcguggaggauggucauauuauugugccggguugaagaaaguaacggagguccgugguuauaccaaaggagggccaggacacgaggagccgguaccuaugucaacauacggauggaauauaguuaagcuaaugaguggaaaagauguauuuuaccuuccacccgaaaaaugugauaccuuacugugcgacauaggagagucguccccaucgccuaccgucgaagagucaaggacaauccggguccuaaaaaugguugaaccaugguugaaaaacaaccaauucuguaucaaaguucuaaaccccuacaugcccaccgucauagagcacuuagaaagacuucagaggaagcacggaggaaugcuggucaggaauccauuaucccgaaauaguacucaugaaauguacuggaucucaaacggcaccgguaacauaguggcaaguguaaacaugguaucacggcuccuauugaauagguuuacaaugacccauaggcgaccaacuauagaaaaggacguugaucuaggcgcgggcacuagacaugucaacgcagaaccagaaaccccuaauauggacguaauuggagagagaaucaaaagaauaaaagaggaacauaacucaacauggcauuacgacgaugagaacccauacaaaacaugggcauaccacgggucguacgaaguaaaagcaacagggagugcaagcagcaugaucaauggaguuguuaaguuguuaacaaaaccaugggauguaguaccaaugguuacgcaaauggcaaugaccgauaccaccccuuucggccaacaaagaguauuuaaggagaaaguagauacccgaaccccgcgaaguaugccagggacuaggcgcguuauggggauuacagccgaauggcuauggaggacuuuagggagaaacaagaaacccaggcucuguacacgugaagaguuuacuaagaaaguacgaacaaacgcugcaaugggggcgguauuuacagaggaaaaccagugggacucugcaaaagcggccgucgaagaugaggacuucuggaagcuaguggaucgcgaaagagaacuacacaaacuuggaaaaugcggaaguugcguguauaauaugauggggaaacgagagaagaaauugggagaauuuggaaaagcgaaaggcagccgcgcaauaugguacaugugguuaggcgcuagauaucuagaguucgaggcacuagguuuucucaaugaagaccacugguucucgagggaaaauuccuauuccgguguggaaggggaggguuuacacaaauuagguuauauucuaagagauaucucuaagauaccagggggagcuauguacgccgacgacaccgccggaugggauacaagaauaacggaggacgaucuacacaaugaggagaaaauaacacaacaaauggauccugaacauagacaguuagcaaaugcuaucuucaaauuaacauaucaaaauaaaguugugaaaguucaaagaccgacaccuacaggaacaguaauggauaucauaagucgcaaagaucaacggggaagugggcaaguugguacauacggacuaaacacuuuuacaaauauggaggcacaacugaucagacaaauggagggcgaaggaguucuaucaaaagcagaccuagaaaauccacauuugccugaaaagaaaguaacccaguggcuggaaacaaaaggagucgaacgucugaagagaauggcuauuuccggugaugauuguguagugaaaccaauagacgaccgauucgcaaaugcgcuguuggcucucaacgacaugggcaaaguucggaaagauauuccacaguggcaaccaucuaagggguggcacgacuggcagcaaguuccauucugcucacaccacuuucacgaacugauuaugaaagacggucggaaacuugugguaccuugccguccucaagaugaacuaauaggcagagcuagaaucagccaaggagcuggauggucccuaagagagacggcuuguuuagguaaagcguaugcgcaaauguggucauuaauguauuuucaucgucgagaucuuagacuggcaucaaaugcaauaugcagugcaguucccguucauuggguuccaacaucuaggacaacauggagcauucacgcccaucaccaauggaugacuacugaagacauguuaacggucuggaaccgcguguggaucgaagauaacccauggauggaagacaaaaccccggucaccaccugggaaaauguaccauaccuaggaaagcgugaagaucaaugguguggcagcuuaauaggauuaacuucucgugcgacaugggcacaaaauauaccaacggcaauacaacagguuagaagucuuauaggcaacgaagaguuucuugauuacaugccgucuaugaagcgauuucgaaaggaagaggaaucugaaggagcuaucugguaa

SEQ ID NO: 23090 - RNA, 9873 nt, Artificial Sequence
  derived and/or modified CDS sequence (opt6) from DENV-3__GQ868578__SS-prME
acaagccuaugucuaaugaugauacugccagcagcauuagcguuucauuugacuucacgggauggggaaccacguaugauuguagguaaaaaugaacgaggaaaaagucuccuauucaaaacagcgucgggaauuaacaugugcacacuuauagcuauggaucuuggugaaaugugugaugauacagugacauauaaaugcccgcacaucacagaaguagaaccugaagauauagauuguuggugcaaucuuaccucgacguggguaacuuacggaacauguaaucaagcgggggaacauagaagagacaaaagaagcguagcauuagcaccacauguaggaaugggacuugacaccagaacacaaacuuggaugucagcagaaggugcuuggcgccaaguagaaaaagucgaaacaugggcguuaagacauccgggauuuacaauacuggcacuauuucuagcucauuauauuggaacuucacugacacaaaaaguaguuauuuuuauuuuauuaaugcuaguaacaccuaguaugacuaugagauguguugguguaggaaacagagauuuuguagaagguuuaaguggagcaacuugggucgacguaguauuagaacauggaggguguguuacaacuauggccaaaaacaaaccuacacuagauauugaauuacagaaaaccgaagcuacucaacuagcuacccuaagaaaacugugcauagaaggaaaaauaacgaacauaacuacugauucacguuguccuacacaaggugaagcuguucuuccagaagaacaagaccaaaacuacgugugcaaacauacguacgucgacagaggcugggguaauggaugcggauuguuuggaaaaggcucucuuguuacaugcgcuaaauuucaaugccuagaaagcaucgagggaaaagugguccaauaugaaaaccuaaaauauaccguaauuauaacgguucacacaggagaucagcaucaaguugguaacgaaacacaagguguuacagcugaaauaacaccgcaggcaucuacgacagaagcaauacuuccagaauauggaacauuaggauuggaguguagcccuagaacugguuuagauuucaaugagaugauauuacugacuaugaaaaauaaagcauggaugguccaucggcaaugguucuucgaccuuccacucccauggacaucuggagcgacaacagaaacaccuacuuggaaucggaaagaauugcucgucacuuucaaaaacgcccacgccaagaaacaagaaguagucguacucggaucacaagaaggugcgaugcauacagcccucacaggggcaacagaaauucagaacucagguggcacaagcauauuugccggacaccuaaaaugcagguugaaaauggacaaauuagaacuuaaaggaauguccuacgcuauguguaccaauaccuuuguguuaaagaaagagguuagugagacacaacauggcacaauacugauuaaagucgaguauaaaggagaagauguuccauguaaaauaccauucagcacagaagacggacaagguaaagcacacaauggacgauuaauaacugcuaacccagucgucaccaagaaagaagaaccaguaaacauagaagcggagcccccguuuggagaaaguaacauuguaaucggaauuggggauaaugcacuuaagaucaacugguauaagaaaggcagcucgauugguaaaauguuugaagcgacagcacgaggugcacguagaauggcuauacuaggugauacagccugggacuucggaucggugggaggaguauuaaacucccuaggaaaaaugguacaucaaaucuuuggauccgccuacacagcauuguuuucagggguaaguuggguaaugaaaauaggaauaggaguauuacuuacauggauaggccuaaauaguaagaauacgaguaugucuuucaguugcaucgcaauaggaauuauuacauuauaucugggugcuguagugcaagcagacaugggguguguuauaaauuggaaaggaaaagaguuaaaguguggaucaggaauauuugugaccaaugaagugcauacauggaccgaacaguauaaauuccaggccgauucaccaaaacgucuagccacugcaaucgccggugcuugggaaaacggaguuugcggcaucagaucgacgacucguauggagaaccuauuauggaaacaaaucgcuaaugaacuuaauuacauucuuugggaaaacaauaucaaauugacaguaguaguaggcgacaucauuggcguuuuggaacaagguaaaagaacucuuacuccucaacccauggagcucaaguacucauggaagacuugggguaaagccaaaauaguaacugcagaaacucaaaauagcuccuuuauuaucgacggaccaaacacgccugaaugccccucugcuucccgagcuuggaauguaugggaagucgaggauuacggguuuggaguuuucacaacgaacauauggcucaaauuacgagaaguauauacgcaauuaugugaucauagacuaaugagcgcagcaguuaaagaugaaagggcuguacaugcagacaugggcuauuggaucgaaagucagaaaaauggaucauggaaacuugaaaaggcaucuuuaauagagguuaagacuuguaaauggcccaaaucacauacauuauggaguaacgguguucuggaaagcgauaugauaaucccuaaauccuuagcuggcccaaucagucaacacaauuauaggccagguuaccauacucaaacugcuggaccuuggcaucuugggaagcuagaacuagauuucaauuauugugaagggacuacuguuguuauuaccgagaacugugggacaagggguccaucucuaagaaccacaacggugagugguaaacuuauccacgaaugguguugcagaaguugcacuuuaccaccauuacgcuacaugggagaagauggauguugguauggcauggaaaucaggccaaccucagaaaaggaagaaaauaugguuaaaagucuuguuagugcaggaaguggcgagguagacaauuucaccauggguguucuuugccuagcgauucuuuucgaagaaguaaugcguggaaaauuuggcaagaaacacaugauagcgggcgugcuguuuaccuuuguguugcuucuaagugggcaaaucacauggagagauauggcacacacuuuaauaaugauaggauccaaugcgagugacagaauggguaugggagucaccuaucuggcccuuauagcaaccuuuaaaauacagccauucuuagcucuaggauucuuccuucguaagcuaaccagucgugaaaaucuacuucucgggguuggccuggcaauggccacaacacuccaguugccugaagauauagaacaaauggcaaaugggauugcucuuggauuaauggcauugaaacuaaucacacaauuugaaacuuaucagcuauggacggcauuaauuuccuuaacaugcagcaacacuaucuucacacucacagucgcauggagaaccgcaacucuaauucuagcaggggugucgcuuuuaccgguaugucagucaucaagcaugagaaaaacugacugguugccgaugacaguagcagcaauggguguuccaccauugccacucuuuaucuuuaguuuaaaagacacauuaaagagacguucuuggccuuuaaaugaaggagucauggcaguuggucuagugagcauacuagccagcucucugcuacgaaaugacgugccuauggcggguccccuaguugcuggcggacuacuuaucgcguguuacguuauuaccgguaccuccgccgaccugacuguugagaaagcugcugacgucacgugggaagaagaagcugaacaaacagguguuucucacaacuuaaugauuacggucgaugacgacgggacaaugcguaucaaagacgacgaaacggaaaacauccugacaguccuauuaaaaacugcucuuuuaauaguaaguggaaucuuuccauauucuaucccagcgacgcuucuuguuuggcauacauggcagaaacagacucaaagaucaggagugcuaugggauguaccaucacccccagaaacgcaaaaagcagaacuagaagaagguguuuaccguauuaagcaacaaggaaucuuugguaaaacccaaguagggguugguguacaaaaagagggcguauuucauacaauguggcacguuacaagaggagcaguacuaacguacaauggaaaaagacuugaaccaaauugggcaagugucaagaaagacuugauuucauauggaggaggguggagacucagugcacaauggcaaaaaggugaagaagugcaaguaaucgcaguagaaccaggcaaaaaccccaaaaauuuccagacgaugccaggcacauuucagacuacaacuggcgagauaggcgcaauagcgcuagacuuuaaaccaggaacuucggguucaccgauaaucaaccgagaagggaaaauagugggucuauacgguaacggcguaguaaccaaaaauggcggcuaugucuccggcauagcgcagacuaacgcagagccggauggaccaacaccagaauuagaagaagaaauguuuaagaaaagaaacuuaacaauaauggaccugcauccagguucagggaaaacacgcaaauacuuaccagcuauagugagagaagcgauaaaaagacgucugagaacucuaauuuuggcgccgacucgaguaguagcagcugagauggaagaggcuuuaaaaggucugccaauaagauaccagacuaccgcaacaaaauccgaacacacagguagagaaauaguugacuugaugugucaugcuacuuucaccaugcgccuacucucuccgguacgaguaccaaauuacaacuugauuaucauggaugaagcccacuucaccgacccagccaguaucgcagcaaggggguauauuaguacacgcguaggcaugggagaagcugcagcuauauuuaugacagcaacaccaccggggacagccgaugccuuuccccaaucuaaugcacccauacaagacgaagaaagggauauuccagagcguucauggaauagcggcaacgaauggauaacugauuuugccggaaaaaccgucugguuuguaccaucaauaaaggccggcaaugauauugccaauugucuaaggaaaaacgguaagaagguuauucaacucucaagaaaaacauuugauacagaauaucagaaaacaaaguugaacgauugggauuuuguagucacaaccgacauaagcgaaaugggagcgaauuucaaggcagacagaguaauagauccgcgacguugcuugaaaccuguuauuuugaccgaugggcccgagagaguaauacuugcaggaccuaugccaguaacagcagcaagcgcggcccagaggaggggaagaguuggcagaaacccacagaaagaaaaugaucaguauauauucaccggacaaccuuuaaacaacgacgaagaccacgcccauuggaccgaggccaaaaugcuccuagacaauauuaacacucccgaaggcaucauaccagcacucuuugaaccagaaagggagaaguccgcagcaauugauggugaauacagauugaagggagaaucuagaaaaacguucguugaguuaaugcggcgaggagaccuaccaguauggcuagcauauaaggucgcuagugaaggaaucaaauacacggacagaaaauggugcuucgauggacaaaggaauaaccagauacuggaagaaaauauggauguggagauauggacaaaagagggggagaagaagaaauuacggccgcgauggcuagacgcucggacguacuccgacccacuugcucucaaagaauuuaaggacuuugcggcugggcggaaaucaauagcauuagauuuaguuacagaaauugggagaguccccacccaccuagcacaccgaacuagaaaugcacuugauaauuuggugauguugcacacgucagagcacgguggcaaagcauauagacacgcgguagaagaacuaccugagacaauggaaacucuauuacuauuagguuuaaugauuuuguuaacagggggagcaaugcucuuuuuaauuucugggaagggcaucggaaagacuucaauuggacuaaucuguguaauagcaucaucaggaauguuauggauggcagagauuccguuacaguggauugcuagugcaaucguauuagaguucuuuaugaugguacuucugauaccagaaccugaaaaacagcgaacuccacaggacaaccaauuagcauaugucguaauaggaauauuaaccuuagccgcaauaauugcugcaaacgagaugggucuauuagagaccacaaaaagagacuuaggcaugucaaaagaaccgggaguaguaucaccuacaucguaucuagauguggaccuacauccugccagugcguggaccuuauaugccguagcuacgacuguuauaacaccgauguuacgucauacuauagaaaauaguacagcaaaugucagcuuagccgcuauugcgaaucaggcaguaguauugauggguuuagauaaggguuggccaauuucaaaaauggaucucggaguaccauuguuagcauuaggguguuauucacaaguaaauccauuaaccuuaacagccgcugucuuacucuuaauaacacauuaugccaucauagguccaggucuacaagcaaaagcuaccagagaagcucagaaaagaacagcagcuggaauuaugaaaaauccaacaguagauggaauaaugacuaucgaccucgacccggucauauaugacaguaaauucgaaaaacagcucggucaagugauguuauugguuuugugcgcuguacaacuuuugcuaaugagaacgucaugggcauuaugugaggcgcucacacuagccaccggaccuaucacaacgcugugggaaggaagcccaggaaaauucuggaacacgaccauagcuguaagcauggcaaacauauucagaggaucauacuuggcuggcgccgggcuagccuuuucaauuaugaaaagcguggggaccgguaaacgugguaccgguucucaaggcgagacucuaggggaaaaguggaagaagaaauuaaaucaguuaucuagaaaagaauuugaccuuuacaagaaauccgguauaaccgaaguugacagaacggaggcaaaagaaggacucaaaagaggugaaauaacucaccacgcaguuucaagaggaagugcaaaacuacagugguuuguugaacguaacauggugaucccugaaggcaggguaauagauuuaggaugugggcgaggaggauggucguacuacugugcaggccuuaaaaaggugacagaaguccguggauacacuaaaggaggaccgggacacgaggaaccgguuccgaugagcacauauggauggaacaucgucaaacuaaugaguggaaaagacguauuuuaccucccgccugagaaaugugacacgcuucugugcgacauaggcgaaagcagcccaucaccuacuguugaagaaucgcguacuauaagagugcucaaaaugguugaaccuuggcugaaaaauaaucaguucuguauuaaaguucuaaaucccuauaugccaacgguaauagaacaccucgaacgacuucaaagaaaacacgguggaaugcuugucagaaauccacucucacgaaauucaacacaugagauguacuggauaaguaacggcacuggaaauaucguugcgucaguuaauauggugucaagacuccuucuaaaccguuuuacuaugacgcaucgaagaccgacaauagagaaagauguagaucugggugcuggaacuagacauguaaaugcugagccagaaacaccuaauauggacguuauaggugaaagaaucaagcguauaaaagaggagcauaacucuaccuggcauuaugaugaugaaaacccuuauaaaacaugggccuaccauggaucguacgaaguaaaggcaacuggaagcgccaguagcaugauuaauggaguugugaaguuacucacaaaaccaugggaugugguccccaugguuacgcaaauggcaaugaccgacacaacaccauuuggccaacaacgaguauuuaaagaaaaaguugauaccaggacaccuagaaguaugccaggcacgcgccgaguaauggggaucaccgccgaaugguuauggagaacauugggcaggaacaagaaaccgagacuauguacccgagaggaguucacuaagaaagucaggacuaacgcagcaaugggcgcgguauuuacagaggaaaaucaaugggauuccgcaaaagcggcaguggaagacgaagacuucuggaaauuaguugacagggagcgagaacuccauaaacucgggaagugcggcuccugcguauauaacaugaugggaaaaagagagaagaaacuaggggaauuuggaaaagccaaaggaucaagagccauuugguauaugugguuaggugccagauaucuagaguucgaggcuuuaggauuucuuaacgaagaucacugguucagcagagaaaauaguuacaguggaguagaaggagaggggcuacauaaauugggauauauacuaagagauauuagcaaaaucccaggaggagcaauguacgcagaugauacugcagguugggacacacgaauaacagaagacgaccugcacaaugaagagaaaauaacacaacaaauggaccccgagcaucgacaacuggcaaacgccauauucaaacuuacuuaucaaaacaaaguagucaaaguacaacguccaacuccaacuggcacaguuauggauauuauaucgagaaaggaucaaagaggaagcggccaaguaggcacauauggacucaauacauuuaccaacauggaagcacaguuaauaagacagauggaaggagagggaguacugagcaaagcggaucuagaaaauccacauuugccagagaagaagaucgcgcaauggcuugaaacuaaagggguagagaggcuuaaaagaauggcuauuuccggagaugacugcguagugaagccaaucgaugauagauucgcgaaugccuuacuugcauuaaacgacaugggcaaaguaaggaaagacauuccccaauggcagcccagcaaagguuggcacgauuggcaacagguaccauuuugcucacaucauuuccacgaauuaauaaugaaagaugguaggaaauuaguuguuccuugcagaccgcaggaugaacuaauuggcagagcaagaaucagucagggugcugguuggucacuacgggaaacagcaugucuagguaaggcuuaugcacaaauguggucgcuaauguacuuccaucgaagagaccuacgcuuagcuucaaacgcuauauguuccgcaguacccguccauuggguaccaacgaguagaacgacguggucaauucacgcucaucaucaauggaugacaacggaagauauguugacugucuggaauagaguauggaucgaggacaauccguggauggaagauaagacaccugugacaaccugggaaaaugugccuuacuuggguaaacgugaggaucaguggugcgguagccucaucggauuaacaucaagagccaccugggcccaaaauauucccacagcaauucaacaaguucguucucucauggguaacgaagaguuccuugacuauaugccuucaaugaaaagauuccgaaaggaagaagaaucugaaggagcaauaugguaa

SEQ ID NO: 23091 - RNA, 9873 nt, Artificial Sequence
  derived and/or modified CDS sequence (opt6) from DENV-3__FJ898457__SS-prME
acuucgcuauguuuaaugaugauuuugccagcugcuuuagcguuucaucuuacguccagagauggagaaccgagaaugauaguugguaaaaaugaacgcggaaaaucccuucuguuuaaaacugcaaguggcauuaacaugugcacccuaauugcuauggaccuaggcgaaaugugugaugauacaguaacauauaaauguccacauaucacugaaguagaaccugaagacauagauuguugguguaacuuaacaucuacgugggucacguaugggacauguaaccaagccggugaacaucgaagagauaaaagaagugucgcauuagcgccacacguaggaaugggguuagauacgcggacacaaaccuggaugucagcugaaggagcuuggcgacaggucgaaaaaguggaaacuugggcuuuaagacauccaggauucacaauacuugcguuguucuuagcgcauuauauuggcacuagcuugacacaaaaagugguuauauuuauacuguuaaugcuaguaacaccgagcaugacgaugagauguguuggagucgggaaucgagauuucguagaaggacuaucuggggcaacuuggguagauguaguuuuagaacacggaggauguguuacaaccauggcgaaaaacaaaccaacacucgacauagagcuucagaaaacugaagcuacgcaacucgcuacacucagaaaauuauguaucgaagggaaaauaacgaauauaacuacugacucaaggugucccacacaaggagaggcagugcugccugaggaacaagaucaaaacuauguauguaaacauaccuacgucgaucgaggcugggguaaugggugugguuuauucggaaaagguucauuaguaacgugugcaaaauuucaauguuuagaaccaaucgaaggcaaaguaguacaacaugaaaaccugaaauauacuguuauaauaacgguacauacaggggaucaacaucaaguuggaaacgaaacgcaaggaguuacagcagagauaacaccccaggcuucaacaacagaggcaauacuuccugaauauggcaccuuaggacuugaauguucgccaaggacaggacuugauuucaacgagaugauccuucuuaccaugaaaaauaaggcuuggaugguacauagacaaugguucuucgaucuuccucuaccguggacuucaggagcaacaacugaaacuccgaccuggaacagaaaagaauuacugguuacauucaaaaacgcacaugcgaagaaacaggagguaguaguauuagguucucaagagggcgccaugcauacagcacuaacaggugcuacggaaauccagaauaguggcgguacaucgauuuucgcuggucaucuaaaaugucgauuaaaaauggauaaguuggagcuaaaagguaugaguuaugcuaugugcacaaauaccuucguucugaagaaagaaguuucggaaacacaacauggaacuauacuaauaaagguggaguauaagggcgaagacgcgccauguaaaauaccauuuucaacagaggacggucaaggaaaagcacacaaugguagauuaauaacagcuaaucccgucguaaccaagaaagaagaaccuguaaacauugaagcugaaccuccuuucggagaaucaaauauaguaauugguauaggugauaaugcucuaaaaauaaacugguauaaaaagggaucaucaauuggaaaaauguucgaagcuacugcaagaggagcacgcagaauggcgauacucggagauaccgccugggauuuuggaagcguuggggguguuuugaacuccuuagguaaaaugguucaccaaauuuuuggguccgcauauaccgcauuauuuucaggggucucauggauaaugaagauaggcauagguguauugcugacguggauagguuuaaauucuaaaaauaccucgaugucuuucucuugcauagcuaucggaauuaucacacuauauuuaggagccguagugcaagcggauaugggaugcguaauuaacuggaaaggaaaagaauugaaaugcggaucugggauauuuguaacuaaugaaguacauacauggaccgaacaauauaaauuccaagcggacuccccaaagagauuagcuacagcaauugcgggggcuugggaaaaugggguaugugggauaaggaguaccacuaggauggagaacuuacuuuggaaacagauagcaaaugaacuuaauuauauacuaugggagaacaauauuaaacucacaguuguaguuggggauauaauagggguguuagaacagggaaaacguacauuaacuccccagccgauggaacuaaaauauaguuggaaaaccuggggaaaggcgaagaucguuacagccgaaacacaaaauuccucauucaucauugauggacccaacacuccugaauguccguccgcaucaagagcguggaacguuugggagguggaagacuauggauuuggcguauucacgacuaauauuugguuaaagcuccgagagguuuacacacaacucugugaccauagauuaauguccgccgccgugaaagacgaacgagccguacacgcagacauggguuauuggauagaaucccaaaagaaugggagcuggaaacuggaaaaagccucacuaauugagguaaaaacgugcacauggcccaaaucacacacccuguggagcaaugggguauuagaaagcgauaugauuauaccaaaaaguuuggcaggaccaauaucacaacacaaucaucgaccagguuaccauacacagaccgcagguccguggcaucuugguaaacuugaauuagauuucaauuauugcgaggguacaacaguaguuauuaccgaaaacugcgggacgaggggccccucuuuacguacaacaacugucucuggcaaauugauacaugaaugguguugcagaucuugcacacuaccaccacucagauacaugggcgaagacggaugcugguauggaauggaaauucgucccauuucugaaaaagaagaaaacauggugaaaagucucguaucggcuggaagcggaaaaguggauaacuucacaauggggguccuguguuuagcaauauuauuugaagaaguaaugcgagggaaguucggaaagaaacauaugauagcugguguauuuuucacuuuuguauugcuauuaagugggcaaauaacauggcgugacauggcccauacucugauaaugauuggauccaaugccucagauagaaugggaaugggaguaaccuaucuggcucuuauugcgacguuuaaaauucaaccuuucuuagcacugggauucuuuuugagaaaacucacgagccgcgaaaauuuacuuuuaggcguagggcuggcaauggcaacgacacuacaacuuccggaggauauagaacaaauggcaaaugguaucgcacuuggauuaauggcacugaaauuaauaacacaauucgagacauaccaacuuuggaccgcuuuaauaucccuaacuuguucaaauacuaucuuuacacuuaccgucgcguggagaacugccacacugauccuagcaggcgucuccuuacuucccguaugccaaucaucuucgaugcguaaaacagacuggcuaccaauggcuguagcagcaaugggaguuccaccguuaccuuuauuuaucuuuagccuaaaagacacuuuaaaaagaaggucauggccccugaacgaaggggugauggccguagguuugguaucaauuuuagcaucgucuuuguuacgaaacgaugugccgauggcugggccucuaguagccggaggauugcuaauugcauguuaugugaucacgggaacaucugcagacuugacgguagaaaaggccgcggauaucacaugggaagaagaagcugaacaaacaggaguuagucauaaucuaaugauuacaguagaugacgacggaacaaugagaaucaaggaugacgaaacagaaaacauacucaccguguuguuaaaaacugcauuacuaauagugaguggaauauuuccauauucuauaccagccacccugcugguuuggcauacguggcagaagcagacucaaagaucaggagucuuaugggaugugccaagcccuccugaaacucaaaaggcagaauuagaagaaggcgucuaccggauaaagcaacagggcauauucggaaaaacccagguaggaguugguguccaaaaagaaggcguuuuucauacaauguggcauguaacaagaggggcaguacugacauacaauggaaaacgauuggaaccaaacugggcgucaguaaagaaagaccucauauccuauggagggggauggcggcuaucugcacaauggcagaaaggagaagaaguucaagucauagccgucgagccaggcaaaaaucccaaaaauuuucaaaccaugccaggcacauuucaaacaacuacuggggaaaucggagccauagcuuuagauuucaaaccaggaaccuccgguucgccaauaauuaaucgagaagguaaaguugugggauuauauggaaacgguguagucaccaagaacggagguuacgucagcggaauugcacaaaccaaugcggagccugacgggccgacgcccgaauuagaggaggaaauguuuaaaaagagaaaucuuacaauuauggaucuucauccugguucaggcaaaacaagaaaguacuuaccggcaaucgugagagaagcaauuaaaagacgguuaagaacauuaaucuuagcaccuacuagagugguagcggcagaaauggaagaggcuuuaaaaggauuaccgauacgauaccaaacgacggcaacaaagagcgaacauacugguagagagauagucgaucuuaugugucaugcaacauuuacaaugcgucugcuaagcccaguaagagugccuaauuauaacuugauuauaauggacgaggcucauuuuacugauccggcuucgauugcugcacgcgguuauaucucgacacgcguaggaaugggagaagcggcagcaauauuuaugaccgcuacaccgccuggaaccgcagaugccuuuccacaauccaaugcaccuauccaagaugaagaaagagacauucccgaacgaaguuggaacucagguaacgaguggauuacugauuucgcuggaaaaaccgugugguuuguuccaucaauaaaagcuggaaacgacaucgccaauugucuaaggaaaaauggcaagaaagugauacaacuaaguaggaagacauucgacacagaguaucaaaagaccaaauuaaaugacugggacuuuguagucaccaccgauauauccgaaaugggggccaacuucaaagccgacaggguaaucgauccaagaagaugccucaaaccgguaauccugacagacgguccggaaaggguaauauuagcugggccuaugccuguaacugcagcaagcgccgcucaaaggcgaggaagaguagggcguaauccacaaaaagaaaaugaucaauacauuuuuacuggacaaccccuaaauaaugaugaagaccacgcgcacuggacagaagccaaaauguuacuugacaacauaaauacgccagaggguaucauaccagcacuguuugaaccggaaagggaaaaaucagcagcaauugacggagaauacagacugaaaggugaauccagaaagacauuuguagaauuaaugcgcaggggcgaucuuccuguuugguuagcacauaaaguagcgucugaaggcauaaaauauaccgaccgaaaaugguguuucgauggucagagaaauaaccaaauuuuagaagagaacauggaugucgaaauauggacaaaagaaggggagaagaagaaacuuagaccgcgcuggcuagacgcuagaacguauagugacccgcuggcccucaaagaauuuaaagauuuugcagcagguagaaaaucgauugcguuagaccucguaacagaaaucgguagaguaccuucccaucuagcucaucggacaagaaacgcucucgacaauuuaguaauguuacacacauccgaacacggaggacgugcauaucgucacgcuguugaagaacuucccgaaacuauggaaacuuuacucuuauuagggcuuaugauauugcuuaccgguggagcaauguuauuucuuaucagugggaaagggauaggaaaaacaagcaucggcuuaauaugugucauagcgucaucuggcauguuauggauggccgagauaccguuacaauggauagccucggcaauaguucuugaauuuuucaugauggugcuuuugauaccagaaccagagaaacaaagaaccccucaagauaaccagcuugcauaugugguaaucggaauacuaacucucgccgcaauuaucgcagcuaaugaaaugggucugcuagaaacaacuaaacgugaccuugggaugucaaaagaacccggaguugugucaccaacauccuauuuggacguggaucugcaccccgcaucggccuggacucuauacgcagucgccacuacaguaaucacacccauguuaaggcacacgauagagaauagcacugcgaauguuagcuuagcggcaauagcaaaucaggcaguuguauuaaugggauuagacaagggauggccuaucaguaaaauggacuugggugucccuuuguuagcauuagguugcuauucucaaguaaacccauuaaccuuaacagcugcaguauuguuacuaauaacccauuaugcuaucauuggaccggguuuacaagcaaaagcaacacgagaagcacaaaaacguacagcugccggaauaaugaaaaaucccacaguagaugggauuaugaccaucgaucucgaucccguaauuuaugauucaaaauucgaaaaacagcuaggucaaguaaugcuccuaguacuaugcgcaguucaacuauuacucaugagaacuagcugggcccuaugcgaagcauugacacuagcaacaggaccuauaacgacacucugggaaggaagcccugguaaauucuggaauacaacuauagcugugucgauggcuaacaucuuucggggaucuuaucuagcuggagcgggccuagcguucagcaucaugaaaacagugggcacggguaagagaggcacuggaagucagggagaaacccucggggagaaauggaagaagaaacucaaucaauugagcagaaaagaauuugaucuauacaaaaagucuggaauaacugaggucgauagaacagaggcaaaagagggucugaaacguggagaaauaacacaucacgcuguuucccgugguucugccaaguuacaaugguuuguagaacguaauaugguuauaccugaaggucgaguuauagaucuagguuguggacgaggagguuggucauauuacugcgccgggcucaagaaaguaaccgaaguaagaggcuauaccaaagguggaccuggacacgaggagccggugccaaugucuacauacggauggaauauuguaaaacuuaugucaggaaaagacguguucuaccuucccccggaaaaaugugauacauuauuaugcgacauuggagaaagcucgccaagcccuacagucgaagaaucgagaacgauaagagucuugaaaaugguagaaccaugguuaaagaauaaccaguuuuguauaaagguacugaacccuuauaugccuacagugauagagcauuuggagagauuacaaagaaagcacggaggaaugcuaguuagaaauccauuaagccggaacucgacccaugaaauguacuggauaucaaauggaacagggaauauuguagccaguguaaauaugguaucuagacuauuacuuaaccgguucaccaugacgcaccgucgaccaaccauagaaaaagacguagauuugggugcagguacuagacaugucaacgcagagccagaaacaccaaauauggauguaauaggagaaagaauaaaacgaauuaaagaggaacauaauucaacuuggcacuaugaugaugaaaauccauauaaaacuugggccuaccauggcaguuaugaaguaaaggcaacuggaucugccucaagcaugauaaauggaguaguaaaacuauugacaaaaccaugggaugucguaccuauggugacccaaauggccaugaccgauacaacgccuuuuggacaacaaagaguguuuaaagaaaaaguagacacgagaacuccaagaucaaugccuggaacucgaaggguuauggguauaaccgccgaguggcuauggcgaacacucgggcgaaauaagaaaccaagguuaugcacucgggaagaguucaccaaaaagguaaggacaaaugcagcgaugggagccguauucacugaagaaaaccagugggauucugcuaaagcggcuguagaagacgaagacuuuuggaaacuuguagauagggaacgugaacuacacaagcuagguaaauguggaucuugcguauauaacaugauggggaaacgggagaagaaacuaggagaguucgggaaagccaaggggagcagggcaauuugguacaugugguugggagcccgcuaccucgaauuugaagccuuaggauucuugaacgaagaccauugguucucuagagagaacuccuauagcgguguagaaggagagggccuccauaaguugggcuauauauuaagggacaucucuaaaauaccuggaggagcaauguacgcagaugacacagcaggaugggacacaagaauaacggaagacgauuuacacaacgaagaaaagauuacccaacaaauggauccggaacaccgccaauuagcgaaugcuauauucaaauuaaccuaucaaaauaagguggugaagguacaacgucccacuccaacaggcacggucauggacauaauauccagaaaagaccaaagagguaguggacaaguaggcaccuauggucuaaacacguuuacaaacauggaagcacaacucauccggcaaauggaaggagaaggcgucuuaucaaaggcugaccuagagaauccacaucuucccgagaagaaaaucacucaauggcucgaaacgaaaggaguagaacgccuuaaaagaauggcaauaucuggagaugauugcgucguaaagccuauugaugauagauucgcuaaugcgcuucuagcacuuaaugauauggggaagguacgcaaagauauaccccaauggcaaccuagcaaagguuggcacgauuggcagcaaguaccauuuugcagccaucacuuccacgaauuaauaaugaaagauggacggaaauuaguaguaccaugucgaccacaagaugaauuaauaggaagggcaagaauuucacagggagcgggguggucacugagagaaacggcaugccuaggcaaggcauaugcccaaauguggucauuaauguacuuucauagaagagacuuacgauuagcgagcaacgccauauguagugcaguaccuguacauuggguuccuacaaguagaacaacauggucuauacaugcucaccaccaguggaugacuacugaggauaugcuuacuguuuggaacaggguuuggauagaagacaaccccuggauggaagacaaaacaccaguaacgacgugggaaaacguuccauaccuagguaaaagggaagaucaauggugugguucauugaucggucugacauccagagcgacuugggcucagaauauaccuacggccauacaacaaguaagauccuuaauuggaaaugaagaguuccucgacuauaugccaucuaugaagcgguuucgaaaagaagaggaauccgagggugcaauaugguaa

SEQ ID NO: 23092 - RNA, 9873 nt, Artificial Sequence
  derived and/or modified CDS sequence (opt6) from DENV-3__KF955505__SS-prME
acuagccucugcuuaaugaugauauuaccugcugcacucgcguuucauuuaacuucacgaaauggagaaccacgaaugauaguagggaaaaaugagagaggaaaaucacuguuauuuaaaacagcaucagguauaaacaugugcacgcuaauagcaauggaucuaggagaaaugugcgacgauaccguuacuuacaaaugcccccauaucacagaaguggaaccugaagauaucgauuguugguguaaccugacaucaaccuggguaacuuaugguaccuguaaucaagcaggagaacauaggagagauaaacgaaguguagcguuagcaccucacguugguaugggacuggauaccagaacgcaaacauggaugagcgcagaaggggcguggagacaaguugaaaaaguagaaaccugggcucuaagacauccaggcuuuacuauucuggcuuuauuuuuggcccacuauauaggaacgucauugacucaaaaaguggucaucuuuauacuccuaauguugguuacaccuucgaugacgaugcguugugucggaguuggcaaucgagacuuugucgaaggcuuguccggugcaaccuggguagacguuguauuggagcacgggggauguguuacgacuauggccaaaaacaaaccaacguuagacaucgaacuccagaaaacugaggccacucaauuagcaacacuacgaaaauuauguauagaagggaaaauaacgaauauuaccacagauagccggugcccuacacaaggcgaggccguauuacccgaagaacaagaucaaaacuaugugugcaaacauacauauguagaucgggguuggggcaacggcuguggacuguucgguaaaggaucccuuguuaccugcgcaaaauuccaaugccuagaaccgaucgaagguaaaguuguccaauacgagaauuugaaauauacuguuaucauuacuguacacacgggagaucaacaccaaguugguaacgaaacgcaaggugucacggcggaaauuacaccacaggcuucuacaacagaggcgaucuuaccagaauacggaacgcuaggacuagaaugcucuccacguacgggucuugauuuuaacgaaaugauacuacuaacuaugaaaaauaaagcauggaugguacauaggcaaugguucuuugauuuaccauuacccuggacaucaggggccacaacagaaacacccaccuggaaucgaaaagaguuguuagucacauuuaaaaaugcgcacgcuaagaaacaagagguggugguguuggguucacaagaaggggcuaugcacaccgccuuaacgggugcgacugagauccaaaacucagggggaacaucaauuuuugcgggucaccucaaaugcagacucaaaauggauaaauuagaacucaaagggaugaguuaugcaauguguacgaacacguucgugcuaaagaaagaagugucagagacucaacauggaacuauucuaauaaaagucgaguauaaaggggaagaugcacccuguaaaauacccuuuaguacugaagacggccaaggaaaagcccacaacggaagguuaauuacagccaaucccgugguaacgaagaaagaagaaccggugaacauagaagcugaacccccauuuggugaaagcaauauagugauaggcaucggagauaaugcauuaaaaauuaacugguauaagaaaggaucgucuauagguaaaauguuugaagccaccgcccgaggagcaagaagaauggcuauacuuggagauacugcaugggauuuuggaucagucggagguguucuaaacagccucggcaaaauggugcaccaaauauuugguucggcguacacagcacuauucucaggcguuuccuggguaaugaaaauugguauuggagugcuauuaaccuggauugguuuaaauagcaaaaauacgucgaugaguuucaguuguauugcaauugggauaauaacauuauaccuaggggcugugguucaagcagacaugggaugcguaauaaauuggaaaggaaaagaguuaaaauguggaucuggaauauuuguaacuaaugaaguucacacuuggacagaacaauauaaauuucaagcagauucaccaaaaagacuugccaccgccaucgcaggagcaugggaaaacggaguaugcggaauuagaaguacaacuagaauggaaaaucuuuuguggaaacagauugcaaacgagcucaauuauauuuuaugggagaacaauauuaaacuaacuguuguaguaggugacauuauaggcguauuagaacaagguaaacggacauuaacaccucaaccaauggaacuuaaauauucguggaaaacauggggcaaagcaaaaauaguuaccgcagaaacacaaaacagcuccuuuauaauagaugguccgaauacgccugaaugcccgagugccucaagggcauggaacguaugggagguagaagauuacggauuugguguauuuacaacaaauauaugguuaaaacuaagggaaguauauacacagcuuugugaccaccgacuuauguccgcagccguuaaagaugaacgagcaguucacgccgacauggguuacuggauagaaagccagaaaaacggcagcuggaaauuagaaaaagcaucgcugauagaaguuaaaacgugcacauggccaaaaagucauacuuuauggaguaauggaguauuagaaagugacaugauaauaccaaaaagccucgcaggaccaaucagccaacauaaccaccgcccugguuaccacacucaaacagcaggacccuggcacuuagguaaauuggaacuagacuuuaacuauugugaaggcacgacagucgugauuacagaaaacuguggcacaagaggaccuucuuuaagaacaacgacagugaguggaaaauugauacaugaaugguguugcaggucgugcacccucccaccacuucgcuacaugggugaagauggcugcugguaugguauggaaauaagaccaaucagugaaaaagaagagaauaugguaaaaucacuugucucagcuggcucaggcaaaguggacaacuuuacuauggguguucucugucuagcaauccuauuugaagagguaaugagaggaaaauuugggaagaaacacaugauugccggugucuuuuucacauuuguuuugcuauuaagcgggcaaauaacauggcgugauauggcccauacacucauuaugauuggaucaaacgcauccgauagaauggguaugggcgugaccuacuuagcuuugauagccacguuuaaaauucaaccuuucuuagcucugggauucuuucuaagaaaauugacuucgcgagaaaaccuacucuuaggcgugggucuagcgauggccacuacacugcaacuucccgaagacauagaacaaauggcaaacgguaucgcauuaggauugauggcacuaaaauuaauaacacaauucgaaacauaucagcuuuggacagcacuaauaagccuaacauguaguaauacaauguucacacuuacuguagcguggcgaaccgcuacauuaauacuagccggugugucacuuuuaccugucugccaaaguucaucaaugcgaaaaacggauuggcugccgauggccgucgcggcuaugggggugccgccucucccguuguuuauauucucacuuaaggacacucuaaagcgacgaucauggccguuaaacgagggcguuauggccguuggauuagucaguauuuuagcuagcagccuacuucgaaacgacgucccaauggcggggccccuaguugcuggaggccucuuaaucgcguguuacguaaucacuggaacaagugcggaccucaccguggagaaagccgcagauauuaccugggaagaggaagcagaacagacaggaguaucucacaaccuaaugauuacgguugacgacgacgguaccaugcgaauuaaagaugacgaaacagaaaauaucuugaccguucuguugaagacugcuuugcugauuguuagcggcgucuucccauauucaauuccagcuacgcuauugguauggcauacauggcaaaaacaaacacagcgcaguggaguuuuaugggacgucccaucaccuccagaaacgcaaaaggcugaacuugaggaaggcguguacaggaucaagcaacaagguauauuuggaaaaacucaaguugguguaggugugcaaaaagaaggcgucuuccauacgauguggcauguaacucgaggggcuguacuuacauauaauggaaagcgacuagagccaaacugggcgagcgucaagaaagaucuaauaagcuauggaggagguuggaggcuaucagcacaauggcagaaaggcgaagaaguucaagugauagcaguagaaccaggcaaaaacccuaagaauuuccagacuaugcccgggacauuucaaacaacaacuggagaaauaggugcuaucgcccuugacuuuaaaccuggaacgagcggcucaccaaucauaaauagagaaggcaaagucgucgggcuauacgguaaugguguaguaacuaagaaugggggauaugugaguggaauagcccaaacgaacgcugaaccagacgguccgacaccugaacuugaagaagagauguuuaagaaacgaaaucuuacuauaauggaucuacaccccgggaguggcaaaacuaggaaauaccuccccgcgauuguuagagaagcuauuaaaagacgccuaagaacacuuauucucgccccgacuagggugguugcagccgaaauggaggaggcauuaaaaggauuaccaauaagauaccaaacuacagcaacuaaaagcgaacacaccggacgagagauaguggaucucaugugucaugccacauuuacaaugcgacuauugucaccgguaagaguuccuaauuauaauuuaaucaucauggacgaagcucacuuuacagaucccgcgagcauugcagcuagaggauacauuucaacuaggguaggaaugggugaagcagcagcgaucuuuaugacggcuacaccgccaggcacagcagacgcguucccgcaaagcaacgcuccgauucaagaugaagaaagggacauuccggaaaggaguuggaauaguggaaaugaauggauaacggacuuugcaggcaagacugugugguuugugccgagcauaaaggcaggcaaugacauagcuaacuguuugcggaagaacgguaagaaaguaauccaauuaucacgaaaaaccuuugauacggaguaucagaaaacuaagcucaaugacugggacuucguaguaaccacagauauaucagaaaugggagcuaauuuuaaagcugaccguguaauagauccgagacgcugcuuaaaaccgguuauauuaaccgauggaccagagcgggucauccuagcugguccaaugccuguaacugcugcuucagccgcacaaaggagaggaaggguaggacgcaauccgcaaaaagagaacgaccaauacauauuuaccggacaaccacucaacaaugaugaagaucaugcacauuggaccgaagcaaaaauguuauuagacaauaucaacacaccagaagggauaaucccagcacuauuugaaccugaaagagagaaaagugcggccauagacggagaauacagacuaaagggggaaucgcgaaagacauuuguagaacuaaugcgaagaggagacuuaccaguuuggcuugcacacaagguugcuucagaaggaauaaaguauacggauaggaaaugguguuuugauggccaaagaaacaaucaaauuuuagaagaaaacauggauguggaaaucuggacuaaggaaggcgagaagaagaaacuacgaccacgauggcuggaugcccguacauauucagauccgcuagcguugaaagaauuuaaagauuucgcugcagguagaaaaucgauagcgcuugaccuggugacugagauaggacgcguuccaucacaccuugcacauagaacucggaaugcacuagauaaucucguaauguuacauacaagugaacacggaggacgcgccuaccgacacgcagucgaagaguuaccagagaccauggagacuuuacugcuacuaggauuaaugauauuacuaacaggaggagcaaugcuauuuuuaauaucugggaaaggaauaggaaagacaaguauaggucuaauuuguguaauagcuaguuccggcaugcuuuggauggcagagauaccguuacaauggauugcgagugcaaucgugcuagaauuuuucaugaugguccuguuaauaccggaaccagaaaagcaacgaacgccucaagauaaucaacuggcauacguuguuauagguauacuuacucuugcugcaauuaucgcagcaaacgaaaugggacuuuuagaaaccacuaaaagagauuuggggaugaguaaagaaccuggaguuguaagcccaacuagcuacuuagauguugauuugcacccagcgucagccuggacauuauacgcuguagcuacaacggugauuacaccaauguuaagacacacaaucgaaaacucuacggcgaacguauccuuggcugcaauugcuaaucaggccgucguacucaugggacucgacaagggauggccaaucucaaaaauggauuuagguguaccacuuuuagcucuggguugcuacucacaagugaauccgcuaacauuaacagccgcaguuuuauuacuaauuacccauuacgcuaucauuggaccaggauugcaagcuaaggcuaccagagaggcccagaaaagaacugcagcaggaauaaugaaaaauccaaccguagauggcauuaugacgauagacuuagauccgguaauauaugauaguaaauuugaaaaacaauuaggacaaguuauguuauugguuuugugugccguacagcucuuacuuaugcgaacaaguugggcccuuugugaagccuuaacucuggccacaggaccaauaacgacucuaugggagggaaguccaggaaaauuuuggaacacgacaauagcgguuuccauggccaauauauuucguggaaguuauuuggcuggagcaggcuuagcauuuagcauaaugaaaucugugggaacaggaaaacgcggaacagguucacaaggagagacuuuaggagaaaaauggaagaagaaauugaaccaguuaagucguaaagaguucgaccucuacaagaaaaguggaauaacugagguagauagaacugaggcaaaagaaggauuaaaacguggugaaaccacacaucaugcugugucgagaggaucugcaaaacuacaaugguucguggaaaggaacaugguaauaccugaagggcgagucauugaucuuggcuguggaaggggugguuggucauacuacugugcuggucuaaagaaaguaacagaaguuaggggcuacaccaaagguggcccaggccaugaagaaccaguaccaauguccaccuaugguuggaacauagucaaacuaaugucuggcaaggauguuuucuaucucccuccagaaaaaugugauacgcuauuaugcgauaucggcgaauccucuccgaguccaacaguugaagaaucaaggacuauaaggguuuugaagaugguagaaccguggcugaaaaauaaucaauucuguauuaagguucuaaauccuuauaugcccacugucauagaacaucuagaacgacuacagaggaaacauggagguaugcugguuagaaacccucuaucaagaaauucaacucacgaaauguacuggauaucuaacggaacgggcaauauuguagcaucggugaauauggucagucgucuuuuguugaauagauuuaccaugacucacagacguccaacgaucgagaaagauguggaucucggggcaggcacacgucaugucaaugcagaacccgaaacacccaauauggacgucaucggagaaagaauaaaacgcauaaaagaggaacauaacagcaccuggcacuacgaugaugaaaauccuuauaaaacgugggccuaccacggcucuuaugaaguaaaagcaaccgguagcgcaucaaguaugauaaauggaguagugaaauuguugacuaagccaugggauguuguuccgaugguuacucagauggcaaugacagauaccacgccuuuuggacaacaacguguauuuaaagagaaagucgauacgcguacaccucgcuccaugccgggaacuagacgaguuaugggcauaaccgcggaguggcuguggagaaccuugggacgaaacaagaaaccccgcuuaugcccucgagaagaguucacuaagaaagugcgcacaaaugcugccaugggugcaguguucaccgaggaaaaccagugggacucagccaaggcggcaguagaggacgaagauuuuuggaaacuuguagacagagaaagagaacuucacaaacuaggaaaauguggaagcuguguauauaauaugaugggaaagagagagaagaaauuaggagaauuugguaaagcaaagggaaguagagcaauaugguacaugugguugggggcccgguaccuagaguuugaggcuuuaggcuucuuaaaugaagaucauugguuuaguagagaaaauuccuauagugggguagaaggugaagggcuacccaaacuuggauacauuuuacgcgauauaaguaaaaucccaggaggugcaauguacgcggacgacacggcuggaugggacacuaggauuacagaggacgaucuacacaaugaagagaagauaccgcaccaaauggaccccgaacacucgcguuuagcuaaugcaauauuuaaauuaacuuaucaaaauaaaguggucaagguacagagaccaacaccgacuggcacugugauggauauuauaucaagaaaagcacaaagggggagcggacaaguaggaacauacggccuuaacaccuuuacaaauauggaggcacaacuuauaagacaaauggagggagaaggaguuuuaucaaaggcggacuuagagaauccacauuuaccugagaagaaaauaacacaaugguuagaaaccaaaggaguugaaagacugaagagaauggcuauuaccggugaugauuguguggugaagccaauugaugaccgguucgcgaaugcucugcuggcacugaaugauaugggaaaagugagaaaagauauaccccaguggcagccaucuaaaggauggcaugacuggcaacaagugccguucugcucgcaccauuuccacgaacuaauaaugaaggauggacgaaaacuugugguccccugucgcccacaagacgaauuaauaggcagagcucgaauuagucaaggcgcagguuggagcuuaagagagacagcuuguuuaggaaaggcuuacgcacaaauguggucgcuuauguauuuucaccggagagacuuaagauuagcauccaacgcaauauguucagcuguuccaguacauuggguuccuacaucgcggacuacgugguccauacacgcucaucaccaguggaugacaacugaagauaugcugaccguuuggaauagagucuggauagaagauaauccguggauggaagauaaaacaccaguaacgaccugggaaaacguaccuuaucuagggaaacgugaagaccaaugguguggaucccuaauaggauugacgucaagagcgacaugggcacaaaauauaccuacggccauccaacaaguaagaucucuaauagguaaugaggaauuucuugauuacaugccaucaaugaaacguuucaggaaagaagaggaaucggaaggagcgauuugguga

SEQ ID NO: 23093 - RNA, 9873 nt, Artificial Sequence
  derived and/or modified CDS sequence (opt6) from DENV-3__FJ898464__SS-prME
acuucccuaugcuugaugaugauauuaccagcugcccucgcguuucaccuaacaaguagggacggggaacccaggaugaucguagggaaaaaugaacgaggaaaaucacuacucuuuaaaacagcauccggaauaaacaugugcacauuaauagcuauggaucuuggagaaaugugcgaugauacaguaacuuauaaauguccucacauaaccgaaguagagccagaagauauagacuguugguguaauuugaccucuacauggguuacauauggaacauguaaucaagcaggagaacauagacgagauaaaagauccguugcucuagccccacacguuggaaugggcuuagauacucgaacacaaaccuggaugucugcagaaggugcuuggagacaaguagagaaaguagaaacaugggcccuaagacauccaggauucacuauauuggcacucuucuuagcucacuauaucggaacuucuuuaacucaaaaaguugucauauuuauuuuacugauguuagucacacccucgaugacuaugagaugugucggugucgguaauagggauuuugucgaaggccuaucaggggccacauggguagauguagucuuagaacauggaggauguguuacaacaauggccaaaaacaaacccacgcuagacauagaauuacagaaaacugaagcaacucaacuagcaacauuaaggaaauuguguauagaagguaaaaucacuaauauaacuacagacucuagauguccuacucaaggcgaagcuguuuuacccgaggaacaagaccaaaacuaugucugcaaacacacauauguggaccgagguugggggaacgguuguggacucuucgggaaggggagcuugguaacuugugcaaaauuucaaugucuagaaccaaucgagggaaaaguaguucaauaugaaaauuuaaaauacaccguaauuauuacugugcacacaggggaucaacaccagguaggaaacgaaacucaagguguaaccgcagaaaucacgccacaagcaucaaccacagaagcuauacuucccgaauacgggacacuggguuuagaguguucgccaagaacuggguuagauuuuaacgaaaugauucuacuuacaaugaaaaacaaagcauggaugguacauaggcaaugguucuucgaucuaccucuaccauggacuucaggggcuacuacagaaacaccuacuuggaauagaaaagaauuauuagugacauucaaaaacgcgcaugcgaagaaacaagaaguaguuguacuagguagucaagaaggggcaaugcacaccgcauuaaccggagcaacugaaauacaaaauaguggcggaacaaguauauucgcuggacauuuaaaguguagguugaaaauggacaaacuggaacuaaaagguaugucguacgcaauguguacgaauacuuucguuuugaagaaagaagucagugagacacagcacggaacaauucugauaaaaguagaauacaaaggggaagaugcuccauguaaaauaccuuuuucaacagaagacggucaagguaaagcacauaacgggagacuuauaacugcgaauccagugguaacaaagaaagaggaaccaguaaauauagaggcugagccuccguucggagaaucaaauauugugaucgguaucggagauaaugcauuaaagauaaauugguauaagaaaggcucaucuauuggaaagauguucgaggcaacagcaagaggugcgagaagaauggccauauuaggagacaccgcaugggauuuuggcaguguuggaggaguacugaacuccuuggguaaaaugguucaccaaauuuucggaucagcuuauacagcauuauuuaguggagucucuuggguaaugaaaauugguauaggaguacucuuaacguggauuggacuaaauucgaagaauacaagcauguccuuuagcuguaucgccauaggaauaauaacacuguaucuaggcgcaguaguccaggcugacauggguugcgucaucaacuggaaaggaaaagaacuaaaaugcggcagcggaauuuuuguaaccaacgaaguucacacuuggacugaacaauacaaauuucaagccgacagucccaaaagacuggcgacugccauugcgggagccugggaaaacggaguuuguggcauuagaagcacuacgagaauggaaaaucuacuuuggaaacaaauugcaaaugagcucaacuauauauuaugggaaaacaauauuaaacuaaccguuguaguaggcgauauaauaggagugcucgaacaaggaaaaaggacucuuacuccacagccaauggaacugaaauauucauggaaaacauggggaaaagcuaaaaucguaacagcugaaacucaaaacucaaguuucauaaucgauggaccgaauacacccgagugcccgagcgccucaagggcguggaaugucugggaagucgaggacuauggauuuggcguauuuaccacgaauauuuggcuaaaguuacgggagguguauacgcagcuaugugaccaccgcuuaaugucggcagcugucaaagaugaaagagcuguucaugcggauaugggauacuggauagaaucucagaaaaacggaagcuggaaacuagaaaaggcuucauugauagaaguuaaaacauguacuuggccgaaaucacauacauuauggucuaacggagucuuggaaagcgauaugaucauaccuaagucauuagcaggacccauaucacaacacaaccaucggccaggauaccacacccaaaccgcaggaccauggcauuuaggaaaacuugaauuagauuuuaacuauugcgaagggacgacggugguaaucaccgagaacugcgguacccgugguccgagucugcguacgaccacagucuccgguaagcucauacacgaguggugcugccggaguuguacccuaccaccgcuaagauauaugggcgaagacgguugcugguacgggauggagauaagaccaauaagcgagaaagaagagaacaugguuaaaagucucguuagugccggauccgguaaggucgauaacuuuacuaugggcguacuaugcuuagcuauucuauuugaagaagugaugcgcggaaaauuuggcaagaaacauaugauagcaggcguauuuuucacauuuguauuauugcuaagugggcagauaacauggagagauauggcucauacauuaauaaugaucgguaguaaugcaagcgaccggaugggaaugggcgucacauauuuagcgcugauugcuacguuuaaaauucagccguuuuuagcuuugggauucuuucuacguaaauuaaccagccgugaaaaucuguuguugggcguuggacuugccauggcgacaacauuacaauugccagaggauaucgaacagauggcaaaugguauagcucucgggcuaauggcccucaaacuuauaacccaauuugagacauaccaacuuuggacagcauuaauuagucuaacuuguucaaauacuauguuuacucuuacaguggcuuggagaacugcgacacuuauacucgccggcgucagucuguuaccuguuugccagaguucuaguaugcguaaaacugauuggcucccgauggcagucgcugcgaugggcguaccgccucuaccacuuuuuauuuuuaguuuaaaagauacgcugaaaagaagaucuuggcccuuaaacgaagguguaauggcagugggucuagucucuauacuagcaucaucauuacuucgaaaugaugugccgauggcuggaccauuagucgcuggugguuuacuaauagcaugcuauguaauaacaggaacuucagcagacuugacaguagaaaaagcugcagauauaacaugggaagaagaggccgaacaaacuggugugagccauaaucugaugauaacaguugaugacgaugggacaaugaggauaaaagacgacgaaacggagaauauauuaacuguauuacuaaaaacggcguugcuaauaguuucugguguauuucccuauucaaucccggcaaccuugcuuguuuggcacacauggcagaaacagacccaaagaaguggggucuuaugggaugugccgagucccccagaaacccagaaagcagaacuagaggagggaguuuaccgaauaaaacagcagggaauauuuggaaaaacucaaguaggaguaggaguucaaaaagagggaguauuucauaccauguggcaugugacacgaggugcuguuuuaacguauaaugguaaaaggcuggaacccaacugggcaucagucaagaaagaccuaauuucauauggagggggcuggagacugucagcacaauggcaaaaaggagaggaaguacaagugauagcuguagagccugguaaaaauccuaaaaauuuucaaacuaugccaggaacauuucaaaccacaacaggggaaauuggugcgauagcucuagauuuuaaaccugggacaaguggaucaccgauuauaaaucgugaaggcaaagugguaggucuuuauggaaauggaguaguuaccaaaaaugguggcuauguuucggggaucgcccagaccaacgcagagccugauggaccuacaccagaacucgaagaagaaauguuuaagaaaagaaaccuaaccaucauggaucuacaccccggaucagguaaaacccgaaaauaccucccagcaaucguuagagaagcaauuaaacgacgauuaagaacauuaauauuagcaccgacacgcgugguagcagcagaaauggaagaagcucuaaagggacugccaauuagauaucaaacaacagcuacaaagagugaacacacggggcgugagauuguagaccuuaugugucaugcaacauucacuaugcgauuauuaaguccagugcguguuccgaacuauaauuuaauaaucauggaugaagcucauuucacagauccagccucuauagcagccaggggcuauauuaguacccgagucggaaugggagaagcggccgcuauauucaugaccgcuaccccaccagguacagcggacgcauucccucaauccaacgcccccauacaagacgaagaacgugauauaccugaacgaaguuggaacucaggaaaugaauggauaacagauuuugcugggaagaccguaugguucguaccaagcaucaaagcaggaaaugacauagccaacugucugaggaagaacgguaagaaaguaauacaauuaagcagaaaaacauuugauaccgaguaccagaaaacaaaguuaaaugauugggauuuugugguuacaacggauauaagugaaaugggagcgaauuuuaaagccgauagaguaauugacccuaggaggugccuuaagccuguuauucuuacagacggaccggagaggguuauacuugcaggccccaugccaguuacagcggcaagcgcugcacaaagaagaggucguguaggucguaauccccaaaaagaaaacgaucaguauaucuuuacaggucaacccuugaacaacgacgaggaucaugcucauuggacggaggcuaagauguuacuugacaauaucaacacucccgaaggaauuauaccggcacuguucgaaccagaaagagagaaaucggcagcgauagauggcgaauacagauuaaaaggugaaagccggaaaacauuuguagaacucaugcguagaggagacuugcccguuuggcuagcacauaaaguggcgagcgaaggaauaaaauauaccgaucguaaaugguguuucgacggacaacgaaauaaccaaauccuugaggaaaacauggacgucgagauauggacuaaagagggagagaagaagaaacuuaggccaagaugguuagaugcaaggacauauucagaccccuuagcacugaaggaauuuaaggauuuugcagcagguagaaaaagcauugcucuggauuuagucacagagauagggcguguuccuagccaccuggcacaccguacaagaaacgcucuggauaauuuaguuauguuacacaccucagaacauggugggagagccuauagacaugcagucgaagaguuacccgagacaauggaaacgcuuuuguuacuaggccugaugauacuguuaacaggaggugccauguuauuucucaucaguggcaaaggcauaggaaaaacaaguauuggucuuaucuguguuauagccaguucagguauguuauggauggcggagauaccuuuacaguggauagcgagcgcaauagugcuagaguucuuuaugaugguacuguuaauucccgaaccugaaaaacagcgcacaccgcaagauaaucaacuugcauaugucgucauaggcauauuaacauuagcggcuauuauagccgccaaugaaaugggucucuuagaaacaacaaagcgugauuuaggaaugucuaaagaaccagguguuguuuccccgacuucguaucucgacguagaucuucacccagccagugcauggacccucuacgcuguugcuacaacaguaauuacuccaaugcuacgucauacgauugaaaauucuacggcaaacguaucacuugcagcgauugcaaaucaagcugucguucuaaugggauuagauaaagguuggccaauaucgaaaauggacuuagguguaccauugcuugcguugggguguuacucgcaaguaaauccucugacguuaacugcugcgguucuacuccucauuacccauuacgcuaucauagguccuggacuccaagccaaggcaacaagagaagcccaaaagcguacugcagcuggaaucaugaaaaaccccacuguggauggaauaaugacaaucgaucuggauccgguaauuuacgacucaaaauuugaaaaacaauuaggacaagucauguuguugguacuaugugccgugcaacuauuguugaugcggacgagcugggcucuaugugaggcuuugacccucgcgacaggaccaauaacuacucucugggaagggaguccuggaaaauuuuggaauacaacgauagcagucucaauggccaauauauuucgcggcaguuaucuagcgggugcagguuuggcguucuccauuaugaaaucuguggggacaggcaaaagaggaaccggaucccagggugaaaccuuaggugagaaauggaagaagaaauuaaaucaauuaagcaggaaagaguuugaucuuuacaagaaaagcgggauuacagaaguugaccgaacagaagcgaaagaaggacuaaagcgcggcgaaacaacccaucaugccgugagcagagguagcgccaaacugcagugguucguagagagaaauauggugauaccugaaggacgcguaauagaucuuggcugcggaagagggggauggucuuacuauugugcuggacuuaagaaaguuacagaaguccggggguauacaaagggaggcccuggucaugaagaaccuguuccaaugucuaccuauggauggaacauagucaaauugaugagugguaaagauguauuuuaucuaccaccagagaaaugcgauacuuuacugugugacauaggagaaagcucuccaaguccgacgguagaagaauccagaacgauaagaguauugaaaauggucgaaccauggcucaaaaauaaucaauuuuguauaaaaguuuugaacccguauaugccgacaguuauagagcaucuugagcgucuccagcgaaaacacgguggcauguuaguaaggaauccucuaagcaggaacagcacucacgaaauguacuggauuucaaauggcacugguaauauaguagcaucuguaaauaugguaaguagguuguuguuaaaccgguuuacaaugacucauagaaggccgacaaucgaaaaagauguagauuugggagcaggaacacgucauguuaaugcugaacccgaaacgccuaauauggaugucaucggcgaacggauaaaaagaauaaaggaagaacauaauaguacauggcauuaugacgaugagaacccauacaaaacgugggcuuaccacgggucauaugaaguuaaagcgacaggcagcgccagcucuaugauuaacgguguagugaaguuauugacuaagccaugggaugucguaccaauggugacacaaauggcgaugacugauacaacaccguuugggcaacaaagaguauuuaaagaaaaagucgacacucgaacgccacgaucaaugccggguacgcgacgugucaugggcauaacagcagaauggcuuuggcgaacacuaggacgcaauaaaaagccaagacuguguaccagagaagaauuuacuaagaaaguaagaacaaaugcagcuaugggagcgguguucacugaggagaaccagugggauucggcaaaagcagcaguggaggaugaagacuucuggaaauuaguagaucgugagagggaguugcacaaacuuggaaaaugcgguuccuguguauacaacaugaugggaaagagagagaagaaacucggagaguucgguaaggcaaaagggucacgugcuaucugguauauguggcuuggagcccgauaucuugaauuugaagcucuagguuucuuaaacgaggaucauugguuuagcagagaaaauucauauagugguguagagggagagggccuccauaaauuaggcuacauuuuaagggauaucaguaaaauaccgggaggugcuauguaugcugaugauaccgcaggcugggauacuagaauaacagaagaugacuuacacaaugaagagaaaauuacccagcaaauggacccagaacaucgacaauuagcaaaugccauauuuaagcugacguaucaaaacaaaguaguaaaaguacagagaccuacccccacagguacaguaauggauauaauuucaaggaaagaucagagggggaguggacaaguagggacauacggguuaaauacguucaccaauauggaagcacaauugauuagacagauggaaggugaggggguuuuaucaaaagcugaccuugaaaauccucaccuucccgagaagaaaauaacucaaugguuagaaaccaaagguguugaaaggcugaaaaggauggcgauaaguggagaugauugcgucguuaaaccaaucgaugauagauuugcgaacgcucuccucgcacucaaugauauggggaaggucagaaaagacauaccacaauggcaaccaaguaagggguggcaugauuggcaacaagugccguuuuguucucaucauuuccacgaacucauuaugaaggacggucgcaagcucguaguaccgugccgaccucaagaugaauugauugguagagccaggauaagucagggugcaggauggaguuuaagggaaacagccugucuaggaaaagcauaugcucaaauguggucauuaauguacuuccaccgcagagaucuaaggcuagccagcaaugcuauuuguagugcaguuccagugcauuggguuccaacaucaaggacuacguggaguauacacgcacaucaucaauggaugacaacagaggauaugcucacuguuuggaauagaguuuggauagaggauaaccccuggauggaagauaagacaccugugacgacgugggaaaacgucccauauuuaggaaaaagagaagaucaguggugugguucccuaauuggccuaacgucucgagcaacuugggcucagaacauaccuacagcuauccaacaaguuagaaguuuaauugguaaugaagaguuuuuagacuauaugccaucgaugaagagauuuagaaaggaagaggaaagugagggagcuauaugguga

SEQ ID NO: 23094 - RNA, 9873 nt, Artificial Sequence
  derived and/or modified CDS sequence (opt6) from DENV-3__JQ922556__SS-prME
acuucauuaugccuuaugaugauucuacccgcagcacucgcauuucaucuuaccaguagggauggagaaccacguaugauuguuggcaaaaaugaacgagguaaaucguuacuauuuaaaaccgcgucgggaauuaauaugugcacucuaauagcgauggauuuaggagaaaugugcgacgauacagugacguauaaauguccucauauuaccgaaguagagccugaggauaucgacuguuggugcaauuuaacaucgacaugggucaccuaugggacauguaaccaagcaggagaacaucgacgugacaaaagaucaguugcacuagcaccucacguagguauggguuuagacacaaggacucaaacauggaugucagcugagggugcuuggaggcaaguggaaaaaguagagacuugggcacuccgucauccgggauucacuauucuagcgcuuuuucuugcacauuauaucgggacuuccuuaacgcaaaaaguagucaucuuuauuuuauuaauguuaguuacaccaucaaugaccaugagauguguaggagucgguaaccgggauuuugucgaaggauuaucuggagcuacauggguugauguaguucuagaacacggagggugcguaacaaccauggccaaaaauaaaccaacauuagacauugaauuacagaaaacggaggcaacgcaacuugcuacacucagaaaauuauguauagaaggaaaaauaacgaauauaacuaccgacagccgauguccaacacaaggcgaagcaguacuaccugaagaacaagaucaaaauuauguguguaaacacacauauguugauagaggcugggggaauggaugcggcuuauucggcaaaggaucuuuggucacuugugcuaaauuccaaugucuagaaccuauagaaggaaaaguaguccaauaugagaacuuaaaauauacuguaauuauaacuguccauaccggugaucaacaucaaguugguaacgaaacgcaaggcguuacugcggagauaacuccacaggcuucaacaaccgaagccauuuuacccgaguaugggacacuaggacuagaauguuccccacgaacaggucuugacuuuaacgaaaugauccuccuuaccaugaaaaacaaagcauggaugguacacagacaaugguucuuugaccuaccacucccuuggaccaguggugccacuacagaaacuccgacauggaacagaaaagaacuuuugguuacguucaaaaacgcucacgcuaagaaacaagagguuguuguauuagggucgcaagaaggugccaugcauaccgcauuaacgggagcaacugaaauccaaaacaguggagguacaucaauauuugcaggccauuuaaaauguagacuaaaaauggacaaacuugaauuaaaaggaauguccuacgcaaugugcacaaacacuuucguccuaaagaaagagguaagugaaacccaacacggcacaauccuaaucaaaguagaauacaaaggagaagacgcgccuuguaaaauaccguuuaguacugaagacggucagggaaaagcacacaacggucguuuaaucacagcaaauccaguagucacuaagaaagaagaaccggugaauauagaagcagagcccccuuuuggugaauccaauauaguuauuggaauaggcgauaaugcacuuaaaauaaauugguacaagaaaggaagcuccauaggaaagauguucgaagcaccggcaagaggggcuagacgaauggcaauauuaggcgauacugcauggguguuuggaucggugggcgguguucuuaacucucuagguaaaaugguccaucagauauuugggagugcuuacacagccuuauucuccggaguaucauggguuaugaaaauagggaucggcguccucuuaacauggaucggauuaaacagcaaaaauacgaguaugagcuucagcuguauagcgauugggaucauuacucuguaucuaggagcaguugugcaagcugacauggguugugucauaaauuggaaagggaaagaacuuaaaugcggaagugggauauuuguaacaaacgaaguccauacuuggacugaacaauacaaguuucaagccgacucccccaagagacucgcgacugcgauugcuggcgcaugggaaaauggcguuugcgggaucagaucaacaacacgaauggaaaaccuauuauggaaacagauagcgaaugaauugaacuauauauuaugggaaaauaauaucaaauuaaccgucgucguuggugauacaauugggguauuagaacaggggaaaaggacuuuaacaccacagccaauggagcugaaauacucauggaaaacuugggguaaagcgaaaauaguaacggcagagacacaaaauaguuccuuuauaauagacggaccaaguaccccugaauguccguccgcaagucgugcauggaauguuugggaaguagaggauuauggguuuggaguguuuacaacaaacauauggcuuaaauuacgggaaguauauacccagaugugugaucaucgauuaaugaguccggcaguaaaagacgagagagcaguucaugcugauaugggauacuggauugaaagucagaaaaaugggaguuggaaacucgagaaagccucguuaaucgagguaaaaaccuguacuuggcccaagucgcacacguuauggaguaacggcguauuagaaagugauaugauaaucccuaagagccuggcuggcccgauuucgcaacauaauuacagaccgggauaucauacgcagacagccggacccuggcaucucggaaaacucgaacuagauuucaacuauugugaagggacaacugugguuaucacugaaaacugcgguacaagagguccuucccuacgaacgacaaccgucucagguaagcugauacaugaaugguguuguagaagcugcacucuuccaccccuccgguauaugggcgaggaugggugcugguaugguauggagauucgacccauaucugagaaagaagaaaacauggugaaaucucuuguaucugccgguaguggaaaggucgauaacuucaccaugggcguauugugccuagcaauccucuucgaggaagucaugaggggcaaguuuggcaagaaacauaugauagccgguguauucuuuacauucguucuuuuauuaagugggcaaaucaccuggagagauauggcacacacacuaauaaugaucgguucuaaugcaucggauagaauggguauggguguuacguaccuagcguuaauagcaaccuuuaaaauacaacccuucuuagcgcuaggauucuucuuaagaaagcuaacaaguagagaaaauuugcuauuaggaguagguuuagcaauggcuacuacacuucaacucccggaggauauugaacagauggcaaacggaauugccuuaggguuaauggcguuuaaauugaucacacaauuugaaacuuaucaacuauggacugcacuuauaagucucacuugcucgaacacgauauuuacgcuaacaguugcauggagaacagcuacccucauucucgcgggagucaguuuacuaccugucugucaaucaaguaguaugagaaaaacugauugguuaccgaugaccguagcagccauggggguaccgccucuaccauuauuuauauucagccuaaaagauacacuaaaaagaagaucauggccuuuaaacgagggaguuauggcagucggacucguuaguauacuugcuucaucacuauugcguaaugauguaccuauggcaggaccuuugguggcaggaggauuauuaauugccugcuauguaggaacagggaccagugcagacuugacuguggaacaggcagcggauguaacuugggaggaagaagccgaacaaacuggcgugucacauaaucuaaugauaacaguagaugaugaugggaccaugagaaucaaggacgaugagaccgaaaacauacugaccguucuucuuaaaacugcguuauugauagucagugggauuuucccauacaguauuccagcaacguuauugguuuggcauaccuggcaaaaacaaacacagcgcuccggcguccuaugggauguaccgucuccgcccgaaacgcaaaaagcagagcuugaggaagggguuuacagaauaaaacaacaagggauacuaggaaagacacagguaggaguaggcgugcaaaaagaaggaguauuucauacaauguggcauguuaccagaggggcaguccuaacacauaauggaaaaagauuagaacccaacugggcaagcgugaaaaaggaccuuauuuccuacgggggaggauggaggcugucaccacaauggcaaaagggagaagaaguacaaguaauuaccguagaacccggaaagaauccaaagaacuuucaaacgaugccggguacuuuucaaacaacaacuggugaaauaggugcaauugcacuugacuuuaaaccaggcaccucuggaucaccaauuauaaacagagaaggaaagguuguaggauuauauggcaaugguguaguaacaaagaauggugguuacgucucgggaauugcucaaacuaaugcugaacccgaugguccuacaccggaguuggaagaagaaauguucaagaagaggaaucuuacaauaauggaucuacauccuggaaguggaaaaaccaggaaauacuuaccagcaauagucagagaagcaauuaacagacgacuucgaaccuuaauccucgcuccaacgcgcguuguggcagcugagauggaagaagcauuaaaaggauugccaaucagauaccagacaacagcaacaaagucugaacauacagggcgugaaauaguagacuugaugugucaugcaacauucaccaugagauugcuaucucccgucagaguucccaacuauaaucucauaauaauggacgaagcucacuucacagacccagccucaauagcugcgcgagguuauauaucaacgcgaguugguaugggagaggcggcugcuauuuucaugaccgcgacuccaccggggacagcugacgcuuucccgcaaagcaaugcgccgauacaagaugaagaaagagacauuccugagaggaguuggaacuccggcaaugaauggauaaccgauuuugcagguaaaacuguaugguucgucccuucaauaaaggccggaaacgacaucgccaauugccuacguaaaaauggaaagaaaguaauucaacucucgagaaaaacauucgaaacagaguaccagaaaacuaaauuaaacgauugggauuuuguuggaacgaccgauauaucagaaaugggugccaauuucaaagccgauagaguaaucgauccgcgccgaugucuuaagccagggauucuuacugacggacccgagggaguaauauuagcagguccuaugccaguaacagccgcaucagcggcacaaagacgugggagagugggacggaacccccaaaaagagaaugaucaauauaucuucacaggccaaccucugaacaacgaugaggaucacgcccacuggaccgaagcgaaaaugcuuuuagauaauauuaacaccccagaaggcauaauacccgcccuuuuugaaccugaaagagagaaguccgcugcuauugauggagaguauaggcuuaaaggggaaaguagaaagacuuuugucgaauuaaugcgacguggagaucuuccugucuggcuagcacauaaaguagcaagugaagguauuaaauacacggauagaaaauggugcuuugauggacaaagaaacaaucagauuuuagaggaaaacauggauguggaaauauggacaaaagaaggagagaaaauuaaauugagaccgcgcugguuagaugcaagaacauauucggauccguuagccuuaaaggaguucaaggacuuugcagcagguagaaaaagcauagcucuagaucuuguaacggaaauuggaagagugcccucccaucuggcucaccggacgaggaacgcucuagacaaucuugucauguugcauaccagcgaacaugguggucgugccuaucgccacgcaguagaggaacuucccgaaacgauggaaacacuccuucuccuagguuuaaugauacuguuaacuggcggugcuaugcuauuucuuauauccggaaaaggaauuggcaaaacaucaauaggucuaaucugcgucauagcuuccucuggcaugcuuuggauggcagaaauuccccuacaauggauagccucagcaaucguuuuagaguucuuuaugauggucuuauuaauaccggagccugaaaaacaaagaacaccucaggauaaucaacuugcguauguaguuauaggaauacuaacacuggcugccauuauugcugccaaugaaaugggcuuauuagaaaccacuaaaagagaucuagggguuucgaaagagccgggaguaguuucaccgacuucauaccuugacguugacuuacacccugccucugcauggacauuauacgccguggcgacuacaguuaucacgccgaugcuacgucauacaauugaaaauucaacagcgaacguaucacuagccgcgaucgccaaucaggcagucguauuaauggggcucgacaagggauggccgauuucaaaaauggaucugggaguuccacuacuagcacucgguugcuacucacaagugaauccuuuaacccuaacagcagcuguguuauuacuaauaacacauuacgccaucaucgggccuggacuacaagcaaaagccacgagagaagcgcagaaacggacugcagcuggaauuaugaaaaauccaacaguggacggaauaauaacgauugacuuagacccuguuauuuaugacaguaaauucgagaagcagcucgggcaaguaauguugcugguccuaugugcaguucaacuucuuuuaaugagaacaaguugggcccuuugcgaagcacuuacgcuagcgaccggucccauaaccacauugugggaaggaucgccuggaaaauuuuggaauacaacuauugcgguuucuauggcaaacauuuucagaggcucauacuuagcaggagcgggauuggcuuuuucaaucaugaaaagcguaggcacaggaaaaagaggaacagguucucagggcgaaacccucggcgagaaguggaagaagaaacucaaucaacuaucacgaaaagaguucgacuuauauaagaaaaguggcauaacagaaguugacaggacugaagcaaaggaaggucuaaaaagaggcgaacuaacccaucacgcuguaaguagagguucggcuaaacuacaaugguuuguagaacgcaauauggugauuccugaaggaagaguaauugaucuaggaugcggccgaggugguuggaguuacuacugcgcugggcucaagaagguaacggaaguuagggguuauacgaaggguggaccgggccacgaagaaccagucccaaugagcacuuacggauggaauauagucaagcuaaugaguggaaaagacguauuuuacuugccuccagaaaagugugacacacuacuaugugacauaggggaaagcaguccgaguccaacuguugaggagucaagaaccauccgaguacuuaagaugguugaaccauggcugaagaauaaucaguucugcauaaaaguacuaaacccuuacaugccagcgguuauagaacacuuagaacgccuacaacgaaagcacgguggcaugcuuguaagaaauccucucuccagaaauagcacacaugaaauguacuggauuuccaauggaacugggaauauuguuuccaguguuaacaugguaagucguuuauuacucaaucgauuuacgaugacacacaggagacccacaauugaaaaggaugucgacuuaggugcaggcacucgacacgucaaugcagagccggagacaccgaauauggaugucauuggagaaagaauaaaaagaauaaaagaagaacacaauagcaccuggcauuaugaugacgaaaauccuuauaaaacaugggcuuaucacggcagcuaugagguaaaagcaacaggaagugggucaagcaugauaaacggugugguaaaguuguuaacaaagccuugggauguaguaccgaugguaacccaaauggccaugacugacacaacacccuucggucaacaaaggguuuucaaggaaaaaguagacacgagaacgcccagaccgaugccaggcacgagaaaagugauggaaauaacagcagaauggcucuggcgaacuuuaggaagaaacaaacgcccccgauuaugcacccgugaagaguucacgaagaaaguucgaaccaaugcggccaugggagcgguguucacugaagaaaaucaaugggauucugccaaagcagcaguggaggacgaagaauuuuggaagcuaguugaucgagagagagagcuacauaagcugggcaaaugugggaguuguguauacaauaugaugggcggaagagaaaagaaacuaggagaauuuggaaaagcuaagggaagucgcgcgauaugguacauguggcuuggagcacgauaucucgaguuugaagcauuaggauucuuaaaugaagaucacugguuuagccgcgaaaauucguacagcggaguagaaggagagggccuacauaaauuagguuauauauugcgagacaucucaaaaauaccagggggagcgauguaugccgaugauacagcagggugggacacacguauuacugaagacgaucugcacaacgaagagaagauuacgcaacaaauggaucccgaacauagauuacuggcgaacgccauauuuaaacuuaccuaccagaauaagguaguuaaaguacaaaggccuacaccuacggggacaguaauggauauuaucucuagaaaagaccagagaggaaguggacaggucggcacuuauggccucaacacauucacaaacauggaagcucaauuagucagacaaauggaaggagagggaguucuuucgaaagcagaucuugaaaacccacaucuuccagagaagaaaauaacccaaugguuggaaacuaaaggagucgaaagauuaaaacgcauggcuaucucaggagacgauuguguggugaaaccuaucgacgauagauuugcuaacgcccuauuagcccuaaaugauaugggaaaagugaggaaagacauaccacaguggcagccuagcaaaggauggcaugacuggcaacaagugccauuuuguagucaucacuuucaugaacucauuaugaaagacggucgaaaacucguugugccguguagaccacaggacgaauuaauuggccgagccagaauaucacagggggcuggauggagucuucgugagacagcgugucuuggaaaagcguaugcgcaaauguggucacuaauguacuuucacaggcgagacuuaagauuggcaaguaacgcgauauguucugcagugcccguacacugggugacaacuucaagaacgaccuggucgauacacgcgcaucaccaauggaugacuacggaggacaugcuuacuguauggaaucgcguuuggaucgaagacaaucccuggauggaagacaagacaccuguuaccaccugggaaaacguuccauaucuaggaaagcgggaagaccaguggugcggauccuuaauuggguuaaccaguagggcgacuugggcacagaacauuccgacugcuauucaacaaguaaggagcuuaauagguaaugaagaauuuuuggacuacaugccaagcaugaaaagauucagaaaggaagaagaaucagaaggcgccauuugguaa

SEQ ID NO: 23095 - RNA, 9873 nt, Artificial Sequence
  derived and/or modified CDS sequence (opt6) from DENV-3__JQ922557__SS-prME
accagcuuauguuuaaugaugauucuacccgcugcauuagcuuuucaucuuacaagccgugauggagaaccaaggaugauaguuggcaaaaaugaacguggaaaaucauugcuauuuaaaaccgcaucagguauuaacaugugcaccuuaauagcaauggauuuaggugaaaugugugacgacacuguaacauauaaauguccacauaucacagaagucgaaccugaagauauagauuguuggugcaacuuaacaaguacauggguaacguacggaacuugcaaccaagcaggagaacacagacgagauaaaagaagcguagcguuagcgccacauguaggcaugggauuagacacacguacacaaaccuggaugagugccgaaggugcuuggagacaaguggaaaaaguggaaacuugggcacuucggcacccuggauucaccauuuuagcuuuauuucucgcucauuacauuggaacauccuuaacacaaaaaguuguaauauuuauccuccugaugcuugugacgccaucaaugaccaugcguugcgucggcguaggcaacagagacuuuguugaacgguuguccggagcuacuuggguggaugucguacuagaacauggcggaugcguaacaaccauggccaaaaacaaaccaacucuugacauugaauuacagaaaacugaagccacucaacuagcgacgcuuaggaaacucuguauagaaggaaaaauaaccaacauuacaacagauagucgaugcccgacucagggggaagcuguucuacccgaggagcaagaucaaaacuauguguguaaacacacuuauguugaccgugggugggguaauggaugcggacuauuuggaaaagguucuuuaguuacuugugcgaaauuucaaugccuagaaccuauagaagggaagguaguacaauaugaaaaccuaaaauacacaguuauaauaacaguacacacuggagaucaacaccaaguagguaacgagacacaaggaguuacagcagaaauaacaccacaagcuaguacgaccgaagcuauccuccccgaauacgggacacuaggccuggaguguucuccucgaacgggauuagauuuuaaugagaugauacuucucaccaugaaaaacaaagcguggaugguccacagacaaugguucuucgauuugccccuaccuuggacaaguggugcuacuacagagacgccuacguggaaucgaaaggaauugcuagucacguucaaaaacgcgcacgcgaagaaacaagagguagucguucuaggaucucaagagggugcgaugcauaccgcgcuuacaggcgccacagaaauacaaaauagcggaggaacuagcauuuucgcuggacauuuaaaaugccgucuaaaaauggauaaacuagaguugaaagggaugaguuacgcaauguguacgaacacguuuguacucaagaaagaagucagugaaacccagcauggaacaauuuuaauuaaaguagaguacaaaggugaagacgcacccuguaaaaucccuuucucuacagaggauggacaagggaaagcucauaaugggcgucuuauaacugcaaacccggugguuaccaaaaaggaggaaccgguuaauaucgaagcagaaccaccauuuggggaaaguaacauagugaucggaaucggagauaaugcguuaaaaauuaauugguauaagaaaggaucuucuauagguaaaauguuugaggcuacagccagaggcgcaagacguauggcaauacucggugacacagcaugggacuucggaucaguuggcggcguucuuaacaguuugggaaagaugguacaccaaauuuuuggaagcgccuacacugcucuuuucucuggggugagcugggucaugaagauaggaauagguguacuucugaccuggaucggguuaaauucgaaaaacacuagcaugucauucucuuguauugcaauagggauuaucacguuguauuugggugcuguaguacaagcagacaugggaugcguuauaaauuggaaaggcaaggaacuaaaaugcggaaguggaauauuugucacaaaugaagugcauacuuggacagagcaauauaaauuccaagcagacaguccaaaacgucuagcuacagcaauagcuggagcuugggaaaacggaguuugugguauacguagcacaacccgaauggaaaaccuauuauggaagcaaauugcaaacgaacuaaauuacauuuuaugggaaaauaauauuaaguugaccgugguuguaggcgacaccauaggcguguuagaacaggguaagcggacacucaccccucaaccuauggaauuaaaauacagcuggaaaaccugggggaaagcgaaaauagugacugcugagacacaaaacaguucauuuaucauugauggccccaacacgccugaaugcccaucagcuucccgagcuuggaaugucugggaaguagaagauuauggcuucgggguuuuuaccacuaauauuuggcugaagcugagggaagucuauacgcaaaugugugaccaucgacuuaugucagcagcuguaaaagaugagagagcggugcaugcugauaugggauacuggauagaaagucagaaaaauggaucguggaaauuagaaaaggcuucgcuaauagaaguaaagacuuguacauggccaaaaagucauacacucuggagcaauggagugcuugaaucagacaugauuauaccaaaaucuuuggcgggaccaauaucccaacauaacuaccgaccugguuaucauacacagacggcuggcccauggcaccuaggaaaauuagagcuagauuucaacuauugcgaagguacuacaguagucauuacugagaacugugguacaagaggaccaagucuacgaacuaccacggugucaggaaaauuaauucaugaaugguguugcaggagcuguacacuuccaccucuaagauacaugggcgaagacggguguugguauggaauggaaauaagacccaucagcgagaaggaggaaaauaugguuaaauccuuagugagcgcagguaaaucaaaacgagauaacagcacaaugggagucuuaugccuugcuauuuuauucgaagaaguuaugaggggcaaauuugggaagaaacacaugauugcaggaguauucuuuacguuuguguuauuauuaucaggccaaaucacauggagagauauggcucacacgcucaucaugauaggaaguaacgcgagugaucgcaugggcaugggcguuacguacuuagcgcuaauugcuacguuuaaaauacaacccuuccuagcguuaggauucuuuuuaagaaaacuuacaucacgugaaaauuuaauguuggggguuggacucgccauggccaccacacuccaguuaccagaagauaucgaacaaauggcgaaugguauugcucucgguuuaauggcgcuuaaacuaauaacccaauuugaaacuuaucaacuuuggaccgcauuaauaucauuaaccuguagcaacacaauauucacgcuaacggucgccuggagaacagcaacuuuaauucuugcuggugucaguuuacuaccgguaugucagaguucaucuaugaggaaaacagauugguugcccaugaccguagcagcgaugggcgucccuccuuuaccuuuauucauuuuuagucuaaaagacacgcuuaaaaggcggucuuggcccuugaaugaggguguuauggcagugggacugguuaguauccuggcaagcuccuuacuuaggaaugacguaccaauggcgggaccauuggucgcaggagguuuacuuauagcuugcuauguaauaacaggcacuucagcagacuuaaccguagaaaaggcggcugacgucacaugggaagaagaagccgagcaaaccggcgugagccacaaucuccucauaacaguagaugacaacggcacaaugagaauuaaagacgaugagaccgaaauaauacuaacgguauuauugaaaacggcauuacagauugucaguggaaucuuucccuauaguauaccagcgaccuuacugguuuggcacacauggcaaaagcaaacacagagaagcggugucuuaugggauguaccaucaccuccagagacccagaaggcagaacucgaagaggguguuuauaggauaaaacaacaagggauacuaggaaagacacagguagggguaggaguacaaaaagaaggaguguuccacacuauguggcacguaacccgaggagcaguacuaacacauaacgggaaacgauuagaaccuaacugggcuucagucaagaaagaucucauaucauacggagguggguggagacugucagcacaauggcagaaaggcgaggagguacagguuauugcuguagagccuggcaaaaacccgaaaaacuuucaaacaaugccagggacauuccaaacaacaacaggggagauaggagcaaucgcauuggacuucaagccaggaacaaguggcucacccauaauaaaucgagaagggaaagucguuggacuuuauggaaacggagucgugacuaaaaacggugauuacuuaucugguauagcucagacaaaugccgagccauauggaccaagucccgaucuggaagaagaaauguucaagaaacgcaaacuuacuauuauggaccugcauccggguuccggacaaacuuuaaaauaccuaccggcuauuguacgugaugcuauaaaaaggagacuaagaauauuaauucuagcaccaacuaggguaguagcagcagagauggaggaggccuuaaagggacuucccauaagauaucaaacuacugcaacgaaaucugaacacaccgguagggaaauugucgauuuaaugugucaugccacguucacaaugcgcuuauuaucuccgguucguguuccaaacuacaaucucauaauuauggacgaagcucauuucacugacccagccaguauagcagcaaggggauauauaagcacgcggguggggaugggcgaagcagcagcuauauucaugacagcaacacccccagguacagccgaugcauuuccucaaucaaaugcgccuauccaagaugcagagcgugacauaccggagaggucauggaauaguggaaaugaauggaucacagauuucgcuggaaaaacagucugguuugugccuucgauaaaagcagggaaugacauugccaacuguuuaagaaagaaugguaaaaaggucauacaguugucgagaaaaacguuugaaacugaauaccagaagacuaagcucaaugauugggauuuuguagucaccacugauauaagugaaaugggugcuaacuuuaaggcugacagaguaauagacccgcgacgcugucuaaagcccgucaucuugacggaugggcccaaacgcguaauucuagcugggccgaugcccgauacugcagcaagcgccgcccaacgccguggacggguuggcaggaauccucaaaaagagaacgaucaauauaucuucccagggcagccccuaaauacugacgaggaucaugcgcauuggccagagacaaaauuauugauggauuuauuuacuaccccagagggaauacuaccuagucauuucgacccucacggcgaaaacuucccugagaucagcggagaguauagacuaaaaggagaaucuagaaaaacauucguagaguuaaugagacguggggaucuaccuguaugguuagcucacaaaguugcuagugaaggaauaaaauauacagaucguaaaugguguuucgauggacaacggaauaaucaaauuuuggaagaaaauauggauguagagauauggacuaaagagggugagaagaagaaacuacguccaagauggcuggaugccagaacguauucugacccauuggcucuuaaagaauuuaaagauuuugcugcagguagaaagucuauugcacuugauuuagugacugaaauagggcgaguaccuagucacuuagcgcaccguacgcguaaugcguuagacaaccucguaaugcuacauacgucagaacacggcggucgagcguaucggcacgccguggaagaacucccagaaacuauggagacuuuauuacuucucggucugaugauacuccuaacaggaggugcuaugcuauuucuaauaucggguaaaggaauaggaaaaacuagcauuggccucaucuguguuauugcauccagcggcauguuauggauggcugaaaucccucuacaauggaucgcaucagcaauaguguuggaguuuuucaugaugguauuacuuauaccagaaccggaaaaacagagaaccccacaagauaaucaacuagcguauguuguuauuggaauccuaacguuggcagcuauaauagcugcaaacgaaauggguuuacuagaaacuacgaaaagagauuuaggaaugagcaaagaaccaggcguagucucaccaacuagcuauuuggacguugacagucaucccgcgagugcauggacuuuguaugcaguggcaacuacagugauuacuccaaugcugcgacauacgauagaaaauucuacagcaaacguaucccuagcggcgauagcaaaucaagcaguuguuuuaaugggguuagauaaagguuggccaauuucaaaaauggaucuggggguaccauuacuugcgcuuggauguuacucgcagguuaauccgcuaacacuaaccgcagcuguauugcuauuaauaacucacuaugcaauuauuggaccaggcuuacaagcaaaagcuacacgcgaagcccagaaaagaacugcagcggggauaaugaaaaauccaaccguagaugguauuauaacaaucgaccuagauccagugauauacgauagcaaauuugaaaaacaguugggacaaguuauguuauuaguacucugcgcaguucaauugcuauuaaugcgaacaucaugggcauuaugcgaagcacuuacacuugcuacaggcccaaugacaaccuuaugggagggcucacccgguaaaauuuggaacacaacaauagccguauccauggcaaauauuuuucgggguaguuaucuugccggugcuggacuggccuucagcauuaugaaaucagucggcacagggaaaaggggcaccggcucacaaggcgagacguugggagaaaaauggaaaaagaaacuuaaucaauuaucacguaaagaauuugacuuauauaagaaaucggguauaaccgaagucgauagaacugaggcaaaagagggacuuaaacgaggagaaacaacgcaucaugcggugaguagggggagugcgaaacuccaaugguuuguugagcgaaauauggugauaccugaaggaagggugauugauuuagguuguggaagagguggcugguccuauuauugugcgggccucaagaaaguaacagaaguaagaggauauacuaaagguggaccuggacaugaagaacccguaccaaugagcacauauggguggaauauaguaaaguuaaugagugguaaggauguauucuaucuaccaccagaaaaaugugacacacucuuaugcgacauaggugagucuucuccuucuccuacagucgaagaaucaagaacaauaagagugcuaaaaaugguagagcccugguuaaagaacaaucaguuuugcauaaaaguucuaaauccguacaugccagcaguaauagagcaucuugaacgguugcaacgaaaacacggaggcauguuaguccgaaauccucucuccagaaauagcacucacgaaaugcauuggauaaguaaugguaccgggaauauaguaagcaguguaaacauggugucucguuuacucuuaaacagauuuacuaugacacaccgcaggccaacuauagagaaggauguugaucucggugcaggcacccggcacguuaaugccgagccagaaacaccaaauauggacguaauaggagaacgcaucaaacgcauuaaagaggaacacaacucgacguggcauuaugacgaugaaaauccauauaaaacaugggccuaccacggaucauacgaggugaaagcuacuggaagcgcaucaucuaugaucaaugguguaguaaaauugcucacaaaaccuugggacguuguacccaugguaacgcagauggccaugacugauacuacaccguucggucaacaaaggguuuucaaagagaaaguagauacacgaacaccaaggccaaugccaggaacacgaaaaguuauggagaucacggcugagugguuauggcguacccugggccguaacaagcgaccaagacuauguacaagggaagaauuuacuaagaaagugagaacuaaugcagcaaugggagccguauucacagaagagaaccaaugggauucagcaaaagcagcaguagaagacgaagaauuuuggaaacuuguugaucgugaaagggaauuacacaaacuugguaaauguggauccuguguauauaauaugauggggaaaagagagaagaaauuaggagaauuugggaaggccaaagguagucgugcaauaugguauauguggcuuggagcuagauaucuagaauuugaagcucuuggauuuuuaaaugaagaccauugguucucuagagaaaauucuuauucuggcguugagggagaaggauuacauaaacuugguuauauucuuagagacaucaguaaaauacccggaggugcaauguacgcugaugauaccgcagggugggacacaaggauaacugaagacgaccuacacaaugaagaaaagaucacacaacaaauggaucccgaacauagauuacuagccaacgcuauauuuaaacuuacauaucaaaauaaggugguaaaaguacaacgacccacgccuacugguacaguaauggauaucauuaguagaaaagaucaaagggguagcggacaaguugguacauacggacucaacaccuucacuaacauggaagcccaacucgugagacagauggaaggcgaaggcguauugaguaaggcugaucuugaaaacccucacuugcccgaaaagaagauuacacaauggcuugaaacuaaaggcguagagagguuaaaaaggauggcuauuaguggcgacgauugcgucguuaaaccgauagacgaucgauuugcuaaugcuuuguuagcauugaacgauauggguaaaguucgaaaagacauuccucaauggcaaccuagcaaaggauggcaugauuggcaacaagugccguuuuguagucaucauuuccaugaacuaauaaugaaggacggucgaaaguuaguuguacccuguagaccucaagaugaacucauagguagagcucgaauuucacaaggagcuggguggucuuuaagggaaacagcuugcuuaggcaaagccuacgcgcaaauguggagucucauguacuuccacagaagagaccuaaggcuugccucaaaugccauuuguagcgcgguuccgguacauuggguuccaacuucgagaacaaccugguccauacaugcucaccaucaauggaugacaacugaagauauguuaacuguguggaaucgggucuggauagaagauaauccauggauggaggacaagacaccugucacuacgugggagaauccaccuuauuuaggaaaacgugaggaccaguggugcggauccauuaucggguuauccaguagagcuacuugggcgcaaaauaucccaacggcaauacaacagguaagguccuuaaucgguaacgaagaauuuuuagauuauaugccaucaaugaaaagauuucguaaagaagaagaguccgagggugccauuugguag

SEQ ID NO: 23096 - RNA, 9873 nt, Artificial Sequence
  derived and/or modified CDS sequence (opt6) from DENV-3__JQ922555__SS-prME
accucccuaugcuuaaugaugauucuaccagcagcauuagcguuucaucuaaccucaagggauggugaaccuagaaugauuguuggcaaaaaugaacgugggaaaagccuccuauucaaaaccgccagcgguauuaauauguguacucugauagcgauggauuugggcgaaaugugugacgacacgguaacauacaaaugcccucauauuacugaaguugaaccggaagauauagacugcuggugcaacuuaacaagcacauggguuacuuacggaacauguaaccaggcgggagaacacagaagagacaaacguuccguagcauuagcaccucacgucggaauggggcuagauacucgaacccaaacuuggaugucagcagaaggggcuuggcggcaagucgagaaaguagaaaccugggcguuaagacaucccggauuuaccauacuagcacuguuucuugcacacuacauagguacaagucuaacucaaaaaguaguuaucuuuauucuauuaaugcuagucacgccaucaaugacuaugagguguguuggagugggaaaccgagacuucguggagggucuaucaggagcaaccuggguugacguaguucucgaacacggaggaugcguuacuacuauggcgaaaaacaaacccacacuagacauagagcugcagaaaaccgaggcaacacagcucgcaacgcuuagaaaacucuguauagaaggcaaaauaaccaauauaacaacagauagccgaugucccacacagggcgaagcagugcuuccugaagaacaagaccaaaauuauguguguaaacacacauauguagaccgaggaugggguaacggauguggauuauucggaaaaggcagccucguuacuugugcaaaauuucaaugccuagaauccauugagggcaaagugguucaauaugagaaucugaaauauacuguuauaaucacaguacauacgggugaccaacaccaaguuggaaacgaaacacaggguguaacggcugaaaucacaccccaagcauccacagcugaggcaauacucccggaauaugguacauuaggguuggaaugcucgccaagaacaggccuggauuucaacgaaaugaucuuauugacgaugaaaaacaaggcuuggaugggacaucgccagaugcucuuugaucuuccuacuccguggacaaguggaacgacgaccgagacuagcgccuggaaucgaaaagagccauuuguaacauuuaaaaaugcacacacuaagaaacaagaaguaguuguauugggaucucaagaaggagcaaugcauaccgccuuaacaggggcaacugaaauacaaaauagcggagggacaucgaucuuugcaggucauuuaaaaugccgccucaaaauggacaaacuggaacuuaaagggaugaguuaugcaauguguacaaacacauucguguuaaagaaagagguaucagaaacgcaacacgguacgauucuaguaaaaguagaauauaaaggagaagaugcgccauguaaaauaccguuuuccacugaggacgggcaagggaaagcacauaacggacgacucauuacugcaaaccccgucgucacgaaaaaggaagaaccaguuaacaucgaggcugaaccacccuuuggcgaaucuaacauuguuauaggaauuggcgacaaagcacuaaaaauaaacugguacagaaaggguuccucaauuggcaaaauguuugaggccacuuccagaggcgcaaggagaauggcgauuuugggcgauacugcaugggacuuuggaucuguggguggaguacucaauucgcuaggaaaaaugguccaucagauauucggaucugcauauacugcuuuauuuuccggaguaucauggguaaugaaaaucgguauaggcguacuacuaacauggaucggcuugaacagcaaaaauacgagcaugucuuuuucauguaucgcuauaggaauaauaacauuauacuuaggggcuguaguucaagccgauaugggaugcguaauaaauuggaaagguaaggaauuaaaaugcggcaguggcauauuuguaacgaaugagguccauacauggacugaacaauauaaguuccaggcggacucuccaaaaagacuugcaaccgcgauugccggugcaugggagaauggagucugugguauucgaucaacuacucggauggaaaaccuucucuggaaacaaauugcgaaugaauuaaacuauauuuuaugggagaacaauaucaaacucaccguugucgugggcgauacaauugggguauuggaacaagggaaaagaacauugacaccccaaccaauggaacuaaaguauaguuggaaaaccuggggaaaagccaaaauuguaaccgcagaaacucaaaauucaaguuuuauaaucgacgguccaaacacaccggaauguccauccgcaagccgggcguggaacguaugggaaguagaagacuauggauucgguguuuucacaacaaauaucuggcuaaaauuaagagagguauauacucagaucugugaucacagauugaugagcgcggcuguuaaggaugaaagagcaguacaugcagacaugggauacuggauagaaagccagaaaaaugguaguuggaaacuagaaaaagcaucgcuaauagagguuaaaacaagcacauggcccaaaagccauacacuuuggucaaauggaguacaagagagcgauaugauuauucccaaaucucuagccggaccuauuucucagcacaauuacagaccuggguaucauacccaaacggcagggccauggcacuugggaaaauuggaacucgauuucaauuauugcgaagggacuacaguuguaauaaccgaaaacugcgggacucgagguccaucauuaaggacaacgacagugagcggaaaguuaauccaugaauggugcugccgaaguuguacuuugccuccauugcguuacaugggugaagauggauguugguauggaauggagauaagacccaucucagaaaaggaagaaaacaugguaaaaucguuagcaucugcugguucugggaaagucgauaauuucacaaugggggugcugugucuggcuauacucuucgaggaagucaugcgugguaaauuugguaagaaacauaugauagccgguguucucuuuacauuuguacugcuauuaaguggacaaauaacuuggcgagacauggcaagaacguugauaaugauagggaguaaugcaucggaucgcauggguaugggaguaaccuaucuagcauugaucgcuacuuucaaaauccagccguuucuugcacuuggauucuuuuuacgaaaacucacgagucgcgaaaacuugcugcucggcguuggucuagccauggcaacaacacuucaguugcccgaagauauagaacaaauggccaauggcauugcacuugggcugauggcuuuaaaacuaauaacccaauuugagacuuaccagcuauggacagccuuagugucuuuaacuugcaguaauacaaucuuuaccuugaccguugcguggagaacagcuacauugauacuagcgggcguaagccuacuuccaguaugucaaucgaguucaaugaggaaaacagauugguuaccaaugacuguagccgcgaugggcguaccuccuuugccauuguucauuuuuagucugaaagauacacuaaaaagacgaaguuggccccuaaaugaaggagucauggcugucgggcuggugagcauuuuagcuagcagccuucuuaggaacgguguuccaauggcggguccauugguagccggcggucuucugauagcguguuauguuauuacaggaacuucagcugaucuaacaguggaaaaagcagccgauguaacaugggaggaggaagcggaacagaccggcguaagucauaaucuaaugauaacgguagaugacgaugguaccaugcggauaaaagacgaugaaaccgagaauauacucacaguauuauuaaaaacagcucuauugaucgucucagggauauuuccauacucaauacccgcuacgcuccuuguauggcauaccuggcaaaagcaaacgcaacgaucagguguguugugggaugucccuaguccaccugaaacccaaaaggcggaacuagaagaaggaguuuaccgaauuaagcaacaaggaauauuuggaaaaacccaaguugguguaggagugcaaaaggaggguguuuuccauaccauguggcauguuacaagaggagcaguucuaacacauaaugggaaaagguuggaaccaaauugggcuaguguuaaaaaggaccuuauuucguacggcggagguuggagguuaucggcacaauggcaaaaaggagaagaagugcagguuaucgcgguagaaccugggaagaauccaaagaacuuucaaacgaugccgggcaccuuucaaacaacaucaggggaaauuggggcuaucgcuuuagauuucaaaccugguaccucgggaaguccaauuauuaaccgagaagggaagguggucggccuuuacggaaacggaguaguaacaaagaauggcggguacgugagcgguaucgcgcaaacaaaugcagaaccagacggcccgacaccggaguuagaagaggagauguuuaaaaagagaaauuuaacgaucauggauuuacauccugguaguggaaagacucguaaauaccucccagcuauaguuagagaagccaucaaaagacgauuaagaacacugauacuagcuccgacucgaguaguugcggcagaaauggaagaggcccuaaaagguuugccaauccgauaccaaacgacagcuacaaaaucggagcacacagggcgggaaauagucgaucucaugugucaugcuacguuuacgaugagacuauuaaguccugugaggguaccaaacuacaacuugaucauaauggacgaggcacauuuuacggaucccgcgagcauagccgccaggggguacauuaguacacgaguagguaugggugaggcugcugcuauauucaugacagcgacgccaccugguacagcagacgcauuuccgcaaaguaaugcaccgauucaagaugaagaaagagauauaccugagaggagcuggaacuccgguaacgaauggauaacggacuuugcaggaaaaacuguuugguucgucccaucaauuaaggcuggcaacgauauagccaacugcuugcggaaaaauggcaagaaagucauacaacuaucacgaaagacuuuugacaccgaguaucagaaaacaaagcuaaacgauugggauuucgugguaacuaccgauauaucugaaaugggggcaaauuuuaaggcugauaggguaauugauccuagaagaugcuuaaagccagugauauuaacugaugguccagaacgaguuauacuggcagggccaaugccugugaccgcugcuuccgcugcucaaagaagaggaagaguaggaagaaauccacaaaaggaaaaugaucaauauauuuuuacuggacaaccacugaauaacgaugaagaccaugcacacuggacugacgcuaagauguuauuagaaaacauuaauacuccggaaggaauaaucccagccuuguuugagccugaacgagaaaagagcgcaggacuggacggagaauacagauugaaaggagagucaagaaaaacauucguugaauuaaugcggagaggagacuuaccgguaugguuggcccacaagguugcguccgaagguauacucuacacagaucguaaaugguguuucgacggacagcgaaacaaccaaauacuugaagaaaacauggauguugaaauauggacuaaggaaggagagaaaaagaaacugagacccagguggcuagaugcaaggacauauucagacccacuagcauugaaagaguuuaaagacuuugcugcagguaggaaaucuauagcauuagacuuaguaaccgaaauaggacgcguaucaagucauuuagcucacaggaccagaaaugcccuggacaauaaaaugaugcuacacacuucagaauauggaggaagggcauauagacacgcaguggaggaauuaccagagaccauggaaacucuacuucuacuagggcucaugauauuguuaacugguggagcuauguuguuccucauaagugguaagggaauaggcaagacgucaauuggacuuauauguguaauugcguccucaggcauguuguggauggcggauguaccauuacaguggauagccucggcgauagucuuagaguuuuucaugauggugcuccuaaucccagaacccgaaaaacaaaggacaccgcaggauaaucaguuagcuuauguuguaauuggcauacuuacucuagcagcaaucauagcugcaaaugaaaugggauuauuagagacgacgaaaagagacuuagggguuucaaaagaacccggaguggugucacccacaucauaccuugaugucgaucuacauccugccagugcauggaccuuauacgcgguagcuacaacaguuaucgcgccaaugcuacgucacacaauugagaacucaaccgcuaaugucaguauggcugcaauagcuaaucaagcggucguauuaaugggauuagauaaaggauggccaauaagcaaaauggauuuaggaguacccuuacuagcgcuuggauguuauuucuauguaaauccuuuaacccuuacagcggcaguguuucuccuugucacccauuaugcuaucauaggucccggguugcaagcaaaagcuacacgagaagcgcauaagaaaacagcggcggggaucaugaauccacccccaggagaugguauaaugacuauagauuuagacccuguaaucuaugacucaaaauucgaaaaacaacuaggacaaguuaugcuauuaguauugugugcaguucaacuauuacugaugaggacauccugggcucuuugugaggcacuaacauuagcaacaggaccaacgacuacuuuaugggaaggaagcccagggaaauuuuggaauacaacaauugcagucaguauggcuaacaucuucagaggaagcuauuuagcuggcgcaggauuagcuuucaguauaaugaaaucaguuggaaccggcaagcgaggaacugguucacagggcgagacacucggagaaaaauggaagaagaaacuaaaccaauugagccgaaaagaauuugacuuauauaagaaaucaggaauaacagaaguggacagaacggaagcuaaggaagguuugaagaggggugaaauuacacaccaugcuguuucaagaggcucagcaaaauuacaaugguucguugaacgaaacauggugauccccgagggaagaguuaucgauuuaggcugcgggaaagguggauggucauauuauugugcuggauugaagaaaguuacugaaguaagagguuauaccaaaggaggaccuggccaugaagaaccaguaccgaugaguaccuacggauggaacauagucaaauuaaugucagguaaagauguauuuuauuuaccaccugaaaaaugcgacaccuuacuuugcgauauuggagaaucuucccccucaccaacuguggaagaaucgaggacgauacguguauuaaagaugguggaaccgugguugaaaaacaaccaauuuuguauuaaaguacuuaaucccuacaugccgacugucauugagcaucuagaacgauugcaaaggaaacauggaggaauguuagucagaaacccauuaucgagaaauuccagaaacgaaauguacuggauaaguaacggaacuggaaacauugugagcaguguuaauaugguaucaagauuauuguuaaacagauucacaaugacgcauaggcgacccacaauagaaaaggacguugauuuaggagcagguacuaggcauguaaaugcugaaccugaaacuccaaauauggaugugauaggagaaagaauaaaacguauaaaagaagaacacaauaguacauggcacuacgaugaugaaaaucccuacaaaacaugggcguaucauggcucuuaugaaguaaaggcgacuggaagugcaaguucaaugauaaaugguguugucaaacuuuugacaaaaccaugggauguaguaccuaugguuacgcagauggcaaugacagauacuacgccauuuggacagcagagaguguucaaagagaaaguagacacaaggacgccucgacucaugccacgaacacggaaagucauggagauaaccgccgaguggcuauggcgaacacuuggcagaaauaagcgaccuagacugugcacgagagaggaguucacuaagaaaguuaggccuaucgccgccaugggggcgguauucacacaacgagaccagugggacucugcuaaagcugcaguagaagaugaagaauuuuggaaaccagucgaucgugaguguaacagucaucaacuagguaaguguggcaguuguguauacaauaugaugggaaaaagagaaaagaaacuaggugaguucggaaaagccaaagguucaagagcaauaugguauaugugguugggagcucgauaucuggaauuugaagcauuaggauuuuuaaaugaggaucacugguucaguagagaaaauuccuauuccggcguagaaggugaaggacugcauaaacugggauauauauugcgagauauuuccaagauuccaggaggagcuauguaugcagaugauacagcagggugggauacuagaaauacggaagaugaucuucauaugaaagaaaagauuacgcaacaaaugggaccaggacacucgagauuagccaaugcaauuuuuaaacuuacauaccaaaauaaagugguaaagguacagagaccgacaccaacaggaacaguaauggauauaauuucucgaaaagaucaacgaggaucaggucagguagguacauauggauuaaauacauucacgaauauggaagcacaauuggucaggcagauggaaggagagggaguccuuucaaaagcugaccuggagaacccgcauuuguuagagaagaaaauaacacaauggcuugaaacuaaaggagucgagagauuaaaaagaauggcaauaucuggcgaugauuguguugucaaaccuauugaugauagauucgcuaacgcuuuacuagcucucaacgauaugggcaaagucagaaaagauauuccucaauggcaaccuucuaaaggauggcacgauuggcaacaggucccguuuuguucgcaccacuuccaugagcuuauuaugaaagacggccggaaauuaguaguaccuugcaggccacaagacgaacucauagguagagcccgcauaucacaaggcgccggauggucccugcgagaaacugcaugucuaggaaaagcauacgcacaaauguggucauuaauguauuuucacaggcgagacuugcguuuagcuucaaacgcaauauguuccgcgguucccguacauugggucccaacuagccguaccacauggagcauacaugcucaccaucaguggaugacuacggaagauaugcugaccguauggaaucgcguauggaucgaagacaauccauggauggaagauaaaaccccaguaaccacaugggagaauguaccauaucugggaaagagagaggaucaguggugcggaaguuugaucggacuaacaagcagagcaacaugggcucaaaacauuccaacagccauacaacaaguaaggucuuuaaucggaaaugaagaguuucuagauuacaugccgucgaugaaaagguuccggaaggaagaagaaagcgaaggggcgauaugguga

SEQ ID NO: 23097 - RNA, 9873 nt, Artificial Sequence
  derived and/or modified CDS sequence (opt6) from DENV-3__GU131903__SS-prME
acgucacuuuguuuaaugaugaugcuaccagcgacucuagcuuuucauuuaacguccagagacggugaaccacggaugauaguagguaaaaaugaaagagguaaaucccuacuguucaaaacggcaucugguaucaacauguguacacuaaucgcaauggauuugggugaaaugugugacgacacuguaacguauaaauguccucuuaucgcggaaguagaaccagaagauauagauugcuggugcaaccuaacaaguacuuggguuacauaugguacauguaaccaagcaggagaacaucgaagagacaaaagaucuguagcacuagcaccacauguuggaaugggacuugacacgcgcacacaaacguggaugagugcggaaggagcauggagacaaguugaaaaaguagaaaccugggcauuaagacacccuggauuuacgaucuuggcauuguuucuggcacauuauauaggcacaucacuaacgcaaaaagucguaauuuucauauuacucaugcuaguuacccccagcaugacaaugcgauguguuggaguagggaacagagauuucgucgaagggcuaaguggggcaaccuggguagacguuguccuugagcaugguggaugcgucacaacaauggcuaaaaguaaaccaacauuggauauugagcuccagaaaacugaggcaacucaacuugccacccuuaggaaacugugcauagaagguaaaauuacaaauaucacaacggacucuaggugucccacgcaaggagaagcaacuuugcccgaagaacaagaucagaacuaugucuguaaacacacuuacguggacaggggauggggaaaugguuguggauuauuuggaaaaggcagcuuaguaacaugcgcgaaauuucaaugucuagagccuauugaagguaaaguaguacaacacgaaaaucuuaaauacacuguaauuauaacaguacauacuggagaccaacaccaaguagggaaugauacgcaagguguuacugucgaaauaacaccacaagcuagcacagucgaggcaguacuaccagaguacgguaccuuaggccuagaaugcagcccaagaacaggauuggauuucaaugaaaugauacuauuaacaaugaaaaacaaagcauggaugguucacagacaaugguucuuugaucuaccgcuuccuuggaccucaggggcgacaaccgagacaccgacuuggaacagaaaagaacuccugguaaccuucaaaaacgcacaugccaagaaacaagaaguagugguauuagggucccaagaaggagcgaugcacacggcacugacaggugcgaccgagauccaaaacucagguggaacaucaauauuugcgggccauuugaaaugucgccugaaaauggauaaauuggaacucaaaggaaugucguaugcuauguguuuaaauacguuuguacugaagaaagaaguaucagaaacacaacauggaaccauccugaucaaaguugaauauaaaggagaagaugcaccauguaaaauuccauucagcacggaagauggucaagguaaagcacauucugggcgacuuauaacagcuaacccgguaguuacgaagaaagaggaaccaguuaacauagaagcugagccgccauuuggagagagcaauauaguuauuggaaucggcgacaaagcauuaaaaauaaacugguauaagaaaggaaguucaauugguaaaauguucgaagcuacugcucguggagcucgucgaauggcgauucuaggcgauacagcuugggacuuugguagcguuggaggaguacuaaauucccuugggaaaaugguucaccaaaucuuuggaagugcauauacagcauuguucucaggcguuaguuggaucaugaaaaucggcauugguguccuuuuaacauggauaggacucaacaguaaaaacacuucuaugucuuucuccuguauaguaauuggcauaauuacucucuaccuaggcgcagugguacaagcagauaugggaugcguaauuaauuggaaaggaaaagaacucaaauguggaucaggaauauuuguuacgaaugaaguucauacauggacagagcaauacaaauuucaagcagacucaccuaaaaggcuugcaacugccaucgcuggugcuugggagaauggagucugugguaucaggagcacaacaagaauggagaaucuauuauggaaacaaauagcgaaugaacuuaauuauauacugugggaaaacaauauaaaauuaacaguaguaguaggcgauauaauuggaguuuuggaacaagguaaacgaacuuuaacuccacaaccgauggaacuaaaauauagcuggaaaacguggggaaaagcaaaaauugugacagcugaaacacagaacaguucuuucauuauugacgggccgaacacaccagaauguccgaaugcuuccagagcuuggaaugucugggaaguagaagacuacggcuucgguguuuucacuaccaauaucuggcuaaaacuuagggaaguuuauacacaaucuugugaccaucgacuaaugagcgcagcgaucaaagaugaaagggcgguccacgcagacaugggguauuggauagaaagucagaaaaacggcucauggaaguuagaaaaagcaucauucauagaagugaagacgugcacguggccuaaaucucauacuuuauggaguaacggcguguuagagagugauaugauuauccccaaaagucuagcugguccaauuucacagcauaaucauagaccgggguaccauacacaaacagcaggaccauggcauuuagggaaacuugagcuagacuuuaauuacugugagggaacaacaguagucauuacugaaaauuguggaacacggggccccucacucagaacaaccacggucucgggaaaacuuauucaugaguggugcugcagguccuguacccuuccacccuuaagauacaugggggaagauggauguugguacggaauggaaauccgccccaucaacgagaaggaagagaacaugguaaaaucauuagucagcgcuggcucuggaaaggucgauaauuucaccaugggagugcuuugccuugccauuuuguucgaagaagugaugcguggaaaauuuggcaagaaacauaugauugcaggaguucucuucacguuuguucucuuauuaucuggucaaauaacuuggcgagauauggcgcacacucucauaaugauugguucaaacgcaagcgaucgaaugggaaugggcguaaccuaucuugcauuaauagcuacuuucaaaauccaaccuuuucuagcgcucggauucuuucuacguaaacuuacaagcagagaaaaucuacugcugggagucgguuuagcuauggcgaccacacuacaauuaccagaagauauugaacaaauggcuaacggaauagcacuagggcuuaugacauuaaaacuuauuacacaauuugaaaccuaccaacucuggaccgcccuaguaucauuaacgugcaguaacacgauauuuacauugacgguggcauggcgcacggccacguuaauucuagcaggcguaucucuauuaccucuaugucagaguucaucuaugcgaaaaacagauuggcuaccaaugacuguugccgcaaugggagugccuccuuuaccuuuauuuauuuucucacuuaaggacacuccaaagaggaggucuuggccucuuaaugaaggaguaauggccgucggcuuaguaucaauucuagccagcucauuacucagaaacgaugugccaauggcgggaccgcuuguagccggaggucuucuaaucgcuuguuaugucaucacugggacaagugcagaucuaaccguugaaaaagccgcggaugugacaugggaggaagaggcggaacaaacaggugucagucauaauuuaaugauaacaguagaugacgauggcacgaugcguaucaaggaugacgaaaccgaaaauauccuaacuguauuauuaaagacugcuuuacucauugugucaggaaucuucccauacagcaucccagcgacccuacuuguauggcauaccuggcaaaaacagacucaacggagugguguuuugugggauguaccgaguccaccugaaacucaaaaagcggaacuagaagagggaguguacagaauuaaacaacaaggcauauuuggaaagacucaaguaggagucgguguucaaaaagaggguguauuccauacaauguggcaugucacuagaggagccgugcuaacucauaauggcaaacgucucgagccaaacugggcaucagucaagaaagaucugaucagcuaugguggaggcuggaggcugaaugcacaauggcagaaaggcgaggagguccaggugauagcaguagaaccagggaagaaucccaaaaauuuccaaaccaugcccggcauuuuucagacaacaacgggugagaucggagcaauugcucuggauuucaaaccagguacaagcgggagccccauuauaaauagagaaggcaaaguagucggacuauacgguaacgguguuguuacuaaaaacggagguuauguaucugguaucgcucaaacuaacgcagaaccggauggaccgaccccagaguuagaggaagagauguuuaagaaacgaaaccuuacgauaauggauuuacauccgggaucugggaagacucguaaauaccugcccgcaauagugcgagaagcaauaaaaaggagacuuaggacauuaauacucgcucccaccagaguagucgccgcugaaauggaagaagcacuuaagggauuaccaauccgcuaccaaacaacagcaacaaagucugagcauacaggacgagaaauugucgacuuaaugugucaugcuacguuuacuaugcgacuccuuucaccgguucgugugccaaacuauaacuuaguuauaauggacgaggcucauuucaccgacccagcgucaauugcggcuagggguuauauuucaacgaggguuggcaugggagaagcugcggccauauucaugacagcaacgccaccggguacugcagaggcuuuuccacaaucuaaugcaccaauacaggaugaagaaagagauauaccagaacggucauggaauaguggaaaugaguggauuacagacuuuguugguaaaacuguuugguuugugcccaguauuaaggcagguaaugacauagcgaauugcuuaagaaagaauggcaagaaagugauacaguuaucacguaaaacauucgauacugaguaucaaaagacucgucuaaacgauugggauuuuguaguaacaacggacauuuccgaaaugggugcuaacuucaaagccgauaggguaauagacccgcguagguguuuaaaaccaguuauacuaacugacggaccugaaagaguuauucuagccggaccaaugcccgugaccgcagcgucggcagcacaacgacgugggagagucggccgcaauccucaaaaagagaaugaucaauauauauucacgggacaaccguuaaauaacgacgaggaucaugcacauuggaccgaggccaaaauguuauuagauaacauaaacacuccagagggcaucauacccgcacuuuucgaaccagagagagaaaagucagccgcaauagacggcgaauaucgccuaaaaggggagucccguaagacguucguagaauugaugcgaagaggagaccuuccaguauggcuagcgcauaaaguagcuagugaaggaauaaaauauacagacaggaagugguguuucgacggagaacgaaauaaucaaauuuuagaagaaaacauggacguagaaauauggacuaaggaaggagaaaggaagaaauugcgcccgagaugguuagacgcaagaacauauagugauccauuagcacucaaggaauuuaaggacuuugcagcuggccguaaaucuauugcucuggaccuaguuaccgaaauugguagaguaccgucacaccucgcucauagaacaagaaaugcucuggauaauuuagucaugcuccauacaucugaacaugggggucgggcguaccgccacgcuguagaagaauugccugaaacaauggaaacauugcuacugcuuggauuaaugauacuuuuaacagggggagcgaugcuguuuuugauaucagguaaagguauaggcaagacaaguauaggauuaauaugcgucauugugucaagugguauguuguggauggcggacgucccucugcaguggauagcgucagcaauuguacuugaguucuuuaugaugguguugcuaauuccagaaccagaaaaacaacgaacaccacaggacaaucagcuagcguauguaguaauugguauauuaacauuagcggcuaucguagcagcuaaugaaauggggcuacuagaaacaacuaaacgggauuuaggaaugagcaaagaaccaggaguaguuagcccuacaaguuacuuagacguugacuuacaccccgcuucagcauggacacuauacgcaguagcuaccacagucauuacaccaaugcuacgacauacuaucgaaaauucuaccgcuaacgugucucuugcugccaucgcaaaucaagcagucguccuuauggguuuggacaaaggguggccaaucuccaaaauggauuuagguguaccacuauuagcccuagguuguuauagucaaguuaacccuuuaacucuuacggcugcuguccuguugcuaguuacacauuacgcaauuauugggccaggauuacaagcuaaagcaacuagagaagcccagaaaaggacagcagcgggcauaaugaagaacccaacaguugaugggauaaugacgauagaccuggacccuguaauuuacgauuccaaauuugagaaacaauuaggccaggucauguuacuuguacuaugcgcaguacaauuacuucuaaugcgcacaucaugggcacuuugugaagcacucacguuagcuacaggccccauaaccacacucugggaaggaaguccagggaaguuuuggaauaccacgauugcaguuucuauggcuaacauauuuagagggucguaccuagcaggagcaggauuggcuuucucaaucaugaaaaguguuggcacuggacgacguggaacuggaucacagggagagacucuuggcgaaaaauggaagaagaaauuaaaccaauuaagccguaaagaguucgaccuguacaagaagucugguauaacugaaguggaccgaacagaagcgaaagaggguuuaaaacguggcgaaacuacgcaccacgcagugagccgugguagcgcuaaacuacaaugguuugucgaacggaauaugguaauaccagaggggagggucaucgaccucgguuguggacgaggcggauggucauauuauugcgcuggauuaaagaaaguuacagaaguuagaggauauacuaaagcagggccagggcacgaggaaccugugcccaugucaacuuacgguuggaauauugugaaauugaugucgggaaaagacguauuuuaccuaccuccagaaaaaugugacacacuacuaugcgacauuggagaaucaucuccaucgccuaccguagaagaaaguagaacgauaagaguauuaaaaaugguugaaccguggcugagaaacaaucaauuuuguauaaaagucuugaacccauauauggcuacugggauagagcauuuagaaagauugcagcggaaauacggaggaaugcucgugcgaaacccauuaagccguaacucgacucaugaaauggauuggauaagcaaugggacgggaaauauaguaaguucuguuaauaugguaucuagacucuuauuaaaucgcuucacaaugacacauagacgcccaaccauagaaaaagauguagaccuaggcgcaggcacacgacauguuaaugcugaaccugaaacaccuaauauggacguaauaggagaacgaauuaaacgaaucaaggaagaacauucaucgacauggcauuaugacgaugaaaaccccuacaaaacuugggcuuaucauggcucauaugaaguuaaggcaacggguucagcaagcucaaugauaaacgggguaguuaaauuacucacgaaaccuugggacguuguaccuauggucacacagauggcuaugacugacacaacaccuuucgggcagcagaggguauucaaagaaaaaguugacaccaggacuccccgaccaaugccagguacgagaaaagucauggaaauuaccgccgaaugguuguggcggaccuugggaagaaauaagaaaccuagacuauguacacgagaggaguucacuaaaaagguucgaacgaaugcagcaaugggagcaguuuuuacagaagagaaucaaugggacucagcccgagcggcgguagaggaugaggaguuuuggaaauugguagaucgagagagagagcuacauaaacuaggaaaaugugguucuugcguuuauaauaugauggggaagagggagaagaaacuaggcgaguuuggaaaagccaaaggaagccgggcaauaugguacaugugguugggggcucgguaucucgaauuugaggcucuuggauuuuuaaaugaagaucauugguuuucacgagaaaauucauauucggguguugaaggcgaaggcuuacauaagcugggguauauucuucgugacauaaguaagauaccuggaggagcaauguacgccgaugacacagcggguugggacacuaggauuacagaggaugacuuacauaacgaagagaaaauaacacaacagauggacccugagcaucgucaacuagcuaacgccauuuuuaaguuaacauaccaaaauaaaguggugaaaguacaacgaccgacuccgaaaggaacaguaauggauauaauaagcagaaaagaccagagaggguccggacaaguaggaaccuacggcuuaaacacauuuacgaacauggaagcgcaguuaguaagacaaauggaaggcgaaggaguucuaagcaaagcugaccuugaaaauccccaccuauuagagaagaaaauuacacaguggcuagaaacaaaaggaguugaaagguugaaacguauggcaauaucaggagacgacuguguuguaaaaccaauugaugaucgauucgcaaacgcauuauuagccuuaaacgacaugggaaaaguacguaaggauauaccccaauggcaaccaaguaaagguuggcacgacuggcaacaaguaccauucugcucucaucacuuccaugaacuaauaaugaaagacggaagaaagcuagugguccccugcagaccgcaagacgaacuaauagguagggcacguauaucacaaggagcuggauggagcuuaaaggagacagcaugucuagggaaagcauacgcgcaaaugugguccuuaauguacuuccauaggcgcgauuuaagacuagcaaguaaugcaauuugcucagccgucccagugcauuggaucccaacauccaggacaacuuggucaauacaugcucaccaccaauggaugacaacugaagauaugcuuacuguauggaacagagucuggauagaagacaacccauggauggaagacaaaacaccuguuacuacuugggaggaugugccauaucuuggaaagagagaagaucaauggugugggucacuaaucggacugacuucaagagcaacgugggcccaaaauaucuuaacggcgauucaacaaguuaggagucuaaucggagaugaagaauuuuuagacuauaugccuucaaugaagagguuccgaaaagaagaagagagcgaaggugccaucugguaa

SEQ ID NO: 23098 - RNA, 9873 nt, Artificial Sequence
  derived and/or modified CDS sequence (opt6) from DENV-3__GU131904__SS-prME
acaagccuuugucugaugaugaugcugccagcaacauuagcuuuucaucuuacuucaagggauggugaaccgcgaaugaucguuggcaaaaaugaacgaggaaagagcuugcuauuuaaaacagcaucgggaauuaacauguguacuuuaauagcuauggaucuaggggaaaugugugaugauacagugacauauaaauguccacuuauugcagaaguagagccggaggauaucgacugcugguguaaucucacuucaaccuggguaacauauggaacaugcaaucaagccggggaacaucggcgugauaaaagaucagucgcacucgccccacacgucgguauggggcuagauacucgaacacaaaccuggaugagcgcugaaggggcuuggaggcaaguugagaaaguagagacgugggcacuaaggcacccggguuucacaauauuagcacuguuccuggcucacuauauugggacaaguuuaacucaaaaagugguuauauuuauuuuacuaauguuagugacgccaucgaugacaaugcggugugugggaguugguaaucgcgauuuuguggaaggcuuaucaggugcgacauggguagaugucguucuagaacaugggggaugugugacuacaauggccaaaagcaaaccaacauuggauauugaacuacagaaaaccgaagcgacgcaacuugccacuuuacgaaaacuauguauagaagguaaaauaacaaauauaacaacagacucgcguugcccuacucaaggagaagcgacauuaccagaagaacaagaucaaaauuacguauguaaacauacauauguggauaggggcugggggaauggcugcggacuauuugguaaaggcucgcucguaaccugcgcgaaauuccagugccuagagccaauugaagguaaagugguucaauaugaaaaccuaaaauauacagugauuauaacgguucacaccggagaucaacaucaaguuggcaaugacacccaggggguuacuguugaaaucacuccgcaagccucaacaguagaagcgguacuaccugaauauggaacauuaggacuagaauguagcccgagaacuggucuagacuucaaugaaaugauucuguuaacaaugaaaaauaaagcguggaugguccauagacaaugguucuucgaucucccgcuaccguggacaaguggcgcaacuacugaaacgcccacauggaauagaaaagaacugcucgugacuuuuaaaaaugcacaugccaagaaacaagaaguaguuguucuuggcagccaggaaggcgcuaugcauacggcgcucaccggcgcgacggaaauacaaaauucaggcgguacauccauuuuugccggucauuuaaaaugccgcuuaaaaauggauaaauuagaacuaaaaggaaugagcuaugcaaugugccuuaauaccuucgucuugaagaaagaagugucugaaacgcaacauggaacaauacuuauaaaaguagaguacaaaggagaggacgcaccuuguaaaauuccuuuuagcaccgaagauggacaaggaaaagcucauaacggucgacugauuacagcuaacccagugguuacgaagaaagaagaacccgugaauaucgaggcugaaccuccauuuggagaaaguaacauugucauugguauaggcgauaaagcccuuaaaaucaacugguacaagaaaggcuccucaauugguaagauguuugaggcuacagcgagaggugcacgcagaauggcaauauuaggcgacacagcaugggacuucgguucaguagguggaguacugaacucacuugguaaaaugguucaucaaaucuucggaagcgcuuacacugcucuuuuuagugguguaaguuggauaaugaagauuggaaucgggguccugcuaaccuggauugguuuaaacagcaaaaauacgaguauguccuuuagcuguauugugauagggaucauaacauuauacuuaggagcggucguucaggccgauaugggauguguuauuaauuggaaagggaaggaauuaaaaugcgggucugggauauuuguaacaaacgaaguccauaccuggaccgagcaauauaaauuccaagcagacucucccaaaagacucgcaaccgcgauugcuggcgccugggaaaaugguguuugugggauacguagcacaacgagaauggaaaauuuacuguggaaacaaauagcgaacgaguuaaauuauauccuaugggagaauaguauaaaauugacaguuguuguuggggacauuauuggaguucuagaacaaggaaaaagaaccuuaaccccacagcccauggaauugaaguauucuuggaagacguggggaaaggcaaaaaucguaacagcugaaacgcaaaauucaaguuucauuauugacggcccuaacacaccggaauguccgagcgcuaguagagcauggaacguaugggagguagaagauuacgguuucgguguauucacuacaaacauuugguuaaaacuaagagaaguauauacucagaguugcgaccaucgacucaugagugcugcaaucaaagaugaaagagccguacacgcagauauggguuauuggauugagucucagaaaaauggauccuggaagcuagagaaagcaaguuucauugaaguuaaaacguguacauggccgaaaucacacacauuauggucaaaugggguucucgaaagugauaugaucauaccgaagucauuggcgggaccuauuucacaacacaaccaucgaccagguuaccacacacaaacggcgggccccuggcauuuaggaaaacuugaacucgauuucaacuauugcgaaggaaccacagucguaauaaccgaaaacugcggaacaagagguccgagucuaagaaccacuacuguaucaggaaaauuaauccacgaguggugcugcagaaguuguacgcucccacccuuaagauacaugggugaagacggcuguugguacgggauggaaauccguccaauuaacgaaaaagaagagaacauggucaaaagucuagugucugcuggaucuggcaaagucgauaauuuuacaaugggaguguuaugucuggcuauauuauuugaagaaguaaugcguggaaaauuuggcaagaaacauaugauugcuggaguucucuucacuuucguucuauuacuaaguggucaaauuacuuggcgggacauggcacauacucuuauaaugaucggauccaaugcaagcgaucguaugggaaugggaguaacauaccuagcucugauagcaacguuuaagauccaaccguuccuagcgcuaggauucuuuuuaagaaaauugacaucacgggaaaaucucuuacuaggaguaggacuugcaauggcgacaacauuacaauuaccggaagauauugagcaaauggcaaaugguauagcguuaggcuugaugacuuuaaaacuaauaacgcaauucgaaaccuaccagcuguggacggcauuaguaagccuaacauguagcaacaccauauucacccuaacggucgcuuggcguacagcaacacuaauucuagcaggaguuucccuccugccuuuaugucaauccaguucaaugagaaagaccgacugguuaccgaugaccguagccgccaugggaguaccaccgcuacccuuauucauuuucucacuuaaagacacaccuaaacgacgauccuggccuuugaaugagggcguuauggcgguaggucuugugucaauacuagccucaucauuguugagaaacgauguacccauggcaggcccgcuuguggcagggggauuauuaauagcaugcuauguaauuacagguacaucugcagaucuuacgguagaaaaagcugccgacgucaccugggaagaggaagcugagcagacugguguaucacacaauuugaugauuacuguggacgaugacggcacaaugagaauaaaagacgacgagacugagaauauuuugacaguucuacuaaaaaccgcacuucuaauagucuccggaauuuuuccuuacagcauaccugcaaccuuauugguauggcacacauggcaaaaacaaacccaacggucagguguacuuugggaugucccuucaccaccagaaacacaaaaagcggaacuagaagaaggaguauaccgcauaaaacagcaagguaucuuuggaaagacccaaguuggugucgggguacagaaagagggcguauuucacacgauguggcauguuacuagaggugcuguauuaacacauaaugggaaacgauuagaaccaaacugggcauccgucaaaaaggaucuaauuucguacggaggugguuggcgucucagcgcacaauggcaaaaaggugaagaagugcagguuauagcgguggagcccggcaaaaaucccaaaaacuuccaaaccaugccaggcaucuuccagacgacaacgggagaaauaggagcaaucgccuuggauuuuaagccuggaacuagcgggagcccuauaauaaaccgugagggaaaaguuguaggacuuuauggaaauggcguuguaaccaaaaaugguggauauguuaguggaaucgcucaaacaaacgcagaaccagauggaccgacuccggaauuagaagaagagauguuuaagaaacgaaauuuaaccaucauggaucuacauccgggaaguggaaaaacaagaaaauaccuuccugccauaguaagggaagccauaaaaagaagauuaagaacccuuauauuagcuccaacuagaguaguagccgccgagauggaagaggcgcuaaaagggcugccaauacgauaccaaacaaccgcuacaaaaagcgagcacacagguagagaaauuguagauuugaugugucaugcaacauucacuaugagauuguuaagcccugugcgagucccaaacuacaacuuggugauuauggacgaagcgcacuucacagacccagcgucaaucgcggcccgggguuacauuucaacuaggguugguaugggugaagcagcagcaauauuuaugacggccacacccccgggaacagcggaggcauucccacagaguaaugcccccauucaagaugaagaacgcgacauaccugaacgaaguuggaacucaggcaaugaauggauuacagacuucgucggaaaaacagucugguuuguacccucaauaaaggcggggaacgauauugcuaauugcuuacggaaaaauggcaagaaagucauacaacuaaguagaaagacuuucgauacugaauaucagaaaacaaggcuaaacgauugggauuucgucguaacaacugauauuucagaaaugggggcaaacuuuaaggcggaccgaguuauagauccgagaagaugucuaaaaccaguuauuuuaacggacgggccagaaagagucauacuagcgggaccgaugccugucacagcugcaucggcugcacaaagacgugggagaguuggacguaacccacagaaagaaaacgaucaauauauuuucacgggccagccauuaaauaacgaugaagaccaugcccauuggacugaagcgaaaauguuacuugacaauauaaauacuccagagggaauaaucccagcauuauuugaaccugagagagagaaaagcgcagcuauagacggagaguauaggcuaaagggcgaaucacguaaaacguucguggaacucaugagaagaggagauuuaccaguaugguuggcacauaagguugcuuccgaagggauaaaauacacagaucguaaaugguguuuugauggggaacgaaauaaccaaauucuggaagaaaacauggacguugagauauggacuaaagagggcgaaaggaagaaacuacggccgcgcugguuagaugccagaacauacagugauccucuugcgcuaaaggaauuuaaggauuucgcugcagguaggaaaaguauagcacuagaucuuguaacagagauuggucguguuccuucucauuuagcacaucgaacuagaaaugcgcuugacaaccugguaauguuacauacuucugaacauggagggcgagcauauagacacgcaguagaagaauuaccagaaacuauggaaacauuguuauuacucggauuaaugauccuauugacuggaggugccaugcuauuccuaaucucagguaaagguauaggaaaaacauccauaggccugauaugcgugauugccaguagugguaugcuguggauggcugaugucccuuuacaauggaucgcuucagcuauaguccuagaguuuuucaugauggucuuacuuauaccugaaccagaaaaacaaagaacaccccaagacaaucaauuagcauacgugguuauuggcauacuaacacuagcagcaauuguagcagcuaacgaaaugggacuucucgaaacgaccaaaagagaucuaggaaugucaaaggagccuggaguaguaagcccaacaucauaccucgacguugaucugcauccugcgagcgcauggacucuauaugccguggcuacuacugugauaaccccgauguuaagacauacaauagaaaacucuacggcgaacgugucacuagcggcuaucgcaaaccaggcugucguguugaugggucucgacaaagguuggccuauaaguaaaauggacuuaggggucccucuauuagcuuugggaugcuacagucaaguaaacccuuugacgcuaacagccgcuguuuuacuauuagugacacauuaugcaaucauaggaccaggacuucaagcaaaagcaacaagagaagcacaaaaacgaacagccgcuggaauaaugaaaaacccgacaguggauggaauuaugacgaucgaccuagauccggugauuuacgauucaaaauuugaaaaacagcuaggccaaguaaugcugcuuguucugugugcaguacaacuacuuuugaugcggacuucuugggcccucugcgaggcucucacauuagccacgggaccaauaacgacacuaugggaaggaaguccagguaaauuuuggaauacaacaauagccguuucaauggccaauauauuccgcggcucuuaucuugcaggagcgggccuagcauuuucaauaaugaaguccguuggaacaggacggcgaggaacaggcucucaaggagagacucugggugaaaaguggaaaaagaaacuaaaucagcugucucgaaaagaauuugacuuauauaagaaaucagguaucacugagguagauaggacggaagcaaaagagggucuaaagagaggggagaccacacaucaugcaguuucaaggggaucagcaaagcugcaaugguucgucgagagaaacaugguaauaccagaagggagagugauagaucuuggcugugguagggguggauggaguuauuauugcgcaggguuacgaaaaguaaccgaaguacgaggcuauacaaagggcggcccaggacacgaagaaccaguccccaugucgacauauggauggaauauaguaaaacuuaugaguggaaaagacguauuuuauuuaccaccagagaaaugcgacacucuauugugugacauaggcgaaucuagucccucaccaacgguagaagaaagcagaacaaucaggguacugaagaugguggaaccuugguuaaggaacaaccaguuuugcauaaaaguacuaaauccuuauaugccuacuguaaucgaacaucuagaaagacuucagcgaaaauauggcggaaugcucguaagaaacccauuaaguagaaauuccacacacgagauguacuggauuagcaauggcacuggcaacauagugucaucggugaauauggucucuagguuauuauuaaauagguucacgaugacucaucgaagaccaacaauagaaaaagacguugacuuaggagcggguaccagacaugugaaugcagaaccagagacucccaauauggauguaauuggcgaaagaauaaaacgaauaaaagaagaacauucuagcaccuggcacuacgaugacgaaaauccuuacaaaacgugggcauaccauggaaguuacgaaguaaaagcaacugguucugcaucaucaaugauaaacgguguugugaaguuacuaacaaagcccugggauguaguaccaaugguaacccagauggccaugacggauacaacacccuuuggacagcaacggguuuucaaggagaaaguugauacaaggacgccacgaccaauggcuggaacuaggaaggugauggaaaucacagcagaaugguuauggcgaacuuuagguagaaauaagaaaccacgauuaugcaccagagaagaguuuacuaagaaggugagaacaaacgcagcgaugggugcuguuuucacugaagaaaaccaaugggacuccgcccgcgcggcuguugaggaugaagaguuuuggaaacuuguagauagagaaagagaauuacacaaguuggggaaguguggaaguuguguuuacaauaugauggguaagagagaaaagaaauugggagaguuuggcaaagcaaaagguaguagagcaaucugguauauguggcuaggugcaagauaucucgaauuugaagcacugggguuucuuaaugaagaucacugguucaguagagagaauaguuauucaggcguggagggcgaaggacuccauaaguuaggcuauaucuugagagauauaucuaaaauaccuggcggugcaauguaugcugaugauacagcaggaugggacacaagaauuacugaagaugauuuacacaaugaagagaaaauaacccagcaaauggaucccgaacacagacaauuagccaacgccauauuuaaacuuacauaccaaaacaaagugguuaaaguccaacgaccaacgccaaaaggaaccgugauggauauuauaagucgaaaggaccaaagaggguccggacaaguugguacuuacggacuaaauacuuuuacaaacauggaagcgcaguugguacgacaaauggaaggcgagggaguguugucuaaagcagaucuugaaaauccgcauuuacuggagaagaaaauaacccaauggcuggaaacaaaaggcguugagcggcugaagagaauggcuauuagcggagaugauugugucgugaaacccaucgacgauagauuugcaaaugcauuacuagcauuaaaugacauggguaaagugcggaaagacauuccccaauggcagccaaguaagggcuggcaugauuggcaacaagucccauuuugcagccaucauuuccaugagcugauuaugaaagacggcaggaaguugguagucccuugcagaccacaggacgaauuaauaggacgugcucgaauaagccaaggugcaggguggagucuaaaggaaacagcaugcuugggcaaagcauacgcacagauguggagcuuaauguacuuccaucgcagggauuugcgguuggcuucgaacgcaaucuguagugcuguaccaguucauuggauuccaacuucacggacuacaugguccauacaugcacaccaucaauggaugacaacugaagacaugcuaacggucuggaacagaguauggaucgaagacaauccguggauggaagacaaaacaccuguaacaacaugggaagacguaccguaccuaggaaaaagagaggaucaguggugcgguucacugauagguuugacaucccgugcaacgugggcccaaaauauucuaaccgcgauucaacaagugagaagucuaaucggagacgaggaguuccuugauuacaugccaucuaugaaaagguuccguaaagaagaagaaucagaaggcgcaauuugguga

SEQ ID NO: 23099 - RNA, 9873 nt, Artificial Sequence
  derived and/or modified CDS sequence (opt6) from DENV-3__GU131906__SS-prME
acgucgcugugcuuaaugaugaugcuaccagcaacauuagcauuucaucuaacauccagagacggugaaccucguaugauuguaggcaaaaaugaacgagggaaaagccuauuauucaagacugcuagcggaauaaauauguguacguuaaucgccauggacuugggggaaaugugcgaugacacaguaacauacaagugucccuuaaucgcagaaguagaaccagaagacaucgauuguugguguaaucucacaagcacuuggguaacuuauggaacauguaaucaagcgggagaacacagaagggauaaaagaagcguugcucuugcaccacauguagguaugggauuagacacucgcacgcaaacauggaugucagccgaaggagcauggagacaagucgaaaaaguugaaacuugggcguuacgucauccaggauuuacuauauuagcgcuuuuucucgcacacuacaucggaacaucccucacccaaaagguagugauuuucauccuacuaaugcuaguaacaccaucaaugacaaugcgaugcgucggagugggaaauagagauuucguggaaggacuaucuggagcaacauggguagacguaguguuagaacaugggggauguguaaccacgauggcaaaaucaaagccuacacuugacauugaauugcaaaagacagaagccacacaacuugcuacguugcgaaaacuauguauagaagguaaaauuacaaacauuaccacagacaguagauguccaacucaaggggaagcaacccuaccugaagaacaagaucaaaauuacgucugcaaacacacuuaugucgauagagguugggguaauggguguggacuuuucgguaaaggaucucuaguaaccugcgcaaaauuucaaugucuagaaccaaucgaagguaaaguaguacaauacgagaacuuaaaauacacaguuauuauuacuguucauacuggugaccaacaucaagucgguaaugauacacaaggcgucaccguagaaauaacgccucaggcuuccacggucgaagcuguccuacccgaauauggaaccuuaggguuagaguguagucccagaacgggauuggacuuuaaugaaaugauacugcugacaaugaaaaauaaagcauggaugguacaucgucaaugguucuucgauuugccauuaccauggacuucaggagcuacuacggaaacuccuacauggaauaggaaagaacuccugguaacuuuuaaaaaugcacaugccaagaaacaagaagucgucgugcuagguagccaagaaggugcaaugcacacugcauuaaccggcgcaacggaaauacaaaacucagggggaacuucaauauuugcaggacauuuaaaguguagauuaaaaauggacaaguuagaguugaaaggcaugagcuacgcuaugugcuuaaauacauucguccuaaagaaagaagugagugaaacucaacacgggacaauacucauuaaagucgaauacaaaggggaagaugcuccaugcaaaauaccuuucuccacagaagacggacaagguaaagcacacaaugggaggcuuauaacugcaaauccgguaguaaccaagaaagaggagcccguaaacauugaagcggaacccccauucggugaaucuaauauagucauuggaaucggggacaaagccuugaaaauaaauugguauaagaaagguaguucgauagggaaaauguuugaagccacagcaaggggugcaagacgaauggcaauucucggagauacggcaugggauuuuggaaguguuggcgguguucuaaauucccugggaaaaaugguacaccaaaucuucggaagugcauauacugcacuuuucagugggguaucguggauaaugaaaaucggaauagggguacuacuuaccuggauaggccuaaauagcaaaaacaccagcaugucguuuagcuguaucgugauaggcauaauaacauuguaucuaggagcaguuguacaagccgauauggguugcguaauaaauuggaaagggaaagaacuaaaaugcggaagcggaauauuuguuacgaaugaaguucauacuuggaccgagcaauauaaauuucaagccgauagcccaaaaagauuagcgacagccauugcaggggccugggagaauggaguaugugguauaagaucgacuacacgaauggaaaaucuacuguggaaacaaauagcgaacgaacuaaauuacauuuuaugggaaaauaacauaaaacuuaccguagugguuggggacauuaucgggguguuagaacaagguaagcgaacucucacgccacaaccgauggaauuaaaguacagcuggaagacuugggguaaagcuaaaaucgucacagccgaaacgcaaaauagcaguuuuauaauagacggucccaauaccccugagugccccucagcgucaagagcuuggaacgugugggagguagaagacuaugguuuugguguguucacaacuaacauuugguuaaaacuaagggaaguuuacacacaaucaugugaucauaggcuaaugagugcggcuauaaaggaugaacgugcaguacaugccgacaugggauauuggauugaaucgcagaaaaacgguuccuggaagcucgagaaagccucauucaucgagguuaaaacguguacauggccaaaaucucauacccuauggucaaacggaguauuagaaucagacaugauaauccccaaaucacuagccggcccaauaucacaacauaaucacaggccgggcuaucauacgcaaacagcagggcccuggcacuuagguaaauuagaacucgauuuuaacuauugcgaagggacaacagugguuaucaccgagaauugcggaaccaggggaccaucauuaagaacaacaacagucucggguaaacuuauucacgagugguguugucgaaguuguacacuaccaccuuugagguacaugggcgaagauggcuguugguauggaauggaaauaaggcccaucaaugaaaaagaagaaaacauggugaaaucauuagucucugcaggcucagggaaaguugacaauuuuacgauggggguucuuugccucgcaauacuguucgaagaagucaugcgcggaaaguuuggcaagaaacauaugaucgcaggcguucucuuuacauuuguguuauuauuaaguggccagauuacauggagagauauggcacacacuuuaauuaugauuggcucuaacgcaagugaccgaauggggaugggaguaacuuacuuagcucucauagcgaccuuuaagauucaaccauucuuagcauuaggauucuuccuuagaaaauuaacuucaagggaaaaucuauuauuaggagugggacuagcaauggccacgacauuacaguuaccagaagauauagaacaaauggccaacggaauagcauugggguuaaugaccuugaaacuuauaacucaauuugagacauaccaacucuggacugcauuagucucccuaacauguuccaacacgauauuuacguuaacuguugcuuggcgaaccgcaacacugauccuagcgggaguaucacuucuuccucuaugucagaguaguucaaugagaaaaaccgauugguuacccaugacuguugcagcaaugggagucccgccucuaccgcuauuuauuuucucccuuaaagacacaccucgaagaagaagcuggccccuaaacgaggguguaauggcaguaggccuaguuucgauucuagcaucuagccuucuacgaaacgacguaccaauggcagguccauugguagccgguggccuccucauugccuguuacguuaucacgggaacgucugcggaccucacaguggaaaaagcagccgaugugaccugggaagaagaagcagaacaaacgggagucagccauaacuuaaugaucaccguagacgacgacggaaccaugcgaaucaaagaugacgagacagaaaacauacuuacaguacuauugaaaaccgcuuuauuaauugugucaggcauauucccauauucuaucccugccacguuguugguauggcauacauggcaaaaacaaacucagcgguccgggguacuuugggauguuccaucgccaccagaaacacaaaaagcagaauuagaagagggaguauacaggauuaaacaacaggggauuuuugguaaaacccaaguggguguuggcguucaaaaggaaggcguuuuccauacuauguggcacguaacucggggcgcgguauugacgcacaacgguaaacgucuagaacccaauugggcaucugucaagaaagaucuaauauccuauggcggaggguggagacuaucagcccaauggcagaaaggggaagaaguccaaguaaucgccguggagcccggcaagaauccgaaaaauuuccagacuaugcccggcauuuuccagaccacaacaggugaaauuggugcaauagcauuagacuuuaaaccagguacuucagguucaccaauaauaaauagagaaggcaaggucguuggauuauauggaaacggaguagugaccaaaaacgggggauaugucagcgguauagcucaaacaaacgcggaaccggauggacccacgccagaauuagaggaagagauguucaaaaagagaaaucucaccaucauggaucuccacccuggaucaggaaaaacacguaaauaccucccugcuauaguucgcgaagcaauuaaacgacgacuacgaacgcugauuuuagcaccgacacgugucguagcagcagaaauggaagaagcauugaaaggacuuccaauacgcuaccaaacaacagcuacgaaaucggaacacacgggucgagaaauagucgaucuuaugugucacgcgacauuuacgaugagacuguuaaguccuguacgaguacccaacuauaauuugguaauuauggacgaagcacauuuuacugacccagcuagcauugccgccaggggcuauaucucgacaaggguagggaugggugaagcagcagcuaucuuuaugaccgcaacuccaccagggacagcagaggcuuuuccacagagcaaugccccaauacaagacgaagaaagagauauuccugagaggagcuggaacucugguaacgaguggauaacugacuuuguaggaaaaacggucugguucguacccucaauaaaagcagggaaugacaucgccaauugucuacguaaaaacggcaagaaaguaauucaacucaguagaaaaacauuugauacggaauaucagaaaacgcgccuaaaugauugggauuucgucguaacaaccgauauaucugaaaugggggcgaauuucaaagcagauagaguaauugauccuaggagaugucuuaaaccaguaauacucacagauggaccugaacgcguuauacuggcggggccuaugccgguaaccgcggccucagcagcacaaagaagagguaggguggggcgaaacccgcaaaaagaaaaugaccaguauauauucacgggccagccucuuaauaaugaugaagaucaugcgcacuggacugaagcaaaaauguuacucgacaacaucaacacacccgagggaauuauacccgcgcuuuuugagccugaaagagagaaaagugcugcuauagacggggaauaucgucuuaaaggugaauccaggaaaacauuuguggaacuaaugaggagaggggauuugcccgugugguuagcacacaagguagcaucagaaggaauuaaauauacagauagaaaaugguguuucgauggagaaagaaauaaccaaauacuggaagagaacauggauguagaaauauggacgaaagaaggcgagagaaagaaacuacgaccucgcugguuggaugccagaaccuacucagauccacuugcgcuaaaagaauuuaaagacuuugccgcggggaggaaaagcauagcucuagaccucguaacagagauaggacguguacccagucaucucgcacacagaacuaggaacgcccuagacaauuugguaaugcugcauacaucugaacauggaggacgagcuuacagacaugccguugaagaacuaccugaaacgauggaaacauugcuucuccugggauugaugauacuccucacggguggagcuaugcucuuuuuaauuagcgguaaaggaauaggaaaaacuucaauuggccuaauauguguaauugcuucaaguggaauguuauggauggccgacguuccacuacaauggauagcaagcgcaaucguguuagaguucuuuaugauggucuuacugaucccugagccagaaaaacaaaggaccccacaagauaaccaacuagcauauguagucauagguauacuuacgcuagcugcaaucguagcggcaaacgaaauggggcuauuggaaacaacuaagcgugauuuagggaugucuaaagaacccggugucguuucaccaacaaguuauuuagacgucgaccugcauccggcaagugcauggacacuauaugcaguagcuacaacugucauaacaccgaugcuaagacacacaaucgaaaauuccacugcgaacguaucauuggcagccauagcaaaucaggcaguaguccuaaugggacucgauaaaggauggccuauuagcaaaauggaccuuggaguaccacugcuugcacucggaugcuacucacagguaaacccacuaacacugacagcagcgguacuauuauuaguaacacauuacgcaauaauaggcccgggucuacaagcgaaagcgacacgcgaggcacagaaaaggacagcagccggaaucaugaaaaauccuacuguugauggcauaaugacgauagacuuagauccagucauauaugauucaaaauuugagaaacaacuugggcaaguaaugcuauuaguacuuugcgccgugcaacuuuuauugaugagaaccaguugggcgcugugugaagcacuaacacuagcaacaggaccuauaacgacuuuaugggagggaucgcccggaaaguucuggaacacaacaauugccguaagcauggcgaauaucuuuagaggaucauaccucgccggggcagggcuagcauucucaauaaugaaaucgguaggaacugguagacgaggaacagguucucagggagaaacacuaggcgaaaaauggaaaaagaaauuaaaccaacugucgaggaaagaguucgauuuauacaagaaaucagguaucacggaaguggauagaacagaggcuaaagaaggacuaaaaagaggagaaacaacacaccacgcaguuucucgcggcucugcgaaacugcaaugguucguugaacguaacauggucauaccagaagggagaguaaucgauuuaggaugugguagaggaggguggucuuauuacugugccggacuuaagaaaguuacugaaguuagaggcuacacaaaagggggaccaggucacgaggaaccgguaccuaugucaacauacggcuggaauauaguaaaauugaugaguggcaaagacguauuuuacuuaccgccugagaaaugugauacauugcucugugacauaggagaaucaagcccauccccuacaguagaagaaagucgaacaauaagaguacucaaaauggucgaaccguggcuacgaaauaaccaguuuugcauaaagguucuuaacccauauaugcccacuguaauagagcaucuggaacggcuucagagaaaauaugggggaauguugguaagaaauccauuaagucggaacagcacucaugaaauguauuggauaucgaacggaacggggaauauaguaagcucaguaaacaugguaagcagauuauuauuaaaccgcuuuacaaugacucaucgacgaccaacaauugagaaggauguugacuuaggagccgguacgcgccauguaaaugcugaaccggagacgccaaacauggacguaauaggugagagaaucaaacgcauaaaggaggaacacaguaguacuuggcauuacgaugaugaaaauccauauaaaacgugggcauaucacggaucguaugagguaaaggcaacaggguccgcgaguaguaugauuaauggaguaguuaaacuuuuaacaaaacccugggacgucguaccgauggucacccaaauggcaaugacugacacgacuccauuuggucaacaacgaguuuuuaaagaaaaaguagacacccguacaccgcgaccuaugccaggaaccagaaagguaauggaaaucacagcagaaugguuauggaggacgcucgggaggaauaagaaaccgagguuaugcacaagagaggaguucacuaagaaaguacgaacaaaugccgcaaugggagcaguauuuacagaagaaaaucaaugggauucugcgcgggcagcaguagaagacgaggaguucuggaaauugguagaucgagaaagagaauuacacaaauuagguaaaugcggaagcuguguauauaacaugaugggaaaaagagagaagaaauuaggagaauuugguaaagcgaaaggaucuagagcaauuugguacaugugguuaggagcacgguacuuggaguuugaagcauuaggguuucuaaaugaggaucauugguucucccgagaaaauucuuauucgggaguggaaggugaaggccuucauaaguuaggcuacauucuacgagacauaucgaagauaccagguggagcuauguaugcagacgacacggcaggcugggauacucguauaacggaagaugacuuacacaacgaggaaaagauuacccaacaaauggauccagaacaccggcaacucgccaaugccaucuuuaaacucacguaccaaaauaaaguggugaaaguucagagaccaacaccaaaaggaacuguaauggauauaaucucacgaaaagaccaacgaggcuccggucaaguaggaacauauggacucaacacauuuacaaauauggaagcgcagcuaguaagacagauggaaggugaagguguauuaaguaaagcagaucuagaaaauccucaucuacucgggaagaagaucacacaaugguuagaaacaaaaggggucgaaagacucaagcgaauggcaauaucuggagacgauugcguugugaaacccauugacgacagauuugccaaugcacuucuagcguuaaacgacauggguaaaguccgaaaagauauaccccaguggcaaccuaguaagggguggcaugauuggcagcaaguaccguucuguagccaucauuuccacgaacuuauaaugaaagaugguaggaaacuuguagucccauguaggccccaagacgaacucauagguagagcaaggauuucacagggagcaggauggucucuuaaagagacagccuguuuaggcaaggcauaugcacagauguggucacucauguauuuccaccgacgugauuuaagauuggcaagcaacgcaauuuguucagcgguacccguacacuggauaccuacauccagaacgacguggaguauucaugcccaccaucaauggaugacaacggaagacaugcuuacaguuuggaauagaguuuggauugaagauaauccguggauggaagacaaaacaccagucacuacuugggaggaugucccuuaucucgguaagagagaagaucaauggugugggucgcuuauaggguugacgagccgugcaaccugggcucagaacauauuaaccgcuauccaacagguaagaucccuuauuggcgaugaagaauuucuagauuacaugccaucgaugaaacgauuucgaaaagaggaggaaucugagggagcuauuugguaa

SEQ ID NO: 23100 - RNA, 9873 nt, Artificial Sequence
  derived and/or modified CDS sequence (opt6) from DENV-3__GU131907__SS-prME
acaagucucugcuuaaugaugaugcugccugcuacucuagcguuucauuuaacgucacgcgacggagaaccacgcaugauugucggcaaaaacgaaagagggaaaagccuauuauuuaaaacagcuaguggaaucaacaugugcaccuuaauugcaauggauuugggagaaaugugugaugauaccgugacuuauaaauguccucuuauagcugaagucgaaccggaggauauagauugcugguguaauuuaacaucuaccuggguuacuuauggaaccugcaaucaagcaggagaacauagaagagauaaacgcuccguggcccuagcaccucaugugggcauggggcuagacacuagaacccaaacauggaugucagccgagggagcauggagacaagucgaaaaagucgaaacaugggcauuaagacaccccggguuuaccauccuggcacuuuuucucgcacacuacaucggaaccucuuugacucaaaaaguuguaauauuuauauuacuuaugcugguuacuccaaguaugaccaugcgaugcguugggguuggaaaucgggauuuuguggaaggacuaucuggagcaacuuggguagacgugguacucgaacaugguggaugcguaacaacaauggcaaaaaguaaaccaacuuuggauauagagcugcagaaaacugaggcaacacaacuugccacauuaagaaaacucugcauugaagggaaaauuacuaacauuacgaccgacucuagguguccaacucaaggagaagcuacuuuacccgaagaacaagaucaaaacuacgucugcaaacacacguacguagauagaggauggggaaacgguugugguuuguuuggaaaaggauccuuaguuacuugcgcgaaauuccaaugcuuagaaccuauagaagggaaaguaguacaauaugaaaaccuaaaauauacaguuauaaucaccguucacacgggagaucagcaucaagucggcaacgauacacaaggaguuacagucgagauaacuccucaagcaagcacuguagaggcaguacuacccgaguauggaacccucggcuuggaguguucgccaaggacaggauuagauuuuaaugagaugauucugcucacuaugaaaaauaaagcauggaugguucauaggcaaugguucuuugaccuaccacuaccguggacaaguggugcaacaacugaaacaccgacauggaacagaaaagaacuauuagucacguucaaaaaugcgcaugcaaagaaacaagaggucgugguuuuaggaucacaggagggggcaaugcauaccgcgcuaacaggugcaacugaaauacaaaauaguggagggacaucuauauuugcaggucaccucaaaugucggcuaaaaauggauaaauuggaacugaaaggaaugucauaugcaaugugucuaaacacauucguccuaaagaaagaagugagugaaacucaacacggaacuauuuuaauuaaaguagaguauaaaggugaggaugcaccauguaaaauuccauuuucuacagaagacggacaaggaaaagcacauaauggaagauugauuacagcgaaucccgucgugacaaagaaagaggaaccuguuaauauugaagcggaacccccuuuuggagaaaguaauauagucauaggaauaggagacaaagcucuaaaaauaaauugguauaagaaaggaucaaguauagggaaaauguuugaggcaaccgcaagaggugcgaggcggauggccauacugggggauacagcaugggauuucgggucuguaggcggaguuuuaaacagccuuggaaaaauggugcaccagaucuucgggucugccuauacagccuuauuuucuggcgucucuuggaucaugaaaaucgguauaggaguucuucugacguggauagggcuaaauagcaaaaacacaagcaugucuuucagcuguauuguaauagguauaaucacacucuacuuaggcgcagugguccaagccgauauggguugcguuaucaauuggaaaggaaaagaauuaaaaugugggaacgguauauucgucacgaaugagguucacacuuggacugaacaauauaaauuucaagcagauucgccaaaaagacuggcaacugcaauagcaggcgcaugggagaacggaguauguggcauacgaaguaccacaagaauggaaaacuugcucuggaaacagauugcaaaugagcuuaauuacauacuaugggaaaacaauauuaaacuuacaguaguaguaggagacauuauagggguacuugaacagggaaaacgaacuuuaacuccacaaccaauggagcuaaaauauucauggaaaacaugggguaaagccaaaauagucacagccgaaacacaaaacaguucguuuaucauugauggccccaauacuccagaaugucccucagccagucgagcauggaacgucugggaagucgaagauuacggauuuggaguuuucacaacuaacauauggcuuaaacuaagagagguauacacgcaaucuugugaucaccgccuaaugucagccgcaauaaaagacgaacgugccguucaugccgauaugggauacuggauugagucgcagaaaaauggauccuggaaacucgaaaaagccuccuuuauagaagucaaaacuugcacauggccuaaaucucauacccuauggaguaacgguguauuggaauccgauaugauaaucccaaaaucccucgcuggaccuauuucccaacacaaucaucgaccagguuaccauacccagacugcgggacccuggcaucuaggaaaauuggagcuagauuucaauuacugugagggaacaacaguaguuauugcagaaaacugcggcacuagaggcccgucuuuaagaacuacuaccguuaguggaaaauuaauucaugagugguguuguagaucaugcacgcuaccaccucuccgguauaugggggaagauggaugcugguauggaauggaaauuagacccauaaacgaaaaagaagaaaauaugguuaaaucauuagugucggcgggaagugggaaagucgacaauuuuacuaugggaguacuaugccuugcaauauuauucgaagagguaaugagagguaaauucggcaagaaacacaugaucgccggaguacucuucacauuuguguuauuacuauccggacaaauuacuuggagggauauggcacacacucucauuaugaucggaucuaacgcgucagacagaauggggauggguguaacauacuuagcauugacagcaacauuuaaaauacagccguuccucgcacuaggauucuuuuuacgcaaauuaacaucacgggagaauuuauuacuaggaguuggauuagcaauggcaacaacccuacaauuaccagaagacaucgaacaaauggccaauggaauugcuuuaggguuaaugacuuugaaacuaaucacccaguucgaaacauaucaacucuggacugcguuaguaagccugacuuguucuaacaccauauucacacuuacuguagcauggagaacggcaaccuuaauccucgcaggaguaagucuacuaccucuuugccaaaguagcucaaugcgaaaaaccgacuggcuaccaaugaccguugcggcaaugggaguaccaccccuaccgcuauuuauauuuucguuaaaagauacaccgaaacgacgauccuggccauuaaaugaaggugugauggcuguaggucuugugucaauucuggcuuccucccuccuaaggaaugauguaccaauggcggggccauuagucgcgggaggucuauuaauagccuguuacguaaucacaggcacaagcgcugaccuaacugucgaaaaggcugcugacgucacaugggaagaggaagcagaacaaacagggguuagccacaaccucaugaucacuguugaugaugaugggacaaugcgaauuaaagaugaugaaacugaaaacauuuuaacaguguugcuuaagaccgcucuacugauaguaagcggcauauucccauacaguaucccagcaacauuacucguguggcacacguggcaaaaacaaacccagcgaucaggaguauugugggacguuccaagcccaccugaaacgcagaaagcugaacucgaagaaggcguuuaucguauaaaacagcagggcaucuuugguaagacucagguuggagucggaguacaaaaagaagguguuuuccauaccauguggcacguuacacgaggggcaguacuuacucauaacggaaagagacuagaaccgaauugggcaagcgucaagaaagauuuaaucagcuacggcggagguuggaggcucucagcgcaguggcaaaaaggagaagaaguacagguaauagccguagaaccaggcaaaaaucccaaaaauuuucaaaccaugccaggcaucuuucaaacaaccacaggcgaaaucggcgccaucgcccuagauuuuaaacccggcaccagcggaagcccgauuaucaauagggagggaaaaguuguaggucuguauggcaauggaguaguaaccaaaaacggaggauauguuuccggcauagcgcaaacaaacgccgaaccagauggaccaaccccagaauuagaggaagagauguucaagaaaagaaaucucacaaucauggaccuacauccgggaucuggaaagaccaggaaauaccuaccugcaauuguaagagaagcgauuaaaagaagacuacgcacauuaaucuuagcgccaacaagaguagucgcagcugaaauggaagaagcgcugaaaggucucccuauaagauaucagacaacugcaacaaaaucagaacauacaggcagggagaucguagacuuaaugugucaugcaacuuucacuaugcgauuacuaaguccaguaagagugccaaacuauaaucucgugauaauggacgaagcucauuucacugacccugcuucaaucgcugcuaggggguauauuucuacaagaguuggaaugggagaagcugcggcaauauuuaugacugcuacaccgccggggacggcugaagcauuuccucagagcaacgcaccuauucaggacgaagaacgcgacauaccugaaaggucuuggaacagcggaaacgaauggauaacagauuucgucgggaaaacagucugguuuguaccaucaauuaaagcaggaaaugauauagccaauugccuuaggaaaaacggcaagaaaguuauacaauuaucacgcaagaccuucgauacagaauaucagaaaacacgacugaacgauugggauuuuguagucacaacggacauaucugaaaugggugcaaacuuuaaggcugauagagugaucgaccccagacguugucuaaagcccgucauucuuaccgacggaccugaaagagucauauuagcgggaccuaugccaguaacagcagcaagcgcagcacaacgaagaggccgaguugguagaaauccacaaaaagagaaugaccaauauauauucacaggccaacccuuaaacaacgaugaggaccacgcacauuggacagaagcuaaaauguuacucgacaacaucaauacgcccgaaggcauuauacccgcucucuuugaaccagaaagagagaaauccgcugccauagacggugaauauagacuuaaaggagagaguagaaaaacauucguagaacuuaugcgcaggggagaucuacccguaugguuagcucacaaaguagcaagugagggaauaaaauacacagaucgcaaguggugcuucgauggcgagaggaauaaucaaauacuagaagagaacauggacguugaaauuuggacaaaagaaggagaaaggaagaaacuuaggcccagauggcuugacgcuagaacauacucagauccacuugcauuaaaagaguuuaaagauuuugccgcuggucgcaaauccauagcgcuagaccuuguaacagaaauagggcgaguaccgucacaucuugcacacagaacacggaaugcauuagauaaccuaguuauguuacacaccagugaacaugggggacgcgcguauagacacgcagucgaagaauuaccagaaacuauggaaacacuacuucuauugggacuuaugauucuuuuaacaggaggugcgaugcuuuucuugauaucagggaaaggaauagguaaaacaagcaucggucuaaucuguguuauuguaucgucggguauguuauggauggcggaugucccacuucaauggauugcgucagcaauaguucuagaguucuuuaugaugguuuuguugauaccagagccagaaaaacaaagaacaccucaagacaaucagcuagccuauguagucauaggcauacugacgcuagcagccauaguagcagcaaaugaaaugggacuacuugaaacgaccaaacgggacuuagguaugucgaaagaaccuggaguggucucucccacaucguaucucgauguagaucuacauccggccagugcuuggacuuuauaugcaguagcaacaaccgucauaacacccauguugagacacacgauugagaacucaacagccaacgucucucuagcugcaauagccaaucaggccguaguauuaaugggauuggauaaaggguggccaauuuccaaaauggacuuagggguaccuuuacucgcacugggaugcuauagucaaguuaauccauugacuuugacugcugcaguauuacucuugguuacccauuaugccauaauaggccccggacuacaagccaaagcuaccagggaagcucaaaaacgaacagcggcaggcauuaugaaaaauccaacaguagaugguauaaugacuauagacuuggauccaguaauauaugacucaaaauuugaaaaacaacuugggcaaguaaugcuacugguucucugugcuguucaacuguuauugaugcguacuucaugggcacuaugcgaagcacuuacacuggcaaccggccccauaacaacgcuaugggaagguagcccugguaaauucuggaauacgacaauugcuguaaguauggcuaacauauucagagggucuuauuuggcaggcgcagguuuagcauuuucuauaaugaaaagcgucggaacaggcaggagaggcacagggucacaaggcgaaacuuuaggagagaaauggaagaagaaacuaaaucaacuaagccgaaaagaauuugaucuguacaagaaaucaggcauuaccgaaguugacaggacagaagcgaaggagggccuuaagagaggugaaaccacccaccaugcaguuucccgcggaucggcaaagcuacaaugguucguugaacguaauauggucaucccugagggacgugucaucgaucuaggcugcgggcgugggggauggucauacuauugugcugggcugaagaaagugacugaagucagaggauauacaaagggagggccaggacaugaggagccuguuccaaugagcacauauggauggaauauugugaaauuaauguccgggaaagauguuuucuaccuuccgcccgaaaaaugugacacauuacuaugcgacauaggugaaucaagcccaagcccgacuguagaagaaaguaggacaauuaggguacucaaaaugguugagcccugguuacgaaauaaucaauuuuguaucaaagucuuaaauccauauaugccaacaguuauagaacaucucgaaaggcuccaaagaaaguaugggggcauguuagugcguaauccacuaaguaggaacuccacccacgaaauguacuggaucucgaauggaacuggaaauaucgucuccuccgugaauauggugucacgccucuuacugaacagauuuacaaugacucauaggagaccaacgauugagaaagacguagacuugggugcaggaaccagacauguaaaugcugaacccgaaaccccgaauauggauguuauuggggaaaggauaaagcggauaaaggaagaacacaguaguacauggcauuacgaugaugaaaauccuuacaagacuugggcauaucauggaucuuacgaaguaaaagcuacgggcucagcaaguucgaugauaaacgguguggugaaacuauuaacaaaaccuugggaugugguacccauggucacacaaauggcuaugaccgauacgacuccauuugggcaacagcgaguauuuaaagaaaaaguagacacaagaacaccccgcccaaugccgggcacacgaaaaguuauggagauuaccgccgaguggcuuuggcggacgcucgggagaaauaaaaagccuagauugugcacaagggaagaguucacuaagaaagugagaacaaacgcagcuaugggagcugucuucacugaagaaaaucaaugggauucagcucgagcagcuguugaagaugaagaguuuuggaaauugguugacaaagaaagagaacuccauaagcuaggaaaaugugguucgugugucuauaauaugauggguaaaagggagaagaaauuaggugaauuuggaaaagcuaaagguucuagagccauaugguauauguggcugggagcaagauaucuggaguuugaggcucucgguuuccugaaugaagaucauugguucucuagggaaaauucauacucggguguagaaggagaggguuuacauaaacuaggauauauucuccgagauauuucuaaaauaccgggaggggcgauguaugcggacgacacagcuggcugggacacccgaauuacggaagacgacuuacauaacgaagaaaagauaacucaacaaauggacccagagcauagacaauuagcgaacgcgauuuucaaacuaaccuaucaaaauaaaguuguaaaagugcaacggcccaccccaaaagguacggugauggauauaauaucaagaaaagaucaaagaggauccgggcagguugggacauacggucuaaacacguucaccaauauggaagcacaguuaguacgacaaauggaaggcgaaggcguuuuaagcaaagcagauuuggaaaauccacaucugcuagagaagaaaaucacacaauggcuggaaacaaaaggaguagagagacuaaagcgaauggcgauaaguggagaugauugcgucguaaaaccuauugacgaucgauucgcuaaugcacucuuagccuugaacgauaugggaaaaguaagaaaggauauaccacaauggcaaccuuccaagggauggcaugauuggcaacaaguuccuuuuuguucccaucacuuccaugaguugaucaugaaagacggaagaaaguuggugguaccaugcagaccccaagaugagcuuauaggucgugcaagaauuagucagggagcuggauggucuuuaaaagaaaccgccugccucgguaaggcuuacgcccagauguggucacuuauguacuuucauaggcgagaccucagauuggcaucaaaugcaauuuguucagccguuccaguucauuggauacccacaucgagaaccacguggucuauucacgcccaccaucaguggaugacaacugaagauaugcuaaccguguggaacaggguuuggauagaggauaaucccuggauggaagauaaaacaccagucacaaccugggaggacgugccauauuuaggaaaaagagaggaccaauggugcgggucucucaucggauuaacgucgagagcuaccugggcucaaaauaucuuaaccgcuauucaacaggucaggucguugaucggagacgaagaguuccuagauuacaugccuaguaugaagagauucaggaaggaagaagaaaccgaaggagcgaucugguaa

SEQ ID NO: 23101 - RNA, 9873 nt, Artificial Sequence
  derived and/or modified CDS sequence (opt6) from DENV-3__GQ868634__SS-prME
acaucauugugucucaugaugauguuaccagcuacacucgcauuccacuuaacaagccgagacggugaaccuagaaugauagugggcaaaaaugaacgagguaaaucacugcuauuuaaaacggcaagugggaucaauaugugcacucuaaucgcaauggaccucggagaaaugugugacgauacagugacauauaaaugcccauuaauagcugaaguagaaccagaagauauugacuguugguguaacuugacgucuacauggguuacuuacgggacaugcaaccaagcaggagaacacaggcgcgacaaacgaaguguagcauuggcaccgcauguggggaugggauuagauacuagaacacagacguggaugagugcagaaggggcauggcgucaaguugaaaaaguugaaaccugggcguuaagacauccggguuuuaccauauuagcauuauuucuugcccauuauauaggaacaagccuuacacaaaaaguuguaauauuuauacuauuaauguuaguaacgccaucaaugacaaugagauguguaggugugggcaauagggauuucguggagggacuuucaggggccacuuggguagacgugguacuagaacauggcggcuguguuacaacaauggcgaaaaguaaaccuacgcuagacauagaauuacagaaaacagaggccacacaauuggcaacacugagaaaacuuuguaucgaggguaaaauaacuaauauuaccacagauaguagauguccgacacaaggugaggccacguugccagaggagcaagaucaaaauuauguaugcaaacauacauacguagacagaggauggggcaauggcuguggauuauucgggaaaggaucccuagucacaugugcaaaauuccaaugucuggaaccuauagaaggaaaaguugugcaauacgagaacuugaaauacacuguuauaauaacaguucacacuggggaucagcaucaaguaggcaacgacacgcagggaguaacaguagaaauuacaccucaggcaucaacaguggaggcagucuuaccagaguauggcacccuagguuuagaguguucaccuagaaccggauuagauuuuaacgaaaugauauuacuaacaaugaaaaacaaagcauggaugguacaucgucaaugguucuuugacuugccgcuacccuggacuucuggugcaaccaccgagaccccaacuuggaaucgcaaagaauuguugguaacauuuaaaaaugcacacgccaagaaacaagaaguaguuguacuaggaagucaagaaggugcaaugcacacggcacuaacgggagcaaccgagauacaaaacaguggagggacaaguaucuucgcagggcacuuaaaauguagacugaaaauggauaaacuagaacuuaaagggaugaguuaugcaaugugucuaaauacguucguccuaaagaaagaaguuagugagacucaacacgguacgauacugauaaaagucgaguauaaaggagaagaugcgccauguaaaaucccauuuucaaccgaagauggccaaggaaaagcucauaauggaagauugauuaccgcuaaucccguaguuacuaagaaagaggaaccaguaaauauagaagcagaaccaccauucggcgagaguaauauuguuauugggauaggagauaaggcuuugaaaauuaauugguacaagaaagggucuaguaucgguaaaauguucgaggcaacagcaaggggcgcacgcagaauggcuauucucggugauacagcuugggacuucgguaguguaggagguguauugaacucguuggggaaaaugguccaucaaauuuucgggagugcguauacggccuuauucucuggagugucguggauuaugaaaauugggauugguguucuauuaacauggauuggguuaaauucuaaaaauacuagcauguccuuuagcuguauaguuauaggaauaauaaccuuauaucuuggagcaguaguccaagcagauaugggcugcgcaaucaacuggaaagguaaagaguuaaaaugcgguagugggauauucguuacuaacgaaguacacacauggacagagcaguauaaauuccaagcagacucgcccaaaagauuggcuacagcaauagccggggcuugggaaaauggagugugugguauccgaagcaccacgcggauggaaaaucuucucuggaaacagauagcuaaugaacuuaacuacauuuuaugggaaaacaauauaaaacucacuguugugguuggugauauuauaggagugcucgagcaaggcaaacgaacauuaacuccccaaccgauggaacuaaaauauucuuggaaaacauggggaaaagcaaaaauaguaacagcagagacgcaaaacagcaguuucaucauugauggaccaaauacgcccgaauguccaucagcgagcagagcauggaacguaugggaaguagaagauuauggauuuggcguauucacgacuaacaucuggcugaaauuaagagaaguuuauacacaaaguugugaucaccgauugaugagcgcagcgauuaaagaugaaagagcaguacaugcagauaugggauauuggauugaaucacagaaaaaugggucguggaaacuagaaaaagcgucauuuauagaagugaaaacuugcacuuggccaaaaucacauacucuauggaguaacgggguacuagagagugauaugaucauccccaaaucucuugcuggcccgaucucgcaacauaaccaccgcccaggauaccacacucagacagccgguccauggcauuuagguaaacuagaauuagacuucaacuacugugaaggcacgacugugguaauaaccgaaaauugcggaacacggggcccaagucuaagaaccacgacaguaucuggaaaacuaauucaugaguggugcugccgaucaugcacgcuuccgccauuaagauauaugggugaggauggaugcugguacgggauggagauuagacccauaaaugagaaagaagaaaauaugguuaaaagccuggugucugcuggcaguggcaaagucgacaacuucaccaugggcguucuaugucuagcuauauuauuugaggaaguuaugcggggaaaauuugguaagaaacacaugauagccggcguacuauuuacguuuguguuacuauuauccggucaaauaacauggcgcgacauggcacauacuuuaauaaugauaggcucaaacgcaucugauagaaugggcaugggugugacauaucuugccuuaaucgcaaccuuuaaaauccaaccuuucuuagcccuaggguucuuucuaagaaaauuaaccucaagagaaaaccucuuacugggcguuggacuagccauggcgacgacguuacaacuuccagaagauauugagcaaauggcaaacgguauagcauuagggcuuaugacauugaaauuaauaacucaguuugagaccuaccagcucuggacagcguuggugagucuaacaugcagcaauacuauauucacauugaccguagccuggagaaccgcgacgcucauuuuagccgguguaucuuuauuaccauuaugccaaucaucaaguaugagaaaaaccgauugguuacccaugacaguggcagcaauggguguuccaccccuuccuuuauuuauauucucacuaaaagauacuccgaaaagacgaucuuggccauuaaaugaaggaguuauggcggugggcuuaguaagcauacuggcuuccagccuauuaagaaaugaugugccuauggcuggaccccuaguugcugguggacucuuaauagcuugcuacgugauaacaggcacuucggcagauuugaccgucgaaaaggcagcagacguaacgugggaagaagaagccgaacaaacaggugugagucacaaucuaaugauaacgguagaugacgaugggacgaugagaauuaaagaugaugaaacagaaaacauucuaacaguguuacuaaagacagcauuguuaauaguuaguggaauauuuccauauaguauaccagcgacauuauugguuuggcacacguggcaaaaacagacgcaacgaucugguguucugugggacguuccaagucccccagaaacccaaaaagcggaauuggaagaaggggucuacagaauaaagcaacaggguauuuuuggaaaaacccagguagggguaggaguacaaaaagaagguguauuucauacuauguggcauguuacccggggagcgguuuugacacacaacgguaaacgauuagaaccuaauugggccagcgucaagaaggauuuaaucagcuacgggggaggguggcggcuuaacgcccaauggcagaaaggcgaagaaguacaggugauagcaguagaaccuggaaagaauccaaagaacuuccaaacaaugccaggaauuuuucaaaccacuaccggugaaauaggggcuaucgcgcuggauuuuaagccaggaaccucggguagcccaauaauaaaucgcgaaggcaaaguuguuggcuuguaugggaacggagugguaacgaaaaauggaggauauguuucaggaauagcacagacuaacgcagaacccgauggucccacaccugaauuagaagaagaaauguuuaagaaacgaaauuuaacaauaauggaucuucauccuggaucagggaagacuaggaaauaccuacccgccaucgugcgagaagcaauaaaaaggagacugagaacauuaauuuuagcgccuacgaggguaguugcugccgagauggaggaagcacuuaaaggacuuccaauccgcuaccagaccaccgcaaccaagagcgagcacacaggacgagaaauaguggaucugaugugccacgcuacauuuaccaugagauuguuaagucccguuagaguuccaaauuauaaucuagugaucauggaugaggcucacuucacagacccagcgagcaucgcugcaagagguuacauaaguacgcggguggguaugggggaagcugcggcgauauuuaugacagcuacuccaccgggaacggcagaagcauuuccccaaaguaacgcgccaauucaagaugaagaaagagacauaccggaaagaucuuggaacucggguaacgaguggauaaccgauuucguagguaaaacagugugguuuguaccgucaauaaaagcgggaaaugauauagcaaauugccuaaggaaaaauggaaagaaaguuauucaauuaucaaggaagacuuucgauacagaauaucagaaaacacgacuaaaugauugggacuuugugguuacaacugacauaagugagaugggagcaaauuucaaggccgauaggguaaucgauccccgaagaugucuaaaaccaguaauuuuaacagauggacccgaaagaguaauucuagccggacccaugccggucacggcugcgucagcagcacaacgacgcgggcgaguugguagaaauccucaaaaagaaaaugaucaauauaucuuuacaggacaaccucucaauaacgaugaagaccaugcacacuggacagaggcuaaaaugcuuuuagauaacauaaauacaccggaagguauaauccccgcccuauuugaaccugagcgggaaaagagcgcugcgauagacggagaguaucgacucaaaggugaaagccggaaaacauuuguagagcugaugagaagaggagacuugccgguguggcuagcacacaaagucgcaucggagggaauuaaauacaccgaucguaaauggugcuucgauggagaacgcaauaaccaaauauuggaagaaaacauggauguagagauuuggacaaaggaaggagaacguaagaaacuacgcccaagauggcucgaugcgaggacauauuccgacccguuagcuuuaaaggaauuuaaagacuuugcagccgggcgaaaauccauagcucuagaucuagugacugaaaucggaaggguuccaagucacuuagcucauaggacucgaaaugcacuggauaaccuaguaauguuacacacaagugagcauggugggagagcauacagacaugcaguugaagaguuaccagagacaauggaaacguuacuacuucuaggacuaaugauauuacuaacuggaggagccauguuauuucuuauaagcgguaagggaauagggaagacaucaauaggucugauauguguaauuguaaguuccggaaugcuguggauggcggauguuccauugcaguggaucgccuccgcuauuguccuagaauuuuucaugaugguuuuauuaauuccggagcccgagaagcaacgaacgccacaagauaaccaguuagcauacguuguaaucggcauacuuacacuggcggcaauuguugcagcaaacgaaaugggacuacuagagacuacaaaaagagaucuuggcaugaguaaagaaccuggcguggucagccccacaagcuacuuagacguagaucuacauccagcgagugcguggacgcuauacgcugucgcaacaacgguuauuacaccaaugcuucgacauacgauugaaaacucaaccgcaaaugugagccuugcagccauagcuaaucaggcuguaguauugaugggauuggauaagggauggccaauuucuaaaauggaucucggaguaccucuucucgcauugggauguuauucacaaguaaauccacuaacacucacagccgccguauuacuacuuguaacacacuacgcaauaaucggaccaggauuacaggccaaagcgaccagagaagcacaaaaacguacagccgccggaauaaugaaaaacccaacuguugaugguauuaugacuauagacuuagauccaguaauauacgauuccaaauucgagaaacaacuaggacagguaauguuacucguccuuugcgccguccaacucuugcucaugagaacaucaugggcccuaugugaggcuuuaacauuggcaaccgguccuauaacaacauuaugggaaggauccccaggaaaauuuuggaauacuacaauugcuguuucgauggcuaauauuuuucggggauccuaccuagccggugcgggguuagccuucaguauuaugaaaucaguaggcacuggucgucgaggcaccgggucucaaggcgaaacacugggagaaaaauggaagaagaaacuaaaucaauuaagccguaaagaauuugauuuauauaagaaauccgggauaacagagguugauagaacugaagcaaaagaaggucuaaaacgaggugagacuacucaccacgcagugagccgaggcucggcuaaguuacagugguuuguugagaggaauaugguaaucccugaagguaggguuauugauuuaggaugcggacgugggggauggucauauuauugugcgggacuaaagaaaguuacugaaguaagggguuacacgaaaggaggucccggucacgaagaaccagucccuaugucaacauauggguggaacauaguaaaacucaugucugguaaagauguauuuuaucuaccaccagagaaaugcgauacguuauuaugugauaucggggaaaguucaccuucuccgaccguugaagaaagcagaaccauaagagugcuuaaaaugguagaaccguggcuucguaacaaucaguuuuguauaaaaguucugaaucccuauaugccaaccguaaucgaacaucucgagagguuacaacggaaauauggugguaugcuugucagaaacccacuauccagaaauucuacacaugaaauguacuggauaagcaauggaaccgggaauauaguaucaucaguuaacaugguaaguagacuucuacuuaaccgguuuacuaugacucaucggcgaccuacaauagaaaaagacguagaucuaggugcgggcacacgccauguuaaugcggagccagaaacuccaaacauggauguuauaggagaaaggauuaaacggaucaaagaagaacauaguuccacauggcacuaugaugaugaaaauccauacaagacaugggccuaucacggaucguaugaagucaaggcuacaggaucagcauccucaaugauaaauggagugguaaaacuauuaacgaaaccaugggauguaguacccauggugacccaaauggcuaugaccgacacuaccccguucggucagcaaagagucuuuaaagaaaaaguagauacaagaacaccaaggccuaugccagggacccgaaaagugauggaaaucacggccgaaugguuguggagaacguugggccgaaauaaaaagccucgacuaugcacuagggaagaauuuaccaagaaaguacgaacaaaugccgcuaugggggcaguauucacagaagaaaaucagugggauucagcuagggcugcaguagaggaugaagaguucuggaaacuuguagauagggaaagagaacuccacaagcuaggaaaauguggguccuguguuuacaauaugauggguaagagagagaagaaauuaggcgaguucgggaaagcaaaaggauccagagcuaucugguacaugugguuaggcgcacgcuaccuagaguuugaggcauuagguuucuuaaaugaagaccacugguuuaguagggaaaacucguauagcgguguagaaggugaagggcuacauaaauuagguuacauucuccgagacauaaguaaaauuccggguggggcuauguaugcagaugauacugcgggaugggacacuagaauaacagaggaugauuugcauaaugaagagaaaaucacgcaacagauggauccagaacaucgacagcuagcgaaugcgauuuucaaacugacguaucaaaauaaagugguuaaggugcaaaggccuaccccuaagggaacaguuauggauaucaucucuaggaaggaucagcgcggaucaggacaagucgguacguacggguuaaauacauuuaccaauauggaggcacaauugguccgacaaauggaaggcgaaggaguccuaucuaaggccgacuuagaaaauccccaucuauuagagaagaaaauuacucaaugguuagagacaaaaggaguagagcgauugaagcguauggcaauuagcggagaugauuguguggugaaaccaauagaugaucgauucgcgaacgcgcuccucgcacuuaacgacaugggaaaagugagaaaagauauaccccaauggcaaccuaguaaaggauggcacgacuggcaacaaguaccauuuuguucucaucauuuucaugaguuaauaaugaaagauggacgaaaacuggugguuccaugccgaccucaagacgaauuaauuggaagggcaaggauaucucagggagccgguuggucuuugaaagaaacggcaugcuuagggaaggcuuaugcgcagauguggucuuuaauguauuuucauagacgugaccuucgacucgccagcaaugcaaucugcucagccguaccaguacauuggauacccacuucgaggacaacuugguccauacaugcacaccaccaauggaugacgaccgaagacauguuaacuguuuggaacagaguauggauagaggauaauccauggauggaggauaaaacuccaguaacaacgugggaagacguaccauaccuaggaaagcgugaagaccaaugguguggaucauugauaggucuaacuucacgagcaacgugggcacaaaauauacuaacggccauccaacagguucgaucauuaauaggggaugaagaguuccuugacuauaugccuuccaugaaaagauucagaaaagaagaagaaagcgaaggcgcaauuugguag

SEQ ID NO: 23102 - RNA, 9873 nt, Artificial Sequence
  derived and/or modified CDS sequence (opt6) from DENV-3__GU131908__SS-prME
acaucucuuugcuuaaugaugauguuaccugcaacguuagcuuuucauuuaacgucaagagauggggaaccacggaugauaguugguaaaaaugaacgaggaaaaagucugcuguuuaaaacagcaucugguauaaauauguguacacugauugcaauggacuuaggagaaaugugugaugacacuguaacuuauaaaugcccauugauagcagaaguagagccagaagauaucgauugcuggugcaacuuaacaucaacgugggugacauauggaacauguaaccaagcuggagaacauagacgcgauaaaaggagcguugccuuagcaccucauguagggaugggacuggacacgaggacacaaaccuggaugagcgcggaaggagcauggagacaaguugaaaaaguggaaacaugggcuuuacgacauccagguuuuaccauauuagcacuauuuuuagcccauuacauagggacaucccuuacucaaaaagugguaaucuuuauacuacugaugcuaguaacacccaguaugacuaugagguguguggguguaggcaaccgggacuuuguugaagguuuaagcggcgcaacuuggguagauguaguuuuagagcacggaggguguguaacuacaauggccaaaucgaaaccaacgcuagacaucgaacuucagaaaacggaggcaacacaacuugccacccuuagaaaacuguguaucgaaggaaaaauaacaaauauaacuacagacucuagaugcccaacucaaggagaagcgacucuacccgaagaacaagaccaaaacuacguauguaaacacacauauguugacagaggauggggcaauggaugugguuuauuuggaaaagggucuuuagucacgugugcgaaauuucaaugucuggaacccauagaagguaaagucgugcaauacgaaaacuuaaaauauacugucauuaucacugugcacacaggggaccaacaucaggucggaaaugauacacaaggugucacaguugagauuaccccucaggcuuccaccguagaagcggucuuaccagaguaugguacacugggauuagaaugcucgccaaggacaggauuggauuuuaaugagaugauauuacuaaccaugaaaaauaaagcauggaugguacaucggcagugguucuuugaccuaccguugccuuggacaucgggagcaacaacugaaacgccgaccuggaauagaaaagaacucuuaguaacauuuaaaaaugcccaugccaagaaacaagaaguuguaguacuaggcucgcaagaaggcgcaaugcauacugcucugacaggggcaacggagauccaaaacagcggagggacuagcauuuucgcuggucaccuaaaaugccgucuaaaaauggauaaauuagaacuaaaagguaugaguuacgcaauguguuugaacacuuuuguucucaagaaagaaguaagugaaacacagcauggcacuauucucauaaaaguugaauauaaaggcgaagacgcgccauguaaaauaccguuuucaaccgaggauggacaaggaaaagcacauaacggaaggcugauaaccgcuaauccggugguuaccaagaaagaggagccaguaaauauagaagcagagccaccauucggcgaauccaauauaguuaucggaauaggugacaaagcacuaaaaauaaauugguauaaaaaggguucaucgauaggcaaaauguuugaagcuacagcacgaggugcccggcgaauggcaauucugggagauacugccugggacuuuggaaguguugggggaguacuaaauucacuuggaaaaaugguacaucaaauauucgguuccgcauacacagcauuguuuuccggaguuaguuggauuaugaagauagggaucggaguacuccuuacauggauuggguuaaacaguaagaacaccucgauguccuucucauguauaguaauaggcauaauaacucucuacuugggggcuguugugcaagcggauaugggaugugcaaucaauuggaaagguaaagagcuaaaaugcggaucugggauuuuuguuaccaaugaaguucacacauggacggaacaguacaaauuccaggccgacagcccaaaacgauuagcaacagcgaucgccggugcauggaagaauggaguaugcggaauaagaagcaccaccaggauggagaacuuauuauggaaacaaauugcaaacgaguuaaauuacauuuuaugggagaauaacauuaaauuaaccgugguagucggcgauauaaucggcguucucgagcaaggcaaacgaacauuaacaccucagccuauggaacugaaauauucauggaaaaccuggggaaaagcaaaaaucgugacagcggagacacaaaacagcucauucauaauugacgguccaaauacgccggaauguccguccgcuagucgcgccuggaacguaugggaaguggaagacuaugguuucgguguauuuacaacaaacaucuggcuuaagcuaagggaaguauauacacaaagcugugaucauagacuuaugucagcggcgaucaaggacgaacgugcaguucaugcggacaugggauacuggaucgaaucacaaaagaauggaucauggaaacuagaaaaggccuccuucaucgaaguuaaaacuuguaccuggccgaaaagccauacacugugguccaacggcguccuugaaagugacaugauuauaccuaaaucccuagcaggaccuauuucccaacacaaccacagaccagguuaccauacucaaacggcgggaccguggcaccugggcaaacuagaacuagacuucaauuacugcgaaggaacuacgguuguuauaaccgagaauugugggacuagaggcccgagccugagaacaaccacgguguccgguaaguuaauucaugaaugguguugucggaguuguacauuaccuccguugagauauaugggugaagaugguuguugguauggaauggaaauuagacccauuaaugaaaaagaagagaauaugguuaagucucuaguaucggcaggcucaggcaaagucgauaacuuuacgaugggagugcuuuguuuggcuauauuauucgaagaaguaaugcgcggcaaauuuggcaagaaacauaugauagcuggagucuuauuuacauuugugcuauuguuaagcggacagauaacauggcgagauauggcucauacccuuauaaugauaggaagcaaugcauccgauagaaugggcaugggcguuacauacuuggcacucauagccacauuuaaaauacaaccauuucuagcauuaggauucuuucuaagaaaauuaaccagcagagaaaauuuacuacuaggggugggucuggccauggcuacaacacuccaacuacccgaggauaucgaacaaauggcgaauggcauagcauuaggauuaaugaccuuaaaauuaauaacucaauucgagaccuaucaacucuggacggcgcuagucucauuaaccuguagcaauacaauuuucacucucacaguggccuggcguaccgcaacauuaauauuagccggagucagcuuauugccuuuaugccaaucaaguucuaugaggaaaacagauugguuacccaugacaguugccgcaaugggagucccucccuugccacuuuuuauauucucccuaaaagacacuccaaaacgucgcucauggccuuuaaaugaagggguaauggcgguaggccuaguaucuauccucgcuucaagucuuuugcggaaugaugugccaauggcgggaccauugguugccggugguuuacuaauagcauguuauguuauuacugggacgucugcugaccuaacgguagaaaaagcugcagacguaacaugggaagaagaagccgaacaaaccgguguaucucauaaucuuaugauaacaguagacgacgacgggaccaugaggauuaaggaugaugaaacugaaaauauauuaacaguucuacuaaaaacugcacuacuaauaguuucugguauuuuuccauauucaauuccugcuacacuacuuguauggcauacguggcaaaaacaaacgcagcgaucugguguccuaugggacguuccaucuccaccugagacucaaaaggcugagcuugaggaaggagucuauagaauuaagcagcaaggcauuuuugguaagacacaaguaggaguaggaguccaaaaagaaggcgucuuccauaccauguggcauguaacaagaggugcuguacuuacccacaacggaaaaagauuagaaccaaauugggcuucagugaaaaaggacuuaauaucauaugguggugguuggcgauuaaacgcacaguggcagaagggggaagaaguacaagucaucgccguugagccagguaaaaaccccaaaaauuuucaaaccaugccggguaucuuccaaaccacgacaggugaaauaggagcaauagcgcuggauuuuaaaccaggcacgaguggcagucccauaauuaaucgugaaggaaagguaguuggacuguauggaaacggugugguuaccaaaaacggcggguauguaucugggauagcacaaacuaacgccgaaccagacggucccacgcccgaacucgaagaagagauguucaagaaacgaaauuuaacuauaauggauuugcauccuggcucugggaagacucgaaaauaucuaccagcgaucgugagagaagcaaucaagagacgucuacggacauuaauauuggcgccgaccagaguaguugcagccgaaauggaagaagcgcucaaaggucuucccaucagauaccaaaccacggccacaaagucagagcacacaggccgggaaauuguggauuugaugugccacgcuaccuuuaccaugagguugcuaucuccagugcguguaccaaacuacaaccuggucauaauggaugaagcacauuuuaccgacccugcaucuauugcagccagaggauauauaucaacucgagucggaaugggugaggcagcugccauuuuuaugacagcuacuccacccgguacagcagaggcuuuuccacaaagcaaugcgccuauccaagaugaagaaagggauaucccugaaagaucguggaacaguggaaacgaauggaucacagauuuugucgguaagacuguaugguucguuccaucaauuaaagccgguaaugauauagcaaauuguuuacggaaaaauggaaagaagguaauccaguuaucgagaaaaacauuugacaccgaauaccagaaaacuagacuaaacgauugggauuucguuguaacgacagauaucuccgaaaugggagcaaauuucaaagcagaucgagucaucgacccuagaagauguuuaaagccagucauuuuaacugacggcccagaaagaguaaucuuagcgggccccaugccgguaacugcagcuagugccgcucaacgucgaggacgagucgggagaaauccacaaaaagaaaacgaucaauacauauuuacaggucaaccguugaauaaugaugaagaccaugcacauuggacagaagccaaaaugcuccuggauaauauaaauacgccagaaggaauuauaccugcacuuuuugaaccugaaagggaaaaaucugcggcaauagauggcgaauaucgacugaaaggcgagucgcguaagacuuuuguagaauuaaugagaagaggcgauuuaccuguauggcuugcacauaaagucgcaagcgaagguauuaaguacaccgauaggaaaugguguuuugauggugagcgaaauaaccagauauuggaagagaauauggacguggaaauauggacaaaagaaggagagaggaagaaauuaagaccgagguggcuagacgcucgcacuuacucggacccccuagcacuaaaagaauuuaaggauuuugcagcgggccguaaaagcauagcacuggaucuaguuacagaaauaggacgaguaccaucacaucuagcucaccguaccagaaaugcauuagacaaccuuguaauguuacauacgucagagcaugggggccgagccuaccgucaugcaguagaagaacuaccggaaacuauggaaaccuugcuucuguuaggauugaugauuuuauuaacaggaggugcuaugcuauuuuuaauaagugguaaaggaauagguaaaacaucuauaggauugauauguguaauuguaaguagugggaugcuauggauggcagacguuccgcuucaauggauagcaucugcuauugugcuagaguucuuuaugaugguucucuugauaccagaaccagaaaaacagagaacaccucaagauaaucaacucgcuuauguuguuauagguauacuuacauuagcagcaaucguugcugcuaacgaaaugggacuauuagaaacaaccaaaagagaucuaggcaugaguaaagaaccaggaguagugaguccgacuagcuaccucgauguugaucugcaucccgcgucugcuuggaccuuguaugcuguugccacgacaguaauaacaccgauguuaagacauacaauagaaaauucuacggcaaacguaucgcuagcagccauagcgaaccaagcgguaguacugaugggacuagauaaaggguggccaaucucaaagauggaccugggugucccauuguuggcauuaggcugcuauucucaaguaaauccacucacacuuacagccgccguacuauuauuaguuacccacuaugcuauuauagguccggguuugcaagcaaaagcaacaagagaggcacagaagcgcacagcagcagggauaaugaagaaccccacaguugaugggauuaugacuauagauuuagacccuguuaucuaugacucuaaauuugaaaaacaacuaggccaaguaaugcuucuaguauuaugugcgguacaguuauugcuaaugagaacuucuugggcucuuugcgaggcucugacucuugccacuggaccuauaaccacccuaugggagggaagcccuggaaaauucuggaauacaaccaucgcaguaucaauggcaaauauuuuccgcggaucguaucuagcaggagcagguuuagcuuucucaaucaugaaaaguguagguacugguagacgaggaacugguucacaaggagaaacguuaggagaaaaguggaagaagaaauuaaaccagcuaagucguaaagaauuugauuuguacaagaaaagcggaauuacagagguagauagaaccgaagccaaagaggguuuaaaaagaggcgaaacuacacaccaugcaguaucaagagguagcgcuaaauuacaaugguucguugaacgcaacaugguuauuccggaaggacggguaauagauuuagguugcggacgagguggauggucguacuauugcgcuggauuaaagaaaguuacagagguuagagguuauacaaaaggcgguccuggacacgaagaacccgucccuaugaguacuuacggguggaacaucguaaaacuuaugucugguaaagauguguuuuauuuaccacccgaaaagugcgauacguuauuaugcgauaucggggaaagcucaccuuccccaacgguugaagaaucuaggacuaucaggguuuuaaaaaugguugaaccuuggcuccguaacaaucaauuuugcauaaaagugcuaaauccauacaugcccacaguaauugagcauuuggagcgauugcaacgaaaauacgggggaaugcuuguaagaaauccucuuucgcgaaacaguacacaugaaauguauuggauuucuaaugguaccggaaacauugucucuagcgucaauaugguaucacggcuguuauugaauagauuuacaaugacucaucgcagaccuacaauugaaaaagacguagacuugggagcuggaacucgacauguaaaugcugaaccagaaacaccgaauauggauguaaucggcgaaaggauaaaaaggauaaaagaagaacauucgucaaccuggcauuaugaugaugaaaauccauacaagacaugggcuuaucacggaucguaugagguaaaagcaaccggcucggcuaguucaaugauaaacggggugguuaagcuacucaccaaacccugggacguugucccuauggugacccaaauggccaugacagauacaacgccauuuggccagcaaagaguuuucaaagaaaaaguugauacaaggaccccacgcccaaugccggggacuaggaagguuauggaaauaacagcugaguggcucuggcgaacguuaggucguaauaagaaacccaggcuauguacgcgcgaagaauuuaccaagaagguaagaaccaaugccgcaaugggagcaguuuuuaccgaggaaaaucaaugggacucugcgagagcagcuguagaagaugaagaauuuuggaaauuaguugacagagaaagagagcuacauaaauugggcaaguguggaucauguguauacaauaugauggguaaaagagagaagaaacuuggggaguucgguaaagcaaaagguagcagagcuauaugguauauguggcuaggugcaagauaccuagaauuugaagcacuugguuucuugaaugaagaucauugguuuuccagagagaauaguuauucaggaguagaaggagaagguuuacauaaauugggauauauacuccgagacauaucuaaaauaccaggcggcgcuauguaugcagacgauacagcagguugggauacuagaaucacugaagacgaucuacauaaugaagagaaaauuacucagcaaauggauccagagcaccgucaguuggcaaaugcaauauuuaaauugacauaucaaaacaaaguuguuaaaguucaaagacccacucccaaaggaacuguuauggauaucauuagcagaaaggaucagagagggaguggacaaguaggaacauauggacuuaauacuuuuacuaacauggaagcucagcucguacgucagauggagggugaaggcguuuuaaguaaagcagaucuagaaaacccgcacuugcucgagaagaaaauaacucaauggcuagaaacaaaggggguagagagguuaaaaaggauggcuauaagcggagaugauugugucguuaaaccuauagacgaucgguucgcaaacgcccuccuugcuuuaaacgauauggguaaaguuagaaaggacauaccacaguggcaaccuuccaagggcuggcacgacuggcaacaaguuccuuuuugcucacaucauuuucacgaauuaaucaugaaggacgguagaaaauuaguaguuccuugucgaccucaagacgaacuuauagguagggcgagaaucucucaaggagcugguuggucauuaaaagaaacagcaugucuuggaaaggcuuaugcgcaaauguggagccuuauguauuuccaucgacgcgaucuaaggcuugcaucuaaugccaucuguuccgcagucccugugcacuggaucccaacaagcagaacuacguggaguauacaugcacaucaccaauggaugaccaccgaagacauguugacugucuggaauagaguauggaucgaagauaauccuuggauggaagacaagacaccaguuacaacgugggaagauguacccuauuuagggaaacgcgaagaccaauggugcgggagcuuaauuggucuaacaucgcgcgcaacaugggcacaaaauaucuuaacugcaauucagcaaguacgaucgcuuauaggugacgaagaauuuuuagauuauaugcccucuaugaaacgcuucaggaaagaagaagagucagaaggugcuaucugguag

SEQ ID NO: 23103 - RNA, 9873 nt, Artificial Sequence
  derived and/or modified CDS sequence (opt6) from DENV-3__GU131909__SS-prME
acuucauugugucuaaugaugauguuaccagcgacacuugcauuccauuugacauccagagauggggaaccccguaugauaguagguaaaaaugaaagaggaaaaucauuauuauuuaaaacggcuucugguauaaacauguguacacuaauagccauggaucuuggugaaaugugugaugacaccguaacguacaaauguccuuuaauagcggaaguugaaccugaagauauugacugcugguguaacuuaacgucaacaugggucaccuauggaacuuguaaccaagccggugaacauaggcgcgauaaaagaucaguagcacuagcaccucacguaggcaugggucuagauacacgaacacaaacauggauguccgcugaaggagcguggagacaaguugaaaaaguggaaacaugggccuucagacacccugguuuuacuauccuagcucuauuccuugcccauuauauaggcaccucccuaacgcaaaaaguugugauuuucaucuuacuaauguugguuaccccgucgaugacuaugcguuguguuggaguaggaaauagagauuucguugaagggcuaucuggggcuaccuggguugauguaguuuuggaacaugguggcugugugacuacuauggcaaaaucuaaaccuacauuagacauagaguuacagaaaacggaagcuacacaauuagcaacacuucguaaauugugcauagaaggcaaaauuacaaauauuacuacagauaguagguguccaacccaaggggaggcgacauugcccgaagaacaagaccaaaauuaugugugcaaacauacauauguugauaggggauggggcaacgguuguggccuauuuggcaaaggaucgcugguaacaugugcaaaguuccaaugucuggagccaauugaaggaaagguuguccaauacgaaaaccugaaauacacaguaauuauaacaguucauacuggcgaucaacaucaaguaggaaacgacacacaaggaguuacgguagagauaacgccacaagcgaguacaguagaggcgguuuugccagaauaugguacuuuaggguuagagugcagcccuagaacgggucuggauuuuaacgagaugauauuauuaacuaugaaaaauaaagcauggaugguacauagacaaugguucuuugacuugccucugccauggacaaguggagcaacaacggagacuccuacguggaaccguaaagaauuacuugucacauucaaaaacgcucacgccaagaaacaagaaguuguaguuuuaggaagucaagaaggggcuaugcauacagcccuuacgggagcgacugagauacaaaacagugggggcacaucaaucuucgcuggccauuuaaagugcagacuuaaaauggauaaacuugaguugaaagggauguccuaugcgaugugcuuaaacaccuuuguauuaaagaaagaaguaagcgaaacgcaacaugguaccauacuuaucaaaguagaauacaaaggagaagacgcgccuuguaaaauaccauucucaacagaagauggccaggguaaagcacacaacggcagguuaauaacugcgaauccuguaguuaccaagaaagaagaaccagugaauauagaggccgaaccgccuuucggcgaaucuaauauaguaaucgguauaggcgacaaagcucuuaaaauaaacugguacaagaaagguagcagcauugggaagauguuugaagcuaccgcucguggcgcucgaagaauggccauucugggugauacugcgugggauuuuggcagugugggcggaguucuaaacucuuugggaaaaaugguucaucaaauauuugggucagccuauacggcacuauuuucaggcgugucauggauuaugaaaaucgguaucggcguauuacuaacuuggauuggacuaaacagcaaaaacaccagcaugaguuuuucuuguaucgugaucggcauaaucacucuauauuuaggagccguaguacaagcugacauggggugugccauuaauuggaaaggaaaggaguuaaaaugugggagcggcauauuuguaacuaaugaaguccauacuuggaccgaacaauauaaguuucaagcagauucaccgaaacgacuagccacagcaauugcuggugcuugggaaaacgguguaugcgguaucaggagcacuacuaggauggaaaacuugcuuuggaaacaaauagcuaacgaauuaaauuacauuuuaugggaaaacaauauaaaacuaacagugguaguaggagauauaauaggaguacuagaacaagguaaaagaacccuaacuccacaaccuauggaauugaaauauaguuggaaaacaugggguaaagcaaagauuguaacagcagagacccaaaauagcaguuuuaucauugacgggccaaauacaccagagugccccucggcaagcagagcauggaacgucugggaaguagaagacuauggauucgggguauucaccacaaacauuuggcuuaaacuuagggaaguguauacacaauccugugaucaucgccuuaugucagcagcgaucaaggacgaacgcgcuguacaugcggauaugggcuauuggauagaaagccagaaaaacggaagcuggaaacuugaaaaggcuucuuuuauugagguuaaaacaugcacauggccaaaaucacacacucuauggucaaauggaguguuagaaagcgauaugaucauuccaaaaucucuagcaggaccaauaagucagcacaaccauagaccugguuaucauacacagacagccgggccuuggcaucucggaaaacuagaguuagauuuuaacuacugugaaggaacgacaguaguuauaacggagaauugcggaaccaggggaccaucguuaaggacuacaacugugaguggaaaacuaauacacgaauggugcuguaggaguuguaccuuaccuccgcuaagauacaugggagaagaugggugcugguauggaauggaaauacgacccauuaaugaaaaggaagaaaacaugguaaaauccuuaguaagugcagguagcggaaaaguagauaacuuuacaauggguguucuauguuuagccauacuuuuugaagaaguaaugcggggaaaauucgggaaaaagcauaugauagcuggaguacuguucacguuuguccuuuuauuaucaggucaaauaacguggcgugauauggcucacacgcuaauuaugauuggguccaacgccuccgauagaaugggaaugggggugacguaucucgcacuuauagcgacuuuuaaaauacaaccguuucuagcccuuggauucuuuuuacgaaaacucacaucaagagagaaccuauuguuagggguagggcucgcaauggcuacgaccuuacaauuaccagaagauauagagcaaauggcaaauggcaucgcgcuugguuuaaugacauuaaaauugauuacucaauuugaaacauaucaguuguggacagcccuggucucauuaaccugcucuaauaccauuuuuacacuaaccguagccuggaggaccgcaacuuuaauccuggcagggguaucauuacucccacucugccagaguucauccaugagaaagacugauuggcugccuaugaccgucgcugcgaugggggucccaccauuaccccucuuuauauucucccugaaagacacucccaaaagaagaucauggccuuuaaaugagggugucauggcagugggucuagugucgauucuagccagcucacuuuugagaaaugaugugccuauggccggaccauuagucgcuggaggccuguuaauagcaugcuacgucauaacugggacgucugccgacuugacuguggaaaaagcugcugacgucacaugggaagaagaggcagagcaaacuggaguuucacacaacuuaaugauaacggucgacgaugauggaacuaugagaaucaaagacgacgaaacagaaaacauccuaaccguccuacucaaaacugcguuguugauagucucuggaauauuuccuuauucaaucccagcuacucuccuaguauggcauacauggcaaaaacaaacgcaacgaucugguguuuuaugggauguaccaucaccaccggagacucaaaaagcggaacuagaagaggguguauauagaaucaaacaacaaggaaucuuuggaaaaacacaaguaggaguuggaguacagaaagaagguguauuccauacaauguggcauguaacaaggggagcaguauuaacgcauaacgggaagagacuagaaccgaauugggcaucugucaagaaagaccuaauaucuuauggcggugguuggcgauuaaaugcacaauggcaaaaaggugaggaaguacaaguuauagcggucgaaccaggaaagaauccgaaaaacuuccagacaaugccuggaauuuuucaaacaacaacuggugaaauaggugcaauagcacucgauuuuaaaccaggaacgagugguucaccaauaauuaaccgggaagguaaaguuguaggguuauauggaaauggaguaguuacuaaaaacggaggguacguaucaggaauagcacaaacgaaugccgaaccagaugguccaaccccugagcucgaagaagaaauguucaagaagagaaaucucacaauuauggaccuucacccugguagcgguaagacccggaaauaucuaccagccauaguucgugaagccaucaaacggagacugagaacacuuauuuuagcaccgaccagaguggucgccgcagagauggaagaagcucuaaagggucuacccauacguuaccaaaccaccgcuacaaaaagcgaacauacgggucgcgaaauagucgaucuaaugugccacgcuacauucacuaugcggcuucuuucgccuguccgugucccuaauuacaauuuaguuauuauggacgaggcccauuuuacugacccugcgaguauagcugcacguggguauaucaguacuaggguaggcaugggggaagcugcagcaaucuucaugacugcaaccccaccgggaacggcagaggcguucccccaaucgaaugcaccuauucaagacgaggaacgagauauuccugaaaggagcuggaauagcggaaaugaguggauaacggacuuuguuggcaaaacaguuugguuuguaccaucgauaaaagcuggaaaugauauagccaacugucuuaggaaaaacggcaagaaaguuauccaacuaaguagaaagacauuugacacagaguaccagaaaacgcgacugaaugauugggauuuuguagucacaacagauauaagugaaaugggagccaacuuuaaggccgacagagugauugauccucgccgaugccuaaaaccaguuauacugacugacggaccggaaagaguaauacuugcagguccuaugccaguaacugcggcgagcgcugcacagaggaggggacgcguaggcaggaacccccaaaaagagaacgaucaguacauauucacgggccaaccacuaaauaaugaugaggaucacgcacauuggacagaggcaaaaauguuguuggauaauauaaauacaccugaagggauuauccccgcuuuguuugagcccgagagagaaaaaucggcagccauugauggcgaauauagacuaaaaggugaaagcagaaaaacauuuguagaauuaaugcgaagaggagacuuaccaguuuggcuagcucauaaagucgcgagugaaggaauuaaauacacagauaggaaaugguguuucgauggagagagaaauaaccaaauacuggaagaaaacauggauguagaaaucuggacgaaagaaggagagcggaagaaacuaaggccucggugguuggaugcucguaccuauuccgauccucuagcacuuaaagaguuuaaagauuucgcagcuggcagaaaauccauagcccuggacuuagucacggagauuggucgcguaccuucucaucuugcgcaucguacuagaaaugcacuagacaaucucguaaugcuucacacaagugaacauggaggacgagcauauaggcaugcaguggaagaacuaccugagacaauggaaacuuuacuucuguuaggucuaaugauauugcuuacagguggugcgaugcuauucuuaauaucaggaaaaggaauaggaaagacuucuauaggguuaauuuguguaauuguaagcucagguaugcuuuggauggcagacgucccuuugcaguggauugccucggccauuguauuggaauuuuucaugaugguauuacuaauaccugaaccggaaaaacaacgaacaccacaggauaaccaacuugcguaugucgugauugggauucugacauuagcugcaauuguggcugcaaaugaaaugggacuauuggaaacaacuaaaagggaccuggggaugagcaaggaaccaggcguaguaucuccuacgaguuacuuggacguagauuuacaucccgcaagcgccuggacauuauacgcuguggcaacaacaguaauaacgccaaugcuaagacauacuaucgaaaauucaacugcaaacguaucauuagcugcuauugcaaaucaagcagugguccucaugggauuagacaagggauggccuauauccaaaauggauuuaggagugccacugcuggcgcuagguuguuauagccagguaaauccacuaacucuaacagcggcagugcuccuauuggucacccauuaugccauuauaggucccggacuacaagccaaagccacacgugaagcacagaaaagaacagcugcagguauaaugaaaaauccaacugucgaugguauaaugacaaucgacuuagacccugugauauaugauagcaaguuugaaaaacaacuaggacaaguaaugcuccuaguacuaugcgcuguacaacuauuacuaaugaggaccucaugggcuuuaugugaagcacucacauuagccaccgggccaauaacaacacuaugggagggaagcccaggaaaauucuggaauacgacuauagcaguuucaauggcuaauaucuuccgagguagcuauuuagcuggagccggcuuagcguuuucaauuaugaaaagcguaggaacaggccgacgaggaacaggaucucagggugaaacacuaggugagaaguggaagaagaaacugaaucagcucucucggaaagaauuugauuuauauaagaaaucgggaauaacugaaguagacaggacagaggcuaaagaaggguugaaaaggggcgagacuacucaucaugcaguaucacggggauccgcuaaacuccaaugguucguugaacguaauaugguaauaccugagggaagagucauagauuuaggguguggaagaggaggauggucauauuacugugccggccucaagaaagucacagaggugaggggauacacaaaaggagguccugggcacgaagaaccaguaccaaugucgacuuacggguggaacaucguaaaauuaaugucaggaaaagauguauuuuaucuaccaccagaaaaaugugacacacucuuaugugacauaggagaaucaucaccuaguccgacaguagaagagucaagaacaauaagagucuuaaaaaugguagaaccaugguuaaggaacaaccaauucugcauaaaaguguuaaaucccuacaugccaacagugaucgaacaucuugagcggcuccagagaaaauaugguggaauguugguaagaaauccacuuucuagaaauucuacacacgagauguauuggauuaguaauggaaccggaaauauugucucaagcguaaauaugguuagcagacuucuuuuaaauagauucacaaugacucacagacgaccaacaauagagaaggacguagauuuaggagcuggaaccaggcacguuaacgcugaaccagaaaccccaaacauggauguuauuggugaaagaauuaaaagaauaaaggaagaacauaguaguacauggcacuacgaugaugaaaacccauacaaaacaugggcauaccaugguucuuaugaagugaaagccacggguagcgcaaguucuaugauaaacggaguaguuaaacuccucaccaaaccuugggacgugguaccaauggucacucaaauggcgaugacagacacaacuccguuuggucagcaacgaguauuuaaagaaaagguugauaccagaacuccccguccuaugccagguacacgcaaggucauggaaauuacggcugaguggcuuuggcgcaccuuaggaagaaauaagaagccccguuugugcaccagagaagaauuuacuaagaaaguucguacuaacgcagcaaugggagcgguauucacagaagaaaaccagugggacucugcaagggccgcgguugaggaugaagaauuuuggaaauuaguggauagagaacgagaacuacacaagcuagguaaauguggaaguuguguauacaacaugauggggaagcgagagaagaaacucggggaauuugggaaagcgaaaggaagccgugcgaucugguauaugugguuaggagcuagguaucuugaauuugaggcacugggauuucuuaaugaagaucauugguucucaagagaaaauagcuauagcggcgucgagggagaaggguugcacaaacuaggauacauuuugagagacauuucaaaaauuccagguggggcaauguaugcagaugacacggcagggugggauaccagaauaacugaagaugaccugcauaacgaagagaaaaucacacaacaaauggaccccgaacacagacaacuugcuaaugcaauauuuaaauuaacguaccaaaacaagguaguuaaaguacagcgccccacgccaaaggggacaguaauggacauaauaucaaggaaagaucagcgaggaaguggacagguggguaccuacggauuaaauacauucacuaacauggaggcacagcuaguccgccagauggagggugaaggaguccuuagcaaagccgaucuggaaaauccacaccuacuggaaaagaagauaacccaauggcuugaaacaaaagggguagaacgcuuaaaacggauggcaauaaguggagacgauuguguaguaaaaccuauugaugacagauuugcgaacgcacuauuagcauuaaacgauauggguaaaguucgcaaagauaucccccaauggcaaccaagcaaaggcuggcacgauuggcaacaaguaccauuuuguucucaucauuuccaugaacugaucaugaaagauggacguaagcuagucguaccuugucgaccccaagacgaacucaucgguagggcccgcauaucgcaaggggcuggauggagucucaaggaaacagcgugucucggcaaagcguaugcccaaauguggucacugauguacuuucaucgacgagauuugagacuugcuagcaaugcuauaugcagugcuguaccaguccauuggaucccgacgagucgaacuaccuggaguauacaugcacaucaccaguggaugacaacagaagacaugcuaacagucuggaaccggguguggauugaggacaacccuuggauggaagacaaaacaccaguaacaacgugggaagauguuccauaucucggcaaacgagaggaccaauggugcgguucacugauuggucuuacuucccgugcgacaugggcacagaauauacuaacagcuauccaacaaguucgcagccuaaucggagacgaagaauuucuugauuauaugccaucaaugaagagauuuagaaaagaagaggaaucggagggagcgaucugguaa

SEQ ID NO: 23104 - RNA, 9873 nt, Artificial Sequence
  derived and/or modified CDS sequence (opt6) from DENV-3__GU131912__SS-prME
acgaguuugugccugaugaugaugcuuccggcaacacuagcguuucauuuaacuucaagagacggggaaccuaggaugauuguagguaaaaaugaacgaggaaaaucucuucucuucaaaacggcaucaggaauaaauaugugcacacuaauagccauggaucuaggagagaugugugacgacacagugacauacaaaugcccauuaauugcggaggucgaaccagaagauauagauuguugguguaauuugacaaguacuugggucacuuauggaacauguaaucaggcaggagagcacagaagagauaaaagaagugucgcauuagccccgcacguaggaaugggauuagacaccaggacacaaacuuggaugagcgcugagggagcauggagacaggucgaaaaaguagaaacaugggcauuaaggcauccgggauucaccaucuuagcacuauuucuggcacauuacaucggaacaagucugacccagaaaguaguaauuuucauucucuugauguugguuacaccaucaaugacaaugagguguguugguguagggaacagagacuucguugaaggacuuuccggugcaacguggguagauguuguguuagagcauggugggugugucacaaccauggcaaaaagcaaaccaacguuagauauagagcuacagaaaacugaagcaacacaacuggcuacucuucgaaaacuuugcaucgaaggaaaaauaacuaacauuacaacagauucucgauguccuacucaaggggaagccacuuuaccagaagaacaagaccaaaacuauguuuguaaacauacuuacgucgaccgaggcuggggcaacgggugcggccuuuucgggaaagguaguuugguuacgugcgcaaaauuccagugccuggaaccaauagaaggcaaaguaguccaguaugagaaccugaaauauacuguuauaauuacuguacauaccggggaucaacaucaaguagguaaugacacgcagggcgucacgguugagauuacuccucaagccucaacaguugaagcgguccuccccgaauauggaacuuugggucuagaaugcucuccucgaaccgggcuagacuuuaaugaaaugauacuucucacuaugaaaaauaaagcguggaugguucaccgucagugguucuuugauuugccauuaccuuggacgucaggagccacgacagaaacuccaacguggaauagaaaagagcucuuaguuacauuuaaaaacgcacaugcaaagaaacaagaaguaguaguucuagggagccaggagggagcgaugcacacggcacuuacaggugcaacggagauucaaaacucagggggcacuaauauauuugcuggucaucuaaaauguagacuuaaaauggauaaguuagagcuaaaaggaaugucauaugcgaugugucuuaauacguuuguacuaaagaaagaaguuagugaaacucaacaugggacuauuuuaauuaaaguugaauauaaaggagaagacgcaccauguaagauaccauuuucaacagaagauggacagggaaaagcacacaaugguagauuaauaacagcaaacccuguuguaaccaagaaagaagaaccaauuaauauagaagccgaaccuccauuuggagaaagcaauaucguuauagguaucggagauaaggcuuuaaaaauuaauugguacaagaagggcucaaguauaggaaaaauguucgaagcaaccgcccgaggagcacguaggauggccauauuaggggacaccgcuugggauuuuggaucaguaggaggaguacuaaauucucuugguaaaaugguacaucagauuuuuggcagugcauauacagcacuauucucaggagugagcuggaucaugaaaauaggaauaggugugcucuuaacauggaucgggcugaauagcaaaaacacaucaauguccuucucauguauuguuauuggaaucauaacauuauaccuaggagcaguaguucaggcugauauggguugcguaauaaauuggaagggaaaagaauugaaaugugggaacggaaucuucguuacuaaugaaguacauacauggacagaacaguacaaauuucaagcugauuccccaaaacgauuagccacagcaaucgcagggagcugggaaaacggggucugcggcauuaggucaacaacaaggauggagaauuuacucuggaaacaaauagcuaacgaacuuaacuauauacuaugggaaaacaauauaaagcuaacgguuguagugggggacaucaucggaguacuagaacagggaaaaagaacguuaacaccucaaccaauggaacucaaauauagcuggaaaacgugggguaaagccaaaauaguaacugcagaaacacaaaauagcagcuucaucauagacggcccaaacacacccgaaugucccucagcuucuagagcauggaauguuugggagguugaagacuauggguuuggaguguucacaacuaauauaugguuaaaacuucgugagguauauacacagucaugcgaccacagguuaaugagugccgcgauaaaagacgaaagggcuguacaugcagacaugggauacuggauugaaagucagaaaaacggaagcuggaaauuagagaaggcauccuuuaucgaaguaaaaacgugcacguggcccaaaucucacacgcucuggucgaacggcguacuagaaagugacaugaucauaccuaagucauuggcggguccuauaagucaacauaaucacagaccuggauaucauacucagacagcaggaccauggcaucuugguaaacuggagcuggacuuuaauuauugcgaaggcacgacuguaguaauugcagagaauugcggaacccgagggcccagccuacgcaccacuacugugucagguaagcucauacaugagugguguugcagaaguuguacuuugccuccccuucguuauaugggagaagauggaugcugguacgguauggagauucgaccgauaaacgagaaggaggaaaauaugguaaagagucuaguaucagcaggaucuggcaaggucgauaauuuuacaauggggguccuaugcuuagcaauauuguucgaagaggugaugcgcggaaaauuugggaagaaacacaugauugcgggaguuuuguucacauuuguguuauuacuuucagggcagauaacauggagggacauggcgcauacuuugaucaugauagguucaaaugcaagugauagaaugggaauggguguuacuuauuuggcuuugauagcaacauuuaagauucaaccguuccuagcacuuggguuuuucuugagaaaauugacuucgcgagagaaucuuuuguugggaguuggguuagcaauggcaacgacauuacagcuaccugaagacauagaacagauggcuaacgguauagcacuaggauuaaugacccugaaacugauaacgcaauucgagacauaccaguuguggacagcauuaguaagucuuacgugcucaaauacuauauuuacauuaaccguagcuuggaggacagccacacugauacuagcagggguaucguuacuuccauuaugucagaguuccucuaugaggaaaacugauugguuaccaaugaccgucgcagcgaugggggugccuccgcuuccguuauuuaucuucagcuuaaaggacacuccgaaaaggaaaucuuggccacuaaacgaagguguaauggcaguaggguuaguuucaauacuagcuucaucguuacuacggaaugauguuccaauggcuggaccacuuguggcaggaggauuacuuauugcuuguuauguuauaacuggcacaagcgcagaccuaacaguagaaaaagcagcagacguuaccugggaggaagaagcugaacaaacaggaguuucucauaauuuaaugaucaccguugaugaugaugguacuaugagaauaaaagaugaugaaacggaaaauauucucaccguucuucuuaagacugcuuugcuuauaguuucaggaauauuuccauacucaauuccugcuacguuauuaguuuggcacacguggcaaaagcaaacgcagagaaguggaguacuaugggauguacccucaccuccugagacccaaaaagcugaacuagaagagggaguauauaggaucaagcaacaaggcauuuuuggaaaaacacaagucgguguaggcgugcaaaaggaagguguguuccacaccauguggcacgugacacguggugcaguuuuaacacauaacggcaagagauuagagcccaauugggcuucaguuaagaaagaccuaauuucauacgggggaggguggcgacuaucugcacaguggcaaaaaggagaagaaguucaaguaauagcgguagagccaggcaaaaauccgaaaaauuuccaaacaaugccaggcaucuuccaaacaacaacuggugagauaggugcaauugcacuggauuuuaaaccaggcacaucgggguccccaauuauuaaucgggaaggaaaaguagucgggcuuuauggaaacggagucguaaccaaaaauggaggauaugucucugguauagcacaaacaaaugcugaacccgacgggccaacuccugaauuagaagaggaaauguuuaagaaacggaaucucaccauaauggauuugcauccuggaaguggcaaaacccgaaaguaccuaccugcgauagucagagaagccauaaagcgaagauuaaggacucugauccuagcaccuaccagaguaguagccgcagaaauggaagaagcacuaaaaggauuaccaauaagauaucaaacuaccgcaagcaaaagugaacauacagggagagaaauuguagaucuaaugugccaugcuaccuucaccaugcgguuauuaucaccuguacguguucccaacuauaaucuuauuauaauggacgaagcucauuucacagacccagcgucaauagcagcaagaggauauauuucgacaagaguaggaaugggcgaagcugcagcuauauuuaugacagcgacaccacccggcacagcagaggcuuucccccaaagcaaugcgcccauucaagaugaagagagagauauaccugaaagaaguuggaacuccggaaaugaauggaucacagauuuuguugguaagacuguaugguuuguacccagcauaaaagccgggaacgacauagcuaacugccuuagaaagaauggaaagaaaguaauucaauugucaaggaaaacuuuugauacagaauaucagaagacaagacuaaaugauugggauuuuguaguuacaacggacauaagcgaaaugggggcaaacuucaaagcggacagaguuauagacccucguagaugucugaaaccugucauauuaacagacgggccggaacgcguaauauuggcuggcccaaugcccgucacugcagcuucagcagcccagcggaggggacgaguugguagaaacccccaaaaagaaaacgaucaauacaucuucacaggacagccucugaacaacgacgaagaucaugcucacuggacggaggcaaaaauguuauuggauaacauaaauacuccagaaggaauaauaccggcauuguuugaaccagaacgggaaaaaucggcagccaucgacggcgaauaccggcucaagggagaaucacgaaaaaccuuuguugaguugaugagacgaggggaccucccugugugguuagcgcacaaagucgcaagugagggaauaaaauacaccgaccguaagugguguuucgacggcgaacgaaauaaccagauacuagaagagaauauggacguugaaauauggacaaaagaaggcgaacguaagaaauuaaggcccagauggcucgacgcaagaacauacucggacccauuagcacuaaaagaauuuaaggauuucgcagcagguagaaaaucuauagcauuagaucucguaacugaaauagggagagugcccagccauuuggcccaccguacccguaaugcuuuggacaaucucgugaugcugcacacgucugagcacggagguagagcauaucgacacgcuguugaagaacuaccagaaacuauggaaacucuucuauuacuuggauuaaugauuuuauuaacaggaggagcuauguuguuuuuaauaagcggaaaaggaauugguaaaacaaguauagggcucauuugcgugaucguaagcaguggcaugcuauggauggcggauguaccccugcaguggauagcauccgcaaucguuuuggaguucuucaugaugguacuuuuaauacccgaaccagagaaacaaaggacgccacaagacaaccaacuagcauauguuguaaucggcauucucacauuagccgcuauaguagcugcuaacgagaugggccuacucgaaacuacuaaacgggacuuggguauguccaaagaaccaggaguaguuucgccaacaagcuaucucgacguggauuuacacccagcauccgcguggacauuguaugccguagcaacuaccguaauaacaccaaugcuaagacauacuauagaaaauagcacagcaaauguuaguuuagccgcuaucgcaaaccaagcaguaguacugaugggucuagacaaggguuggcccauuucuaaaauggaucuuggcguccccuuauuagcacuaggauguuauagccagguaaaucccuuaaccuuaaccgcugcgguauuguuauuagugacacauuacgcuaucaucggcccgggucuccaagcaaaagcaacacgagaagcucaaaagcgaacagcagccgguauaaugaaaaauccuacagucgaugguauaaugacgauagaccucgauccagucauuuacgacucuaaauuugaaaaacaacucggacaggugauguuauuaguucugugugcaguacaauuauuauuaaugaggacaagcugggcccuaugcgaggcauugacgcuugcgaccgggccaauuacaacacucugggagggaucuccggguaaguucuggaacacaaccauagcaguuucaauggcaaauaucuuucgcggaucguauuuagcaggcgcaggacucgcuuucaguaucaugaaaagugucgguaccgggaggagggguaccggaucgcagggagaaacacuaggcgaaaaauggaagaagaaauuaaaccaguugucaagaaaagaauuugacuuauauaagaaaagcgggaucaccgaaguugaucguacagaggcgaaagaaggacuuaagaggggugaaaccacacaccaugcagucagucgaggcagcgccaaacuucaaugguucguggaaagaaacaugguaauucccgagggccgaguaauugacuuagggugugguagagggggauggucguauuauugugcaggauuaaagaaagugacugaagugcgugguuauacgaaaggcggcccaggucaugaggaacccguaccaaugucaacguacggguggaauauaguuaaauuaaugucuggaaaagauguauuuuauuuaccaccagaaaagugcgauacacuguuaugcgacauaggugaaaguucgccgucaccuacgguggaggagucgagaacuauccgcgucuuacguaugguugaacccuggcuacguaacaaccaauuuugcauaaaaguauuaaacccauacaugccuaaugucauagaacauuuggaacggcuucaaagaaaauauggaggaauguuaguaaggaauccucuaucuaggaauagcacgcaugagauguacuggauuucuaacggaacugguaacauagugagcucagugaauaugguaucaagauuauuauugaaucgauucacgaugacccacaggagacccacaauagagaaagaugucgauuuaggggcaggaacucgucaugucaaugcggagccggaaacgccuaauauggacgucauaggggaaagaauaaaacguauaaaagaagaacacagcucuacguggcacuacgaugaugagaauccguacaaaacaugggcuuaucaugguuccuacgagguuaaagccacggguucagcuucaaguaugauuaauggagucguaaaacuuuuaaccaagccgugggaugucguaccaaugguuacccagauggcaaugacggacacgacaccguucggacaacaaagaguauucaaagagaaaguagauacuagaaccccgcgaccuaugccuggaacuagaaagguaauggaaauaacagcagaauggcuuuggcgaacucuuggcagaaacaagaaacccagacuaugcaccagggaagaauuuacaaagaaaguaagaacuaaugcagcaaugggcgccguauuuacagaagagaaccaaugggauucugcgcgagcugcaguagaagacgaggaauuuuggaaauuaguagauaaagaacgggaacuacacaaauuaggaaaaugcggauccugugucuacaauaugaugggaaaaagggagaagaaauuaggagaauuuggaaaagcuaaaggaucacgagcaauuugguacaugugguuaggcgcucgauaucuggaguuugaggcucuuggauuucuaaacgaagaccacugguuuucccgggagaauaguuauaguggaguagaaggagaggggcuccauaaacuuggauauauucuuagggauauaucuaaaaucccgggcggugcaauguacgcagaugacacagcggguugggauacaagaaucacagaagaugauuuacauaacgaagagaaaauaacacaacaaauggauccagaacaucgacaauuggccaaugcuauuuucaaacuaacauaccaaaauaaaguuguuaaaguacaacgcccgacuccaaaaggcacaguaauggacaucauaagucguaaagaucaaagaggcaguggacaaguggguacauauggauugaacacauucacuaauauggaagcucaacucgucagacagauggaaggggaaggaguguuaagcgaggcugaccuggaaaauccucacuuguuagaaaagaaaauaacccaaugguuggagacuaaagguguagaaagacuaaaaagaauggcgauaucaggugacgauugugucgucaaaccuauagaugauagguucgcaaaugcgcuucuagcguuaaaugauauggggaaaguuagaaaggauauaccacaguggcaaccaucaaaaggauggcaugauuggcaacaagugccuuucugcucucaucauuuccaugaauuaauaaugaaagauggucguaaguuagucguuccuugucgaccucaagaugaguuaauugggagagccaggaucucgcaaggagcagguuggagucugaaggaaaccgcaugucuaggcaaggcuuaugcacaaauguggagucuaauguauuuccauaggagagauuuacgacuagcaagcaacgcuauuuguucggcuguaccaguucacuggauacccacuucgcgaacaacauggaguauucaugcacaucaccaauggaugacgacugaagacauguuaaccguuuggaauagaguauggaucgaagauaauccauggauggaagauaaaacuccagucacuaccugggaagacguuccuuaccuuggaaaaagagaagaucaauggugcggaaguuuaauuggguuaacaagucgagcaacuugggcccaaaauauuuugacagcuauccaacaaguacgaucguugaucggagaugaagaauuuuuagacuauaugcccuccaugaaaagauuccgaaaagaagaagaaucagagggagcuauuugguaa

SEQ ID NO: 23105 - RNA, 9873 nt, Artificial Sequence
  derived and/or modified CDS sequence (opt6) from DENV-3__GU131913__SS-prME
accaguuuaugcuuaaugaugauguuaccagcgacauuagcauuccaccuuaccucaagagacggagaaccucgaaugauaguuggcaaaaaugaaagagggaaaucacuguuauucaaaaccgcaagcggaauaaauauguguacauuaauagcaauggaccugggagaaaugugugacgauaccguuacauauaaauguccucuaauugcagaaguggaaccggaagauauugacugcuggugcaaccuuacauccacuugggugaccuacgggacuugcaaucaggcgggagaacaucgucgagauaaacgaaguguagcacuagcaccacauguagguaugggauuagauacgagaacccaaacguggaugagcgcggagggggcguggagacaaguagaaaaaguagagacuugggcuuuaagacacccaggauuuacaauacuagcacuauuuuuagcacacuauauagguaccucacuaacucaaaaaguaguaauauuuauacugcuaaugcuugucacuccaaguaugacaaugcgguguguagggguaggaaauagagacuuuguagagggccuaagcggcgcaacauggguagacguuguucuugaacauggaggauguguaacgacuauggcgaaaucuaaaccaacucuugacauugagcuacagaaaacagaagcuacucaguuggcuacucuccgcaaacuaugcauagaggguaaaauaacgaauauaacuacggauucaaggugcccuacacaaggugaagcaaccuuaccagaagaacaggaucagaauuaugucugcaaacauacauauguagauagaggauggggaaaugguugcggccucuuuggaaaagggucguuggucaccugugcuaaauuccaaugucucgagccaaucgaaggaaaaguuguacaauacgaaaauuuaaaauacacaguuauuauaacaguucauacaggagaccaacaucaagucggaaacgauacucaggguguaacugucgaaauaaccccucaggcaucaaccguggaagcuguacuccccgaauacgguacacugggacuggaauguucaccacguacggggcuugacuuuaaugaaaugauacuauuaacaaugaaaaauaaagcguggaugguacaucgucaaugguuuuucgacuugccauugccauggacaagcggugcaaccacugaaacaccuaccuggaauagaaaagaacuuuuaguuacauuuaaaaaugcucacgcuaagaaacaggaaguagugguuuuaggcucgcaagaaggagcgaugcauaccgcauuaacgggagcgacggaaauccaaaauucaggcgguacaucgauauuugccgggcaucuuaaaugcagacuaaaaauggauaaacucgaauuaaaagguaugucuuaugcaauguguuugaauacauuuguucuaaagaaagaagucucagaaacgcagcaugguacaauucuuaucaaagucgaauacaaaggagaagacgcccccuguaaaaucccauucucgacagaggaugggcaagguaaggcacauaauggaagauuaauuacggccaaucccgucguaacgaagaaagaagaaccuauuaacauagaagcggaaccaccuuuuggggaaucaaauauaguuauaggaaucggcgauaaagcauugaaaauaaacugguauaagaaaggaucaucuauuggaaaaauguuugaggcaacagcuagaggagcgcgaaggauggcuauacuaggagauacagccugggacuuuggaaguguuggcgggguacuuaauucuuuaggaaagauggugcaucaaauauuuggaucagcuuacacggcauuguucagcgggguguccuggauaaugaaaauuggaaucggcguauuauuaacauggauaggccuaaauucaaagaauacuagcaugagcuuuucaugcauaguaauaggaauuguaacgcuuuauuuaggagcaguaguccaagcugauaugggcugcguaaucaauuggaaagggaaagaauugaaaugugggaacgguauauuuguuacuaacgaaguacacaccuggacugaacaauacaaauuucaagcagacuccccuaaaagauuagcaacagcaauugccggugcaugggaaaacggagugugcggaauuaggucgaccacacguauggaaaaccuauuauggaaacaaauugcaaaugaacuaaauuauauuuuaugggaaaacaacauaaaacucacuguaguggugggugacauaaucggaguacuugagcaaggaaaacgaacccuaacuccucaaccuauggaacuaaaauacucguggaaaacgugggguaaggcaaaaauuguuacugcggaaacacaaaauucuagcuuuaucauagaugguccaaauaccccagaguguccaagugccucacgugcauggaacguuugggaagucgaagacuauggcuucggaguuuuuacuaccaauauauggcugaagcuacgugaaguacacacacaauccugcgaccaucgacugaugucagcggcaauuaaagaugaacgagccguucaugcugauaugggauauuggauugaaucgcaaaagaauggaucguggaaauuagaaaaagcaucauuuauugaaguaaaaacuuguacuuggccaaaaucacauacacuauggucgaacgguguucuugagagcgacaugauaauaccaaagagcuuagccggaccaauaagucagcacaaucauaggccgggauaucauacacaaacagcaggccccuggcacuuaggaaaacucgagcucgacuucaauuauugugaaggcaccacaguugucauagcugaaaauuguggaacuagaggcccaucauuacgaacuacgacagucagugguaaacuuauacacgaaugguguugccgcucauguacguuaccaccccuuagauauaugggugaagacggaugcugguacggaauggaaauuagaccaaucaacgaaaaagaggagaauaugguuaaauccuuaguaucagcuggaucaggaaaaguugacaauuucacgaugggaguguuaugucucgcaauauuauuugaagaaguaaugagagguaaauucgggaaaaagcauaugauagcgggaguacuuuuuacuuucguauuguuacuaucuggucaaauaaccuggagagacauggcgcacacguuaauuaugauugguuccaaugccucggaucgaauggggaugggaguaacauaccuagcucuuaucgcaacuuucaaaauacaaccauucuuagcauuaggauuuuuccuuagaaaauuaacuucaagagagaauuuauuacugggcguggguuuagcuauggcuacgacauuacaacugcccgaagacauagaacaaauggcgaacggcauagcacuuggauuaaugacauugaaacuuauaacacaauucgaaaccuaccaacuauggacagcucuugugagccuuacuuguaguaacacgaucuuuacccuaacgguggcauggagaaccgcgacauuaauucuagcggguguaucuuuauugccauuaugccaauccagcaguaugcgcaaaaccgacuggcucccaaugacaguagcagcaaugggagugccaccguuaccccuuuucauauuuucacuuaaggauacaccaaaaaggaaaucuuggcccuugaaugaaggaguuauggcuguaggcuugguaucaauucucgccagcaguuuacuucgaaaugaugugccaauggcaggaccuuuaguugcaggaggauugcucauagcuuguuauguaauaacagguacaagugcugaucuuacggucgagaaagcugcggacguaacgugggaagaagaagcagaacaaacuggagucagucauaauuuaaugauaacaguagacgacgacggcacuaugagaauaaaggaugaugaaacagagaauauuuuaacuguauuguugaaaaccgcauuauuaaucguaucuggcauauucccguacagcauuccagcgacucuacuuguauggcauacuuggcaaaaacagacgcaacgaucaggcguuuuaugggacgucccaucuccaccagaaacacaaaaagcggaguuagaagaagggguuuaucgcauuaaacaacaggguaucuucggcaaaacccagguaggcguuggaguucaaaaagaaggagucuuucauacaauguggcauguaacgagaggagccguacuaacgcacaacggaaaaagacuagaaccuaauugggcgagugucaagaaagauuugauaagcuacgguggcgguuggcgccuaucagcccaguggcagaaaggagaagaaguacaagucauugcugucgagccagguaagaacccuaaaaauuuccagaccaugccgggcauauuccaaacuacaacgggagaaauaggugccauagcuuuagauuuuaaaccuggaacaagcggaucaccaaucauaaauagggaagggaagguaguuggccuauacgguaacgggguaguaaccaaaaauggaggguacguuagugggauagcgcaaaccaacgcagagccagacgguccuaccccugagcuagaagaagaaauguucaagaaaagaaacuuaacaaucauggaucuacauccgggaaguggcaagacgagaaaauaccucccugccauaguuagggaggcaauaaaaaggagacugcgcacacuuauucuagccccaacaagaguaguugcagccgagauggaagaagccuuaaaagguuuaccgauuagauaucaaacaacagccacaaaaucggaacauacggguagagaaauuguugauuuaaugugccaugcuacauucacaaugcgguuguuaagcccaguacgaguuccgaacuauaaucuagugauaauggacgaagcucauuuuacugauccagccucaauugccgcaagaggguacauaucuacuagaguaggcaugggcgaagcugcugcgauauucaugacggcuacucccccuggcaccgcggaggcuuuuccccaaaguaaugcuccaauacaggaugaggaacgugacauacccgaacgaaguuggaacuccggcaacgaauggauaacagauuuuguaggaaagacaguuugguucguaccaucuauaaaagcaggaaacgacauugcaaacugccuucggaaaaaugggaagaaaguaauacaacuaagccgaaaaacauucgauaccgaguaucagaagacccguuuaaaugauugggauuucguaguuacuacggauaucagugagaugggagcuaauuucaaggcagaccgcgucaucgacccaagaagaugucuaaaaccaguaauauugacggacgggccggaacguguaauacuugcuggaccuaugccgguaacugcugcuucagcagcgcaaagaagaggaagaguaggaagaaauccacaaaaagaaaaugaucaauacauuuuuacuggccagccccuaaauaaugaugaagaccacgcacauuggacggaagcaaaaauguuacuagacaacauuaacacaccugaaggcauuauuccagccuuauucgagccagaacgagaaaagucagcugcuauagacggagaauaccgacucaaaggcgagucaagaaaaacauucguagaauugaugcgaagaggggauuuaccaguuuggcucgcccauaaaguagccagcgaagggauaaaauacacagaucgaaaaugguguuuugauggugagcgaaacaaccagauucuagaagagaauauggauguugaaaucuggacgaaagaaggagaaaggaagaaacucagaccacgauggcuggaugcacgcacguacuccgacccucuggcacuaaaggaguucaaagauuuugcggcugggcgcaaaucuaucgcgcuggacuuaguaacagagauuggcaggguaccaucacauuuagcccacagaacaaggaaugcauuagauaacuuaguuauguuacauacaagugagcauggagggagagcauaucgucaugcaguagaagaacuaccagaaacgauggaaacccuccuacuauuagggcuuaugauauuguuaacaggaggagcuauguuauuuuuaauaucuggcaagggaauaggcaagacgucuauuggauuaauaugugugauuguaucaaguggaaugcucuggauggcagauguccccuugcaguggauugccagcgcuauugucuuggaguucuuuaugaugguuuuacucauaccggaaccagaaaaacagcguacgccacaagacaaucagcucgcuuacgucguuaucggcauucugacgcuagcggccaucguugcggcuaaugaaaugggcuuacuagagaccacaaaacgggaccuggguaugucaaaagagcccggcguaguuucacccacuuccuauuuagauguagaucuucauccugcaucugcuuggacucuauaugcgguggcaaccacaguuauuacaccgaugcuacggcacaccauagagaauagcacugccaauguuucacuugcagcgaucgcaaaccaagcagucguccuuauggguuuggauaaaggauggccgaucucaaagauggaccucggugucccucuucuugcucucgguugcuauucgcaaguaaauccgcuuacccugaccgcggcuguauuacuucuagucacucauuaugcgauaauagggcccggcuuacaggcaaaggccacuagagaggcccaaaaacggacggcugcaggaaucaugaaaaauccuacagucgaugguauuaugacuauugauuuagauccuguuauauacgauagcaaauuugagaagcaacucggacagguuaugcucuuagugcugugcgcaguucaacuauuauuaaugagaaccucgugggcauuaugcgaagcgcuuacgcuggcgacuggaccuauuaccacacuuugggaaggcucacccggaaaguuuuggaauacuacuauugcaguaucuauggcaaauauuuucagagguaguuauuuagcaggggcuggguuggcauuuuccauaaugaaaucuguagguacuggaagaagaggcaccggaucccaaggugaaacauuaggcgagaaauggaaaaagaaacuaaaccaguuaaguagaaaagaguuugaccuuuacaagaaaagcggaauuacagaaguagaucgcacagaagcaaaagaaggacucaaacggggagagacuacucaucaugcuguaucaagaggaucggcgaaacuucaaugguuuguagaacgcaauaugguuaucccugaaggacgaguaauugaucuagguuguggaagaggcggcuggagcuauuacugugccggacuaaagaaaguaacagaagucagaggcuauacgaaaggaggacccggacacgaagaaccggucccuaugucgaccuauggcuggaauauagucaaacuaaugagugggaaagacguguuuuaucuaccacccgaaaaaugugacacucuacuuugugacauuggagaaagcucuccaucacccacaguggaagagucucgcacgauacgcguauuaaagaugguagagccaugguugcggaacaaccaauuuugcauaaagguguuaaauccguauaugccaaacguuaucgaacauuuagagagacuacagaggaaauauggaggaauguuagugaggaauccacuaucaaggaauaguacacacgaaauguauuggauaaguaaugggacugguaacauaguauccucuguuaacaugguuagcagacuacuucugaauagauuuacgaugacacauaggcgaccuaccauugaaaaagauguggauuuaggagccgguacaagacacgugaaugccgaaccagaaacacccaacauggacguaauaggagagaggaucaagagaauuaaggaagaacauucaucuacauggcacuacgacgaugagaauccguauaagacuugggccuaucacggaucauaugaagucaaggcuacagguucugcaucuaguaugauaaauggaguagucaaauuacuuacaaaacccugggaugucguaccuauggucacucaaauggcaaugacagauacgacgccauuuggucaacagagagucuucaaagagaaaguagacacaagaaccccuagacccaugccaggaacccguaaaguuauggaaauaaccgccgaaugguuauggcguacuuuaggccguaacaagaaacccagacugugcacgagagaagaguuuacuaagaaaguuaggaccaacgcagcaaugggugcgguuuuuaccgaagaaaaccagugggacucagcccgugcagcuguagaagacgaagaguucuggaaguuaguagauaaagaaagagaacuccauaaauuaggaaaaugcgguucgugugucuauaauaugaugggcaaaagagaaaagaaauugggggaguucggaaaagcgaaaggaaguagagcaauaugguacauguggcuuggugcaagguuccucgaguucgaagcacuaggcuuccuaaaugaagaccacugguucucaagagaaaauagcuacucaggaguugaaggugaaggcuugcauaaauuaggauauauauuaagagacaucagcaaaauaccaggaggugcaauguaugccgaugacacggcaggaugggauacucgaauaaccgaagacgauuuacacaacgaagaaaagauaacccagcagauggacccagaacauagacagcuagcaaaugcaauuuuuaaacuuacauaucaaaauaaagugguaaaagugcaaagaccaacaccaaaaggaacggucauggacauuauuaguaggaaagaccaaagaggguccggccagguaggaacauauggucuuaauacauuuacaaauauggaagcccaacugguaagacaaauggaaggugaaggugucuuaucugaagcagaucuagaaaacccccaucuccuggaaaagaagauuacacagugguuggagacaaaaggugucgagcgacuaaaaagaauggcaauuuccggagaugauuguguaguaaaaccuauagacgaucgauucgcaaaugcgcuacuugcguugaacgauaugggcaaaguaaggaaagauaucccucaauggcagcccuccaaaggauggcaugauuggcaacaaguuccauucuguagccaccauuuucaugaacucauaaugaaggauggacgaaaauuagucguaccaugcagaccacaagacgaguuaaucgggagagcacguauuagucaaggugccgguuggucguuaaaagagacagcuugucuggggaaggcuuacgcucaaauguggaguuuaauguauuuccauagacgagacuugcgacuagccagcaaugcaauaugcuccgcgguuccgguucauuggauaccgacgucaaggacaacauggagcauucaugcucaucaucaauggaugacuacagaagauaugcugacggucuggaaucgcguauggauagaagauaacccuuggaugggagacaaaacuccagugaccaccugggaagauguaccauacuugggcaaaagggaagaucaauggugugguucauuaaucggccuuacuucgagagcuacgugggcucaaaauauacuaacggcuauccaacaaguacgaucacuuaucggagaugaagaguuuuuagauuacaugccaagcaugaagagauuucgcaaagaagaggagagugaaggggcuauuugguaa

SEQ ID NO: 23106 - RNA, 9873 nt, Artificial Sequence
  derived and/or modified CDS sequence (opt6) from DENV-3__GU131914__SS-prME
acuucucuaugcuuaaugaugaugcuaccagcuacuuuggcguuucauuuaacaaguagagauggcgaaccaagaaugauaguaggcaaaaaugaaagagguaaauccuuacuuuuuaaaacugcgaguggcaucaauaugugcacucucaucgcuauggaccuaggagaaaugugcgacgacacaguuacguauaaauguccacugauagcagaaguagaaccugaagacauugacuguugguguaaccucacaagcaccugggugacuuaugggacgugcaaucaagcaggagaacacagaagagauaaaaggagcguagcacuugcaccccacguggggauggguuuagauaccagaacccaaacauggaugucugcggaaggcgccuggcggcagguagaaaaaguagaaacaugggcccuccgacaccccgguuuuacaauuuuagcucuguuucuagcgcauuacauaggcacaucgcuaacacagaaagucguaauuuuuauccuuuuaauguuaguaaccccaagcaugaccaugaggugcgucggaguaggaaaccgcgauuuuguagaagguuuaucaggggcaaccuggguugacguaguccuagaacacggugguugugugacuacuauggcuaaaaguaaacccacacuagauauagaauugcagaaaacugaagcaacacaauuagcuacacuaagaaaauuguguauugagggaaaaauaaccaacauuacuacagauucccgauguccuacgcaaggagaagcaacucuuccugaagaacaagaccaaaacuauguaugcaaacauacauaugucgaucgagguugggguaacgggugcggacuuuucggaaaagguucauuaguuacaugugcuaaauuucaguguuuagaaccgauugaaggcaagguaguacaguaugagaacuuaaaauacaccgucauuauaacgguacacacuggggaucaacaucagguaggcaacgauacucaagggguuacaguagaaaucacuccgcaagccucaacgguggaagcuguacuuccagaguaugggacacuagggcuagagugcucaccgcgaacgggacuggauuucaaugaaaugauacuauuaacaaugaaaaauaaagccuggaugguucacagacaaugguucuuugaucuaccacucccauggacaucgggcgcuacaacagagaccccuacuuggaaccgaaaagagcucuuaguuacauuuaaaaaugcccaugcuaagaaacaagaagucgucguuuuaggaucucaagaaggagcuaugcauacugcauugacuggagcgacagaaauacaaaauucagguggaacuucaauuuuugccggucauuugaaaugucgauuaaaaauggauaaacuagaguuaaaaggaaugucauaugcaaugugucuaaacacauucguguuaaagaaagaaguauccgaaacucaacaugguacuauauugauuaaaguugaauauaagggcgaagaugcaccuugcaagauaccguuuucgaccgaagauggacaggguaaggcucacaacggucgucuuauaacggcaaacccuguugugacgaagaaagaagaaccaauuaacauugaagcugagcccccauuuggcgaguccaacauaguuauuggcauaggugacaaagcguugaaaauuaauugguauaagaaagggagcaguauagguaagauguuugaagcuacugcuaggggcgcacgucgaauggcaauacugggagauacagcuugggauuuuggaucaguggguggcguacuaaacucauuagguaagaugguacaccaaauauucgguagugcauauaccgcccucuucaguggcguauccuggauaaugaaaauaggaaucggaguccuccuaacguggauaggauugaacucuaaaaacaccaguaugucguuuaguugcaucguaauuggcaucauaacccuguaccuaggcgcggucguccaggccgauaugggguguguaauaaacuggaagggaaaggaauuaaaauguggaaauggaauauuuguaacuaaugaagugcauacauggaccgaacaauacaaauuccaggcugauucaccuaaacgccuagccacugcgauagcuggggcaugggaaaauggugugugcggaauaagaucgacaacgcgaauggaaaacuuacuauggaaacaaauugcaaacgaacuaaacuauauuuuaugggaaaauaacauaaaauuaaccguaguuguaggcgauauaauaggcgugcucgaacaagggaaaagaacguuaacgccucaaccgauggaacucaaguacucauggaaaacuugggguaaagcuaaaauaguuaccgcugagacucaaaacucauccuucauuauagauggaccuaauacgcccgaauguccaucugcaaguagggcguggaaugugugggagguagaagacuacggguuugggguauucacaaccaauauauggcugaaacuaagagaagugcacacacaauccugcgaucauagacuaaugucagcagcaauaaaggacgagcgugcuguccaugcggacaugggauacuggauagaaucccagaaaaauggaucuuggaagcuggaaaaggccucauuuauugaagucaagaccugcacuuggcccaaaucacauacucuauggaguaauggaguucuugaaucagacaugauaauaccaaaaaguuuagcggguccgauaucacaacauaaccaucguccaggauaucauacacaaacagcuggcccauggcaucuagguaaauuggagcuggacuuuaauuacugugaagguacaacggucguuauugcagaaaauuguggcacgcgaggcccaucccucaggacgacaaccguaucgggaaaacuuauccaugaguggugcuguaggagcuguacucuaccgcccuuaagguauaugggagaagaugggugcugguacggcauggaaaucagaccgauuaacgaaaaagaagaaaauaugguaaaaucucucguaagcgcagggaguggaaaggucgauaauuucaccaugggaguacuaugcuuggcgauucuauuugaagaaguaaugcguggaaaguucggcaagaaacauaugauugccgguguuuuguucaccuucguucuuuuacuaagcggucagauaacauggagagauauggcacacacauugauaaugauugggagcaaugcaagugacagaauggggaugggcguuacauaucuagcauuaauagcaacguuuaaaauacagcccuuuuuagcccuaggauucuuuuugagaaaacuaacaagucgugagaauuuauuacucggaguggguuuggccauggcuacaacacuacaguuacccgaagauauagaacaaauggcuaaugggauagcgcugggucucaugacacuaaaauuaauaacccaguuugaaacauaccaacuuuggacggccuugguaucauuaacuuguagcaacacuauauuuacacuuaccgucgcauggagaacugccaccuugauccucgcuggaguaucucuauuaccauuaugccaaucuucaagcaugagaaaaacugacugguuacccaugacaguagccgcuauggggguacccccacucccauuauuuauauuuagcuuaaaagacacgccaaaaagaaaaucguggccucugaacgagggggucauggcugucggucuaguaucaaucuuagcaagcagcuuacucagaaaugacguaccaauggcgggaccucuaguagcuggcgguuuauuaauagccugcuauguuauaacggggaccucugcggauuuaacaguagaaaaagcagcggaugucacuugggaagaagaagcagaacagacagguguaagucauaauuugaugauuacaguggaugacgaugggaccaugagaauaaaagaugacgaaacagaaaacauauugaccguguuguuaaaaacagcguugcuuaucgugaguggcauauuuccauauaguauuccugcgacauuauuagucuggcauacauggcaaaaacagacccagaggucaggaguauuaugggaugucccaagcccuccagaaacacagaaggccgaacuggaggagggaguguauagaauaaaacaacaaggaauauucgggaaaacacaagugggaguagguguucaaaaagaaggagucuuucauacaauguggcacgucacucguggagcagucuuaacacauaacgggaagcgcuuggaaccaaauugggcaucagucaagaaagaucuaaucagcuauggaggaggauggcgauuaagugcgcaguggcaaaaaggagaggaaguacaaguaauagcaguagaaccagggaaaaauccgaaaaacuuccaaacuaugccaggaauauuccaaacaacaacaggcgagauaggugcaauagcacuggacuucaaaccugguaccucggggagcccaauaaucaauagggaggggaaaguggucggacucuaugguaauggggucgucacuaaaaaugguggguaugugucgggcauugcacaaacuaacgcggagccugaugguccuacacccgaacuagaagaagagauguucaaaaagagaaaucuuacuauaauggaccuucauccagguucaggcaaaacccgaaaauacuugccagccauagugagagaagcgauuaaaagaagacuuagaacucuuauacucgcccccaccagaguaguggcagcggagauggaagaagcgcuuaagggcuuaccaauaagauaucagacaacugcuacaaagagcgaacauaccggaagagaaauagucgaucuuaugugccaugcuacguucacaaugcgacuacucucuccgguaagaguaccuaauuacaaucuaguuauaauggacgaagcccacuucacagacccagcgucaauagcugcuagggguuacaucucuacacgcguaggcaugggagaagcagcugcaauuuucaugacagcaaccccuccugggacagcagaagcauucccccagagcaacgcucccauacaagaugaagagagagacauccccgagcgaucuuggaacuccggaaacgaguggauaacugauuucguagguaaaacgguaugguucguaccaucaauaaaagccgguaaugacauagcaaauugccuacguaaaaauggaaagaaaguaauccaacucucaaggaagacauuugacacagaauaucagaaaacuagacuaaacgauugggauuucguggugacuacagauauuucagaaaugggagccaauuuuaaagcagacaggguuauugauccccgcagaugcuuaaaaccagugauacuaacagauggaccagagcgcguaauuuuagccggacccaugccgguaacggccgcaagcgcagcacaacggagagggagggugggaagaaauccacaaaaggaaaacgaccaauauauauuuaccggucaaccccuaaauaaugacgaagaucacgcacauuggacagaagcuaaaaugcucuuagacaauauaaauacaccggaaggcauaauuccagcuuuauuugagccugaaagagagaaaagugcagcaauugauggugaguaucgauuaaaaggugaaucccgaaaaacauucguagaacucaugagaaggggcgaccucccugucugguuggcgcauaaaguagccucagaaggaauuaaauauacugacagaaagugguguuuugacggcgaaagaaacaaccaaauacuggaggaaaacauggacguugagauuuggacuaaagaaggcgagaggaagaaacuucgaccaagauggcuugaugcgcgaacauacagugauccucuugcauugaaggaguuuaaagacuuugcggcagguagaaaaucuauagcuuuagaccucgugaccgaaaucggacgaguaccaagucacuuagcacauagaacgaggaaugcuuuggacaauuuaguaauguugcauaccagcgaacauggugggagagcuuauagacaugccguagaagaacuaccugagacuauggaaacauuguuacuacuugggcucaugauacuauuaacgggaggagcgaugcuauuuuuaauaucuggaaaagguaucggaaagaccaguauuggauuaauaugcguuaucguuagcagcgguaugcucuggauggccgauguaccguuacaauggauugcgagugcuauugugcucgaguucuuuaugaugguuuuacuaauuccagaaccagaaaaacaaagaaccccacaagauaaucaacuagccuauguugugauaggaauccugacguuggcagccauuguugcagcuaacgagaugggauuauuagaaacaacaaagcgagacuuagggauguccaaagaaccuggaguagucuccccaacaagcuaccuugacgucgacuuacacccagcaucagcauggacacucuacgcugucgcaacuacgguaauaacgcccauguuaagacacacaauagaaaauucuacagcuaaugugucauuagcagcaauagcaaaucaagcuguagugcugaugggauuagauaaaggcuggccuauaaguaaaauggauuuaggagugccacugcucgcucucggcugcuacucucagguaaauccauuaacucucacugcugcuguauugcuauuaguaacacauuacgcgauuaucgguccuggacuucaagccaaggcgaccagggaagcacagaaaaggacagcugcugguauuaugaaaaauccuaccguagacggcaucaugacaauagacuuggauccgguuauauacgacagcaaauucgaaaaacaauuaggacaaguaaugcuacucguacucugugccguccaguuauugcuaaugagaaccucuugggcacuaugugaagcccuuacgcuggcuaccgguccaauuaccacgcucugggaaggaagcccaggcaaauucuggaauaccacaauugccguaucuauggccaauauuuuucgagguagcuauuuagcaggcgcaggauuagcguucagcauaaugaagucugucgguacaggaagaagaggaacaggaucucaaggugaaacuuugggagagaaauggaagaagaaauuaaaccaauuaucaagaaaagaauuugauuuauauaaaaagucaggaaucacggagguugauaggacggaagccaaagaaggucuaaaaagaggcgaaacaacccaucaugcgguaucaaggggaucagcaaaguuacaaugguuuguugagagaaacauggucauuccagaaggaagagugauugaucuaggauguggaaggggaggauggucauauuauugugcuggacuaaagaaaguuacggaagugagggguuacacaaaaggugguccaggccacgaggaaccaguuccaaugucaaccuauggauggaacauaguuaaacucaugagugguaaagauguauuuuauuugccuccugaaaagugcgacacacuucuuugcgacauaggcgaaucaagcccaagcccuacaguggaagaaucaagaaccauacguguguuaaaaaugguagagccuugguuacgaaacaaucaauuuuguauuaaaguauugaauccauacaugcccaauguaauagaacacuuggagagacuacaacguaaauauggugggauguugguucgaaacccccuaucccgcaauagcacacacgaaauguauuggauuaguaauggaacugggaacaucguuaguagcgugaauaugguaucuagauuacuauuaaaucguuuuaccaugacucauaggagaccgacaaucgaaaaggacguagaccuaggagccggaacgcggcauguuaacgcagagccugagacuccaaacauggacgugaucggggaaaggauaaaacgcauuaaagaggagcacaguuccacauggcauuaugacgacgagaauccauacaaaacuugggcguaucacgggagcuacgaaguaaaagcaacggguagcgcuucaaguaugauaaauggugucguuaaauugcucacgaaaccaugggacguuguuccgaugguaacacaaauggcaaugacagauacuacuccauucggucaacaaagaguuuuuaaagaaaaaguagauacaagaacaccaaggccaaugccgggcacacgaaaaguuauggaaauuaccgcggaaugguuauggagaacucuaggacgcaauaagaagccccggcugugcacaagggaagaauuuaccaaaaagguuagaacuaaugcagcuaugggagcgguauucacagaagaaaaucaaugggauuccgccagagcagcuguugaagacgaagaauuuuggaagcuaguugacaaagaaagagagcugcacaaguuaggaaaaugcggcuccuguguauacaauaugauggguaaaagagagaagaaauuaggagaauuuggaaaagcgaaagguucccgagcgaucugguauauguggcugggagcacgcuucuuagaguucgaagcgcucggguucuugaaugaagaucacugguucucgagagaaaauagcuauaguggcguugaaggggaagggcuucacaaacucggauacauacuaagagacauuaguaaaauacccgguggagccauguacgccgacgacacagcgggcugggauacccggauaacagaagaugaucugcacaaugaagagaaaaucacacaacaaauggauccagaacaucgacaacucgccaaugcaauauuuaagcuaacguaccaaaauaaaguagucaaaguucagcgacccaccccuaaaggaacaguaauggauaucauuagucguaaggaccaaagaggaucaggacagguaggaacauaugguuuaaauacuuuuacuaauauggaagcacagcuagucagacagauggagggagaaggaguucuaucagaagcggacuuagagaacccccauuuauuagagaagaaaauuacacagugguuagaaacuaaaggaguggaacgacuaaaaaggauggcaauuaguggugaugauugcguagucaaacccauagacgaccgcuuugccaaugcauuacuagcucuaaaugacaugggaaaagugcgaaaagauauaccucaguggcaacccaguaaaggauggcacgauuggcaacaaguaccauucugcucucaucauuuccacgaauugauaaugaaagaugggaggaaguuagucguuccaugucggccacaggaugaauuaauaggaagggcgagaauuucccaaggagcuggauggucacucaaggagaccgccugcuugggaaaagcauaugcccaaauguggagcuuaauguauuuucauaggcgagauuuacgucucgccucuaaugccauuuguucagccguuccaguucacuggauacccacuucucguacaacuugguccauacaugcccaucaucaauggaugacgacugaagacauguugacuguuuggaacagagucuggauagaagauaacccauggaugggagauaagacuccaguuacgacaugggaagacguaccauauuuagggaagagagaggaucaauggugcgguucgcugauuggucuaacaagucgagccacaugggcacaaaauauacuaacugcgauacagcaagugaggucccuuauaggugaugaagaauuucucgacuacaugcccaguaugaagcgguuccgaaaagaagaagagagcgaaggcgcuauuugguaa

SEQ ID NO: 23107 - RNA, 9873 nt, Artificial Sequence
  derived and/or modified CDS sequence (opt6) from DENV-3__GU131915__SS-prME
acaucauuaugucuaaugaugaugcugccagcaaccuuggcuuuccauuuaacuucacgagacggugaaccaagaaugauaguugguaaaaaugaacgugguaaaaguuuauuauucaaaaccgcuucagguauaaauaugugcacucuaauugcuauggauuugggagaaaugugugaugauacaguaacauauaaauguccacuaauugcugaagcugaaccagaagacauagauuguugguguaaucuuacaucaacguggguaacuuauggaacauguaaucaagcaggcgaacauagaagggacaaaaggucgguugcguuagcaccacauguaggcauggggcuggacacaagaacccaaaccuggaugagcgcggaaggugcguggcgacaagucgaaaaaguugaaacaugggcacuucgacacccaggcuuuacgauuuuagcgcuguuccuggcucacuacaucggaacaucacuuacucaaaaaguugugauauucauuuuauugauguuagugacgccgucuaugaccaugcguuguguagguguugguaacagagacuucguagagggccucagcggagcgaccuggguagauguagucuuagaacaugggggaugugucacuacaauggcgaaaucaaaaccaacccuagauauugaacuucagaaaaccgaagcaacgcaauuagcuacacuucgaaaauugugcaucgaagguaaaauaacaaauauaaccacggacuccaggugcccuacccaaggagaagcuacacuaccugaagaacaagaccagaacuauguauguaaacacacuuacguagaccguggauggggcaauggaugcggguuauuugggaaagggagcuuaguaacaugugcaaaauuccaauguuuagagccaauagaaggaaaaguaguacaacaugagaauuuaaaauauacagugaucauaacgguucacacgggggaucaacaucagguuggaaacgauacacaggguguaacaguggaaauaacuccccaggcuuccacaguagaagcaguacuacccgaauauggaacacugggccuagagugcaguccaagaacugguuuagauuuuaaugagaugauucuccuaacaaugaaaaacaaggcuuggaugguacauagacaaugguucuuugaucuaccccuucccuggacaucuggggcuaccacagagaccccaacauggaauagaaaagaacugcuggugaccuuuaaaaacgcacaugccaagaaacaggaagucgucguauuggggucacaagagggugcaaugcacacggccuugacaggugccaccgaaauucaaaacaguggugguaccucuaucuuugcaggccaccugaaaugcagauuaaaaauggacaaacucgaacugaaaggaaugucuuacgcaauguguuugaauacuuuuguccucaagaaagagguuucugaaacacaacacggaacaauuuuaauaaaaguagaguauaaaggagaagacgcgccguguaaaauaccauucucgacugaagacggacaaggaaaagcccauaguggaaggcuaauuacagcgaauccugugguuacuaagaaagaagaaccgguaaauauagaagcagaaccgccuuuuggggaaucaaauauagugauuggaauaggugauaaagcauuaaaaauuaauugguacaagaaaggaaguucgauaggaaaaauguucgaagccacugcaaggggagcacggcguauggcaauauuaggggacaccgcaugggacuucggaucugugggaggaguauugaacucacuuggaaaaaugguucaucagauauucgggucugcuuauacugcacuguuuucugguguuagcuggauuaugaaaauagguauugggguucuucuuacuuggauaggccucaacagcaaaaauaccaguaugucuuuuucaugcauagucauugguauuauuacucuauauuugggagcugucguacaggccgauaugggauguguaaucaauuggaaaggaaaagaacuuaaguguggcucaggaauauuuguuacaaaugaaguccacacuuggacggaacaauauaaauuucaggcagauaguccaaaaagacuagcaacugcuauagccggugcaugggaaaauggaguuuguggcaucagaucaacaacccgcauggaaaauuuacuguggaaacaaaucgcuaacgaauuaaauuacauacuuugggagaauaacauaaaacuuaccguaguugugggagauaucaucggaguucuagaacagggaaaaagaacacuuacuccgcagcccauggaacuaaaauacucauggaagaccugggguaaggcuaaaauuguaacggcagagacacagaacagcagcuuuauuauagauggaccaaacacacccgaaugcccgagugcguccagagcauggaacguuugggaaguugaagacuaugguuuuggcguguucacaacaaauauauggcugaaacuuagggaagucuauacgcaaucgugcgaccacaggcugaugucugcagccauaaaagaugaacgagcaguucacgcagauauggguuauuggauagagucgcagaaaaaugggucuuggaaacuugaaaaggcuucuuuuaucgaaguuaaaacgugcacauggccaaaaagccauacacuauggagcaauggaguauuagaaucugauaugauuaucccgaaaaguuuagcugggccaauaucacaacacaaucaucgaccaggguaucauacacaaacggcagguccauggcauuuaggaaaacuugagcuagauuucaauuauugcgaagggacaacaguagugauaacugaaaauuguggcacaagaggcccuucauuacgaacgacaaccguaucuggaaagcucauacaugaauggugcugucgaucguguacguuaccaccuuuaagauacaugggggaggacggcugcugguacggcauggaaauucgcccuauaaaugaaaaagaagagaauaugguaaagucacucguauccgcggguagcggaaaaguggacaauuucacaaugggagugcugugccuagcuauauuguuugaagaagucaugagaggaaaauucgggaagaaacauaugauugcgggaguccuauuuacauuugugcuguuacucucgggacaaauaaccuggagagacauggcacauacucugauuaugaucggcucuaacgcgagugauagaaugggaaugggaguaacguauuuggcucuuaucgccacauuuaaaauccaaccauuucucgcacuaggauucuuucugagaaaauugacaaguagggaaaaucuacuauuaggugugggauuagcuauggccacuacuuuacaacuacccgaagauauagaacaaauggcaaacggaauagcuuuagggcuaaugacauuaaaacuuauuacacaauucgaaacauaccagcuauggacagcgcucguuagucuaacauguucuaauacuauauucacucuaacaguagcauggagaacugcuacccuuauccuagccggaguaagccuacuacccuugugccaaucaucaucaaugagaaagacagauugguugccuaugacgguugcagcaaugggcgucccaccauugccucuauuuauuuucucucuuaaagauacgccaaaaagaagguccuggccuuugaaugaaggaguaauggcaguaggucugguaucgauacuagcaaguucacuuuuacggaaugaugugccgauggcuggcccauugguugcgggagguuuauugauagcuuguuaugucaucacuggaacaucugcggacuugacagucgaaaaagcugcggacguaacaugggaagaggaggcagaacaaacgggaguuagccacaaucuuaugauuacuguagacgaugauggcacaaugaggauaaaagacgaugagacugaaaauauauuaaccguauuauuaaaaacugcacuucuuaucgugucugggauauuuccauacagcauaccagcuacacuuuuaguauggcauacauggcaaaaacaaacucaacggagcggcguucucugggacguuccaaguccgccagagacgcaaaaagcugaacucgaagaaggaguguaccgcauaaaacaacaaggaaucuucgguaaaacgcaagugggaguuggcguccagaaagaaggagucuuucacacgauguggcacguaacacgaggugcuguauuaacacauaacgggaaacgguuggaaccuaacugggcaucaguuaagaaagaucuuauaucuuauggaggcgguuggagauuaaacgcgcaguggcaaaaaggagaagaaguacaaguaauagcuguggaaccaggaaagaauccuaaaaauuuucagacuaugcccgggauauuucaaacuacgacuggagagauaggagcaauagcuuuagacuuuaaaccagggacaucugggucuccgauaauaaaucgugagggaaaagucgugggauuguauggaaacggcguaguuaccaaaaacggaggcuacguuuccggcaucgcccaaacuaacgcagaaccugaugguccaacaccagaacucgaagaagaaauguucaagaaacgcaaucuaacaauaauggaucuacauccuggcuccggaaaaaccagaaaauaccucccagccauaguaagggaagccauaaaaagacgacucagaacgcuuauacuugccccaacuagaguagucgcagcagagauggaggaagcauuaaaagguuuaccgauucgauaccagacaacggcgacuaagucggaacacacgggaagagaaauuguagauuuaaugugccaugcaacuuuuacaaugcgguuauugucuccaguucgagugccuaauuacaaccuagugauuauggaugaagcacacuucaccgauccagcuuccauagcggcacgaggauacauaucaacccgggugggaaugggcgaagcggcugccauuuuuaugacagcgaccccuccugggacggcagaagccuucccacaauccaaugcuccgauucaggaugaggaacgagauauaccagaaagaaguuggaacucaggcaacgaguggaucacagacuuuguuggcaaaaccgugugguuugugccgucaauaaaggcaggaaaugauauagcuaauugcuuaaggaaaaaugggaaaaagguaauacagcucagucggaaaacauuugacacagaguaucagaaaacacgauuaaacgacugggauuucguagucaccacagacauuagcgaaaugggcgcuaauuucaaagcggauagaguaaucgacccgagacgaugcuugaagccagucauucucacagaugguccugagagaguuauacuugcaggaccuaugccugucacugcagcaucugcugcacaacgacgagggagaguaggucguaacccucaaaaagaaaaugaccaauacauuuucaccggacaacccuuaaauaaugaugaggaucacgcucauuggacagaagccaaaaugcuauuggauaauauuaauacuccugaaggaauaauacccgcauuauucgaaccugaacgagaaaagucagcagcuauugacggcgaauaucgauuaaaaggugaaagcagaaaaaccuuugucgaauugaugaggagaggggacuuaccaguuugguuggcacauaaggucgcguccgaaggaauaaaguacacugauagaaaauggugcuucgacggcgagcgcaacaaucagaucuuagaggagaauauggacgucgagauauggacgaaggaaggagagaggaagaaacugagaccgcgauggcucgaugcuaggacuuauuccgacccacuagcauuaaaggaauuuaaggauuuugccgccgggcgaaagucuauagcguuagauuuagugacagagauuggcagggucccaucccacuuagcccaucggaccagaaaugcguuagauaauuuagugaugcuacauacaagcgaacaugggggacgggcauaucgacaugcugucgaagaacugcccgagacaauggagacauuauuacuacuuggauugaugauauuacucacaggcggugcuaugcuauuccucauaucagguaaggguauaggaaaaacgucaauaggucucauuugcguuauugugucuagcggaaugcuauggauggcggaugugccucuacaauggauugcaucggcaauaguauuagaguucuuuaugaugguacuuuuaauacccgaacccgaaaaacaaagaacuccucaagacaaucaguuagccuauguaguuauuggaaucuugacauuagcagcaauuguagcugccaacgagaugggguuacuugagacgacaaaaagggacuuagguauguccaaagaacccgguguaguuaguccuacuucguauuuagacgucgauuuacauccugccagcgcuuggacauuauaugcgguagcgacuacaguuauuacaccgaugcugagacauacaauagagaacucgaccgcuaaugugagccucgcugccaucgcaaaccaagcuguggugcugauggggcuugacaaagguuggcccauuucaaagauggaucuaggaguaccauuguuagcacuagguuguuauucccaaguuaauccucucacuuugacggcugcaguauuacuacugguuacgcauuaugcaauuauuggaccaggauugcaagcaaaagcaacaagagaagcacagaaaaggacagcagcgggaaucaugaaaaauccaacagucgacgguauaaugacaauagaccuugauccaguuauauaugacucaaaauucgaaaaacaacuagggcaggucaugcuuuuagucuuaugcgcgguccaacuacuacuaaugcguacgucaugggcacuaugcgaggcuuugacucuggccacgggcccaauaacuacacuuugggaaggcuccccagggaaauuuuggaacacaacuauugcaguaaguauggccaacauuuuccgaggaagcuaucuugcaggcgcugggcucgcauuuuccaucaugaagaguguuggcacgggacggcgaggcacuggcucucagggagaaacccugggcgaaaaauggaagaagaaacuuaaucaauuaucuaggaaagaguuugaucuauauaagaaauccggaauuacggagguagaucgaaccgaagcuaaagaaggauuaaaaaggggagaaacaacccaccaugcuguuaguagaggaagugcuaaacuucagugguuuguagaaaggaauaugguaauacccgaaggaagaguaaucgacuuagguugugggcgggguggaugguccuauuacugugcaggacuaaagaaaguaacugaaguaaggggauacacuaagggaggaccaggacacgaagaaccgguacccauguccacauauggauggaauauaguaaaacucaugagugguaaagauguguucuaucuuccacccgaaaaaugugauacucuuuugugcgacauuggggaauccucucccaguccaacaguagaggaaucgagaacaauuaggguacugaagaugguagagccaugguugaggaacaaucaguucuguauaaagguacugaacccauauaugccuacagucauagaacacuuggagcgauuacagaggaaguacggaggcauguugguuagaaauccauuauccaggaacuccacucacgagauguacuggauuagcaauggaacagguaauaucguaaguucuguaaacauggugagcagacugcuauuaaaccgauuuacaaugacgcacagaagaccaacgauugagaaagacgucgaccuuggggcagguacacggcauguaaaugcagaaccggaaacaccaaauauggauguaauaggagaacggauuaaacguaucaaagaagaacauuccucuaccuggcacuaugacgaugaaaauccuuauaaaacuugggcuuaccacggaucauaugaagugaaagccacggguagugccucaucaaugauaaaugggguugucaaguugcuaacaaaaccgugggauguugugcccaugguaacucaaauggccaugaccgauacaaccccguucggacaacaaagggucuucaaagaaaaaguggauacacggacuccgaggccuaugcccgguaccagaaaagucauggaaauuacagcagaauggcuauggcgaaccuuagggaggaacaagaaaccaagguuguguacucgugaagaauuuacaaagaaagugcggacaaaugcagcuaugggcgcgguauucacagaagagaaucaaugggacucagcacgcgcagcaguugaagacgaagaauuuuggaaauuaguggaccgcgaacgugaacugcacaaauuggggaaauguggaaguuguguauauaacaugaugggaaaacgagagaagaaacuaggugaguuugggaaagccaagggaucucgggcuauuugguauaugugguuaggagcgcgauaccuugaauuugaagcacuuggcuuuuuaaacgaagaccauugguucagucgagaaaauuccuacucaggugucgaaggggaaggcuuacauaaauuaggguacauccuaagagauauuucaaagauuccaggaggagcaauguaugcagacgauacugccgggugggauacaagaaucacugaagacgauuugcauaacgaggagaaaauaacucaacaaauggaucccgagcaucggcaauuagcaaaugccauauucaaacuaacguaucaaaauaaagucguaaaaguucaaagaccaacuccuaaagggacuguaauggacauuauaucccgcaaagaccaaagaggcaguggacaaguuggaacauauggacucaacacauuuacaaauauggaagcucaauuaguaagacagauggaaggugaaggcgugcuaagcaaggcggauuuagaaaauccacaccuccuugagaagaaaauaacucaaugguuggagacgaaagguguagaaagacucaaacguauggcaaucuccggagacgauugcgucgucaagccaauagaugacagauucgcuaacgccuuauuagcucuaaacgauaugggaaaaguccgaaaagacauuccacaauggcaaccgucaaaggguuggcacgacuggcagcaaguaccauuuugcucucaccacuuucaugaauugaucaugaaagacggucguaaacuugucguuccuuguaggccccaagaugaguuaauugguagggcuaggaucucacaaggggcaggauggagccugaaggagacagcuuguuuagggaaagcauaugcucaaauguggagccuaauguauuuccacagacgggauuuacgcuuagcuucuaaugcaauuuguucugcaguccccguucauuggauucccacaucaagaacaacuuggaguauucacgcucaucaucaguggaugacaacagaggauauguuaacaguuuggaaucggguuuggauugaagacaauccauggauggaagacaaaacaccagucacgacuugggaagauguaccauaucuuggaaaaagggaagaccaaugguguggaucucuaauuggucuuacaaguagagcaacaugggcccaaaacauauuaaccgcaauccaacagguccgaucuuuaaucggagaugaagaguuccuggacuacaugccuaguaugaaaagauucagaaaagaagaagagucugagggugccaucugguaa

SEQ ID NO: 23108 - RNA, 9873 nt, Artificial Sequence
  derived and/or modified CDS sequence (opt6) from DENV-3__GU131916__SS-prME
acgagccuaugccucaugaugauguuaccugcaacauuagcguuucaucucacaucaagagauggggaaccucgaaugauaguagguaaaaaugaaaggggaaaaucucuacuauucaaaacagcaucaggcaucaauaugugcacuuuaauugccauggaucucggggaaaugugcgaugauacugucacauauaaauguccauugauagcagaaguagaaccggaagacaucgauuguugguguaacuuaacuucaacgugggugaccuacgggacuugcaaccaagcuggggaacacaggcgcgacaaaaggaguguugcauuagcuccucauguaggcaugggacuugauacacgaacucaaacguggaugucugcagaaggcgcauggcgucaaguggaaaaaguugaaaccugggcacuucgucauccaggauuuaccauacucgcauuauuuuuagcacacuacauaggaaccucauuaacacaaaaagucgugaucuuuauucugcugauguuagucacgcccucgaugacaaugagaugcguuggcguagggaaucgagauuuuguugaaggacuaucaggugcuacuuggguagauguggugcuugaacauggcgguugcguaacuacgauggcgaaaucaaaaccaacguuggauauugaauuacagaaaacggaagcaacucaacuggcaacuuugaggaaacuauguauugaagguaaaauaacaaauaucacuacugacucccgaugccccacacaaggugaagccacccuaccagaagaacaggaccaaaauuauguuuguaaacacacuuauguugacagaggcugggguaacggguguggacuauuuggaaaaggaagucuuguuacaugcgcaaaauuucaauguuuagaaccuauagaagggaaaguugugcaauaugaaaaucucaaauauaccgugauuauaacaguccauacuggagaccagcaucaaguaggaaacgauacgcaagggguaacgguggaaaucacaccacaagcaaguacuguagaagcaguacuuccggaauaugguacacuagguuuagaauguaguccacguacugggcuagacuuuaacgaaaugauauuguuaacaaugaaaaacaaagcauggaugguccacagacaaugguucuuugauuuaccauuacccuggacuagcggugcaacaacagaaaccccuacauggaacagaaaagaacuuuuaguaaccuuuaaaaaugcacacgcgaagaaacaagaggucgucgucuuaggaagucaggagggagcgaugcauacagcauuaacaggggcaacggaaauccaaaauagugguggcaccaguauauuugcggggcaccuaaaaugccgauugaaaauggacaaacucgaacucaaagggaugucuuacgcaaugugcuuaaauacuuucguacugaagaaagaaguaucugaaacacagcacggcaccauauugaucaaaguugaauauaaaggagaagaugcaccuuguaaaauaccuuuuuccacugaagauggucaaggcaaagcccauaacggcagacucauaacggcaaacccaguuguaacuaagaaagaggaaccggugaauauagaggcugaaccuccuuuuggggagagcaauauuguaauagguaucggagacaaagcacucaaaauuaauugguacaagaaaggguccucuaucggcaaaauguucgaggcuacagcacguggagcacguagaauggcgauauugggugacacagcgugggauuuuggaucgguaggcggaguacugaacucguuagguaaaaugguacaccagauuuuuggaucugcauauacggcguuauucucgggggucucauggauaaugaaaauaggcaucggcguauuacucaccuggauuggauuaaacuccaaaaacacaucuauguccuuuucguguauuguaauaggcauaauuacuuuguaucucggagccguaguacaagcggacaugggauguguuauaaauuggaaaggaaaagaauuaaaauguggaucggguauauuugucacaaacgaaguacacacauggacggaacaguacaaauuccaagcugauagcccgaaaagguuagcaacagcgauagccggugcaugggaaaauggaguuuguggcauucgaucaaccacucgcauggagaacuuauuauggaaacaaauagcuaaugaguuaaacuauauucucugggaaaacaacauuaaauuaacaguuguggugggugauauaauaggcguuuuagaacaaggaaaacggacucuuacaccccaaccuauggaguuaaaauacaguuggaaaacauggggaaaagccaaaauuguuacagcagagacccaaaauuccagcuuuaucauugaugguccaaacacaccggaaugucccucugcgucucgagcauggaauguuugggaggucgaagacuacggauuugguguauuuacuaccaacauauggcuaaaacuuagggaaguauauacucaauccugcgaucauagacugaugucugcagcaauuaaagacgaaagggcaguccaugcugauaugggauauuggaucgagucacagaaaaaugggaguuggaaacuugaaaaggcuucguuuaucgaaguaaaaacauguacuuggccuaaaucacauacacuauggucgaauggcguucuugagucugauaugaucauaccuaaaucacuagccgguccuauaucucagcauaaccaucggccaggauaccauacacagacagcuggcccguggcauuuagggaaacucgagcuugauuucaauuacugugagggaaccacuguugugauuacggaaaauuguggcacacggggaccgaguuuaagaacaacaacuguaagugguaaacucauucaugaaugguguugcagaagcuguacgcuaccaccacuaagauauaugggagaggauggcugcugguaugguauggaaauacgaccaaucaaugaaaaagaggaaaacaugguuaagagucuugugucagcgggaucuggaaaaguagacaacuuuacgaugggaguacucugcuuggcuauauuauuugaagaggugaugagagguaaauuugggaaaaagcacaugauagcagggguauuguuuacuuuugugcuauugcuaucgggacagauuacauggcgagauauggcucauacuuugauaaugauuggcucaaaugcgagugacagaaugggcaugggagucaccuauuuagcacuuaucgcgacuuuuaagauucaaccauuucucgcccuuggcuucuuuuugaggaaacugacaagccgugaaaauuuacuacucggcgucgguuuggcaauggcgacaacacuucaauuaccagaagacauagaacaaauggccaaugguauagcccuuggauuaaugaccuuaaagcucauuacucaauucgaaacuuaccaauuauggaccgcuuuaguaagucuaacauguucaaacacaauauucaccuuaacugucgcuuggaggacagcaacauugauccuagcaggcguaagucugcuuccacuuugccaauccuccagcaugagaaaaacugacuggcuuccuaugacagucgcugcuaugggaguaccgccacuacccuuauuuauuuucagcuuaaaagacacaccgaaacgucgaagcuggccguuaaacgagggaguuauggcuguaggcuuagucaguauauuggcuaguucauuacucaggaacgacguuccuauggccggaccacucguugccggaggauuacucauugcauguuacgugaucacuggcaccagugccgacuugacaguagaaaaagcagcagaugucacaugggaagaagaagcagaacaaacagguguaagucacaaccugaugauaacaguggacgaugauggaacuaugagaauaaaagacgaugaaacagaaaauaucuuaacagugcuuuugaaaacagcuuuauugaucgugucaggaauuuuuccauauucaaucccggcaacacuacugguuuggcauacauggcaaaaacaaacacaaaggucaggagugcuaugggaugugccaucuccaccagaaacucaaaaagcagaacuagaggagggaguuuaucgcauuaaacagcaaggaauauucggaaagacucaaguaggaguaggcguacaaaaggaagguguauuucauacgauguggcacguaacacguggggccguuuugacgcacaaugguaagagacuggagcccaauugggcaucugugaagaaagaucugauaucuuacggggguggguggagauuaagcgcgcaauggcagaaaggggaagagguucagguuaucgcuguagaaccugguaaaaauccuaaaaauuuucaaacuaugccagguauuuuccaaacaaccacaggggaaauaggugccauugcguuggacuuuaaaccuggaacuagcggaucgccuauuaucaacagggagggcaaggucguaggauuauaugggaaugguguaauuaccaaaaauggcggcuacgucuccgguauagcacagacuaacgcugaacccgauggaccaacaccugaacuggaagaagaaauguuuaagaaaaggaaccuaacaauaauggaccuccauccgggcaguggcaaaacccgcaaguauuuaccagcaauaguucgagaggcaauaaagcgaagauugagaacuuuaaucuuggcuccuacacguguuguggccgcugagauggaagaagccuugaagggcuuaccgauucgcuaccaaacgacggccacaaaaucugaacauacagggcgcgaaaucguagauuuaaugugucacgcuacauuuacaaugcgauuacuuaguccaguacguguaccaaacuauaaucucgugauaauggaugaggcacauuucacggauccggccagcauugcagcaagaggcuauauaagcacaaggguuggcaugggagaggcugcugcuauauuuaugaccgcaacaccaccgggcacugcugaagcauuuccacaaucgaaugcgccaauucaggaugaggaacgcgauauaccugaacguucauggaauagcggaaaugaauggauuacagacuucguaggcaagacagugugguuugugccuucaauuaaagcgggaaaugauauagcaaacugcuuaaggaaaaaugguaagaaagugauucaacuuagcagaaaaacauuugacacugaauaucagaaaacacguuugaaugacugggauuuugucgugacaacagacauaucagaaaugggggcaaauuucaaagcagacagaguaauugacccgagaaggugccugaagccaguuauuuuaacagacgggccagaacggguuaucuuagcaggcccuaugccgguaacugcagcaucagccgcccaaagacguggcagaguuggcagaaacccgcagaaagaaaacgaucaauauauuuuuaccggacaaccacucaauaaugacgaggaccaugcgcauuggaccgaagcgaaaauguuauuagauaauauuaauacaccagaggggauaauaccagcguuauucgaacccgagcgcgagaaaagugcagcuauagacggagaauauagacuuaaaggcgagaguaggaaaacguuuguugaacugaugagacgaggugauuuacccgucugguuagcccacaaaguugcuucggaaggaaucaaauacacggaucggaaauggugcuucgauggagagagaaacaaccaaauacucgaagaaaauauggaugucgagauauggacaaaagaaggcgagaggaagaaauuaaggcccagauggcucgacgcgaggacauacagugacccacuagcccucaaggaauuuaaagauuucgcugcuggaagaaaaaguauagcuuuagauuuaguuacggaaauuggacgaguuccaucacauuuagcacaucguaccagaaaugcacuagacaacuuaguaaugcuccauacuagcgagcaugggggaagggccuauagacaugccguugaagaauuaccagaaacuauggaaacauuauuguugcuuggacuuaugauauuauugacgucaggugcgauguuauuucuaauaaguggaaaaggaaucggaaaaacaagcaucgggcuaaucugugugauaguaaguaguggaauguuauggauggcugacguuccguuacaauggaucgcaagugccauugucuuagaauuuuucaugaugguuuuauuaauaccggaacccgaaaaacaacguaccccgcaagauaaucagcuagcauaugugguuauaggcauacuaacacuggcagcuauuguggcggcaaacgaaauggggcuucuagagacuacuaaacgcgaucuggguaugucaaaagaaccgggaguaguuaguccuacuucuuaccucgacguagauuuacaucccgcuucagcauggacucuauaugcgguugcaaccacagugauuacucccauguugcgccauacaauagaaaacucaacugcuaauguuucacuagccgcaauugccaaccaggcuguaguacugaugggccuagauaaggguuggccuauaucaaagauggauuuaggaguuccauuguuagcacuugguuguuauucacaaguuaauccccucacuuugaccgcagcaguauuacuguuaguaacucacuaugcaauuauugguccuggucuacaagcaaaagccacgagagaagcccagaaaagaacugcugcggguaucaugaaaaacccuacgguagacggaauaaugacaauugaucuagauccaguuaucuaugauaguaaauuugaaaagcaguuaggucaaguaaugcuucugguacuaugugcaguacaacugcuacuuaugagaacaaguugggcacucugugaggcuuuaaccuuggcgacgggaccaauuaccacacugugggaggguucaccagguaaauuuuggaauacaacaauagcugugagcauggcuaauauauucagagggagcuaccuagcgggggcuggucuagccuuuaguauaaugaaaucaguagggacagguagacguggaacuggaagccaaggugaaacucugggagagaaauggaagaaaaaguugaaucagcucagucgcaaagaauuugauuuguauaagaaaucgggaauaaccgaaguagaccguacagaagcaaaagaaggauuaaaaagaggcgagacgacacaucacgccguaagccgaggaucagcuaaacuacaaugguuuguagagagaaauaugguaauuccagaaggucggguuauagaccuuggaugcgguaggggaggcuggucauauuauugcgcaggacuaaagaaaguuaccgaagugcguggauauacgaaggguggaccugggcaugaagaaccaguuccaaugaguacuuauggauggaauaucguaaaacuuaugagcggcaaagauguauuuuacuuaccuccagaaaaaugugacacgcuguugugugauaucggagagucaucuccaucuccaacgguagaagaaagcaggacaauaagaguauuaaagaugguugaaccuugguuaagaaacaaccaauuuuguaucaaaguucuaaauccauauaugccaaccguaauugaacauuuagaaagauugcaaagaaaguauggaggaauguuaguccggaacccacuaucccgcaauucuacccacgaaauguauuggauuagcaacgguacugggaacaucgucucaagugugaauauggucucgagacuacuguuaaauagauucaccaugacacauagacgcccaacaauagaaaaggacguagauuugggugcaggaacccgacaugugaaugcggaacccgaaacgccgaauauggauguuauuggagaacgaauaaaaagaauaaaggaggaacacucgucaacguggcauuacgaugaugaaaaccccuauaaaacuugggccuaccauggauccuacgaggucaaagcaaccggaagugccucuagcaugauuaacggggucguaaaauuacuaacaaaacccugggauguuguuccaauggucacacaaauggcuaugacugauacgacaccauucgggcaacagcguguauucaaggaaaaaguugauacgagaacucccagaccuaugccaggcacaagaaaaguuauggaaauaaccgcagaaugguuguggagaacucuugggaggaacaagaaacccagacuuuguaccagggaagaauuuaccaagaaaguacgaaccaacgccgcuaugggggcaguauucacugaagaaaaucaaugggacucugccagggccgcaguagaagaugaagaguuuuggaaacuuguggaccgcgagagggaacuacauaaguuaggcaagugcggaagcugcguuuauaacaugaugggaaaacgugagaaaaagcuaggagaguucggaaaagcuaaaggaaguagagcaaucugguauauguggcucggggcuagauauuuagaguucgaagcacuaggauucuuaaacgaagaucauugguucaguagggaaaacagcuauagcgggguagaaggugaaggucuucauaaauuaggauacauuuuaagagauauuuccaaaauaccuggaggagccauguacgccgaugacacagcgggcugggacacgagaauuacagaggacgacuuacauaacgaagagaagauaacccaacaaauggacccugaacauagacagcuggcgaacgcaauauuuaaacuuaccuaccaaaacaaaguaguuaaaguucaacguccgacucccaagggcacaguaauggauaucaucucacgaaaagaccaaagaggauccgggcaaguagguacauacggacuuaauacguuuacaaauauggaggcacaguuaguuagacaaauggaaggagaagauguacuaucgaaagcagacuuagaaaauccacaccuauuggagaagaaaauaacacaauggcuugaaacgaaggguguugaaagacuuaagcgaauggcuaucagcggcgaugacuguguugugaagccaauagaugaucgcuuugcaaacgccuuacuugcacuaaaugauaugggaaagguucggaaagauaucccacaguggcagccgaguaaagguuggcaugacuggcagcaaguacccuucuguucccaucauuuucaugagcugauuaugaaagauggucggaaauuaguaguaccuugccguccccaagaugagcuaauagggagagcuaggauuagucagggcgccggauggucgcuuaaggaaacagcaugucugggcaaagcguaugcacagauguggagccugauguauuuucacagacgcgacuuaagguuagcuucuaaugcaauaugcuccgcuguuccaguucacuggauaccaaccucacggacaacuuggucaauacacgcucaucaucaguggaugacaacugaagacauguuaaccguauggaauagagucuggauugaagauaaccccuggauggaagacaaaacaccgguuacaacaugggaggauguaccuuaccuuggaaagagggaagaucaaugguguggaagucugaucgggcucacgucuagggccacuugggcacaaaauauacucacagcuauccaacaaguacgcucguugauaggagaugaagaguucagcgauuacaugccaaguaugaaacgauuuaggaaagaagaggaaagugaaggggcaaucugguaa

SEQ ID NO: 23109 - RNA, 9873 nt, Artificial Sequence
  derived and/or modified CDS sequence (opt6) from DENV-3__GU131917__SS-prME
acaaguuuaugucugaugaugaugcugcccgcaacauuagcauuucauuuaacaucaagagacggggaaccuagaaugauuguugguaaaaaugaaagaggaaaaucguuguuauuuaaaacugcgagcgggauuaauaugugcaccuugauagcuauggauuugggugaaaugugugaugauacagucacauauaaauguccucuaauagcagaagucgaaccagaagauauugauuguugguguaauuugacuucgacuuggguaacguaugguacguguaaucaagcuggagaacaccgaagggauaaacggucagucgcacuugcuccccacguaggaaugggacuagauacuagaacacaaacguggaugagcgcagaaggugcguggagacaaguugaaaaaguagaaaccugggcuuuaagacacccagguuuuacuauauuggcauuguuucuggcacacuauauagggacuucacuuacacaaaaaguuguaauauuuacauuacuaauguuagugacgccuaguaugacuaugcgauguguagguguaggaaauagggauuuuguagaaggacucucgggagcaacuuggguagacguuguccuugagcauggaggcugcguaacuacaauggcuaaaucuaaaccaacacuagacaucgaacuacagaaaacggaagcaacccaacucgcaacauugaggaaacuauguauugaaggaaaaauaacaaacauuacuacagacucaagguguccaacucaaggagaggcuacucuaccugaggagcaagaucaaaauuauguuuguaaacacacuuauguugaucggggcugggggaaugguuguggguuauuuggaaaagguucauuaguaaccugcgccaaauuucaaugcuuggaaccaauagaaggaaaaguuguacaauacgagaaucugaaauauaccguuaucauaacaguccacacuggcgaccaacaucaagucggcaacgauacacaaggaguaacagucgaaauaacaccccaagcgagcacgguagaagccguauuaccagaauacggcacauugggauuagaaugcuccccucgaacgggccuagacuucaacgaaaugauauuacucaccaugaaaaacaaagccuggaugguacauagacaaugguuuuucgaucuaccgcugccauggacuagcggugcuacaacggaaacacccacguggaacagaaaagagcuauugguaaccuucaaaaaugcucacgccaagaaacaagaaguuguuguuuuggguagccaggaaggagcuaugcauacagcuuugacaggagcaacugagauucaaaacagugggggaacgagcaucuuugcuggccaccuaaaaugcaggcuaaaaauggauaaacuggaacuaaagggaaugaguuaugcaaugugucuaaauaccuuuguucuaaagaaagaagugagcgagacacaacauggaacaaucuuaauuaaaguagaauacaaaggagaagaugcuccaugcaaaauaccauuuucgacagaggauggccaagguaaagcacauaacggucgccuaauaacugcuaauccgguaguaaccaagaaagaagaaccaguuaacauugaagcagaaccaccguuuggagagagcaacauuguaauagggauuggcgacaaagcauugaaaauaaauugguacaagaaagggucaucgauuggcaagauguuugaagcuacggcaaggggcgcgaggcguauggcaauacuaggagauacagccugggauuuugguaguguggguggaguccuaaauucgcucggaaaaauggugcaucaaauuuucgguagugccuauacugcacuauucucaggggugagcuggauuaugaaaauagguauaggaguuuugcucaccuggaucggucugaacagcaaaaauacaaguaugucguuuaguuguauaguuauaggaauaauaacccuuuaucuaggagcaguaguacaagcugauauggguugcguaauaaauuggaaagguaaagaacuuaagugugggaauggaauauuuguaacuaaugagguacauacuuggacagaacaauauaaauuccaagcugauucgcccaaacgucucgcaaccgcuauagccggagcuugggaaaaugggguaugugggauaaggaguaccacucguauggaaaaucuucuauggaaacagaucgcuaaugaacuaaauuauaucuugugggaaaauaauauaaaguugacagugguuguaggcgacauuauaggaguguuggagcagggcaaacguacauuaacaccgcagccaauggaguugaaauauaguuggaagacaugggguaaggccaagauugucacagcagagacgcaaaauucaucauuuauaauugacgguccaaauacccccgaaugcccaucggcaucaagagcuuggaaugugugggaagucgaggacuauggauuuggaguguucacuacaaacauaugguuaaaacuuagagaggucuauacacagaguugugaucauaggcugaugucagcugccauaaaagaugaaagagccguccaugcugauaugggguauuggauagaaagucagaaaaacggcucauggaaacuagaaaaggcuucguuuauagaagugaaaacguguacuuggccaaaaagucacacuuuaugguccaacggaguacuagagucugacaugauaauaccaaagucauuagccggucccauaucccagcauaaccaccgaccugguuaccauacacaaacagccggcccuuggcaccuaggaaaacuagaauuagauuuuaauuauugcgaggguacaacaguuguaauugcggaaaacuguggaacaaggggucccagucugcgaaccacaacgguaagcgguaaacuaauacaugaauggugcugcagaucauguacccuacccccacuaagauauaugggagaagaugguugcugguaugguauggaaauaagaccaauaaaugaaaaagaggaaaauaugguuaaauccuuagucucugcuggcucaggaaaaguggacaauuucacuaugggagucuuaugccuggcuauucucuuugaagaagugaugagagguaaauuugggaagaaacauaugauugcaggagugcuauucacguuuguacuacuccuuucuggccagauuacguggcgggauauggcccauacuuuaauaaugauuggcucaaaugcgucagauagaauggguaugggaguuaccuaucuagcauuaaucgcgacauucaaaauccaaccauuccuagcauuaggguucuuucuucggaaacucacaaguagagaaaauuuguuauuaggaguagggcuagcaauggcgacuacacuacaguuacccgaagauauugagcaaauggcgaauggaauagcacuaggguuaaugacgcucaagcuaauaacacaauuugaaacauaucagcuuuggacugccuuagugagucuaacauguuccaauaccauauuuacauuaacuguagccuggagaacggcgaccuuaauacuagcggggguuagccuccuuccucuuugucaauccucaaguaugcguaaaacugauugguuaccgaugacggucgcggcaaugggagucccaccauuaccccuauucauauucucuuuaaaagacacuccgaagagaagaaguuggccccuuaaugaaggaguuauggccguaggucuaguuaguauucucgcuucguccuugcugaggaacgacguacccauggccggacccuuaguugccggcgggcuccuaauugcuuguuacguuaucacagggacaagugccgaucuaacagucgaaaaagcagcagauguuacuugggaagaggaagccgagcaaacuggaguaucacacaaucugaugauaacaguggaugaugauggaacuaugagaauuaaagacgaugaaaccgagaauauacuuaccguauuauuaaaaacugcauugcuaauagucucgggaauuuuuccguacaguauuccggcaacuuugcuaguuuggcauaccuggcaaaaacaaacgcaacgaucugggguucucugggaugugccaucaccacccgaaacacagaaagcggaacuagaagaaggaguuuaccgaauuaaacaacaaggaauauuuggcaaaacacagguuggcguagguguucagaaagaagguguuuuucacacaauguggcauguaacgcguggagcuguucugacucauaaugggaaacguuuggagcccaacugggcaucugugaagaaagaccuaaucaguuaugggggaggauggagguugagcgcccaauggcaaaaaggggaggagguccagguaauagcaguagagccuggcaaaaauccaaagaauuuucaaacuaugccuggaauauuucaaacaacuacuggggaaauuggugcgaucgccuuggauuuuaagccgggcaccaguggcaguccuauuauuaacagggaagggaaaguaguaggacucuacgggaaugguguuguaaccaaaaaugguggguauguuaguggaauagcccagacuaaugcugagccagacgggccaaccccagaauuggaagaggaaauguuuaagaaaagaaaccuaacgauuauggaucuacacccagguagcggaaagacccgaaaguauuuaccagcuauuguaagagaagcuauaaaacguaggcugagaacccuaauauuagccccaacacgaguugucgccgcggaaauggaagaggcccucaaagggcucccaauuagauaccagaccacugcuacuaaguccgagcacacagguagagaaaucguagaucuaaugugucaugcaacauucaccaugcgccuucuaagcccaguaagggugccaaacuauaauuuaguaauuauggacgaagcacacuuuacagauccagcaucuauagcagcgcgcgguuauauuucgacucguguaggcaugggcgaggcugcggccaucuuuaugacagccacacccccaggaacagcagaagccuuuccgcaaaguaacgccccaauacaggacgaagaacgagacauaccugaaaggaguuggaauaguggaaacgaauggauaacggauuuuguaggaaaaacaguaugguuuguacccucuauaaaagcuggaaacgauauagcuaacugcuugcgcaagaauggcaagaaagugauacaguuaagucgcaaaacauuugauaccgaauaccagaaaacacggcuaaacgacugggauuuuguuguaacaacagauauuagugagaugggcgcaaauuuuaaagcggaucgggugauagauccgagaagauguuuaaaaccaguaauucucacggauggaccagaaagggugauacuggcaggacccaugccagugaccgcugcaagugcugcucaaagaaggggacgaguugguagaaacccccaaaaagaaaaugaucaauacaucuuuacaggacaacccuuaaacaacgacgaagaccaugcacauuggacagaggccaaaauguuacuagacaauauaaauacaccggaaggaauaauaccggcacuguuugaaccagaacgugagaaaucagcugcaaucgauggagaauauagauuaaagggggaaucacgcaagaccuuuguggaguuaaugagacguggggaccuaccaguuuggcucgcacauaaagucgccucugaagggauaaaauacacggauagaaaaugguguuucgauggugaacgcaauaaccaaauacuagaggagaauauggacguagagauuuggaccaaggaaggagaacgcaagaaauuaaggccacgaugguuggaugccaggaccuauagugauccccucgcacugaaggaauuuaaggauuucgcagcggguaggaaaucaauagccuuagaucuagugaccgagauuggcagagucccaagccaucucgcacaccgaacaaggaaugcucucgacaaucuaguaaugcuacauacuagcgagcaugguggcagagccuauagacaugcaguugaagaacuaccagaaacaauggaaacauuacuuuuacuaggccuuaugauauuacugacagguggcgcuaugcuuuuccugauaucagggaaagggaucggaaaaacuagcauuggauuaaucuguguuauuguaucaucaggaauguuauggauggcugauguuccgcuacaauggauugcaagugcuauuguauuagaauuuuucaugaugguacuguuaauaccagaaccugagaaacaacgaacaccacaggacaaccaacuggcauacgugguaauaggaaucuuaacguuggcagcaauuguagcggcuaaugaaaugggucuccuagaaacaacuaagcgagauuuaggaaugaguaaagaaccugguguaguuucgccgacguccuacuuagauguugauuugcauccugcgagcgcguggacauuguaugcggucgccacuacaguuauaacaccaaugcuuagacacacuauugaaaauaguacagcuaauguaucgcuagcugcaauugccaaucaagccguuguauuaaugggucuugacaaaggauggcccauaucuaagauggacuuggguguuccucuacuagcucugggauguuauagucaagucaauccauuaaccuugacugcagcuguacuguuacugguaacacauuacgcuauuaucgguccuggacuccaagcgaaagcaaccagagaagcacaaaaacguacagcugcuggaauaaugaaaaauccaacuguagauggaauuaugacuaucgaccuugauccaguuauauaugacagcaaauucgaaaagcaacuaggccaagugaugcuucugguauugugcgccgugcaacugcuuuuaaugagaacuagcugggcgcuuugugaagcacuaacucucgcaacagguccaauuacaacacuuugggaaggaucaccggggaaguuuuggaauacgacuauugcggucucaauggcaaauauauuuagaggaaguuaccuggcaggggcaggguuagccuuuagcauaaugaaaucaguagguacaggaaaacgugggaccggaucgcaaggggaaacucuuggugaaaaguggaagaagaaacucaaucaacugucgcgaaaagaguucgacuuguacaagaaauccggcaucacagagguugaccgaagugaagccaaggaggggcuaaaacggggagagacaacacaucacgcagugucaagggguagugcaaaacugcaaugguuuguggaaaggaauauggugauaccggaaggcagaguaauagauuuaggaugcgguagaggcggguggaguuauuacugcgcaggccucaagaaaguuaccgaggugagaggauauacaaaggguggccccggacaugaagaaccaguaccgauguccacguacggguggaauauaguaaaacuaaugucuggaaaagauguauuuuauuuaccacccgaaaagugugauacacucuugugcgauauaggugaaucuucccccagcccuacaguugaggaauccaggacgauccgcguauugaaaaugguagaaccguggcuacgaaauaaccaauucuguauaaaaguuuuaaacccguacaugccgacuguaauagaacaccuagaacgacugcaaaggaaauauggaggcaugcuaguuagaaauccauuaagucguaauagcacacaugagauguauuggauaaguaaugggaccgggaauauaguauccagcguaaacaugguuucaagacuauuauuaaacagauuuacaaugacacacagaagaccuacgaucgagaaagaugucgauuugggggcgggaacaagacacguaaaugccgaaccggagacaccaaacauggaugucauuggcgaacgaauaaaaagaauaaaagaagaacauaguucaacauggcauuacgaugacgaaaauccuuauaaaacaugggccuaccacggaaguuaugaaguuaaggcaacugggagugcauccuccaugauaaauggaguggugaaguuauuaacuaaaccaugggaugucgucccaauggucacacaaauggcuaugacugacacuacacccuucggacagcaacgaguauuuaaggaaaaaguggauacaagaacaccccgaccaaugccugggacacggaaaguaauggaaauaacggcagaauggcuauggagaaccuugggacgaaacaaaaagccacguuuauguacuagagaagaauuuaccaagaaaguacgaacaaaugcugcgaugggagcaguguuuacagaagaaaaccagugggauucagcccgagcagccguagaggaugaagaguucuggaaacuuguagauaaagaacgagagcuccauaagcuaggcaagugugguucauguguauacaauaugaugggaaaaagagagaagaaguugggagaguucggaaaggcaaaaggcucuagagcuauuugguacauguggcuaggugcaagguauuuagaguucgaagcacuaggauuccuaaacgaagaucacugguuuaguagagaaaauagcuacucaggaguugagggagaaggacuucauaaauuaggguauauauuaagagauauaucaaaaaucccaggaggggcgauguaugccgacgauacggcugggugggauacacgcaucacggaagaugacuuacacaacgaggagaaaaucacucaacaaauggacccugagcaucgacaauuagcaaaugcuauauuuaagcuaacguaccaaaauaagguugugaaaguacaaaggccgacacccaaagguacaguaauggacauuaucucccgaaaagaccaacgugguucaggucaaguugguacguacggauuaaauacuuucacaaacauggaggcacagcuuguacggcaaauggagggagaaggcguuuuaagcaaagcagauuuggaaaauccacauuuacuugagaagaaaauuauccaaugguuagagacgaaaggugucgagagacuaaagaggauggcaaucaguggagacgauugcguuguaaaaccuaucgacgaucgauuugcaaaugcccuauuagcacuaaaugacauggguaagguacggaaagacaucccucaauggcagccuuccaaaggauggcacgauuggcaacaaguacccuuuuguucacaucacuuucaugaauuaaucaugaaggauggucgaaaauugguagugccaugucgaccucaagaugaacuaauuggccgggcacguaucucucagggagcggguugguccuuaaaagagaccgcuugucucggcaaggccuacgcacaaauguggagucuaauguauuuucaccgaagagauuuacgacuagcuagcaaugcaauauguuccgcgguccccguacauuggauuccaacgaguagaaccacuuggagcauacacgcacaucaccaauggaugacgacagaagauauguugaguguuuggaacagagucuggauagaggacaauccuuggauggaagacaagacgccaguuaccacaugggaagauguaccguaccuggguaaaagggaagaucaaugguguggcucacugauaggacuaaccucacgagccacuugggcccaaaacauacuuacggcaauacaacaaguuagauccuuaaucggcgacgaggaguuccuugacuauaugccaucgaugaagagauucagaaaagaagaagagucagaaggggccauaugguga

SEQ ID NO: 23110 - RNA, 9873 nt, Artificial Sequence
  derived and/or modified CDS sequence (opt6) from DENV-3__GU131918__SS-prME
acaaguuuaugucuaaugaugauguuaccugcaacacuagcauuccaccuaacaucaagagacggcgaaccaagaaugaucguggguaaaaaugaaagagggaaaagucuucuauuuaaaacagcaagcgguauuaacauguguacacuaaucgcaauggacuugggugaaaugugcgacgacacggucacauauaaauguccauuaaucgcagaagucgagccugaagauauagacuguugguguaaucugacgagcacauggguuaccuaugguaccuguaaccaagccggugaacacagaagagauaaaagaucagucgcuuuagccccgcauguaggaaugggacuagacacccguacacaaacauggaugucggccgaaggugcauggcgacaaguugaaaaaguugaaacaugggcuuugcgucauccuggauucacuauuuuagcccucuuucuugcacauuauauagggacgucucuuacgcagaaagucguaauauuuauuuuauuaaugcugguaacuccuuccaugacuaugcgauguguuggaguuggaaauagagacuuuguagaaggacuaagcggagcuacauggguagauguugucuuggagcauggcgggugcgucaccacaauggccaaaaguaaaccaacuuuggauauugaacuucagaaaacagaagcuacucaacuagcaacgcuaagaaaauugugcauagaaggcaaaauaacaaauauaacaacagauucgagauguccuacccaaggggaagcgacccuaccagaagaacaagaucaaaauuacguuuguaaacauacuuacguagaucgagguugggggaacggguguggauuauucgguaaaggaaguuuaguaacaugugcuaaauuucaauguuuggaaccaauagaagggaaaguagugcaauacgagaaucuaaaauacacggugauaauaacaguacauacaggggaccaacaccaaguaggaaacgauacacaaggagugaccguagagauaacaccacaagcaucaacaguagaagcaguauuaccggaauacggaacgcuaggauuggaauguucaccaagaacuggcuuagauuuuaacgagaugauauuauuaacaaugaaaaauaaagcauggaugguacacagacaaugguucuuugauuuacccuuaccauggacaaguggagcaacgacagaaacgccaacauggaaucgaaaagaacuucucguuacauuuaaaaacgcacaugccaagaaacaagagguaguagucuuagguucucaggaaggagcaaugcauaccgcguugacaggagcaacagagauccagaauaguggugguacuagcaucuucgcaggacaucucaaauguagauuaaaaauggacaaauuagagcuaaaagggaugagcuaugcuauguguuuaaauacauuuguauuaaagaaagaggucucggaaacacaacacgguacaauuuugaucaaagucgaauauaaaggcgaagacgcaccauguaaaaucccauucucuacagaggauggccagggaaaagcacauaacggucgacuaauaacagcaaauccaguaguuaccaagaaagaagaaccaguaaauaucgaagcggaaccacccuuuggugaaaguaauauaguuauagggauaggcgauaaggcuuuaaaaauuaauugguauaagaaagggaguaguaucggaaaaauguuugaagcaacugcacguggagcacgaagaauggcaauacuuggggauacagcgugggauuucggaucaguaggugguguacuaaacagucuugguaaaaugguucaccagauauucggaucggcguauacugcacuguucuccggcguuucuuggauuaugaaaauagggauaggcguauuacuuacuuggauaggccugaacagcaaaaauacaucaaugagcuuuuccuguauaguaaucgggauaauuacacuuuaccuuggagcagugguucaggcugauauggguuguguuauaaauuggaaaggaaaagaguuaaagugugguaacggcauauuugucacaaaugagguacacacauggacugaacaauauaaauuccaggcggauucaccuaaaagguuagcaacugcaaucgcaggagcaugggagaauggugugugcgguauccgcucuacuacucgaauggagaauuuauuguggaaacaaaucgcaaaugaauuaaauuauauacuaugggagaauaacaucaaguugacagugguaguaggagacauaauaggagucuuagaacaagggaaacguaccuuaacgccacaaccaauggaauugaaauacagcuggaaaacauggggaaaggcaaaaauaguaacagcggagacacaaaauucaucuuucauaaucgacgguccaaacacgccggaguguccgagcgcuucacgagccuggaauguaugggaaguagaagauuacggauuuggcguuuuuacgacaaacaucuggcugaaauuaagggagguauauacacaaucaugugaucauagauuaaugucagccgcuauaaaagaugagcgagcaguccacgccgacaugggcuauuggauugaaucgcagaaaaauggaucauggaaacuggaaaaagcaucuuuuauagaaguuaagacauguacguggccgaagucucacacacuuuggaguaauggaguuuuggaaucggauaugauuauuccuaaaucccuagcuggccccauaucucaacauaaccauagaccagguuaucauacgcaaacagcaggaccuuggcaccuugggaaauuagaacuggacuuuaauuauugugagggcacaacagugguaauaacagaaaacugugguacaagagguccauccuuacggaccacaacgguuuccggaaaauuaauacacgaaugguguugcaggaguugcacucuaccaccauuaagauauaugggagaggaugguugcugguacgggauggaaauacguccaauaaaugagaaagaagaaaauaugguaaaaucauuaguaagcgcuggaaguggcaaggucgauaauuucaccaugggcgugcuuugcuuggcaauauuauuugaggaaguaaugagaggaaaauuugguaagaaacauaugauagcgggaguccuuuucacauucguacucuuauuaucaggacaaauaacauggcgcgacauggcacacacacuaauaaugauugguuccaacgcaucggauagaaugggcauggguguaacauacuuagcauugaucgccacuuucaaaauucaaccauuucuagcacuggguuucuucuuaaggaaacuaaccucacgagagaaccuuuuguuaggaguaggccuagcaauggcuacuacguugcaauuacccgaagacauagaacaaauggcaaauggaauagcacugggccuaaugacucuaaaauuaauaacccaauucgagacauaccaacucuggacagcccucguaucauuaacaugcaguaacaccauauucacacucacgguugcauggagaacugcuacccuuauacuagccgggguauccuuauuaccauuaugucaguccaguucuaugagaaaaacagacugguuaccuaugacuguagcagcaaugggcguuccgccacugccucuuuucaucuucucccuuaaagacacuccaaaacgaagaaguuggccgcuaaaugaaggaguaauggccguagguuuaguauccaucuuggcaucaagucuacugcguaaugacguccccauggcugguccccuaguugccgguggacuccuuauagcgugcuauguaauaacuggaacaucagcagauuuaacaguagagaaggcugcugauguaacgugggaagaagaagcugaacaaacuggcguuagccauaaccuuaugauaacaguagacgaugacgguacgaugcgaauaaaagaugaugaaacagaaaacaucuuaacaguacuacuaaaaacugcacuauuaauaguuucaggcauuuucccguacucaaucccagcgacacuacugguauggcacacauggcaaaaacaaacucagagaagcggaguucuaugggaugucccaagcccaccugagacccagaaagccgaacuagaagagggaguuuaucgaauaaaacagcagggcaucuuuggaaaaacucaagucggugugggaguacaaaaagaaggaguuuuucauacgauguggcacgugaccagaggagcaguccucacacauaaugguaagaggcuagaaccaaacugggccucaguuaaaaaggaucugaucucauacgguggggguuggcgauuaagugcacaguggcaaaaaggugaagaaguccaaguuauagcaguagaaccagguaaaaaucccaaaaauuuucaaaccaugccagggauuuuucagacaacgacaggcgaaauaggcgcaaucgcucuagauuucaaaccagggacuucuggcucgccaaucauuaaccgcgaaggaaaagugguugguuuguaugguaauggcguuguuaccaaaaacggaggauacguaucaggaauagcucaaacuaaugccgaaccggaugguccuacuccagaauuagaagaagaaauguucaagaaaagaaauuuaacgauuauggacuuacacccagguuccggcaagacacgaaaauaccugccggcuauuguccgcgaagcaauaaagagaagauuacgaacuuugauauuagccccuacaagggugguugcggcagagauggaagaagcacuuaaaggacucccuauacgauaccaaaccacagcgacuaaaagugaacacacgggacgggaaauaguugauuuaaugugucaugcuacguucacgaugcguuuauuaaguccugugagagugccaaacuauaauuuaguaauaauggacgaggcgcauuuuacagauccggcuucuauagcugccagaggauauauuaguacacgggucggaaugggagaagcagcagcuauauucaugacugcaacaccgccagguacagcugaagcauucccucagucuaacgcaccaauccaagacgaagaacgagauauaccagagcgaaguuggaacucagguaaugaguggauaacggacuucgucgguaaaaccgucugguuuguuccuaguauaaaagccggaaaugauauugcuaauugccugcgcaagaauggaaagaaagucauacaacuuucuagaaaaacguucgacacagaauaucaaaagacaagauugaaugacugggauuuuguugugacuacagauaucucugaaaugggagcgaacuucaaggcagaccgugucauugauccaagaagauguuugaagccaguaauacuaacagacggccccgaaagaguaauacuagcagguccgaugccggucacagcugcguccgccgcccaaagacggggucgaguaggucgaaacccucaaaaagaaaacgaucaauacauauucacaggccagccccugaauaacgacgaagaccacgcucauuggacggaagcaaaaaugcuauuagacaauauaaauacgccggaggggauaauucccgcccuauucgaaccugaacgugagaaaucagcagcaauagauggcgaauacagauuaaaaggugaaagucguaaaacauuuguagagcugaugcggcgaggagaucuuccaguauggcuugcgcacaaaguagcuagugaagguauaaaauauacagaucguaaauggugcuucgacggcgaacgaaauaaucaaauucuagaagagaauauggaugucgaaaucuggacaaaagagggcgaaaggaagaaacuacguccacgauggcuagaugcaagaaccuacucggaucccuuagcucucaaagaauuuaaagauuucgcagcugggcgaaaaucaauagcacuugaccuaguaacagaaauuggaagaguaccgagccacuuagcacaucguacacguaaugcguuagauaauuuaguuaugcuucacacgagcgaacauggcggcagagcauauagacaugcgguggaagaacucccugaaaccauggaaacauuacuacuacuggggcuaaugauucucuuaacaggcggagcuaugcuguuuuugauauccggaaaagguauuggaaagaccuccauuggccucauuuguguuauuguaagcagcggaaugcuuuggauggcggauguaccacuccaauggauagcaagugcuaucguauuagaguuuuucaugaugguuuuguuaauaccagagccugaaaaacagagaacaccacaagauaaucaauuagcguauguaguaaucggcauacuuaccuuagcagcaaucguagcugccaaugagaugggcuuacucgaaacaaccaagcgggaucuaggaaugagcaaagagccaggcgucguaucuccaacuuccuaccuugacguagaccugcauccggcaagugccuggacauuguaugcagucgcuacaacagucaucacaccuaugcuacgacauacaauagagaauaguacagcgaacguaaguuuggcagcuauagcuaaucaagcgguaguguugaugggguuggacaagggauggccaauaucgaagauggauuuaggcguaccgcuucuugcguuaggguguuacagccaggugaauccacuuaccuuaacagcagcaguauuacuccucguuacgcacuacgccauaaucggcccagggcuacaagcaaaggcuacgagagaagcacagaaaagaaccgcugcuggaauaaugaaaaauccgacuguggacgggauaaugacaaucgauuuagauccaguaauuuaugacucaaaguuugaaaagcagcucggacaaguaaugcugcucguuuuaugugcugugcaauugcuccuaaugagaacaucaugggccuuaugugaagcccugacguuagccacugggccaauaacaacacuuugggaaggcucaccaggaaaauuuuggaauacuacuauugcuguuucuauggcaaacauuuucaggggcucauauuuagccggugcuggacuagcguucaguauuaugaagucuguuggaacgggaaagcgcggaaccggcagucaaggugaaacuuuaggugagaaauggaaaaagaaauuaaaccaguugagucgaaaagaauuugaccuauauaagaaaucugguaucaccgaaguagaccguucagaagcaaaagaaggccuuaagcguggagaaacgacacaucaugcagucagucgaggaucugcaaaguugcagugguuugucgaacgcaacaugguuauccccgaaggaagagucaucgauuuaggcugcggaagaggaggguggucguauuauugugcgggucuuaagaaaguaacggaagucaggggguauaccaaaggcggaccuggccaugaggaaccaguuccaaugucaacauauggauggaacauagucaaauuaaugagcggcaaagauguauucuauuuaccaccugaaaaaugcgacacccuccugugugacauaggagagucuaguccaaguccgacaguugaggaaagucgcacaauaagagucuuaaagaugguagagcccuggcugagaaacaaccaguuuuguaucaaaguccugaauccuuauaugcccacagucauagagcauuuagaaagauugcagcgcaaauacggaggaaugcuaguacguaauccccuaagcaggaauaguacccaugaaauguauuggauauccaaugguacuggaaauauaguaucgucaguaaauaugguuaguagacuguuauugaaucgauuuaccaugacacacaggcgucccacaaucgaaaaagauguagauuuaggugccggcacacggcacguuaaugcggagccagagacgccaaacauggauguaauaggagaaagaaucaaaagaauaaaagaggagcacagcucaacguggcauuacgacgaugaaaauccuuacaaaacuugggccuaucacgggucauaugaaguuaaagcgacugguagugcuucuucaaugauaaauggaguagugaaacuuuuaacaaaaccaugggacgugguacccaugguaacucaaauggcuaugacggauaccacuccauuuggucaacaacgaguauuuaaagaaaaaguugacacaagaacaccuagaccuaugccggguacaaggaaaguaauggagauaacagcugaauggcuauggcgaacucuaggacgcaauaagaaacccagauuaugcacccgugaagaauuuacuaagaaaguacgaacuaaugcagccaugggagcuguuuucacugaagaaaaccaaugggacucggcaagggcagcaguagaagacgaagaguucuggaagcuaguagacaaagagcgugaacugcauaagcuaggaaaaugcgguucuuguguguacaauaugaugggcaaacgggagaagaaauuaggcgaguucgguaaagcaaaagguucacgugcaauaugguauauguggcuuggugcacgcuaucuggaauuugaggcauugggcuuucucaacgaagaucauugguuuucaagggaaaauaguuauucuggugucgaaggugaaggacuucacaaacuuggauacauauuacgggauauaucuaaaauuccgggaggcgcaauguaugcggaugauacagcaggaugggacacuagaauuacggaagaugaucuccacaaugaagagaagauaacacaacaaauggaccccgaacaccggcaacucgccaaugcaauuuucaaauuaacauaccagaauaaggugguaaaaguccaacguccaaccccgaaaggaacgguaauggauauaauuucuaggaaagaucaaagaggcucagggcaaguagguacuuacggacuaaacacguuuacaaauauggaagcucagcuagucagacaaauggaaggagaggguguuuuaagcaaagcagaucucgagaauccgcaucuucucgagaaaaagauaauucaguggcuagaaacuaaagggguugaaagacugaaacgaauggcaauaagcggggaugacugcgugguaaaaccuauugacgaucgauuugcgaacgcauuguuagcccuaaaugacaugggaaagguacgcaaagacauuccacaauggcaaccaagcaaaggauggcaugacuggcagcagguccccuuuugcagucaucacuuucaugaguuaauaaugaaagauggccgaaaauuaguuguaccaugucggccacaggaugaacugauuggcagggccagaauaucacaaggcgcaggauggagucugaaagaaaccgcuuguuugggaaaagcguaugcacaaauguggucccuuauguauuuccacagaagagaccuaagacuagccucuaacgcaauauguucggccguuccaguacacuggaucccaacuagcaggaccacguggucaauacaugcacaccaucaauggaugacgacggaagauaugcuaucaguauggaaccggguauggauugaagauaaucccuggauggaggauaaaacaccugugacuacaugggaggauguuccauaucuagguaagagagaagaucaaugguguggaucuuuaauaggcuuaaccagccgagccacaugggcacaaaauauucugacagcaauccagcaaguccgaucucucauuggcgaugaagaguuccuugauuacaugccgucuaugaaaagauuucgaaaagaagaagagucugaaggcgcuauaugguag

SEQ ID NO: 23111 - RNA, 9873 nt, Artificial Sequence
  derived and/or modified CDS sequence (opt6) from DENV-3__GU131933__SS-prME
accaguuuauguuugaugaugaugcuuccagcgacucuagcuuuucaucuaacuucuagagauggagaaccgcguaugauugugggcaaaaaugaacgugggaaaagccugcuauuuaaaacggcuucaggaaucaauauguguacacuaauagcaauggauuuaggagaaaugugugacgauacaguuacguacaaauguccucucaucgcagagguggagccagaagauauagacuguugguguaaucucacuuccacaugggucacuuaugguacaugcaaccaagcuggugaacaccgccgggauaaaagaagcguagcauuagcuccacauguagguaugggauuagacacaagaacccaaaccuggaugucagcugaaggugcauggcgacaaguagagaaagucgaaacuugggccuugcggcacccgggauuuacaauauuagcacuguuccucgcacacuacauugggaccucauuaacccaaaaaguagucauauuuaucuuauuaaugcuugucacaccuucuaugacaaugaggugcguuggaguugggaauagggauuuugucgaaggguuaucaggugcgacauggguagauguuguguuggaacauggaggauguguuacaacuauggcaaaauccaaaccaacauuagauauugagcuacagaaaacagaggcaacccaauuagcaacguuacguaaacuaugcauagaagggaaaauuacuaauauaaccacagacucacgauguccaacacagggggaagcaacuuuaccagaagaacaagaccaaaauuauguuuguaaacacacuuauguagauagggguuggggaaacgguuguggacuauucggaaaaggcuccuuggucacaugugcaaaauuccaauguuuggaacccauugaagguaaagucguacaauacgaaaaucuaaaauacacagugauuaucacuguacacacaggagaccaacaccaaguaggaaaugacacgcaaggagugacagucgagaucaccccgcaagcaucaacagucgaagcaguacugccugaauauggaacucugggacucgagugcaguccgcggacaggccuggauuuuaaugaaaugauuuuauuaacuaugaaaaauaaagcauggaugguacacaggcaaugguucuuugaucuuccacuccccuggaccucuggcgcuacuacagagaccccaacuuggaaucguaaagagcuguugguaacauucaaaaacgcccacgcuaagaaacaagaaguaguaguacuaggcagucaggaaggugcaaugcauacugcacucacgggagccacagaaauucagaacagcggaggaacguccauuuucgcuggucaccuuaaaugccgcuuaaaaauggacaaauuagaacuaaaaggcaugucuuaugccaugugcuuaaauacguucguauuaaagaaagaagugagcgagacucaacauggaacuauccuuauuaaagucgaauacaaaggagaagaugcaccgugcaaaauaccuuucagcaccgaggacggacaaggcaaagcacauaaugggagauugaucacggcgaauccuguaguuacuaagaaagaagaaccggucaauauagaagcugaaccgccuuuuggugagucuaauauagucauugguauaggagauaaggcuuuaaaaaucaacugguacaagaaagguuccucgauaggaaaaauguucgaagcgacagcucguggugcucgacguauggcgauacuuggggauacggcaugggauuucggaagugucggcgggguccuaaauucauuggggaaaauggugcaccaaauauuuggaagugcauauacugcccuuuuuaguggggucucauggaucaugaaaauaggaauagguguauuacuaacuuggauuggguuaaauaguaaaaauaccucaaugucauucucguguauagugauaggaaucauuacauuauaucucggagcuguagugcaagcagacauggguugugucauaaacuggaaaggaaaagaauuaaaaugcggguccggcauuuuugucacaaacgaaguccauacauggacugaacaauacaaauuucaggcagacucgcccaaaagauuagcgacagcgauagcgggggcaugggaaaauggcguauguggaauuagaucaacgacuagaauggaaaaucuauuauggaaacagaucgcuaaugaauugaauuauaucuuaugggaaaauucaauaaagcuaacaguaguaguaggugauauaauaggagugcuagagcaaggaaaaagaacacuaacgccgcaaccaauggaguuaaaauauuccuggaaaacguggggaaaggcgaaaauagugacagcagaaacacaaaauagcucuuuuauaauagaugguccaaauacuccugaauguccaucugcuagcagagcguggaacgucugggaaguagaagacuacgguuuugguguguucacuacgaauauaugguugaaauuacgagaaguauauacacaauccugcgaccacagacucaugagugcagccauaaaggacgaacgagccguacacgcagauaugggauacuggauugaaucgcagaaaaaugggagcuggaagcucgagaaagcaaguuuuauagaaguaaagacaugcacauggccaaaaucacauacuuuauggucgaacggaguacuugaaucagauaugauuauuccaaaaagucuugcagggccaaucucccaacauaaucaucgcccaggcuaucauacacaaacagccgguccauggcaucuagggaaguuggaacuugauuuuaacuacugcgaagguacaacuguugugauaaccgagaauuguggaacuagaggaccgaguuugcgcacaaccaccguaucggguaaacuaauucaugaauggugcugucgaagcuguacauuacccccucucagauacaugggagaggacggauguugguauggcauggagaucagaccaauuaaugaaaaagaagaaaauauggugaaaucacugguaagcgcuggaagugguaaaguggacaauuucaccaugggaguauugugccuugcaauccuguucgaggaagucaugagggggaaauuugguaaaaagcauaugauagcaggcguccuauucaccuucguucuauuacuuucaggacaaaucacauggcgugauauggcccacacauugauaaugauagguucgaaugcuagcgauagaauggguaugggcguaacauacuuagcccuaaucgcuacauuuaagauacaaccauuucuagcgcugggauucuuuuuaagaaaguugacaaguagggaaaauuuacuguugggcgugggucuagcaauggcuaccacauuacagcuaccagaagauauagagcaaauggcaaacgguauagccuuaggcuuaaugacacuaaaauuaauuacccaauuugaaaccuaucaacucuggaccgcguuaguaucguuaacuugcucaaauacgauuuuuacuuuaacaguugcuuggagaacagccacacuuauauuagcuggagugucucuauuaccauuaugucaguccagcucaaugcguaaaacggauugguuaccaaugacuguugcugcuaugggcguaccuccuuugcccuuauuuauuuuuaguuugaaagauaccccaaaaagacgcucauggccauuaaaugaaggugucauggcaguaggccugguaaguauucucgcaucuaguuugcuccguaacgaugugccaauggccggaccuuuaguagccggugguuuauuaauagcguguuauguaauaacagggacgagcgcggauuuaacuguggagaaagcugcugaugucacgugggaagaagaggcugagcagacuggggucagccacaaucuuaugauaacagucgacgacgaugggacaaugagaauuaaagacgaugaaaccgagaauauucuaacaguccucuugaagacagcacuacuuaucguuagcggcauauucccauauucuauaccagcaacauuacugguauggcauacuuggcagaagcaaacucaaagaucagguguguuaugggacgugccaaguccacccgaaacucaaaaagcugaacuagaagaaggaguauacaggauuaagcagcaaggcauauuuggaaagacucaaguuggagucgggguccaaaaagaaggagucuuucacacaauguggcauguaaccagaggagccguauuaacucacaaugggaaaagauuggaaccgaauugggcaucagucaagaaagaucuuaucucauauggggguggcuggcgacuaucggcacaauggcagaaaggagaagaggugcaaguuauagcuguugagccagguaaaaaucccaaaaauuuucaaaccaugccaggaauauuucaaacuacaaugggagagauaggugcaauagcacucgauuuuaagccagggacaagcggcucuccgauuauuaacagggaaggaaagguuguugguuuauacggaaauggaguggugaccaaaaauggggguuacguuucugguaucgcacagacuaacgcugaaccugauggcccaacaccggaacuggaggaagagauguucaagaaaagaaacuuaaccauuauggaucugcauccgggaucugggaagacaaggaaauacuugccugcaauugugagagaggcgauaaaaagacgguugaggaccuugauauuagcuccaacaagggugguagccgcggagauggaagaagcacuaaagggauuaccaauaagauaucaaacgacagcuacaaaaagugaacauacaggaagagagauuguugaucuaaugugucacgcaacauucacaaugagauuacuaaguccaguacgaguaccaaauuauaaccuaguuauuauggaugaagcacacuucacagacccggcgaguauagcagcuaggggauauaucagcacuagaguaggaaugggcgaagcagcugccauauucaugacggcaacuccuccugguaccgcugaagccuuuccgcaaucuaacgcacccauacaggacgaggaaagggauauaccagaaagaucauggaauagugguaacgaauggaucacggauuucguugggaaaacggugugguucguaccuaguaucaaagcaggaaaugauaucgcuaacugccuacgaaagaacggcaagaaagucauucaauuauccagaaaaacguuugauacugaauaccagaaaacgagguuaaacgacugggauuuugucguaacaacugauauuucagaaaugggcgcuaacuuuaaagcagaucguguaauagauccaagaaggugucucaagccagucauauugacagauggcccugaacgaguaauccuggcaggaccgaugccaguaaccgcagcaagcgccgcucaaaggagaggaagaguaggaaggaauccacaaaaagagaaugaccaguauauauuuaccggccaaccauuaaauaaugacgaagaucaugcccauuggacugaggcuaagaugcucuuagauaauauaaauaccccugaagggaucauaccugcauuauucgaaccagaaagagagaaaagcgcagcuauugauggugaauauaggcuaaaaggggaaucuagaaaaacguuuguagaacuaaugcgacgaggugacuugccugugugguuagcacacaaagucgcaucugaagggauuaaguacacggauagaaaaugguguuuugacggggagcgcaacaaccaaauucuggaagagaauauggacguagaaauauggacuaaagaaggagaaaggaagaaacuaagaccuagaugguuggacgcacgcacauauucagauccauuggccuuaaaagaauuuaaggacuucgcggcuggcaggaaaaguaucgcacucgauuuaguaaccgaaauaggucgggucccaagucacuuggcacacagaacuagaaaugcucuagauaauuugguaaugcuacauacgagcgaacauggaggcagagcuuaucgacaugcaguagaagaacuaccugaaaccauggaaacacuauuacuucuagguuugaugauuuuguuaaccgggggagcuauguuguuucuaauaaguggaaaggguauaggaaaaacaucgaucggauugauuuguguuauagccagcaguggaaugcuuuggauggcagacgucccccuacaguggauagcaagcgcaauugugcuugaguucuucaugaugguauuacuaauuccggagccagagaaacaacguaccccgcaggauaaccaguuagcguacguggucauaggaauauuaacgcuugcagcaauaguagcggcaaacgaaaugggucuucuagaaacgaccaaaagagauuugggaaugucaaaagagccaggaguaguuagcccuacgucuuaccuagacguggaccuacacccugcaucugcuuggacauuguaugcuguugcgacgacaguaauaacuccuauguuacgacacacuauagaaaauuccacugcuaauguguccuuagcggcuauugcgaaucaagcaguaguacuuaugggauuagauaaggguuggccgauaucuaaaauggauuuaggcgugccccuccuggcuuuaggauguuacucucagguaaauccacucacacuuacagcggcgguccuauuguuaguaacacauuaugccaucauuggaccaggauugcaagccaaggcuacuagagaagcgcagaaaagaaccgcugcggggauuaugaagaauccaacgguugacggaauuaugacaauugacuuagauccugucauauaugacucaaaauuugagaagcaacuaggacaaguaauguuguugguauuaugugcuguccaauuacuguuaaugcgaaccaguugggcauuaugcgaggcacuuacgcuagccacuggaccuauaacgaccuugugggaaggaucaccuggaaaauuuuggaacaccaccauagcuguuaguauggcaaauauuuuuagggguaguuaccuagcuggagcgggauuagcuuuuaguaucaugaaauccgucgguacaggaagacgagggacugguucgcaaggagaaacacuuggagaaaaauggaagaagaaacuuaaccagcucaguaggaaggaauuugauuuauacaaaaagaguggaauaaccgaagucgauagaacagaagcuaaagaaggacucaagagaggagaaacaacacaccaugcuguaagcaggggaucugcaaaauuacaaugguuuguggaaagaaacaugguaaucccagaagguaggguaaucgacuuaggaugugguaggggaggauggaguuauuacugugcgggccucaagaaagugacagaggucagagguuauacuaaaggagguccgggccacgaggagccaguaccuaugaguaccuacgguuggaacauagugaaacuaaugaguggaaaggacguauucuacuuaccaccugaaaaaugugauacacucuuaugcgauauaggggagagcucaccaucaccuaccgucgaggaaucccgaacaauuagaguguuaaaaaugguagaaccauggcucagaaauaaucaguucuguauuaaaguguuaaacccauacaugccgacuguaaucgagcauuuagaaagauugcagagaaaauauggugguaugcucguuaggaacccacuaaguagaaacucaacucacgaaauguauuggauaagcaauggcacuggaaacauugugucguccguaaauaugguaagccguuugcuauuaaacagauuuaccaugacgcauaggcgaccgacaaucgaaaaagauguggauuuaggugccggcacacgacauguaaaugcggaaccugaaaccccaaauauggauguaauaggugaacgaauaaaaagaauuaaggaggagcauucaucgacauggcauuaugacgacgaaaaccccuauaaaacaugggcuuaucacgggucauacgagguuaaagcuacugguucggcaagcaguaugauaaauggagucgugaaacuucuuaccaagccuugggauguuguucccauggugacgcaaauggcgaugacugauaccacaccauuugggcagcaaagaguuuucaaagaaaagguagacacccguaccccacgaccaauggccgggacaaggaagguuauggaaauaacagcagaaugguuauggcgcacucuugguagaaacaaaaagccuagacucuguacaagggaagaguucacuaagaaaguuaggacgaaugcagcaaugggcgccguguucacagaagaaaaucagugggacagcgcaagagccgcuguagaggacgaagaguuuuggaaacugguugaucgcgaaagagaauuacacaaacuaggaaaaugcggaucaugcguuuacaauaugauggguaaaagagagaagaaauuaggugaguuuggaaaggccaaaggaaguagggcgauaugguacaugugguuaggagcgcgauaucuugaguuugaagcucuuggauuucuuaaugaagaucacugguucaguagagaaaacaguuacaguggcgucgaaggagaagggcuucacaaguuagguuacauacugcgggacauuucaaaaaucccagggggagccauguacgccgacgauacagcaggaugggauaccagaauaaccgaggacgauuuacacaacgaagaaaagauuacacaacaaauggaccccgaacaucgucagcuugcgaaugcaauuuucaaauuaacauaucaaaacaaagucguuaaaguucaacgaccaacgcccaaaggaacuguaauggauauaaucaguagaaaagaucagcgaggaucagggcagguugguacauauggacuaaacacauuuacuaacauggaagcgcaguuaguaaggcaaauggagggugaaggaguacuaucuaaggcugaucuagaaaauccacaccuacuagagaagaaaauaacccagugguuagaaacaaaggguguugaacgccuuaaaagaauggcaauaucaggagaugauugcguagugaagccgauugacgaccgauucgccaaugcauuauuagcucuaaaugacauggggaaaguaagaaaggacaucccgcaguggcagccuagcaaaggcuggcaugauuggcaacaaguacccuuuuguagucaucauuuccaugaauugauaaugaaagacgggaggaaguugguagucccaugucggccacaagacgaguuaauaggaagggcacggauaucacaaggcgcuggauggagucuaaaagaaacagccugcuugggcaaagccuacgcacagauguggucucuaauguacuuucaucgaagagauuuaagauuagcaagcaaugcaauaugcucugcuguccccguacauuggauacccaccucgcgcaccacauggucaauccaugcacaccaucaauggaugacaacugaggauauguugacuguauggaauagggucuggauagaagauaaucccuggauggaagacaaaacgccaguuacaacuugggaggauguuccauauuuagguaaacgagaggaucaguggugugggucguuaaucggccuaacuagcagagccacuugggcccaaaacauucuaacugcuauccaacagguaaggagcuugauaggagaugaagaauuucuugauuacaugccaaguaugaagagguuuagaaaagaagaagagucugaaggagcaauuugguag

SEQ ID NO: 23112 - RNA, 9873 nt, Artificial Sequence
  derived and/or modified CDS sequence (opt6) from DENV-3__GU131934__SS-prME
acuucacuguguuuaaugaugaugcugccagcuacacuugcuuuucacuugacaaguagagauggagaacccagaaugauugucgggaaaaaugaacguggaaaaaguuugcuuuuuaaaacggccaguggaaucaauauguguaccuugauugcuauggauuuaggagagaugugcgaugauacggugacauacaaaugcccucuuaucgcagaaguggaaccagaagauaucgauugcugguguaauuuaacuagcaccuggguuaccuaugguacguguaaucaagcgggugaacacagaagagacaaaagaagcguugccuuggcuccgcauguagguauggggcuagacacaagaacacagacauggauguccgcagaaggagcuuggagacaaguagaaaaagucgaaacaugggcauuaagacacccggguuucacgauauuggcacuuuuccuagcccauuauauagguacgagccuuacccagaaaguaguaaucuucauauuacuaauguuaguaaccccauccaugacaaugaggugugugggggucggaaaucgggauuuuguggagggauugucgggugcaaccuggauugauguaguucuagaacacgggggauguguuacaacaauggcgaaauccaaacccacuuuggacauugaacuucagaaaacugaagcuacucaauuagcaacucuucguaaauuguguaucgaaggaaaaaucacuaauauaacgacugacucacgauguccaacacaaggagaagccacgcuaccggaggaacaagaucaaaauuauguuugcaaacauacguauguugaucgaggauggggcaacgguugcggccuuuucgggaaaggaagucuugucaccugugcaaaauuccagugccuugaaccgauagaggggaaaguaguucaguaugaaaauuugaaauauacugucauuauuacaguucauacuggagaccaacaccagguagggaaugauacacaagguguaacaguugagauaacuccucaagcguccaccgucgaagcaguacuaccugaauauggaacauuagguuuagaauguucaccacgaacuggcuuagauuuuaaugaaaugauauuacuuacaaugaaaaauaaggcuuggaugguccacagacagugguucuuugaucuaccacuacccuggacgaguggcgcuacaacagagacaccgaccuggaaccgaaaagaguuauugguuacguucaaaaaugcucacgcuaagaaacaggaaguaguuguauuaggcucacaggaaggugcgaugcauacugcacuaacaggggcuaccgaaauccaaaauucaggaggaacuuccauuuuugccggucaccuuaaaugucgacuuaaaauggacaaauuggaacugaaagguaugucauaugccauguguuuaaacaccuucguucuaaagaaagaaguuucugagacacaacacggaaccauauuaauaaaagucgaauacaaaggugaggacgcgccgugcaaaaucccuuuuaguaccgaagacggacaagggaaagcccacaacggcagguuaauuacagccaauccuguaguaaccaagaaagaagaaccgguaaauauagaagcagaacccccauucggggagagcaauauugugaucgguauaggagauaaagcguuaaaaauaaauugguauaagaaagguuccucaauagguaaaauguuugaagcaacggcuagaggagcuagaaggauggcaaucuuaggggacacagcaugggauuuuggaagcguaggagggguauugaacagccuaggaaaaaugguacaucaaauauucggcuccgcauacacagcauuauucagcggaguuucguggauaaugaaaaucggcauaggcguauuacuaacuuggauuggacuaaauuccaaaaauaccagcaugagcuucaguugcauaguaauaggugucaucacucuauaucuuggcgcgguaguacaggcagauaugggauguguuauuaauuggaaagggaaagaguuaaaaugcggaaacggaauauuuguuaccaacgaagugcacacauggacggaacaauauaaauuucaggcagacucucccaaaagauuagcaacagcaauagcuggagcaugggaaaauggaguuugcgguauaagaagcacaacuaggauggaaaauuuacuuuggaaacagauagcaaaugaacucaauuacauacuaugggaaaauaauauuaaauuaacuguuguugucggcgauauaauagguguccuagaacaaggcaaaagaacuuuaacgccacagccaauggagcucaaauauucuuggaaaaccuggggaaaagcgaaaauuguaacugcagagaaucaaaauucuucauuuauaauugauggcccuaacacaccugaaugcccaucugccucgagagccuggaacguaugggaagucgaagauuacgguuuuggaguauuuacaacuaacauuuggcuaaagcuccgggaaguauauacacaaagcugcgaccauagauugaugucggcggcaauuaaggaugagagggccguacaugcagauaugggcuauuggauugagagucagaaaaauggaagcuggaaguuagaaaaagcaaguuucaucgaaguuaaaaccuguacauggccgaaaagucauacuuuguggucgaacgguguacuugaaagugacaugaucauaccaaaauccuuagcuggcccuauaagucaacauaaucaucggccuggcuaucauacucagacagcagggccuuggcaucucgguaagcuagaacuagacuucaauuacugugagggaaccaccgucguaauagcugagaauuguggaacucgaggcccaaguuuaaggacaacaaccgucagugggaaauuaauccacgaaugguguugcagaucauguacacuuccuccacuucgguacaugggugaagacgguuguugguacggcauggaaauaagaccaauuaaugaaaaggaagaaaauaugguaaaaucgcuaguuucugcugguuccgguaagguggacaacuuuacaauggggguacuaugcuuagcaauucuuuuugaagaagucaugaggggaaaguucgguaaaaagcacaugauagcaggaguuuuguuuacauuuguacuacuucuaucaggacaaauuacguggagagauauggcacacacauuaauaaugauaggcagcaaugcaagcgaucgcaugggaaugggugucacuuauuuagcuuugaucgcuaccuuuaaaauacaaccauuuuuggcacuaggcuucuuucugcgaaaacuaacaaguagagaaaaucuauuacugggagugggguuagcuauggcgacuacccuccaacucccagaagauauugagcaaauggcaaauggaaucgccuuaggacuaaugacacuuaaacuaauaacacaauuugagacauaccaacuuuggacggccuuggugagccugacauguaguaauacuauauuuaccuugacgguggcuuggaggacagcaacucuuauauuagcuggaguaaguuuauugccuuuaugucaaagcucgucuaugagaaaaaccgacuggcucccaaugacaguugcagcgaugggugugccuccuuugccccuguucauauuuuccuugaaggauacgccaaaacgaagaaguuggccccuuaaugaaggaguuauggcuguuggauuagugucuauucucgcaucuucucuauuaaggaacgauguacccauggccggaccucuugucgccggaggccuacucauugcauguuacguuaucacgggaaccucugcggaucugacaguagaaaaggccgccgauguaacaugggaagaagaagcagaacaaacaggugugagucauaaucuaaugaucacgguugacgacgacgguacgaugcguauaaaagaugacgagacagagaauauuuugacaguguuacuaaaaacagcuuuauuaauaguaucagggauauucccguauucuauuccugcuacauuauuggucuggcauacauggcaaaaacaaacacaaaggagcggaguacuaugggacgucccuucuccuccagaaacccaaaaagcugagcuggaagagggcguauauagaaucaagcaacaaggaauauuuggaaagacgcaagugggaguagguguccaaaaggaaggcgucuuccauaccauguggcaugugacaagaggagcuguauuaacucacaacggaaaaagauuagaaccgaauugggccucgguaaagaaagaccuuauaucuuacggagggggauggcgacuaucagcucaauggcaaaaaggugaagaaguccagguaauagcaguggaaccggggaaaaacccaaagaauuuucagacaauuccugggaucuuccaaaccacaacgggugaaauuggugcuauugcccucgacuucaaaccaggcaccagcggaucgccgauuauaaacagagaggggaaaguuguuggcuuauaugguaauggagugguaacuaaaaauggugguuacgucucuggcauagcucagacaaacgcggaaccggaugggccgacgccagagcuagaggaagaaauguuuaagaaacgaaacuuaacaaucauggacuuacauccggguaguggcaaaacaagaaaauaucucccggcgauaguuagagaagcgauaaagcgaagacuacggacauuaauacuagcuccaacacgaguaguugccgcugaaauggaagaagcacucaaagguuuacccauacgguaccaaaccacagcaacaaaguccgaacauacaggaagagagauaguugaucuuaugugucacgccacuuucacaaugagacucuugucuccgguaaggguucccaauuauaaucuaguuauaauggaugaagcacacuuuacagacccagcaaguaucgcggcuagaggauauauaaguaccagaguuggcaugggggaagcggcagccaucuuuaugacagccacaccgccagggacagcagaagccuuuccucaaaguaaugcucccauacaggaugaagagagagauaucccugaacgcaguuggaacucaggaaacgaauggauaacagacuucguaggcaaaacaguaugguuuguuccgucuaucaaagccgggaaugacaucgcuaacuguuugaggaaaaaugguaaaaagguuauacaacuuaguagaaaaacauuugauaccgaauaucagaaaacucgacugaacgacugggauuuuguggugacgaccgauauuagcgaaaugggugcaaacuuuaaagcagacagagugauagauccgcgccgcugcuuaaaaccgguuauacuuacagauggcccugaacgcguuauuuuagcgggcccuaugccaguaacagcggccucagcagcgcaacgaagaggccgggucgguaggaacccucaaaaagaaaaugaccaauauauauuuacaggucaaccguugaauaacgaugaagaucacgcacauuggaccgaagccaaaauguuacuagacaacauaaacacacccgaaggcauuauaccagcucuauuugagccagaacgagaaaaaucagcggccauugacggagaguauagauugaaaggugaaucucgaaaaacuuuuguagaauuaaugagaagaggugaccuaccaguaugguuggcgcacaaaguugcaagugaagguauaaaauauacagacagaaagugguguuuugauggggaaagaaauaaucaaauauuagaagagaacauggauguugaaauuuggacuaaggagggagaaaggaagaaauuacgaccuagauggcucgaugcuagaacuuauucugauccguuagcucuuaaagaauuuaaagacuucgccgcaggacggaagucgaucgcauuagaucuggugaccgaaauaggccguguaccaucucaucuggcccacagaacacgcaacgcucuagacaaccuaguuaugcuacauacaucagaacauggaggcagagcauauagacacgcuguggaagaacuuccagaaaccauggaaacacuacugcuacuuggucucaugauucuccuaacaggaggggcuauguuauuuuuaaucagcggaaaggggauuggcaaaacaaguauaggauuaauaugcgugauuguaaguaguggaauguuauggauggcugauguuccgcuacaauggauagccuccgcaauuguccucgaauuuuucaugaugguuuugcucauuccagaaccagagaaacaacggacgccgcaagauaaccaacuagcuuauguuguuauugguauucuaacucucgcagcuauaguugcugcgaacgaaaugggccuacuggaaacaacuaaaagagaucuuggaauguccaaggaaccaggaguugugucgccgacaucuuaucuagacguagaccuccacccagcgucggcauggacacuauacgcuguagcuacaacuguaauuacgcccaugcuuaggcauacuaucgagaacagcaccgccaacguaucucuugcagcgaucgcuaaccaagcaguuguucugaugggacuugauaaaggauggccaauuucuaaaauggacuuaggcguacccuuguuagcacucggauguuauagucagguuaauccucuuacucuuacugcagcugucuuacuauuagucacccauuaugcaauuauaggcccuggcuugcaggcuaaggcuacccgagaagcacaaaagagaacggcagcggguauaaugaaaaauccaacagucgacgguaucaugacaauagaucuagauccgguaaucuaugauagcaaguuugaaaaacaacuaggucagguaaugcuccugguguugugcgcuguacaauuacuucugaugcgcaccucaugggcacuuugugaagccuugacgcuggcuaccgguccaauaaccacacuuugggaaggcucgccaggaaaauuuuggaacaccacgauugcuguuagcauggcgaauauauuucgaggaagcuaucuagcaggagcaggauuggcguuuucgaucaugaagaguguaggaacugggcggcgagguaccgggucucaaggggaaacucuuggagaaaaauggaagaagaaacuuaaucaacugucucgaaaagaguucgaccucuauaagaaaucuggaaucacagaaguugauaggaccgaggcuaaggaaggacucaaacgaggggagacuacgcaucacgcagugagucggggaucugcaaagcuccaaugguucgucgaaagaaauaugguaaucccagaaggaagaguaauagaccuagggugugguagaggcggauggucauacuacugcgcaggacucaagaaagucacggagguaagaggauauacuaaagguggcccuggucacgaagaacccgugcccaugucaacguacggcuggaacaucguuaaacuuaugucuggaaaggauguauuuuaucucccuccggaaaaaugcgacaccuugcugugugauauuggagaaucaagcccaagcccuaccguagaggaaaguaggaccauucgaguguuaaagaugguugaaccguggcuuagaaacaaucaguuuugcauuaaaguauuaaacccauauaugccaacugucaucgagcacuuagaacgauuacaacguaaauaugggggaaugcuaguaaggaauccucuaucuaggaacucgacgcaugaaauguacuggauuaguaauggcaccggcaacauagugucaucuguuaauaugguuagucggcucuuauuaaauagauucacgaugacacauagaaggccuacuauagaaaaggaugucgacuuaggugccggcacuaggcacguuaaugcggaaccagaaaccccuaacauggauguaauaggggagaggauuaaacguauaaaagaggaacacucgaguacuuggcauuacgacgaugagaauccauauaaaacaugggcguaucacggaagcuaugaaguuaaagcuacagguagcgcgucuucuaugaucaacggaguaguaaaacuuuugacgaagccgugggauguaguaccaaugguuacacaaauggcaaugacagauacaacaccguuuggucagcaacggguauucaaggaaaagguagacacucguacgccacgaccgaugccgggaacccggaaaguaauggaaauaacagcagaauggcuauggagaacauugggacguaacaagaaaccacgauuguguacucgagaagaguucacuaaaaagguaagaacgaaugcugcuaugggugcggucuuuacagaagagaaucagugggauagcgcuagagcagccguagaagaugaagaguucuggaaauuaguggacaaagaaagagaauuacauaaauugggaaagugcggguccugcgucuauaauaugauggguaaaagagaaaagaaauuaggagaauuugggaaagcaaaagguucgagagcaauaugguauauguggcuaggugcaagauaccuugaguucgaggcguugggauuucuaaaugaagaucacugguuuagucgggaaaacagcuauucuggaguugagggggaaggguugcauaaacuaggauacauucuucgggauauaucaaagauacccgguggugcuauguacgccgaugacaccgccggcugggacacucggauuaccgaggaugaccuucauaaugaagagaaaauaacucagcagauggauccggaacaccgacaacucgcaaaugcaaucuuuaaacucacuuaucaaaacaaggucgugaagguacaaagaccgacucccaaaggaacaguaauggacauuauuucaagaaaagaccaaagaggcucgggucaaguuggcacguauggauugaauacauucacaaauauggaagcacagcuagugcgucagauggagggggaagguguacucucaaaggcggaccuagaaaauccucaccuauuagagaagaaaauaacccagugguuagaaacaaaaggaguugagcgacuuaaacgcauggccauaagcggagaugacuguguaguaaaacccauugaugaccgcuuugcaaaugcgcuguuggcauuaaaugacaugggaaaagugagaaaagauauaccacaguggcagccgaguaaaggcuggcaugacuggcagcagguccccuucugcagucaucauuuucaugaacucauuaugaaagauggaagaaagcuagucgucccuugcagaccacaagacgaacuuauaggcagagcaaggauaagccaaggugcaggauggucgcuaaaagagacugcguguuuagguaaagccuaugcccagauguggagucuuauguacuuccacagaagagaccuuagauuagcuagcaaugcaauuuguagugcugucccgguucauuggauaccuaccucaagaacaacuuggagcauucaugcgcaucaucaauggaugacaacugaagacaugcuaaccguauggaauagagucuggauagaggacaauccuuggauggaggacaaaacaccagugacaacgugggaagacgucccauacuuaggaaaacgagaggaccaauggugugggagcuugauugggcuuacuagcagagccacgugggcacagaauauauuaacagcaauacaacagguucggaguuugaucggugaugaagaauuuuuggauuacaugccuaguaugaaacgauuuagaaaagaagaagaaaccgagggcgcuauaugguga

SEQ ID NO: 23113 - RNA, 9873 nt, Artificial Sequence
  derived and/or modified CDS sequence (opt6) from DENV-3__GU131935__SS-prME
acaagucuuuguuuaaugaugaugcugccagccacucuugcguuucauuuaacuagccgugauggagaaccgaggaugauuguugggaaaaaugaaaggggaaaaucacuuuuauucaaaacugcaagcggcauaaauaugugcacucuaauagcuauggaucuuggugaaaugugcgaugauacagugacguauaaauguccauugauagcagaaguagaaccagaagauaucgacuguugguguaauuuaacaaguacuuggguaaccuaugggacuuguaaucaggcgggugaacaucguagggacaaacgaagcgucgcucuugcgccucacguaggaaugggauuagacacaagaacucagacuuggaugagcgccgaaggagccuggcgucaaguagaaaaaguagaaacaugggcauugagacacccagguuucacuauacuagcgcuauuucuagcucauuacauaggaacauccuugacacagaaagugguaauauuuauacugcugaugcuugucacaccaaguaugacaaugagauguguuggaguagguaaucgagauuuugucgaaggccuaucaggagcaacuuggguagacguuguauuggaacacggcggauguguuacaacuauggcaaaaaguaaaccaacuuuagauauagaauuacagaaaacugaagcuacacaacuggccaccuugagaaaauuaugcauugaaggcaaaauaacuaacauuacaacagauagcagaugcccaacucaaggcgaagcuacacuacccgaagaacaggaucagaauuauguuuguaaacacacauauguagaucgaggcuggggaaacgggugcggccuauuugggaaagguagucuggucacgugugcaaaauuccaaugucuugaaccaauagaaggcaaaguaguacaguaugaaaaucuuaaauauacuguaaucauaacuguacauacuggagaucagcaccaaguuggaaaugacacucaaggaguuacaguugaaauuacaccacaggcuucaacagucgaagcugugcugccugaauauggcacauuagguuuagagugcagccccagaaccggguuggauuuuaacgagaugauauuacugacuaugaaaaauaaagcauggauggugcauagacaaugguucuucgaucuuccucuuccauggacaaguggagcuacuacagaaacgccaacauggaaccguaaggaauuauuagucacuuuuaagaacgcgcaugcaaagaaacaagaaguaguggucuuagggucucaagaaggugcuaugcauacggcccuaacaggcgcaaccgagauacaaaauucgggagguacaaguauauuugcuggucauuuaaagugcagacuaaaaauggacaaacuagaacugaaagguauguccuacgcaaugugcuuaaacacauucgugcucaagaaagagguguccgagacucagcauggcacuauuuuaaucaaagucgaguacaaaggugaggaugcgcccuguaaaauaccauuuaguacggaggauggacaaggaaaggcacauaauggacgauuaauuaccgcaaauccuguuguaacuaagaaagaagaaccugucaauauagaagccgagccaccuuuuggagagucaaacauuguuauugguaucggugacaaagcucuaaagauaaauugguauaaaaagggcucaucaauaggcaaaauguuugaagccaccgcuagaggggcaagaagaauggcuauacuaggagacaccgcaugggacuucgggucaguuggaggaguuuuaaacagcuuaggaaagaugguacaccaaauauuugggagcgcguacacugcacuauuuagcggagugaguuggauaaugaagauaggaauagguguauugcuuaccuggaucgguuuaaauaguaaaaacacaucuaugucauucucuuguauaguaauugggaucauaacguuauaccuaggagccgucguacaggcugacaugggaugugcaaucaauuggaaagguaaggaacuaaaauguggaucagggauuuuugucacuaacgagguccacacuuggaccgaacaguauaaauuucaggccgauuccccuaaaagguuagcaacggccauugcgggcgccugggaaaauggggucugcgggauccguaguacgacacgaauggaaaaucuauuauggaaacagauagccaaugaguugaauuacauacuaugggaaaacaauauuaaacuaacagucguaguuggagauaucauuggcguacuagagcaagguaaaaggacauuaaccccacaaccaauggaacuuaaguauucauggaaaacauggggaaaagccaaaauaguaacagcggaaacucagaacagcagcuuuauaauugacggaccaaauacucccgaauguccuagugcgagcagggcauggaauguaugggaaguggaagacuauggauuugggguguuuacaacaaauauaugguuaaaguuaagagagguuuauacgcaaucaugcgaccacaggcuaaugucagcugcuauuaaagaugaaagagcuguucacgccgauaugggauacuggauugaaagucaaaagaacggaaguuggaaacuagaaaaggcuuccuuuauagaggugaaaacauguacauggcccaaaagccauacuuuauggucgaauggugucuuagaguccgacaugauaauacccaaaucacuagcugggccaauuucucaacacaaccaucgacccggcuaucauacccaaacagcgggaccguggcaccuaggaaaacuggaguuagacuucaauuauugcgagggcaccacuguaguaauaacugagaacuguggaacccgagggccuagccuacggacaacuacuguaucuggaaaguuaauacacgaauggugcugucgaaguuguaccuuaccgccguugcgauauaugggagaagacggguguugguacggaauggaaauaaggccaauuaaugaaaaggaggaaaacauggugaaaucauuagugagugcaggcaguggcaaagucgauaauuuuaccaugggcguacuaugucuggcuauccucuuugaggaaguaaugcgaggaaaauuugggaagaaacauaugauugcgggaguauuauucaccuuugugcuacuacuuucaggucagauuacauggagagauauggcccauacacucauaaugauagguaguaacgcuagugaccgaaugggcaugggaguaacauaucucgcucuaauagcaacuuucaaaauucagccauuuuuggcguuaggauucuuucuacguaaacuaacgaguagagaaaaccuauuauuagguguuggcuuagcaauggcaacgacucugcaacuuccggaagauauagaacagauggcaaauggcaucgcauuaggacuaaugacuuugaaauugauaacgcaguuugaaacguaucagcuauggacagcuuugguaagccuaacuugcagcaauacaauuuucacacuaacaguagcuuggcgaacggcuacauuaauccuggcuggagugucauuauuaccuuuaugucagagcucaucaaugagaaagacagauuggcugcccaugaccguagccgccaugggggugccaccauugccgcucuuuauauucagucuaaaagauaccccuaagcgccgaaguuggccauuaaacgaaggugugauggcugugggccuaguaaguauucuagcauccucucuacuucguaacgacgucccuauggcgggcccauugguagcgggaggguuguuaauugcguguuacguuauuacaggaacaagcgcggaucucacaguagaaaaagcagcagauguaaccugggaagaagaagcagagcagacuggggugucgcauaaccuaaugauuaccguugaugaugaugggacaaugagaaucaaagacgaugaaacggaaaacauacugacgguccuauugaaaacugcauuauuaauaguaucggguauauuuccguacaguauuccagcgacccuauuaguuuggcauaccuggcaaaaacaaacacaacgcaguggaguauugugggauguaccuucaccaccagaaacacaaaaggcagaguuagaagaagguguuuacagaauaaaacaacaagggauauucgguaaaacacaaguagguguagggguccaaaaagaagggguuuuccacacuauguggcacgugacccgcggagcagucuugacccauaauggaaaaagauuagaacccaacugggcaagcgucaagaaagauuuaauaucguacggcgguggcuggagauuaaaugcacaauggcaaaaaggagaagaaguacaagugauagcugucgagccggguaaaaaucccaaaaacuuucaaacuaugccuggaauauuucaaacuacuaccggagaaauuggugcaauugcacuagauuuuaaacccgguacaagcggaucaccaauuauaaauagggaagguaaagugguaggacuauaugguaauggcguaguaacgaaaaauggaggauacguuucagguauagcccaaacgaacgcagagccagacgggccaacacccgaauuggaagaagaaauguuuaagaaacguaaucuuacaauuauggacuuacauccugguagcgguaaaacccguaaauacuugccugcuauaguaagagaggcaauuaagaggcgauuacgaacuuuaaucuuagcaccgacaagaguuguugccgcggaaauggaagaagcgcuuaaagguuuaccaauacgauaccaaaccacagccacgaaaucugagcauacaggacgcgaaauuguugaucucaugugucacgccacuuucacaaugcgauuacuuucaccaguaaggguuccaaacuacaaccucguuauaauggaugaggcucauuuuacagaucccgcaagcauugcugcucgggguuauauaucuacacguguaggaaugggagaagcugcagccauauuuaugacagcuacgccaccaggaacagcggaagcguuuccacaaucuaaugcacccauacaagaugaggaaagggauauucccgagaggaguuggaacucgggaaacgaguggauuacagauuuugucgggaagacagugugguuuguuccauccauuaaggccgggaacgacaucgcuaacuguuuacggaaaaacgggaagaaaguuauacaacucagcagaaaaacuuuugacaccgaauaccagaaaacuagauuaaaugauugggauuucguaguaacgacggauauaucugaaaugggagcaaauuuuaaagcugaccgcguaauagauccacgaagaugucuaaaacccguaauauuaacagauggaccagagcgaguaauauuagcagguccaaugccuguuacagcugcaucggcugcccagcgacguggacgaguagggcguaacccacaaaaagaaaacgaucaauacauauuuaccggacaaccgcuaaauaaugaugaagaccaugcucacuggacagaggcaaaaaugcuccuagacaauauaaauacgcccgaaggaauaauacccgcauuguucgaaccagagagagagaaaagcgcugcuauugacggugaauaucgauugaaaggcgaaagcagaaaaacuuuuguagaauugaugaggaggggcgaccuaccagucuggcuugcacauaaaguugcguccgaggguaucaaguauacggaccggaagugguguuucgacggugaaagaaacaaccaaauacucgaagaaaauauggauguggaaauauggacuaaggaaggagaaagaaagaaauugagaccccguugguuagaugcccgcaccuauucagacccgcuagcauuaaaagaguucaaagauuuugcagcaggacgaaaaaguauagccuuagaucucguaacugagauaggcagaguuccaagucaucuugcgcacagaacgcgaaaugcguuagacaaccuuguuauguuacauacauccgagcauggagggcgagccuacaggcaugcuguugaagaacuuccggaaacuauggaaacucuuuugcuccuaggauugaugauacuacucacagggggugucauguuauuucugauuucugggaaaggaauagggaaaacaaguauaggacuuauauguguaauaguuuccucggguaugcuguggauggccgacgugccgcugcaguggauugcgagugcaaucguacuggaguuuuucaugaugguuuuacuaauacccgaaccagaaaaacaaagaacaccucaagauaaccaguuagcuuauguagucauaggaauacugacacuagcagcuauuguagcagcaaaugagauggggcuacucgaaacaaccaaacgggauuuagggaugucaaaagaaccaggagugguaaguccaacaucauaccuagacguagauuugcacccagcaucugcuuggacuuuauaugcaguagcuacuacaguaauuacaccgaugcugagacauacaauagaaaauaguacggcgaacguaucauuagccgcgaucgcaaaucaggccguaguacugaugggacuggauaaaggauggccuauuuccaaaauggaccuugggguaccgcugcuagcguuaggauguuacagucaaguuaauccacuaacacuaaccgcugcagucuuacuucuaguaacacauuacgcaauaauaggaccuggacuucaggcuaaggccaccagagaagcucagaaacggacggcagcaggaauaaugaagaauccuacaguggauggaauaaugacgauagacuuagauccuguaauauacgacagcaaauuugaaaaacaauugggucagguuaugcuucuaguguuauguaccgugcaauuacuguuaaugagaacaaguugggcacucugugaggcauuaacgcucgcaacuggaccgauuacuacacuaugggaaggaagcccgggaaaauuuuggaauacaacgauagcuguaagcauggcaaacauauucagggggagcuaccucgcaggggcaggacuagcuuuuucaauaaugaaaucaguaggcacugggagacgaggaacgggaucucagggcgaaacauuaggugaaaaguggaagaagaaauugaaccaacuaucccgcaaagaguucgaccuauacaaaaagucgggaauuacugaaguagacaggacagaggcgaaggaaggcuugaaaagaggcgaaacaacgcaucaugccguuaguaggggcagugcuaaauuacaaugguuuguggagcgaaauaugguuauuccagaaggcagaguaauagaccugggauguggaagagguggcuggaguuauuacugcgcggggcucaagaaaguaacagaaguaagaggguauaccaaaggcggaccaggacaugaagaaccuguuccgaugucuacuuaugguuggaauaucgucaaacucaugucagggaaagacguauuuuaucuucccccagaaaagugugauacauuacugugugauauaggugaaucaagucccagcccaacuguugaagaaagucgaacaaucagaguacugaaaaugguagaacccugguugaggaauaaucaguuuuguauuaaagugcuuaacccuuauaugccaacaguuauagaacauuuagagaggcuucagcgaaaauacggagggaugcuuguacgcaacccgcuuucacguaauucuacgcaugagauguacuggauuucgaacggcacagggaacauaguaucuucuguuaauauggugaguagauuauuacuuaaccgcuucacaaugacgcauagaagacccacaauugaaaaggacguagaucuaggcgccgguacucgacacguaaaugcagaacccgagacaccuaacauggaugugauaggggaacguauuaaacgaauaaaggaggaacauucaaguacuuggcauuacgacgaugaaaacccuuauaaaacaugggcguaccauggaaguuaugaagucaaagcaacaggcagcgcaucaaguaugauuaauggcgucguaaaacuccuaacaaaaccaugggaugucguaccaaugguaacacaaauggccaugacagauacgaccccauucggacaacaacgaguguuuaaagaaaaaguugacacacgaacgcccagaccgaugccgggaacuagaaaaguaauggagauuacggcugaauggcuguggcgaacauuggggagaaacaagaaaccuagguuauguacucgcgaagaguucacuaagaaaguuaggacuaacgcagcuaugggugcagucuuuacagaagaaaaucagugggacagugcucgggcugcuguagaagacgaggaguucuggaaauuaguugaccgagaacgagaauuacauaagcugggaaagugcggaucaugcguauacaacaugauggguaaaagagagaagaaauuaggugaguucggaaaggcuaagggcucacgagcaauaugguauaugugguuaggagcucgcuaucuagaauuugaagcauuaggauuuuuaaaugaagaucauugguuuucccgagaaaauaguuauucaggcguugaaggagaaggccugcauaaacuuggauacauccucagagauaucaguaaaauuccugggggugcaauguacgcugaugauacagcugguugggauacaagaaucacggaggaugacuuacacaaugaagagaaaaucacacagcaaauggacccugaacauagacaacuagccaaugccauauuuaagcuaacauaucagaauaaagucguaaaaguucagcgcccuacgccuaaaggaacagugauggauauaauuagccgaaaagaucaaagaggaucaggacagguuggaacauauggccuaaauacuuucacgaauauggaagcucaauuaguacgucaaauggagggggagggcguucuaucuaaagcugauuuagaaaauccacaucuucuagagaaaaagauuacgcaauggcuugaaacuaaaggaguagaaaggcuaaaaagaauggcgauaucuggugaugacugcguugucaaaccuaucgaugauagauucgcgaaugcucuauuagcauuaaacgacaugggcaagguacgaaaagacauaccacaauggcaaccuagcaagggauggcaugauuggcagcaaguacccuuuugcucacaucauuuccaugaauuaauuaugaaagauggacgaaaauugguggucccauguagaccccaagacgaguuaauugguagggcacgcauuagucaaggagccggguggucuuuaaaagagacagcgugucucggcaaggcuuacgcacaaauguggagucuaauguauuuccauagacgagaccuccgauuagcauccaacgccaucuguuccgcuguuccuguucacuggauacccaccucacgaacaacauggaguauacaugcacaucaccaguggaugacgaccgaagauauguugacaguuuggaacaggguguggauagaagacaacccauggauggaggauaaaacaccgguaacgacaugggaagauguuccguauuuaggaaaaagagaagaucaauggugugguucauugauuggucuaacaucccgagcgacaugggcacaaaacauauuaacugcuauucaacaggugcggucauuaaucggaaacgaggaguuccuagauuacaugccaucgaugaaaagauucaggaaagaggaagaaucagaaggggcuaucugguga

SEQ ID NO: 23114 - RNA, 9873 nt, Artificial Sequence
  derived and/or modified CDS sequence (opt6) from DENV-3__GU131936__SS-prME
acaagucuauguuuaaugaugaugcuuccugcuacucuggcguuucacuuaacaucgagagacggggaaccaaggaugauaguagggaaaaaugaaagagggaaaagccuauuauuuaaaaccgcaagugggauaaauauguguacucuuaucgcuauggauuuaggugaaaugugugacgacacgguaaccuacaaauguccauuaauagcagaaguggaacccgaagacaucgacuguuggugcaauuuaacuucuacguggguaacauauggaaccuguaaucaagccggggagcaucgacgugacaaacgaaguguagcuuuagcgccacauguaggaaugggacuugacacucggacacaaacguggaugagcgcugaaggugcuuggagacaaguugagaaagucgaaaccugggcguuacgacacccaggauucacuauccuagcacuauuccuagcgcauuacaucgggacaucucuaacgcaaaaaguagucauauuuaucuuguuaauguuaguuacaccaucuaugacuaugagaugugugggagucggaaaucgcgauuuuguugaaggucuuucgggagcgacguggguggacguagucuuagaacauggcggcuguguuacgacgauggcuaaaucaaaaccaacauuggauauagaauugcagaaaacagaggcaacucaacuagcgacauugcguaaacucugcauugaggguaaaauuacaaacauuacuacugauucaagauguccaacucagggugaagcuacauugccugaagaacaagaucagaauuauguauguaaacauacauacguagaucgcggauggggaaacgguuguggguuauuugguaaagggucucuuguuacaugugcuaaauuccaaugccucgaaaguauagaaggaaaagucguccaguacgaaaauuuaaaauauacagucauaauuacgguccacacaggagaccaacaccaaguaggaaaugacacccaaggagucacuguagaaaucacuccacaagcuaguacuguugaagcaguguugccugaguauggcacauuaggccuagaguguucacccagaacaggauuggauuucaaugagaugauauuguugacaaugaaaaacaaagcauggaugguccaccgacaaugguucuuugaucuucccuugccauggaccagcggugcaacaacagagacaccaacauggaacagaaaagaguuguugguaacauucaaaaaugcacaugccaagaaacaagaagugguaguauuagguucccaagaaggugccaugcauaccgcccucacaggugccacggaaauacaaaauucagguggaacuucaauuuucgccgggcauuuaaaauguagacugaaaauggacaaacuugaauuaaaagguaugagcuacgcuaugugcuuaaauacauucguauuaaagaaagaaguaucugaaacccagcacggaacaaucuuaauaaaaguugaauauaaaggcgaagacgccccgugcaaaauaccauuuucgacugaggauggacaaggaaaagcucauaauggccgucuaaucacugcgaaccccgugguuacuaagaaagaagaaccaguaaacaucgaagcagaaccacccuucggagaaucaaacauuguuauagguaucggggacaaagcacugaaaauuaacugguacaagaaagggucaucaauugguaaaauguuugaagccacugcucggggcgcgagaagaauggcuauucugggcgauacugcuugggacuucggaucagugggaggaguuuugaacaguuuagguaaaaugguucaucaaaucuuugguucugcauauacugcacuauuuucaggaguuucguggauuaugaaaaucgguauugggguauuacuaacauggauuggacuaaauaguaaaaauacgucuaugaguuucucauguauaguuauuggcauaaucacuuuguaucuuggagcaguaguacaagcggauaugggaugcguuauuaauuggaaaggcaaagagcugaaaugcggaaacgguauauuuguaacuaacgagguccauacguggacugagcaauacaaauuccaagcagacucucccaaacguuuagcgacagcuaucgcgggcgcaugggaaaacggaguuugugggauaagaucaacgacaagaauggaaaaucuacuauggaaacagauagcuaaugaacuaaacuauauucuaugggagaauaauauaaaauuaacaguuguagucggagacauuaucggaguuuuggaacagggcaaacgugcucuaacuccucagccaauggagcuuaaauauaguuggaaaacuuggggcaaagcuaaaauaguaacagcagagacacaaaacucaucuuuuauaaucgauggaccaaauaccccagaauguccuagugcguccagagcguggaacguaugggaaguagaagauuaugguuuuggaguauucacuacuaauauauggcuaaaacuucgagaaguuuauacacagucgugcgaucauagauuaaugucugcagcgaucaaagaugaaagagccguccacgcugacaugggguacuggauugaaucacaaaagaauggcagcuggaaguuggaaaaagcaucauuuauagaaguaaaaacaugcacguggccaaaaagccacaccuuaugguccaauggaguguuagagucagacaugaucaucccaaagagccuugccgggccgaucagucagcauaaucauagaccaggauaccacacccaaacggcagguccauggcauuuaggaaaacuugaacuggacuuuaauuauugugaagguacuacaguagucaucgcugaaaauuguggcacaagaggcccuagcuuaaggacaaccacagucucaggaaagcuaauucacgaauggugcuguagaucuugcacgcuaccaccucuucgguacaugggagaagacggauguugguacgguauggaaauucguccaauuaaugaaaaggaagagaauaugguuaaaucuuuaguaagcgccggaucugggaaaguagauaauuuuaccaugggaguguuaugcuuagcuauuuuguucgaggaagucaugagaggaaaguucggcaagaaacauaugauagcgggcguguuguuuaccuuuguacuuuuauuaaguggacaaauaacguggagggauauggcacauacacugaucaugauaggguccaaugcuagugacagaauggguauggggguuaccuauuuagcgcuuauugcaacguuuaaaauccagccauuuuuagcuuuagguuucuuucucaggaaauugacgucuagagaaaaccuacuacuaggagucggacuugcaauggcgacuacuuuacaacuuccagaagauauagaacaaauggcaaaugguauagcacuaggccuaaugaccuugaaacuaaucacccaguuugagacuuaccaguuauggacggccuuagucagccucacgugcucuaauacuauuuuuacauuaaccgucgccuggcguaccgcgacacuuauacucgcgggcguaucucuucuuccacuaugucaaucaucgucaaugcgaaaaacagauuggcuuccaaugaccguugccgccaugggcguuccaccucucccauuauucauuuucaguuuaaaagauacaccgaagaggagaaguuggcccuuaaacgaaggugucauggcaguaggccucgucucgauauuagcaagcucgcuucuaaggaaugauguaccgauggcugguccucugguagcuggaggauugcuuaucgccugcuacgugaucacggggacuucagcagacuuaacuguagagaaagcagcggacgucacgugggaagaagaagcggagcaaaccggagucucacacaaucuaaugauuacaguagaugaugacgguacuaugaagauuaaggaugacgagaccgaaaacauacugaccguccucuuaaaaaccgcacuacuaauaguauccggcauauuuccauauucuauaccugcuaccuuacuugucuggcauaccuggcagaaacaaacacaaagaaguggcguauuaugggauguccccucaccaccagaaacacaaaaagccgaguuagaagaaggaguauaucgaaucaaacagcaagguauauuugguaaaacucagguaggaguagggguucagaaagaaggaguuuuccacacaauguggcauguaacaagaggugcaguauugacacacaauggaaaaagauuagaaccaaauugggccucagucaagaaagaucuaaucaguuacggagggggauggagacuaucugcacaguggcagaagggagaagaaguccaaguaauagcuguugaaccaggcaaaaauccgaagaacuuccaaaccaugccaggaauauuucaaacuacaaccggcgaaauaggagccauagcucuagacuuuaaaccagguacaagugggucccccauaauuaaucgagaaggaaaagugguugguuuguacgggaauggaguaguaaccaaaaacggaggauauguaucuggcauagcucaaaccaaugcugagccagacggcccaacuccagaauuagaggaggaaauguucaaaaagcgaaauuugacgauaauggacuuacauccugggagcggaaaaacaagaaaguauuugcccgcuauaguacgugaggcaauaaagcggcguuuacgcacacuaauauuggccccgacacggguaguggccgcugaaauggaagaagcccucaaaggguuaccaauaagauaccagacgacagcuacuaaaucagagcauacggggcgugaaauaguagaucuaaugugucaugcaaccuucacuaugaggcuuuuaucaccuguccgugucccuaauuauaacuuagugauaauggacgaggcacauuucacugauccagcaagcauugcugcaaggggauauauaucgacaagagucgguaugggugaagcagcagccauuuucaugacugcaacuccucccgguacugcagaggcuuuuccucaaucuaacgccccaauacaagacgaagaaagagauaucccugaacguaguuggaacaguggaaacgaauggauuacagacuuuguggguaaaacugucugguuuguaccuuccaucaaagcagggaaugauauagcuaacuguuugcgcaaaaaugggaagaaagugauacagcucucaagaaagaccuucgauacugaguaucagaaaacaagacuaaacgauugggacuucguaguuacgacagacauuucagaaaugggcgcuaacuucaaagcugaucgaguuauugacccaagaagaugccucaagccagucauauugacggauggaccagagcgcguaauacuugcaggacccaugccaguuaccgcagcaagcgcagcccaacggcguggacgaguaggaagaaauccgcagaaagaaaaugaccaguacauauuuaugggacaaccauuaaauaaugaugaagaccacgcgcauuggacggaagcaaaaauguuacuagacaacauaaacacaccagaggggaucauuccagcacuauucgaacccgaacgggaaaagagugcagcaauagacggggaauauagacugaaaggagaaucaagaaagacguucguugagcuuaugagaaggggugauuuaccuguauggcuagcacacaaaguagccucggagggcaucaaauauaccgaucguaaaugguguuuugauggagaaaggaacaaucaaauuuuagaagaaaacauggacgucgaaaucuggaccaaagaaggggaacgcaagaaacuaagaccgcgaugguuagaugcgaggacuuauucagacccauuggcccucaaagaauuuaaagacuuugcagcgggucgaaaaagcauagcuuuagauuuaguaaccgaaauagguagaguccccucucaucuugcacacagaacgcguaacgcucuugacaaucuagugaugcuacacacauccgaacacggcgguagagcauaucgccaugcuguagaggagcuaccagaaacaauggagacccucuugcucuuaggucuaaugauacuucuaacugggggugcaauguuauuuuuaauuucagguaaaggaauaggaaaaacuucaauaggucugauaugugugauagugucgaguggaaugcuuuggauggccgacgucccauugcaauggauagccucugcuauuguucuugaguucuuuaugaugguccucuuaauuccggaaccggaaaaacaacgaacgccgcaggauaaucaacuugcauauguuguaauuggcauacuaacuuuggcagccauaguagcggccaacgagaugggcuugcuagaaacuaccaaacgggaccugggaaugucuaaagaaccuggagucgugucgccuacaucauaucuagauguagacuugcacccugcaagcgcauggacauuauacgcaguagcuacaacagugauaacuccaauguuaagacauacuauugaaaauucgacagcaaauguuaguuuagcggcaauagcuaaucaagcgguaguacucaugggccuagauaaaggguggccgauuucaaaaauggaucuugggguaccccuacuggcauuaggauguuacucgcagguaaauccuuuaaccuugaccgccgcuguuuugcucuuaguaacgcacuaugcaauaauugguccaggauuacaagcaaaagccacacgagaagcucaaaagagaacagcagcaggcauaaugaaaaauccuacaguugacgggauaaugacgauagacuuagacccaguaaucuaugauagcaaguuugaaaaacagcugggacaaguaaugcuauuaguuuuaugugcuguacaauuacuauuaaugagaaccaguugggcucucugugaggcacuaacucuagccacaggaccaauuaccacacucugggaagguagccccggaaaauuuuggaacacuacuaucgccguaucaauggcuaauauauuucgcggaaguuaucuugcaggcgcaggcuuagcauucaguaucaugaagucuguggguaccggacguagaggaacaggaagccaaggugaaacuuuaggcgaaaaauggaagaagaaacucaaucaacuaagccgaaaggaguuugaccuauauaagaagucugguauaacagaaguugaccguacugaagccaaggaagguuuaaaacguggggaaacuacgcaucaugcaguauccagggguucagcuaagcuacaaugguuugucgaacguaauaugguaauucccgagggucgcgugauugaccuaggaugugggagagggggcuggucauauuauugcgccggucuaaagaaagugacagaaguacgagguuacacuaagggcgguccgggacaugaagaacccguaccuaugucuaccuauggauggaauaucguuaaauugaugagugguaaagauguauuuuaucuucccccagaaaagugugacacacuccucugcgauauaggcgagucaaguccgucaccaacaguagaggaaucccgcacuauccgagugcuuaagaugguggagcccugguuaagaucuaaucaauuuugcaucaaaguucugaacccuuauaugccuacaguaauugaacaucuagaacgauugcaacgcaaauacggcggaaugcugguacgcaauccacugagucgaaauucaacccacgaaauguacuggauuagcaauggaacugguaauaucguuucuucgguaaacaugguuuccagguuacuguuaaauagauucacuaugacacacagaagacccaccaucgaaaaggaugucgaucucggggccgguacgagacacguuaacgcggaaccugaaacaccaaauauggaugugaucggagaacguauaaaaagaauaaaagaagaacauucuucuacuuggcauuaugaugacgaaaauccuuauaagacgugggcauaccaugguagcuaugagguuaaagcaaccggauccgccaguucaaugauaaauggcgucgucaaauuauuaacgaaaccaugggauguaguaccaaugguaacucaaauggccaugacagacacaacgcccuuuggccaacagaggguuuuuaaagaaaaaguagacacgaggacuccgaggccuaugccuggaacacgaaaaguuauggaaauaacugcagaauggcuguggagaacacuaggacgaaacaagaaaccaagacucuguacuagagaagaauuuacgaagaaaguuagaaccaacgccgcaaugggcgccguauucacugaggaaaaccaaugggauucagcuagagcugcaguugaagacgaagaguucuggaagcuaguugauaaagaacgagaauuacacaaguuaggaaaaugcggaagcugcguguauaauaugauggggaaacgugagaagaaacuuggggaauuuggaaaagcgaaagguucuagagcuauaugguauauguggcuaggagcacgcuacuuagaguuugaagcgcucggauuuuuaaacgaagaucacugguucagcagagaaaauaguuacagcgggguugagggugaaggacuacauaaauuaggguauauccugagagauauuucaaaaaucccugggggugcaauguacgcagacgauacugcuggaugggauacucgaauaacagaagacgaucugcacaacgaggagaaaauaacccaacaaauggauccggaacauagacaauuagcaaacgcuauauuuaaauuaacguaccagaauaaagucgugaaagugcaacguccaacaccgaaaggaaccguaauggacauuaucucuaggaaagaucaacgaggaagcggacaaguaggcacauauggucugaauacauuuacaaauauggaggcucaguuaguaaggcaaauggaaggagaaggugugcuuucuaaagccgaucuagagaacccucaucugcuggaaaagaaaauaacucaaugguuagaaacaaaaggaguugagagacuaaaaagaauggcaauaaguggcgaugacugcguggucaagccaauagaugaccgauuugcuaaugcccuauuagcuuuaaacgauaugggaaaggucaggaaagauauaccucaauggcaaccaaguaaaggcuggcacgacuggcaacaaguaccuuuuugcagucaccauuuccaugaacuuaucaugaaagacggcagaaaacugguggugccgugucgcccgcaagaugaacucauuggacgcgcgagaauaucacaaggagcuggauggucguuaaaagagaccgccuguuuaggcaaggcuuaugcucagauguggucauuaauguacuuucaucggagagacuuacgacuggcuucgaaugcgaucuguucagcaguuccgguacauuggauaccuacaucacggacuaccuggucgauacacgcucaccaccaauggaugaccacagaagacauguugaccguauggaaucgagucuggauugaagauaacccauggauggaggauaaaacuccuguaacgacgugggaagacguacccuauuuagguaagagagaagaucaaugguguggguccuugauaggacuaacaucaagagcuacaugggcacagaacauucuaaccgcaauucaacaagugcgaucauuaaucggagaugaagaguucuuagauuauaugccuaguaugaaaagauuuagaaaagaagaagaaacagaaggcgccauaugguaa

SEQ ID NO: 23115 - RNA, 9873 nt, Artificial Sequence
  derived and/or modified CDS sequence (opt6) from DENV-3__GU131937__SS-prME
acaucgcuaugccuaaugaugauguuaccugcaacguuggcauuucauuuaacgucuagagacggagaaccucgaaugauaguagguaaaaaugaacgagguaaaucacuccucuuuaaaaccgcgaguggaauaaauaugugcacauuaaucgcaauggauuuaggggaaaugugcgacgauacaguaacguauaaauguccucucauugcagaaguugaacccgaagacauagauugcugguguaaccuaacuagcacauggguaacauaugggacaugcaaucaagcaggagaacaucgucgcgauaaacgcagcguagcucuugcuccccacguagguaugggucucgacacuagaacgcagacguggaugucagcagaaggagcauggcggcaaguagaaaaagucgaaacaugggcucuaagacaucccgguuucacaauauuagcacucuucuuggcgcauuacauuggaacaucacuaacacagaaagugguuauauuuauacuguuaaugcuaguuacucccaguaugacaaugcgaugcguaggaguagguaaucgugacuucguugaaggucugucaggagccacauggguagacguuguucuugaacauggagguuguguaacaacaauggccaaauccaaaccaacguuagacauagagcuucagaaaacagaagcuacgcaauuagcaacacugagaaaauuaugcaucgaaggaaaaauaaccaacauaacaaccgauucuagauguccuacacaaggggaggcgacucugccagaggaacaagaucaaaacuauguuuguaaacauacauauguagauagaggaugggggaacggcugugguuuauuuggcaaagggaguuuagucacaugcgcuaaguuucaaugucuagagcccaucgagggaaaaguaguacaguaugaaaaccugaaguacacuguuauaaucaccguacauacuggagaccaacaucaaguuggcaacgauacccaagggguaaccguagagaucacaccccaggcuucaacggucgaagcuguguugccggaauauggaacacuuggacuagaaugcaguccgcguacgggucuagacuucaaugagaugauucuacuuacuaugaaaaacaaagcauggaugguucacagacaaugguucuuugacuuaccucugccauggacaaguggugcaacaacagaaacuccuacauggaaccgaaaagaacucuuagucacguuuaaaaaugcucaugcuaagaaacaagaagucguaguauuaggcucucaagaaggugcaaugcacacagcucuaaccggagccacggaaauacaaaacucugguggaacaaguauauuugcaggucaucuaaaaugcagacugaaaauggauaagcucgaguuaaaaggaaugaguuaugcgaugugcuuaaauacauuuguuuuaaagaaggaaguuagcgagacccaacauggaacuauacugauaaaaguggaauauaagggugaagaugcgccaugcaaaauacccuuuuccacugaagacggacaaggaaaggcgcauaauggcagauugaucaccgccaacccugugguaacaaagaaagaggaaccaguaaauauugaggccgaacccccauuuggagaaucgaacauaguuaucggcauaggcgauaaggcuuuaaaaauaaacugguauaagaagggauccagcaucggaaagauguuugaagccacagcuagaggugcacgccgcauggccaucuuaggcgauacggccugggacuuuggcucuguaggagguguucuuaauucacuggguaagaugguacaccaaauauucggcagcgcuuacaccgcauuauucucaggaguuaguuggauaaugaagauuggaauugggguccucuuaaccuggauuggucuaaauuccaaaaauacuucgauguccuucucaugcauagugauaggaauaauuacguuguaccuaggugcagugguucaagccgacauggguugcguuauuaauuggaagggcaaagaguugaaaugcggcucuggaaucuucguuacaaaugagguccauacauggacagaacaauauaaauuccaagccgauagcccaaaaagguuagcaacagcaauugccggugcuugggagaaugguguaugcgguauucgcagcacaacuagaauggagaaucuuuuguggaaacagauugcuaacgaacuaaauuacauauuaugggaaaacaauauaaaacucacuguagucgucggugauauuaucggaguauuagaacaagggaaacggaccuuaacuccacaaccuauggaauuaaaauacaguuggaaaacuugggguaaagcuaaaauuguaacagcagaaacccaaaauaguaguuuuauaaucgauggucccaauacgccagagugccccucaacccuuagagcguggaacgugugggaagucgaggacuacgguuuugguguauuuacuacaaauauaugguugaaauugagagaaguuuauacacaauccugugaucacagacuuaugucagcggcaaucaaggaugaacgugcaguacaugcggauauggguuauuggaucgaaucacaaaagaacgguuccuggaagcuagaaaaggcaaguuuuauugaagucaaaacuugcacauggccaaaaucucauacauuauggaguaaugguguguuagaaucagauaugauuauaccaaagucucuugcuggcccgauuagucaacauaauuauaggccaggguaucauacacaaacugcuggccccuggcaucuagguaagcuagaacuagacuuuaauuacugugaaggaacaaccgucgucauaaccgaaaacugcggcacgcgaggacccucauuaagaaccacgacgguaucgggcaaguugauacacgaaugguguugccgaucauguacguuaccacccuugagauauaugggagaagacggauguugguauggaauggagauaagaccaauaaaugaaaaagaagaaaacaugguaaaaucacuuguaucagccgguucuggcaaagucgacaauuuuacaaugggaguccucugccuugcaauucuauucgaagaggugaugagaggaaaguucggaaagaaacacaugauagccgguguuuuauucaccuucguucuauuacugucagggcaaauaacauggcgagauauggcucauacacugauaaugauaggcuccaacgcauccgauagaauggguaugggaguaacauauuuggcauuaauugccacauuuaaaauccaaccauuuuuagcauuagguuucuuuuuaagaaaauuaacuucaagagaaaauuugcuacuaggcgugggguuggcaauggcaacaaccuuacaauuacccgaggauauagaacagauggcaaauggcaucgcccucggauuaaugaccuuaaaacuaauaacacaauuugagacuuaccaauuauggacggcuuuaguaucacuaaccugcaguaacacuaucuucacacuuacaguugccuggcgaacagcaacacuuauccuugcggguguuagucuacuuccacucugucagaguucaaguaugaggaaaacggacugguuaccaaugacaguagcagcgaugggagugccaccuuuaccauuauucauauucucccugaaagacaccccgaaaagaagaucauggccacuuaaugagggcguuauggcaguaggcuuagugaguauauuagcuucuucuuuacuacggaacgacguuccaauggcugguccacucguggcagggggucuacuaauagcaugcuaugugauuaccggaacaagcgccgauuuaacaguugagaaagccgcugauguaacaugggaagaagaggcggaacaaacaggcguaucacacaaccuaaugauuacgguagaugacgacggcacuaugcgcauuaaagaugaugaaacagaaaauauucuuacaguauuauuaaagacugcauugcucaucgucucaggaauauuccccuauucaauaccugcaacauuauuaguuuggcauacauggcaaaaacaaacacagagaucggggguauugugggacguaccgucacccccggagacacagaaagcugaauuagaagaagggguuuacagaaucaaacaacaaggcaucuucgggaagacgcaaguagguguaggagugcagaaggaaggagucuuucauacaauguggcacgugacaaggggugcugucuugacucacaaugguaagcgauuagaacccaacugggcuucagucaagaaagaucuaaucucuuauggaggaggauggcgacuaucugcacaauggcaaaaaggcgaagaaguucagguaauagcggucgaaccugggaaaaauccuaaaaacuuucaaacaaugccuggaaucuuccaaaccacuacuggagaaauuggugcgaucgcacuagacuucaagccuggaacauccgguaguccaauuauuaaccgggaaggaaaagugguaggucucuaugggaaugguguaguaaccaaaaacggcgguuaugucaguggaauugcucaaacuaaugccgaaccagacggaccaacuccugaacucgaagaagaaauguuuaaaaagagaaaccuaaccauuauggaucuacacccgggcagcggcaaaacuaggaaauacuuaccagcaauaguacgugaagcuauuaaaagacgacuaaggacucuaauucuggcaccaaccagagugguagcugcagagauggaagaggcauuaaaaggucuuccaauaagauaucagacuacagcuaccaaaucagaacauacaggcagagaaauaguagacuuaaugugucaugcuacuuuuacuaugcgacuauuaucaccgguucgcguucccaauuauaaccuugucauaauggaugaggcucacuucaccgacccagcgagcauagcagcucgcgguuacauaaguaccaggguagguaugggugaagcagcggcuaucuuuaugacugcaacuccucccggaacugcugaggcuuuuccacaaucaaacgcaccuauacaggacgaagaaagagauauuccagaacggucuuggaacagugguaacgaauggaucacagauuuuguaggcaagacugugugguuuguuccgucaauaaaagcaggaaaugauauugcuaauugccuccgcaaaaauggaaagaaagugauucaacuuucgagaaaaacuuucgauacggaauaucagaaaaccagacuuaaugacugggauuuugucgucaccacggacauauccgaaaugggagcuaauuuuaaagcagaucgaguuauagauccgagacggugucuuaaacccgugauucuuacugauggaccggaaaggguaauacuugcaggacccaugccagugaccgcugcaucugcagcucaaagacgugguaggguggggagaaauccacaaaaagaaaaugaucaauacauuuuuacuggacaaccuuuaaacaacgacgaggaccacgcacauuggacagaagcaaaaaugcuauuagauaauaucaauacaccugaggguauuauaccagccuuauuugaacccgagagagagaaaucagcagcaauagauggagaauauagacuaaagggagaaucgagaaaaacuuucguggaacucaugagaagaggugaccugccagugugguuagcgcauaaaguagcgucagaagguauuaaauauaccgaccgaaaaugguguuuugacggcgaacguaauaaccagauucuugaagaaaacauggacguagaaaucuggacuaaagaaggagagcgaaagaaacuacgaccgcgguggcuagaugcgagaacguauagcgacccgcuggcucucaaagaauuuaaagauuuugcugcugguaggaaaaguauagcuuuggacuuaguaacugagaucgggagagucccaucacacuuggcgcauagaacgcgaaaugcgcuagauaaucuaguaaugcuacauacuucugagcacgggggacgggcguauaggcaugcuguugaagaacuuccggaaacuauggaaacacuacugcuauuaggacuuaugauuaguuuaacugguggugccauguuauucuuaauuucaggaaaagguauuggcaaaacaucgauugguuuaauaugugugauagugucuucagguauguuauggauggcggaugucccauuacaauggauugcaucagcuauuguucuggaauuuuucaugaugguccuacuuauucccgaaccagaaaagcaaagaacgccacaagacaaccaacuagcguacgucgugaucggcauucuuacacuggcagccauaguugcagcuaaugaaaugggguugcuagagaccacuaaaagagaccuaggaaugagcaaggagccuggaguaguauccccaacgucguauuuagauguagaucuucauccugcgagugcguggacucucuacgcaguugcaacaacgguaauaacaccaauguuacgacacacaauagaaaauuccaccgcaaauguaagccuagccgcaauugcuaaccaggcgguuguccugauggggcuagauaaaggguggccgaucagcaaaauggauuuaggggugccucuauuagcauugggcuguuauucgcaaguuaacccauugacuuugaccgcagccguucuacuuuugguaacacauuacgcuauuaucggaccuggauuacaagcaaaggcuacucgagaggcacagaaaagaacagcagcagguauuaugaaaaauccuacaguagaugguaucaugacgauagaucuugaccccguaauauacgacucuaaauucgaaaaacaauuaggacagguaauguuauuaguuuuaugugcaguucaauuguuacucaugcgaaccagcugggcuuuaugugaagcccugacacucgcuacagggccuaucacaacuuuaugggagggaucccccgguaaauuuuggaacacgacaauugcaguauccauggcuaacauauuccgaggaucguauuuagccggugcagguuuggcuuuuucaaucaugaagucaguagggacgggucgaagaggcacaggcucacaaggcgaaacacuuggggaaaaauggaagaagaaauuaaaucaauuaaguagaaaagaguucgaucuauacaagaaaucuggaauuacggaaguagaccgaacugaagccaaagaagguuugaaacggggagaaacaacgcaucaugcugugucucguggaagcgcaaaauugcaaugguuugucgagcgcaauaugguaauuccagaaggucgcguaauagaucuagggugcggaaggggagguuggagcuauuacugcgcgggacuaaagaaagugacagaaguaaggggguauacaaaaggaggucccggucaugaagaaccagucccuaugaguacauacggguggaacauugugaaauugaugagcggaaaagacguuuucuaucuaccacccgaaaaaugcgacacacuguugugugauauaggggagagcucucccagcccaacuguggaagaaaaucgaacuauccgaguuuuaaaaauggucgagccaugguugagaaacaaucaauucuguauuaaggucuuaaauccauacaugccuacuguaauagagcaucuagagaggcuucaaagaaaauacggaggaaugcuagucaggaauccauuaucuagaaacucaacucacgaaauguauuggauaaguaauggaacugguaauauaguaucaucuguuaauauggugagcagauuauuauugaauagguucacuaugacacauagaagaccuacuauagaaaaagaugucgaccucggggcuggcacaagacaugucaacgccgagccugaaacgccgaauauggaugugauuggugaacgaauaaaaaggauaaaagaagaacauucgagcacguggcacuaugaugacgagaacccuuauaagaccugggcauaccacgguaguuacgaaguaaaagcaacugguucagcguccagcaugauaaauggugucguaaaacuauuaacaaaaccuugggaugucguaccaaugguuacacaaauggccaugacugacacaacuccauucggacaacaacgaguuuucaaggaaaagguagauacacgaacuccacguccaaugccagguacacgaaaaguaauggaaauuacagcagaaugguuguggaggacucuaggacgaaacaagaaaccgagauuauguacgcgagaagaauuuaccaagaaaguucgaaccaaugcggcaaugggugccguauuuacggaagaaaaccaaugggauucggcacgcgcagcaguagaggacgaggaguucuggaaauuaguugauagggaacgcgaauuacauaagcucggaaagugcggaucuuguguuuauaacaugaugggaaaacgagagaagaaacuaggggaguuuggaaaagcaaaaggaucuagggcuaucugguacauguggcuuggcgcucgauaucuagaauuugaagcguuggguuuucuaaacgaggaccauugguuuucgagagaaaacucauauucaggugucgaaggggaaggacuccacaaauuaggauacauacuaagagauaucaguaaaauaccuggaggcgcaauguaugccgacgacacugcgggaugggacacgcgaauuacagaggacgacuuacacaaugaagagaaaauaacucaacaaauggauccagaacacaggcaacuugcgaaugcgauauuuaaacuuacauaucaaaauaaaguuguuaaaguucaacguccgacaccaaaaggcacagugauggauauaauaaguaggaaggaccaacgagguucagggcaaguagggacuuacggccuaaauacauuuaccaacauggaggcgcaauuagucagacaaauggaaggagaagggguccuuucaaaggcggauuuggagaacccucaucuccuagagaagaaaaucacgcaguggcuugaaacaaaagggguggaaagacucaaacgcauggcgaucaguggcgacgacuguguuguaaaacccauagaugauagauucgccaaugcccuguuagcacucaaugauauggguaaaguccggaaagauauaccucaauggcaacccagcaaaggauggcaugauuggcagcaaguaccauucuguucacaucauuuccaugaacucauuaugaaagauggacgcaaguuggugguaccuuguagaccccaagaugaauuaauagguagggcucguauuucacaaggagccgguuggaguuuaaaagaaacugcaugccucggcaaagccuaugcgcagauguggucucuuauguauuuucauaggagagaucuuagauuagcuuccaacgcaauaugcagugcaguaccagugcacuggauucccacaagccgaacgaccuggucgauucaugcacaucaccaguggaugaccacagaagacaugcuaacuguauggaaccgaguauggauagaagacaacccuuggauggaagacaaaacacccguaacaacaugggaagauguacccuacuuggguaaacgcgaggaucagugguguggaucacugauagguuuaaccaguagggcaacgugggcacaaaacauccuaacugcaauacagcaagucagaucgcuaauaggcgaugaagaguuucucgauuauaugccaucuaugaaaagguuucgcaaagaagaagaaucagaaggugcaaucugguga

SEQ ID NO: 23116 - RNA, 9873 nt, Artificial Sequence
  derived and/or modified CDS sequence (opt6) from DENV-3__GU131938__SS-prME
acuagccuuuguuugaugaugauguuaccugcaacucuugcuuuucaccuaacaucccgcgacggagaaccuaggaugauagucggcaaaaaugaacgcgguaaaucuuuguuauucaaaacugcaagcgggauuaauaugugcacauuaauagcaauggacuuaggagagaugugugacgauacuguaacauacaaaugccccuugauagcagaaguugagccugaagacauagacuguugguguaaucuuacaucaacaugggucacauacggaacaugcaaccaagcgggagagcaccggagagauaaacggagcguagcauuagcuccccacgugggaaugggacuagacacaaggacacaaacauggauguccgcagaaggagcauggaggcaaguggaaaaaguggaaaccugggcguuaagacacccgggcuuuacaauucuugcucuauuuuuggcucauuauaucggcacaagucucacccaaaaaguuguuauauucauacuacuuauguuaguuacccccagcaugacaaugaggugcgucggagugggcaaccgagacuuuguugagggccuguccggagcaacauggguugacguaguacuugaacacgggggcugugugacaacuauggcaaaaucaaaaccaacucuagauaucgaauuacagaaaacugaagcgacccaauuagcgacauuaagaaaacucugcauagagggcaaaauaacaaacauuacuacagauagucgauguccaacccaaggugaggcuacucuaccugaagaacaagaccagaacuacguguguaaacacacauaugucgaucgugguuggggaaacgguuguggguuauuugguaaagguucauuggucacaugugcuaaauuccaaugucuagaaucgauagaagguaaaguaguacaauaugagaaucugaaauauacuguaauaauaaccgugcauaccggugaccagcaucaaguggguaaugauacucaaggugucacuguagaaauuacaccccaggcuucuacgguagaggcaguucuaccagaauaugguacauuaggacuugaguguagucccagaacuggacuagauuuuaaugaaaugauauuacuuacaaugaaaaauaaagcauggaugguacaucgucagugguucuuugaucuaccauuaccauggacaucuggagcuacaacagaaacuccaacauggaauagaaaagagcuuuuaguaacguuuaaaaaugcgcaugccaagaaacaagaagucgugguauuaggaagccaagaaggggcuaugcacaccgcuuuaacaggugcuaccgagauacaaaacucaggaggaacuucgauauuugcuggccacuuaaaauguagacuaaaaauggacaaacuagaacuaaaaggcaugucuuaugcaaugugccuaaauacauuuguuuugaagaaggaaguuucugagacucaacauggaacaauuuugauaaaagucgaauacaaaggugaagaugcgccuuguaaaauuccguuuagcacugaagaugggcaggggaaggcccauaauggcagacuuauuacggccaaucccgugguuacuaagaaagaagaaccgguaaauaucgaagcagaacccccuuuuggugaaucaaauauugugauaggcauuggggauaaggcccugaagauaaauugguauaagaaaggguccucgauuggaaaaauguuugaagcuaccgccagaggagccaggagaauggcuauuuuaggcgacacagcuugggauuuuggaaguguuggcggaguccuaaauucacuggguaagaugguucaccaaauauuugggucugcauauacagcuuuauuuucaggaguaucauggauaaugaaaauuggaaucgggguacuauugaccuggaucggccuaaauagcaaaaacacaaguaugaguuuuucauguaucgucauagguauaauaacuuuauaucuuggcgcaguggugcaagccgacauggggugcguaauaaauuggaaagguaaagaauuaaaaugugguaacggaauuuuuguaaccaacgaaguacauacguggacagaacaauauaaauuucaagcggacucucccaaacgucuagccacugcgauagcuggggcaugggaaaaugguguaugcggaauccgauccacaacuagaauggaaaaucuucucuggaaacaaauugcaaacgaauuaaauuacauccuaugggaaaauaacauaaagcuaacggugguaguaggugauauaauuggagucuuggagcaaggaaaaagagcucuuacuccccaaccuauggagcuaaaauauagcuggaaaacuuggggaaaagcuaagaucguaacggcagaaacacagaauaguaguuuuauaauagauggcccgaauacaccagaguguccaucagcaucuagagcguggaauguaugggaaguagaggacuacggcuuugggguuuucacgacgaacauuugguugaaguuaagggaagucuauacgcaaucaugcgaucauagauuaaugucugcugccauaaaagaugaaagggcgguucaugcugacaugggguacuggaucgaaucgcagaaaaaugguaguuggaaauuggaaaaagcaaguuuuauagaaguaaaaaccuguaccuggccaaaaucgcauacguuguggucaaacgguguacucgagagcgacaugaucaucccuaaaucauuagcgggcccaauuagccaacacaaucaccguccaggauaucacacucagacagcugggccguggcaucuuggaaaacuagagcuagacuuuaauuacugcgaagggacaacugugguaauagcagaaaauuguggaacucgaggaccuucacuccgaacaacaacgguuagcggcaaacuaauacaugagugguguugccggucauguacacuaccgccucucagauauaugggagaagacgguuguugguaugguauggagauaagaccuauaaacgaaaaagaagagaacauggucaaaucauuaguuucagcagggucuggaaaagucgauaauuucacuaugggugucuugugucuugcgauacuauuugaagaaguuaugagagggaaauucgguaagaaacacaugaucgcgggaguccuauuuacuuuuguccuuuuauuaucagggcaaauaacuuggagggacauggcacacacacucauuaugaucggaucaaacgcgagcgauagaaugggcauggggguuacauauuuggcguuaauugcuacauuuaaaauucaaccuuuucuugccuugggauuuuuccuucguaaacuaaccucacgugaaaaccuccuucuugggguggguuuagcgauggcaaccacauuacaacuaccugaagauauagaacagauggcaaauggcauagcauuaggguuaaugacgcuaaaauuaauaacacaguuugaaacauaucaacucuggacugcucuugucuccuugacguguaguaauacuaucuuuacccucacgguagcauggcgaacagcaaccuugauacuagcaggagugucucuccuucccuugugucaaucgucgucuaugcgaaaaacagacuggcugcccaugacuguagcagcuaugggagucccacccuugccacuauuuaucuuuucccuaaaagacacuccaaaacgaaggucauggcccuuaaacgaaggagugauggcaguagggcuggugucgauccuagcguccucucuacuaaggaacgacgugccaauggcugggccguuaguagccggugguuuacuuauagcauguuacguaauuacaggaaccucagcagaucucaccguugaaaaggcagcagacguaacaugggaagaagaagcagaacagacaggaguuucucauaauuuaaugauaacaguggaugacgauggaaccaugaaaauuaaggacgaugaaacagagaacauacuaacuguguuauugaaaaccgcuuuacugaucguuucaggaauauuucccuacaguauaccagcgacucuauuaguuuggcauaccuggcaaaagcaaacucaacgaucaggcguucuuugggauguaccaucuccaccggagacacagaaagcugaacucgaagaaggaguauacaggauuaaacaacagggcauauucggaaaaacccaaguuggugugggcguccaaaaagaagggguuuuccacaccauguggcacguaacaagaggugcuguguugacacacaauggaaaaagauuagaaccaaauugggcgagugucaagaaagauuuaaucuccuacgguggcggauggagauuauccgcucaauggcaaaagggcgaagaagugcaagucauugcuguagagccuggaaagaauccuaaaaauuuccaaaccaugccggguaucuuccaaaccacuaccggagaaauuggagcaauugccuuggacuuuaaaccaggcacaucuggcagcccuauaaucaaccgagaagguaaaguagugggccuuuacgguaauggcguaguaaccaaaaauggaggauauguuucugggaucgcacaaacaaacgccgaaccggacggacccacgccugagcuagaagaggagauguuuaagaaacguaaucuuacuauuauggauuugcauccgggaucuggcaaaacaaggaaauaccuuccugcgauagucagagaggccauaaaaagaagacucaggacauuaauccuugcaccaacaagagugguagcugcugaaauggaagaggcuuuaaaaggucuuccaauccgauaucaaacaacugccacaaaaagcgaacauacagggcgagaaaucguagaucucaugugucaugcaacuuuuacgaugcgcuuguugucaccagucagaguccccaacuacaaccuaguuauuauggaugaagcacauuuuacagauccggcgucuauagcagcuagaggauauauaucgacacggguaggaaugggggaagcggcagcgauuuuuaugacugcuacuccgccaggaacugcugaggcauucccacaaucuaaugccccaauucaagaugaagaacgagauauaccagaaaggucauggaacucagguaaugaauggauaaccgacuuugugggaaagacuguuugguuugucccgucuauaaaagccgguaacgacauagcgaacugucuacgaaagaauggcaagaaaguuauacaauugagcaggaaaacauuugauacagaauaucagaaaacaagguugaacgauugggauuuugucguaaccacagacauuagugagaugggugccaauuucaaagcagauagggucauugacccccgucgauguuugaaaccuguaauuuugacagauggaccagaacgaguuauccuagcuggacccaugccagugacagcagcuagugcagcacaaaggagaggcaggguuggcagaaauccacaaaaagaaaaugaccaauauauuuuuaugggucaaccucuaaacaaugaugaggaucacgcucauuggacagaggcaaagauguuacuugauaauauaaauacaccugaagccaucauacccgcucuauuugagccugaacgugaaaagagcgcggcaauagauggagaauaccgucuaaaaggugaaagccgcaaaacguucguggaauugaugcgacgaggggaucugccuguuugguuagcccauaaaguagcaucggaagggaucaaguauaccgaucguaaauggugcuuugauggggaacgaaauaaucaaauacuugaggagaauauggacgucgagauuuggacaaaagagggagagcguaagaaauuaagaccccguugguuagaugcacggacauauuccgacccuuuagcacuaaaagaauuuaaagauuucgcagcggggagaaaaucaauugcauuagacuuaguuacugaaauaggaaggguucccagucaucucgcacaucgaacaaggaaugcgcuugacaaucuaguuaugcuacauacaagugaacacggcggucgugcuuaucggcaugcugucgaagaacuaccagaaaccauggaaacacugcuacuguuaggacugaugauacuauuaaccggcggugcaauguuguuccuaauaagcggaaaaggcauaggaaagacauccaucggauuaauauguguaauuguaaguucgggcaugcuuuggauggcugacguaccauuacaguggauagcaagugcaauaguacucgaguucuuuaugaugguauuacuuauaccagaaccagaaaagcaaaggacuccacaagauaaccaacuggcuuaugucguaauugguauuuugacacuagccgcaauaguugcugcuaaugaaaugggcuuacuggaaacaacuaaaagggaucuuggcaugucgaaagaaccgggggucguaucaccaacaaguuauuuagauguugauuuacauccagccucagcguggacacuauaugcuguggccacgacagucaucacgccaauguuaagacauaccauagaaaauucgacugcgaauguaucauuagcugcuauugcuaaucaggcaguaguacuaaugggauuggacaaggguuggcccaucaguaaaauggaucuaggcguaccgcuauuagcuuuaggauguuacucacaagucaacccccuaacacuaacagcagcuguauugcugcuaguaacucacuacgcaauuaucggaccgggccuccaagcuaaagcaacaagagaagcccagaaaaggaccgcagcaggaaucaugaagaauccgacaguagacggaauaaugacgauagacuuagauccaguuauuuaugauucaaaauucgaaaaacaauugggccaaguaaugcuccuaguacugugugcuguccaauuacuccucaugagaacaaguugggcauuaugugaggcacuaacuuuagcuacuggcccaauaacgacacuuugggaaggaucaccgggaaaguucuggaauacuacaauagcugucuccauggcgaauauuuuucgagggucuuauuuagcaggagcuggauuagcguuuagcauaaugaagagugugggaacaggaagaagaggaaccggaucucaaggggaaacccugggagagaaauggaagaagaaacugaaucaguuaucacguaaagaguuugaccucuacaagaaaaguggcauuacugaaguagaccgcacggaagccaaagaaggccugaaaagaggcgaaaccacccaucacgcuguaucaagaggaucugcaaaacugcaaugguucgucgaaagaaauauggugauuccggaggguaggguaauagaucuaggauguggucgcggaggauggaguuauuauugcgcagguuugaaaaagguaacagaagugagagguuauaccaaggguggaccaggacacgaggaaccuguacccaugaguacauauggauggaauauaguuaaguuaaugagcgggaaggacgucuucuaucuuccgcccgaaaaaugugauacucuccugugugauauuggugaaagcucaccuaguccaaccguagaggaaagcaggacaauuaggguuuuaaaaaugguugagccauggcuacgcucgaaucaauucugcauaaaaguauuaaacccguacaugccuaccguuauugagcaucuagaacgacuacaacguaaguaugguggaaugcuggugagaaacccauuaagcagaaauuccacccaugaaauguauuggauuucaaauggaacagguaacaucgucucgucugucaacauggucucaagacuacuacugaaccgauuuacuaugacgcaucguagacccacuaucgaaaaagaugucgaccucggagcuggcacaagacaugugaacgcggaacccgaaacaccaaacauggauguuaucggcgagcggauuaagcggauuaaagaagaacauucaaguacuuggcauuacgaugaugaaaauccauacaagacgugggcuuaucauggaucauacgaggucaaagccacaggaucagcuucaagcaugaucaacggaguaguaaaacucuugacgaaaccaugggauguaguuccgaugguuacacagauggccaugacugauacgacaccuuuuggucaacagaggguauucaaagaaaaaguugauacaagaacacccagaccaaugccuggaacaagaaaagucauggagauuacugccgaauggcuguggagaacacuuggacgaaacaaaaagccccgauuauguacacgagaagaauuuaccaagaaaguaagaaccaaugcugcaaugggggccguuuuuacagaagaaaaccaaugggacucugcacgcgccgcgguagaagaugaagaguuuuggaaauuaguagauaaagaacgagagcuccauaaauuaggaaaauguggaaguugcgucuacaauaugaugggaaagcgagaaaagaaauuaggggaguuuggaaaggcuaaggggagcagagccaucugguauaugugguuaggagcucgcuacuuggaguucgaagcacuaggauuuuuaaacgaagaucacugguuuagcagggaaaauucuuacagcggaguagagggagaagggcuacacaaacuuggauauauacuacgagauauaucgaagauucccggcggagcaauguaugcggaugacacugcuggcugggauacuagaauaacagaggacgauuuacacaaugaagagaagauuacucaacagauggacccagaacauagacaguuagcuaaugcaauauuuaaacuuacguaucaaaacaaaguaguaaaaguacaaaggccgaccccaaagggaacaguaauggauauaauaucucgaaaagaucaaagaggcucagggcaaguggguacguauggauugaacacauucacgaacauggaagcacagcuugugcgccaaauggaaggagaagggguucucucaaaagcugauuuagaaaauccacaucuauuagagaagaaaauuacacaaugguuagaaacuaagggaguugagagauuaaaacguauggccauaucgggggaugauugcgugguaaaaccuauagacgaccgauuugcgaaugcuuuauuggcacuaaacgacaugggcaaaguccgcaaagacauuccucaauggcaaccaaguaaagguuggcacgauuggcaacaaguaccuuucugcagucaucacuuccaugaauugauuaugaaagacggcagaaaacuugucguuccaugucgcccccaggacgaacuuaucggucgagcccguaucucgcaaggugcaggcuggagccugaaagaaacugccugucuaggaaaagcauacgcccaaauguggucuuuaauguacuuccacagaagagaccugagacuugcgucuaaugccauuugcagugcaguuccuguacauuggauaccuacaagucgaacaacguggagcauacaugcgcaccaccaauggaugacuacagaggauauguuaacagucuggaaucguguuuggauugaagacaacccauggauggaagacaaaacucccguuacaaccugggaggauguuccuuacuuagggaaacgugaggaucaguggugcgguagucuuauugggcuaacuucuagagccacgugggcccaaaauauuuugacugcuauacaacagguaagaucauuaauuggagaugaagaguuccuagacuacaugccaagcaugaaaagauuccgaaaagaagaggaaacagaaggagcgauuugguga

SEQ ID NO: 23117 - RNA, 9873 nt, Artificial Sequence
  derived and/or modified CDS sequence (opt6) from DENV-3__GU131939__SS-prME
acaagucugugcuuaaugaugaugcuuccagcaacacuagcauuccaccuaacuagcagggauggggaaccucggaugauaguuggcaaaaaugaacgagggaaaucauuacuauuuaaaacugcaagugguauuaauaugugcacccugauagcgauggaccuuggagaaaugugcgaugauacagugacauacaaaugcccacuaauagcagaaguugaaccggaagauauagacugcuggugcaaccuaacaucaaccuggguaacuuacgggaccugcaaccaagcgggggaacaccggagagacaaacguucaguugcccuagcaccacauguagggauggguuuggacacccgcacucaaacuuggauguccgcagaaggagcauggagacaaguagaaaaaguagaaacuugggcauuaagacacccugguuuuaccauucucgcacuuuucuuggcucauuacauaggaacuagcuuaacacaaaaaguuguaauuuucauuuuacuaaugcuugucacgccaucgaugacaaugcgaugcguugguguuggaaauagagacuuugucgaaggucuaucuggagccacuuggguggauguggucuuggaacacggggguuguguuacgacuauggcuaaaucgaaaccaacgcuggauauagaauuacagaaaacagaagcuacacagcucgcuacauuaaggaaauuguguauugaagggaaaauaacaaauauaaccaccgacucacgaugucccacucaaggggaagcaacauugccagaagaacaagaccaaaauuacguuugcaaacacacuuauguugauagggguuggggaaaugggugcggacucuucggaaaagguagcuuaguuacaugugcaaaauuccaaugccuugaaccaauagaaggaaaaguuguacaauaugagaacuugaaauacacuguaauaauuacuguacacacaggagaucaacaucaaguuggaaaugacacacaaggaguuacagucgagaucacuccacaggcaaguacgguugaagcaguuuuaccagaauacggcacacuaggccuugaguguaguccaagaaccggacuggauuuuaaugaaaugauauuauugaccaugaagaauaaagcauggaugguacauagacaaugguuuuucgaccugcccuugccauggacaaguggggcuacaacugagaccccaacuuggaacagaaaggaacuacuugugacguuuaaaaacgcacaugcgaaaaagcaggaaguugugguauugggaucacaggaaggcgcaaugcauacggcucuaacaggagcaacagaaauccaaaauuccgggggcacaaguaucuuugccggacauuuaaaaugcaggcuaaaaauggacaagcuggaacuaaaaggcaugaguuaugccaugugucuaaauacauucguucucaagaaagaaguuucggagacccaacaugguacaauauuaauaaaaguagaauacaaaggagaggacgcacccuguaaaauccccuucucuaccgaggacggccaaggaaaagcacauaacggucguuuaauaacugcuaauccugucguaaccaagaaagaggagccgauaaauaucgaagcugaaccaccauuuggcgaaagcaauauaguaauaggcauaggugacaaggcacuuaaaaucaacugguauaagaaagguaguucaauaggaaagauguuugaggcgacagcccggggagcuagacgaauggccauauuaggcgacacugcaugggacuuuggaagugucgguggcgucuugaacucucuuggaaaaaugguacaccaaauuuucgguagcgcauacacagcucuguuuuccgguguuucauggauaaugaagauagguauaggugugcuccuaacguggauaggacugaacaguaaaaacaccaguaugagcuucucaugcaucgugaucggcaucaucacauuguaucucggugcaguagugcaggcggauauggguugugugauaaauuggaaaggcaaagaacuuaaauguggcaacggaauuuucguuacuaacgagguacacacuuggacagaacaauacaaauuccaagcggacagucccaaacgacuagcuacugcgauagcuggugcgugggaaaacggaguaugcgguauucguuccaccacccgcauggaaaaucuacuauggaagcaaauugcaaaugaacucaauuacauuuuaugggaaaacaauauaaaacucacgguuguuguuggugauauaauaggaguacuagaacaaggcaagagaacauugacaccccaaccaauggaauuaaaauacucuuggaaaacuuggggaaaagcaaagauuguaacggcugaaacucaaaauucuuccuucauaauagaugggccaaacacuccugaaugcccgucagcgucgagagcuuggaacguaugggaaguagaagacuauggauuuggaguauuuacuacuaacaucugguuaaaacuuagagagguguauacucagagcugugaucacagacucaugagugcggcuaucaaagacgagagggcaguccaugcugauaugggauauuggauagagucccagaagaauggaaguuggaaauuagaaaaggcuuccuuuauagaagugaaaaccuguacguggccaaaaucacacacgcuuuggagcaaugggguuuuagaaagugacaugauaauuccgaaaucuuuagcagguccuauuucacaacauaaucaucgaccaggguaucacacacaaacggcagguccuuggcaucugggaaaacuagaacuagauuucaauuacugcgagggaacaacgguugucauugcugaaaauuguggcacucgcggcccaucauuacgaacuacaacaguaucaggcaagcuaauacaugaauggugcugccgaucauguacauuaccuccccugagauauaugggggaagacgggugcugguacgguauggaaauuaggccuauaaaugaaaaagaagaaaacauggugaaaucucuaguaagugcaggcaguggaaagguagacaacuucaccaugggaguauuaugccuggcaauucuauucgaggagguuaugcgcggaaaguuuggcaagaaacacaugaucgcuggcguauuauuuacauucguuuuauuacuguccgggcaaauaacauggagggauauggcacacacguuaaucaugaucggauccaacgcgagcgaucgcauggguaugggugugaccuaccuagcuuuaauugcgacguucaaaauacagccuuuucuugcacuuggauuuuuccuacgcaaauuaacgucaagagaaaaucugcuauuagguguagguuuagcgauggcaacaacgcugcagcucccagaagauaucgagcaaauggcaaauggaauugcucuuggauuaaugacccuaaaguuaauaacacaauuugaaacguaucagcuuuggacagcucuagugaguuuaacauguuccaacaccauauuuacacuaacaguagcauggagaacagcaacguugauucuugcggggguaucucuccuuccacuuugccaaaguuccucaaugagaaagacagauuggcuaccuaugacaguugcggcgaugggcgugcccccuuuaccgcuuuuuaucuuuucacuaaaagauacacccaaaagaaaaucauggccucuuaaugaaggcguaauggccgugggacucguaucaauuuuagcaaguagccuacuaagaaaugacgucccuauggcugguccacuugucgccgggggacuacuaaucgcauguuauguaauaacuggaaccucagcagacuugacaguagaaaaggccgcugaugucacaugggaagaggaagcagaacaaacgggaguaagucacaacuuaaugaucacagucgacgaugauggaacaaugcggauaaaggaugaugaaacggaaaauauucuuacaguuuuacuaaaaacugcauuauuaauaguuagugggaucuuuccauacucaauaccagcaacacuauuagucuggcauaccuggcaaaaacaaacacaacgaagugguguucuuugggauguccccagcccuccugagacccaaaaagcugaguuggaagagggugucuaucgcauaaagcaacaaggaauauuuggaaaaacccagguugguguggguguucagaaggaagggguauuucacacgauguggcauguaacaagaggagccguccuaacacacaaugguaaacgacuagaaccuaacugggcaagugucaagaaagacuuaauauccuauggaggaggauggagacuaucagcccaguggcaaaaaggugaagagguacaggucauagcaguagaacccggcaaaaaucccaaaaauuuccaaacgaugccgggaauauuccaaacuacuacaggggaaauaggugccauagcccucgacuucaagccgggcacuuccggcucgccuaucaucaaccgagagggcaaaguaguaggacucuauggaaauggcgugguuacuaaaaauggaggcuauguuucggggauagcucaaacuaaugcagaaccugauggacccacuccugaauuagaagaagaaauguuuaagaagagaaacuuaaccauaauggauuuacacccuggcucagguaagacacgaaaauaucuaccagccaucguaagggaagcgaucaaacgccgacuuagaacauugauacuagcucccacaagagucguugcagcagaaauggaggaagcauuaaagggcuuaccaauaagauaucaaacuacagcaacaaaaagugagcauacagguagagaaauugucgaccugaugugccaugcaacauucaccaugagauuacuuucaccuguaagaguuccuaauuauaacuugauuauaauggaugaagcacauuucacagacccggcaucuauugcagcuagaggauauauauccacgagagucgggaugggugaagccgcggcaauauuuaugacggcgacgccuccugggacagcggaggcuuuuccgcaaagcaaugcgccgauacaagaugaggagagggacauuccagaaagaaguuggaacucagggaaugaauggauuacugauuucguagggaaaacgguuugguuuguacccucuauuaaagccggaaacgacaucgcuaacugucuccguaaaaacgggaagcgaguaauacaacuaucaagaaagacauucgacacugaauaccagaaaacacgucuuaacgacugggauuuuguaguaacuacagacauuucagaaaugggggcgaauuucaaagcugaucguguaauagaccccagaagaugucuaaaaccagucauauuaacugacgguccugaacgagugauccuagcugggccuaugccgguaacugcagcaucagcagcacaacgccguggaagagucgguagaaacccacaaaaagaaaaugaccaguacauauuuacaggccaaccacuuaacaaugacgaagaucaugcccacuggacugaagcuaaaauguugcuggauaauauaaacacaccugaagggauaauaccugcacuauuugaaccugaacgcgaaaaguccgcagcuauagacggcgaauacagacuaaaaggcgaaagccguaaaacuuucguagagcucaugcgacgcggugacuuaccaguauggcuggcucacaaagucgcaucggaagggaucaaguacacggaccgcaaguggugcuuugacggugagagaaauaaucaaauacuggaagaaaacauggaugucgagauuuggaccaaagaaggagaacgaaagaaacucagaccaagguggcucgacgcuagaacuuacucggacccacuagcacuuaaagaauuuaaagauuuugcagcgggaagaaaaaguaucgcacuugaucuugugacagaaauaggaagaguaccaucacaccuagcacacagaaccagaaacgcuuuagacaauuuaguaauguuacauacgagugaacacggaggacgagccuaucgacacgcuguggaagaacucccugagacuauggaaacacuucuuuuacuaggcuuaaugaucuuguugacugguggggcgaugcuguuucuuauuuccggcaaaggaaucggcaaaacaucaauuggacuuauuuguguaauaguaagcaguggcaugcuauggauggcggauguuccauugcaauggauagcuagugcgauaguacuagaauuuuucaugaugguuuuacuaauaccugaaccagaaaaacaaagaacaccacaagauaaccaacuagcguacguugugauuggaauccugacauuagcagcgauugucgcggcuaaugagaugggauuacuagaaacaaccaaaagggaucuggguaugucaaaagagcccggaguuguuucgccaacuagcuaucuugaugucgauuugcacccggcuucggcuuggaccuuauacgcaguugcaacuacuguaaucaccccaauguuaagacacacuauagaaaauuccacugcaaauguaagucucgcggcaaucgcaaaucaagcagucguacuuaugggccucgauaagggauggccaauaaguaaaauggacuuaggaguaccacuucuagccuuagguuguuauagccaaguuaauccgcugacgcuaacggcggcagucuuacucuugguaacccacuacgcaauaaucgguccaggccuucaggccaaagcuacuagagaagcccaaaagcgaacagcagcugggauaaugaaaaacccaacaguggacgggauuaugacuauagaccuagauccgguaauauacgauucuaaauucgaaaaacaauuaggccaaguaaugcuauuagucuuaugugcgguacagcuucuccuaaugaggacaaguugggcauugugugaagccuuaacccucgcaacgggaccgauuaccacacucugggaaggaucgcccgguaaguuuuggaauaccaccauagcgguauccauggccaauauauuuaggggguccuauuuagccggagccgguuuagcuuuuucuaucaugaaaucugugggaaccgguagacgaggaacaggaucacagggcgaaacacuuggugaaaaauggaagaagaaauuaaaucaauuaagucgaaaggaguucgaucuauauaagaaaucaggaaucacagagguugaucgaacagaagccaaagaaggucuuaagagaggugaaacaacacaucacgcgguaagucguggaucugcgaaauuacaaugguuuguugaacgaaacaugguaauuccugaaggaagaguaauagauuuagguuguggcagagguggguggagcuauuauugugcaggacuaaagaaaguaacugagguaagaggcuacacuaaaggagggccgggacacgaagaaccagucccgaugaguaccuauggauggaacauaguaaaguuaaugucggguaaagauguauuuuauuugcccccagagaaaugcgauacacucuuaugugacauaggggaaaguucgccaucaccuacuguagaagaaucaaggacuauacgggucuuaaaaaugguagagccuugguuaaggaauaaccaauucugcauaaaaguacucaauccauauaugcccaauguaauagaacauuuagaaaggcuucaacgaaaauacggagguaugcugguaagaaacccguuaucacguaacuccacacacgaaauguacuggauaagcaacgguaccggaaacauaguuucuagcgucaauauggucaguagauuguugcuaaaccgguuuacaaugacacauaggagaccaacgauagaaaaagaugucgauuuaggugcaggaacaagacacgugaaugccgaaccagaaacucccaacauggauguaauaggcgaaagaauaaaaagaauaaaggaggaacacucuucaaccuggcacuaugacgaugagaauccuuacaaaacgugggccuaucacggaagcuaugaagucaaggcaacaggaagugcgucaucaaugauaaaugggguugucaaguuacuaacaaagcccugggacguugucccgauggugacccaaauggcaaugacagauacaacaccuuucgggcaacagcgagucuucaaagaaaaaguagauacccguacuccaagacccaugccagggaccagaaaaguaauggaaauaacagcggaaugguuauggcggacacuuggcagaaauaaaaagccucgcuuauguacacgugaagaauuuacaaagaaaguaagaacaaaugcugcaaugggugcaguauuuacagaagagaaccagugggauucugcacgagcagcaguggaagaugaagaguucuggaaacucguggacaaagaacgagaacuacauaaacucgguaaaugugguaguugcguguacaauaugauggguaaaagagaaaagaagcuaggcgaguuuggaaaagcgaaggguucucgagcaauaugguauauguggcuaggugcccgguauuuagaguuugaagcacuaggauuuuuaaacgaagaucauugguucagucgagaaaauagcuacucugguguggaaggugaaggauuacauaaguugggauauauucuucgagauauaucuaaaauacccggcggcgcuauguacgccgacgacacggcggggugggacacaagaaucacggaagaugaucuucacaaugaagagaaaauuacgcagcaaauggaucccgaacacagacagcuggcuaaugcuauauuuaaauugacguaccagaauaaaguggucaaggugcaaagaccuaccccgaagggaacaguaauggauauuauaucaaggaaagaccaaaggggaagcggacaaguuggaacauauggacugaauacauucaccaauauggaagcccaacucguuagacaaauggagggagagggaguacuaagcgaagccgauuuagaaaacccgcaucuccuagagaagaaaauaacgcaauggcuggaaaccaaagguguagagagacugaagcggauggccauaaguggagacgacugcgucguaaagccaauugaugacagauuugcaaacgcccucuuagcacuaaaugauauggguaaaguaagaaaagacauuccucaguggcaaccaucuaagggcuggcaugauuggcaacaaguuccauucugcucucaucauuuucacgagcuaauaaugaaagauggccggaaauuaguuguaccauguaggccccaagaugaacuaauugggagagcgagaaucagucaaggagcaggauggucauuaaaagaaacugcauguuuaggaaaggcauaugcacaaauguggagucucauguauuuccaucggcgagaccucagacuagcgucaaacgcaauuugcagugcaguaccaguacacuggauuccaacaagucgcaccacauggaguauacacgcucaucaucaauggaugaccacugaggauaugcugacaguguggaacaggguauggauagaggacaacccauggauggaagacaaaacaccuguaacuaccugggaagauguacccuauuuggggaaacgagaagaccaauggugcggaagucuuaucggcuuaacuuccagagcuacaugggcacagaauauacuaacggcaauacaacaaguaagaaguuugauuggggacgaagaguucuuagauuauaugccgucgaugaagagauuccgaaaagaggaagaaucugaaggagcaauaugguaa

SEQ ID NO: 23118 - RNA, 9873 nt, Artificial Sequence
  derived and/or modified CDS sequence (opt6) from DENV-3__GU131940__SS-prME
acaagccugugcuuaaugaugauguuaccagcaacucuagcauuucauuuaacgucaagagauggugaacccaggaugauagucgguaaaaacgaaagaggaaaaucccuauuauuuaaaacggcuucuggaauuaauauguguacucucauugcgauggaccuuggagaaaugugcgaugauaccgucacauacaaaugccccuuaaucgcggaaguagaaccagaagauauugauuguugguguaaucugaccucuacuugggugacguacggaacauguaaccaagcuggcgagcauagacgagauaaaaggucaguugcacucgcuccacauguugguaugggauuagauacuagaacucaaaccuggaugagugcggaaggagcuuggagacaaguagaaaaaguugaaacaugggcauugcgacauccaggauucacaauauuagcucucuucuuagcucauuacauuggcacgucccuuacccaaaaagugguuauuuucauauuacuaaugcuaguuaccccauccaugacuaugagguguguaggcguaggcaaucgggacuuuguggaaggacuaucuggcgcuaccuggguagacguuguacuugaacaugguggauguguuacuacaauggcgaaaagcaagccuacccuugacaucgagcuacagaaaacugaagcuacccaacuagcaacauuacggaaacuauguauagaaggaaagauuacuaauauaacuacagacucaagguguccaacgcaaggagaagcaacucucccagaagaacaagaucaaaacuauguaugcaaacauacauacgucgaccgaggauggggaaacggauguggauuguuugguaaagguucccuaguaaccugugcuaaguuucagugcuuagagccuauagaagggaaaguaguacaguaugaaaauuugaaauacacuguaauaauaacggugcacaccggggaucaacaucaggucggaaacgacacacaaggcgugacuguagaaauaacaccacaagcgagcacgguagaagccguucuaccagaauaugggacccuaggccuugaauguucgcccagaacuggauuggauuuuaaugagaugauacuauugacuaugaagaauaaagcauggauggugcauagacaaugguucuuugaucuuccacuaccuuggacaucaggugcaacuacagaaaccccuacauggaaucguaaagaacuccuugugacauucaaaaacgcucaugcgaaaaagcaggagguagucguacuaggaucucaagaaggugccaugcauaccgccuugacgggugcaacugaaauucaaaauaguggaggaaccaguauauucgcuggacauuuaaaaugucgccuuaagauggauaaacucgaacuaaaggggaugucguacgccaugugccuaaauacguucguucuaaagaaagaaguguccgaaacgcaacaugguacuauccuaauaaagguagaguacaaaggcgaagaugcuccauguaaaaucccauucagcaccgaagacggacaagggaaagcccacaacgggcgguuaauaacagccaaccccguaguaacaaagaaggaagaaccagugaauauagaagcugaaccgccauucggugaaucaaauauagucaucgguauaggcgacaaggccuuaaagauaaacugguauaagaaagguagcagcauagggaaaauguuugaggcuacugcucguggugcacgaaggauggccaucuuaggcgacacagccugggacuuuggaagcguagguggcgugcuuaauucguuaggaaagaugguacaccaaauuuuuggauccgcauacaccgcgcuauuuucgggaguuucauggauaaugaagauaggaaucgggguccucuuaacuuggauuggacugaacucaaagaacacaagcauguccuucagcuguauagugaucgguauuauaacacuauauuuagguacaguaguacaagccgauauggguugugcuauuaauuggaaaggaaaggaacucaaaugcgguucaggaauuuucguaacgaaugaaguacacacuuggaccgaacaauacaaguuucaggcagacaguccuaaaagacuagcaacagcaaucgcaggagcuugggaaaauggaguaugcgguauccgcuccacaacuaggauggaaaaccuguuauggaaacaaaucgcgaaugaacugaacuacauacugugggaaaauaacauaaaacuuacuguagucguaggagauaucaucgguguauuagagcaaggaaagagaacguuaacaccccagccaauggaauuaaaauacucauggaaaacuuggggaaaagccaaaauaguuaccgcugaaacacaaaauucaucguuuauuauugauggaccuaauacgccugaaugcccuucagcaucacgagcauggaaugugugggaaguggaagauuacgguuuugguguguuuacuacaaauauauggcuaaaauuacgugaaguguauacucaauccugugaucauaggcuaaugucugccgcuauaaaagaugaacgagccguacaugcggauaugggauacuggauagaaagccagaaaaauggcaguuggaagcucgaaaaagcaaguuucaucgaaguuaagacauguacuuggccgaaaucccauaccuuaugguccaacggaguucuugaaucugauaugauaauaccaaagucuuuggcagguccaauaucacaacauaaccaucggccgggcuaccacacgcagaccgcuggucccuggcaucuugguaaauuagagcuagauuuuaacuacugcgaggggacaaccguaguaaucacagaaaauugcggaacacgaggaccguccuuacggacuacuacgguaucuggcaaacuaauacaugagugguguugucgcaguugcacccugccaccacucagauacaugggugaagauggauguugguacgggauggaaauucguccuaucaacgaaaaagaagaaaauaugguaaagagcuuagucucggcaggcucgggaaaaguugacaacuuuacuaugggcguucuaugcuuggcuauacuuuuugaggaaguaaugagaggaaaauucgguaagaaacacaugaucgcaggaguucuuuucacuuuugugcuauuacuuuccggccaaaucacuuggagagauauggcucauacauuaauuaugauuggauccaaugcgucagaucgcaugggaauggguguuaccuaccuagcacuaauagccaccuuuaagauacaaccauuucuagcacucggauucuuucuucgcaaacuaacgagucgggaaaaucuacuucuaggaguagguuuagccauggcaacuacuuuacagcuaccugaagacauugagcagauggccaauggaaucgcuuugggucuuaugacgcuaaaguuaauaacacaguucgaaacauaucaguuauggacugcauuagucucccucacaugcucaaauaccauuuuuacauuaaccguagccuggagaaccgcaaccuuaauacuagccggugucucacuguuaccuuuaugucaauccucgucgaugagaaaaacugauuggcuccccaugacaguagcugcgaugggugucccaccauuaccgcuauuuauuuuuaguuuaaaggacacuccaaagcgacgaagcuggccacuuaaugagggagucauggcaguuggauuaguaaguaucuuagcaucaucacuuuuaagaaaugauguccccauggcuggcccauuagucgcagggggauugcucauagcuugcuaugucauaacagguacguccgcagauuuaacggucgaaaaagcagccgauguaacaugggaagaagaagcagaacagacaggaguaagucauaaucuaaugaucacggucgaugaugacgggacaaugcguauuaaagaugacgaaacugaaaacauacuuaccguguugcucaagacggcacuacuaauugucaguggaauauuuccauauucgauaccagcuacucuccuaguguggcacacauggcaaaaacaaacacaaagauccggaguauuaugggauguaccaagcccacccgagacacaaaaagccgaacuggaagaaggagucuacagaauaaaacaacagggaaucuucggaaaaacacaaguaggggucggaguacaaaaagaaggugucuuucacaccauguggcaugugacaagaggcgcaguacuuacucacaauggaaaacgauuggaaccaaauugggcaagugugaagaaagaucuaauaucauacgguggcggauggagauugaaugcacaauggcaaaagggagaagaaguacaaguuauagccguagagccggguaaaaaucccaaaaacuuccaaacgaugcccggaauauuucaaacaacaacaggagaaauaggcgccauagcucuugacuucaagccuggcacaucagguucaccaauuaucaaucgggaagguaagguugugggcuuguaugguaacggcguaguuacaaagaauggaggguauguaaguggaauagcgcaaacaaacgcagaaccagaugggccgacaccagaacucgaagaagagauguucaagaaacgaaaccuuacaauaauggauuugcaucccggaagugggaaaacaagaaaauaucuuccagcgauaguccgagaagcuauaaaaagaaggcuacgcacauuaauacuagccccuacgagggucguagcugcagaaauggaagaagcgcuuaagggccugccaauucgauaccagacgaccgcaacaaagucugaacauacaggacgagagauaguugauuuaaugugccaugcuacauuuaccaugagacuacuaucaccagugcguguaccaaauuacaacuuaguaauuauggacgaggcucacuuuacggacccagcgucaaucgcugcgagaggauacauaucgacacgaguagguaugggcgaagccgcagccauauucaugacggccacaccaccaggaacagcugaagcauucccucaaucaaaugcaccuauucaggaugaggaaagagauauaccugagagaucauggaacuccgguaaugaauggauuacugacuucguagguaaaacuguaugguucgucccaucgauuaaggcagggaacgacauagcuaacugccuuagaaagaaugguaagaaagugauacaauugaguaggaaaacuuuugacacagaauaccagaaaacaagacugaacgauugggauuucgucgugacgacagacauaucagaaaugggagcaaacuuuaaggccgauaggguuaucgauccaaggcgcugucugaaacccgucauacugacggauggcccugaaagaguaauucuagcugggccaaugccaguaaccgccgccuccgcagcacaaaggaggggacgugucggacguaacccacaaaaagaaaacgaucaguauauauucacgggucagccucugaacaacgacgaggaccaugcgcacuggacagaagccaagaugcuauuagacaauaucaauacgccagaaggaauaauaccagcgcuguucgaaccugaaagagagaaaagugcagcaauugauggggaauaccgauugaaaggugaaaguagaaaaaccuuuguggaacuaaugcgucguggcgauuuacccgucugguuggccuauaaaguagcaagugagggaaucaaguauacugaucguaagugguguuucgauggcgaacguaacaaccaaauauuagaggaaaacauggacguggagauauggacuaaagagggcgaaagaaagaaacuaagaccccgcuggcuugaugccagaacauacagugacccccucgcucuaaaagaauuuaaagauuuugcagcggggagaaagagcaucgcacuagaccucgucacugagauagggagaguaccaucucaccucgcgcaccgaacucgcaaugcucuggauaauuuaguuaugcuacacaccucugagcacggagggagggccuauagacaugcaguugaagaacuccccgaaaccauggaaacccuccugcuauuaggacuaaugauacuuuuaacagguggcgcuauguuauuucugauaucagguaaagggaucgguaagacaagcauuggucuuauuugcguaauaguaaguucuggcauguuauggauggccgacguaccguuacaauggauagcuagugcaauugugcuagaauuuuucaugaugguauuauuaauaccggaaccugaaaaacaaagaacaccacaagacaaucaacuggcguacgugguaauagggauucuuacauuggcugcgaucguagccgcaaacgaaaugggauuauuagaaacaacaaagagagacuuaggaaugucuaaggaaccagguguagugucaccaacaaguuaccuugauguugaucuacaccccgcuucagcguggacguuauaugccguugcuacuacaguaauaaccccgauguugcgccauacuauugaaaauucaacggcaaacguaucacuugcagcuauugcaaaccaggcagugguccuuaugggcuuagauaaaggcuggccuaucuccaagauggauuuagguguaccuuuacucgcguuaggaugcuacucucaaguuaauccacuaacacuuacugcugcaguuuuacuauugguuacgcauuaugcuaucauagguccaggacugcaagcuaaagcgacucgcgaggcacaaaaacgaaccgcagcugggaucaugaagaacccgaccguagauggcauaaugacuaucgacuuggacccagugauauaugauucuaaauuugagaaacaacuaggacaaguaauguuauuagugcuaugugccguucaacuauugcucaugaggaccucaugggcucuuugugaagcguugacgcucgccacggggcccauaacaacucugugggaagguaguccaggaaaauucuggaacacaaccauagcaguaaguauggcuaauauauuuagggggucauacuuagcuggggcaggacuagcauuuucgauaaugaagucggucggcacgggaagaagggguacaggcagucaaggggaaaccuuaggugaaaaauggaagaagaaacuaaaucagcuaagucgaaaagaguucgaccuauacaagaaaagugguauuacugaaguggaucguacagaagcaaaagaaggauuaaaacgaggggaaaccacucaucacgcagucucucgcggaagcgcuaaauuacaaugguuuguugaaagaaauaugguuauuccggaagguagaguaaucgauuuaggaugugggagagguggguggagcuauuauugcgcaggacucaagaaaguuacagaaguaagagguuauaccaaagguggcccaggacacgaagaaccagucccaauguccaccuauggauggaacauugucaaauuaaugucaggcaaagacguauucuaucucccaccagaaaaaugcgacaccuuguuaugcgauauuggagaaagcucgccaagcccuacgguagaagaaucgcgcacaauaagggugcuaaaaauggucgaaccauggcucagaaauaaccaauuuugcaucaagguuuuaaacccauauaugccaacagucauagagcauuuagagagauugcaacgaaaguacggcgguaugcuaguucguaauccgcugagcagaaauucaacccaugagauguauuggauaucaaacggaaccggaaauauugucuccucugugaacauggugagucgacuuuuacugaauagauuuacaaugacucaucgacgacccacgaucgagaaagacguggaucuaggcgcaggcacaagacacguuaaugcugaacccgaaacacccaacauggacgucauuggagaaagaauaaaacgaauaaaggaagaacacagcaguacuuggcauuaugacgacgaaaauccuuauaaaacgugggcuuaucauggauccuaugaagucaaagcuacuggaagcgcuucguccaugauuaacgguguagucaaauuauuaacaaagccaugggauguagugccuaugguaacacaaauggccaugacugacacuacaccuuuuggccaacaaagaguauuuaaggagaaaguagauacacggaccccacguccaaugccaggcacacgcaaggugauggaaauaacagcggaauggcuauggagaacauuaggaagaaacaagaaaccaaggcuauguacaagagaagaguuuaccaagaaaguaagaacgaacgcggcuaugggugcaguauuuacagaggaaaaucaaugggauagcgcgagagcggcaguugaagacgaagaauuuuggaagcucguagauagagaacgggaacuacauaaauuagguaaaugugguucauguguuuacaacaugaugggaaagagagagaagaaacugggagaguuuggcaaagcaaaaggaaguagagcuauuugguauauguggcucggagcuagauauuuagaguuugaagcgcuaggauuuuugaaugaagaucauugguuuaguagagaaaauucuuauucuggggucgagggugagggacuacauaaacuuggauauauccuuagagacauauccaaaauuccaggcggggcaauguaugccgacgauaccgcaggaugggauacuagaauaacagaagaugaccugcauaaugaagagaaaaucacucagcaaauggauccggaacacagacaacuagccaaugccauauuuaaauuaacauaccaaaauaaaguaguaaaaguacaaagaccaacucccaagggcacagugauggauauaauuucacgcaaagaucaaagggguagugggcaaguugguaccuacggucuuaacacauucacaaauauggaagcccagcuaguucgucaaauggaaggagaaggcguuuuaucaaaggccgaucuugaaaauccccauuuacuggagaagaaaauuacucaaugguuggaaacgaagggaguugaacggcuaaaaagaauggcaauuuccggagacgacugugucgugaagccaauagacgaccguuucgccaaugcauuguuagcauugaaugacaugggaaaaguaaggaaggauauaccacaauggcaaccuucuaaggguuggcaugauuggcagcaaguuccauuuugcagccaccauuuucacgaacuaauaaugaaggauggacguaagcuaguugucccuugcaggccacaagaugaacuaaucgguagagcgagaaucucacaaggugcaggguggucuuugaaagagaccgcgugccucggcaaagccuaugcacagauguggucgcucauguauuuucauaggagagauuuacgccuugcgagcaaugcgauauguucagcgguacccguacacuggauuccaacaagcaggacuacauggucaauucaugcccaucaucaauggaugacaacagaagauauguuaacggucuggaauagaguuuggauagaggauaauccauggauggaagacaagacaccuguaacaacaugggaagauguuccauaccuuggaaagagagaagaccaauggugugguucccuaauaggauuaacuucaagggcaacgugggcacagaacauacuaacggcaauccagcaaguuaggucucucauuggcgaugaagaauuucuggauuauaugccaucaaugaaacguuuuagaaaggaggaggagucugaaggugcaauaugguag

SEQ ID NO: 23119 - RNA, 9873 nt, Artificial Sequence
  derived and/or modified CDS sequence (opt6) from DENV-3__GU131942__SS-prME
acaucguuaugccuaaugaugauguuuccggcaacauuagcauuucacuuaaccaguagagauggugaaccgagaaugauuguuggcaaaaaugaacgaggaaaaucccuacuauucaaaacagcuucaggcauaaauauguguacauugauagcaauggaccugggggaaaugugcgacgauaccguaaccuacaaaugucccuugauagcagaaguugaaccggaagauauagauuguuggugcaauuuaacaucaacaugggugacauacggaaccuguaaccaagccggugaacaucgaagggauaaaaggagcguggcacuagcaccacauguagguaugggacuagauacgaggacccaaacauggaugagcgcugaaggagcauggagacaaguagaaaaaguugaaacgugggcacuccgacaucccggauuuacuauauuagcacuauucuuagcgcauuauauagggacaucacuuacacagaaaguugucaucuucauauugcuuaugcuagucacaccaucuaugacuaugagaugugucgggguuggaaaucgggacuuugucgaaggucuaucaggugcaacauggguagacguaguuuuagaacauggcggaugugucacgacgauggcaaaaaguaaaccaacacuugacauagaacuucagaaaacagaagcuacccaauuggcaacacuccgaaaacuuuguauagagggcaaaaucacgaacauuaccacagauucaaggugucccacccaaggugaagcgacacucccggaagaacaagaucaaaauuacguauguaaacauaccuauguugacaggggguggggcaauggcuguggauuauuuggaaaagggucguuaguaacaugugcaaaauuccagugccucgaaccaauugaaggaaaaguuguucaauacgaaaauuugaaauauacaguaauaauuacagugcauacuggggaucagcaccaaguaggaaacgacacucaaggaguaacaguugaaauaacuccacaagcgucgacaguggaagccguccucccggaguauggaacauuaggacuagaaugcagcccccggaccgguuuagacuucaaugagaugauacuauugacuaugaaaaacaaggcuuggaugguucauaggcaaugguuuuucgaucugccacuucccuggacuagcggagcaacaacagaaaccccaacauggaaccguaaagaguugcuuguuacguuuaaaaacgcgcaugccaagaaacaggaagugguuguauuagguucucaagaaggcgcaaugcauacagcgcugacuggagcgaccgaaauucaaaauucggguggaacaaguaucuucgcuggacauuugaaauguagauuaaaaauggacaaacuugaacuuaaaggaaugucauacgcaaugugucuaaauacauucgugcucaagaaagaaguguccgaaacccagcaugggacaauacugauaaaaguagaauacaaaggugaagaugcgccaugcaaaauaccauuuucuacugaagacggucaaggaaaagcccacucaggcagauuaauuacagcaaauccuguuguuacuaagaaagaagaaccagugaacaucgaagcugaaccgccguucggugaaucuaauauuguuauagguaucggagacaaagcacuuaaaauaaauugguacaagaaagggucauccauaggaaaaauguucgaagcaacagcuagaggagcuaggcguauggccauucugggcgacacagcaugggauuuuggaaguguaggcggugucuugaacucauuggguaaaauggugcaucaaauauucgguagcgcauauacugcucuauucucgggaguuucguggguaaugaaaauagguauaggagugcuuuugacguggauuggacuaaacagcaaaaauaccucaaugucauuuuccuguaucguuaucggaauaauaacucuauaccugggugcaguaguucaggcggauauggguuguguaaucaauuggaaaggaaaagaauuaaagugcggaucuggcaucuuuguuacgaaugaaguucauacuuggacagagcaguauaaauuccaagcugauaguccgaaaagauuagcaacugcuauagcaggcgccugggaaaacggaguaugugguauacgaaguacaaccagaauggagaauuuacucuggaaacagauugcgaaugaacuaaacuacauacuaugggaaaacaacauaaaacugaccgucgugguaggagauauaaucggaguacuagaacaagggaagagaacauuaacuccacaaccgauggaacuuaaauacaguuggaaaacgugggggaaagcaaagaucguaacagcugagacgcaaaauucgucauucauaauagacggaccuaauacuccagaguguccgucugccucgagggccuggaacguaugggaaguggaagauuacggguuuggaguauucacaacgaacauuuggcuaaagcuccgcgagguguauacucaaagcugugaccacagacuaaugucagccgccaucaaagaugaacgggccguucacgcagauaugggcuacuggauagaaagucagaagaacggcucguggaaacuagaaaaagcauccuuuauagagguaaaaacgugcaccuggccaaaaagccauacauuauggagcaaugguguacuagaaucggacaugaucaucccgaagaguuuggcagguccuauaagucaacauaaccauagaccgggguaccauacucaaacugcuggacccuggcaucuaggaaaacuugaguuagauuucaauuacugcgaaggaacaaccguagugauuacggaaaacuguggaacgagagguccgagucuacggacgaccacugucucagguaaauuaauacacgaauggugcugucgcucuugcacauugccuccgcugcgauacaugggagaagauggaugcugguacggaauggagauuagaccaauuaaugaaaaggaagagaauaugguuaagucccucguaagugccggaagugguaaaguagauaauuucacuaugggagugcuauguuuagcuauauuauucgaggaagucaugagagguaaauuugguaagaaacacaugaucgcugggguucuauuuacguuuguguuacuucuuagcgggcaaauaacguggcgugacauggcacacacucugauuaugauuggaagcaacgcuucugaccguaugggaaugggugugaccuacuuggcauuaauagcuaccuuuaaaauacaaccguucuuggcauugggcuucuucuuaaggaaacucacaucgcgagaaaaccuucuucucggggucggguuagcaauggcaacaaccuuacaacuacccgaggauauugagcaaauggcaaaugguauagcacuaggacuaaugacgcucaaguuaauaacgcaauuugagacuuaucagcucuggaccgcauuggugucuuuaaccuguaguaauacuguauuuacccuaacuguggcuuggcgcacagcaacguugauacuugcaggagugucgcuucugccacuaugucagucaucuaguaugcgaaaaacugauuggcuuccuaugacuguagcggccaugggaguuccgccacucccacuauuuauuuucagccuaaaggacacuccaaaaagacgaucauggccauuaaacgaaggcguaauggcaguuggacucguaucaauacuugccaguucccuauuacgaaacgauguaccaauggcagggccuuuggucgccggaggacuauugaucgccugcuaugucauaacugguacgagugcagaucuaacgguugaaaaagcugccgaugucacaugggaagaggaagcggaacagacaggaguuagccacaacuuaaugaucacaguagacgacgacgguacaaugcgaaucaaagaugaugaaacggaaaauauccuuaccguacuucuuaaaacugcccuacuuauugucaguggcauauuuccguacucaaucccggcaacucucuuaguauggcauaccuggcaaaagcagacacaaaggucugguguacuaugggauguaccgagcccaccggaaacccagaaagcugaauuagaagaagguguuuacaggauaaaacaacagggcauauuugguaaaacccaaguaggcguaggaguucagaaggaaggaguauuucacaccauguggcaugucacccgaggagcuguucuaacccauaauggaaaacgauuggaaccaaacugggcuucugugaagaaagaucucauaaguuauggaggaggauggcgacucaacgcacaauggcaaaaaggugaggaaguacaggugauagcuguagagccugguaaaaauccgaagaauuuccagacaaugccagguauuuuucaaacuacuacaggugagauuggagcgauugcccuagauuucaaaccagggacauccggaucacccaucauuaauagagaaggaaaagugguuggauuguaugggaauggugucgucaccaagaauggagguuaugucagcggcaucgcacaaacgaaugccgaaccugacggaccaacuccagaguuagaagaagaaauguuuaagaaaagaaacuuaacuauaauggauuuacacccaggcagugguaaaacuagaaaguacuuaccggcaauagugagagaagcuauaaaaaggagguugcgcacauuaauuuuagcaccaacaagaguuguagcagcggaaauggaagaggccuuaaaggggcuacccaucagauaccaaacuaccgcuacuaaaagugaacauacuggaagagaaauaguagauuuaaugugucaugccacuuuuaccaugcguuuacucagcccagucagagucccaaacuauaacuuaguaauaauggaugaggcucacuucacugauccagcaucaauugcugcuagaggcuauaucuccacacgaguaggcaugggagaagcagcggcaaucuuuaugacugcuacacccccgggaacugcagaagcauuuccucagucaaacgccccgauacaggaugaagaaagagauaucccugaacguuccuggaacuccggcaaugaauggauuacggacuucguaggcaaaacgguaugguuuguacccaguauaaaagcagggaaugauaucgcaaacugcuugaggaaaaauggcaagaaaguaauucaacuaucaagaaaaacauucgacaccgaauaucagaaaacacgacuaaacgacugggauuuuguugugacaacggacauaucggaaaugggagccaacuuuaaagcagaccggguuauagacccaagacguuguuuaaagccuguaauucugacggacggaccggagagaguaauucuagcagggcccaugccgguaacagcggcguccgccgcgcaaaggagaggucguguggguagaaauccacaaaaagagaaugaccaauacauauuuaccggccaaccccucaauaacgaugaagaccaugcacauuggacagaagcaaaaauguuguuagauaacauaaauacuccggaagggauaauaccagccuuauucgaaccugaaagggaaaaaucagccgcaauagauggagaauacagacuaaaaggugaaucacguaagaccuucguugaacucaugcgacgaggggacuuaccgguaugguuagcgcauaaaguggcuagugagggaauuaaguacacagauagaaaauggugcuucgauggcgaacgaaauaaccaaauuuuagaagaaaacauggauguagaaauuuggacaaaagagggugaaaggaagaaacuuagaccucgcugguuagaugcuagaacuuacucugauccauuggcacucaaagaauuuaaagauuuugcagcgggcagaaagucuauugcucuagacuuaguuacggagauuggucguguuccaagccacuuagcacauagaacacgaaaugcauuagauaauuuaguaaugcuacauacuucagagcauggagggcgugcguauaggcaugccguugaagaacuccccgaaacgauggagacacucuuacuucuuggacuuaugauucuauuaacagguggugcaaugcuuuuccuaauuuccggaaaagguauaggaaagacaucuauugguuuaauuuguguaauaguuaguucggguauguuguggauggcagaugugccgcuacaauggauugcuagugcaauaguguuggaguucuucaugauggucuuguugaucccugaaccggaaaagcaacggacuccucaagauaaucaacuagcguauguaguuauagggauuuuaacauuagcagcgauagucgcagccaacgagaugggcuuacuagaaacuacuaaacgagauuuagguaugaguaaagaaccagguguggugucuccuacaaguuaucuugauguagauuugcaccccgccuccgccuggacuuuauacgcggucgccaccacagucauuacaccaaugcuuaggcauaccauagaaaauuccacagcuaauguuagcuuagcagcuauagcaaaccaagcagugguauuaaugggguuggauaaaggcuggcccauaucaaaaauggacuuagguguuccgcuacuugcguuaggcuguuauucgcaagucaauccacuaacucucacagccgccguauuauuacuugugacgcauuaugcaauuauaggcccaggcuugcaggccaaagcaacgcgagaagcgcagaaaagaaccgcggcgggcaucaugaagaaccccacaguggauggaauaaugacaauugaccuugauccaguaauauaugauucaaaauuugaaaagcaacuuggccaagugaugcugcuggugcuaugugccguacaacugcucuuaaugcgaaccucaugggcguugugugaagcgcuaacauuggcuacagggccaauaaccacccuaugggaggguucaccaggaaaauuuuggaauaccacuaucgcaguuuccauggcaaacauauuuagggguucuuacuuggcuggagcaggauuagcauucuccauuaugaaaagcguaggggccggaagaagggggacugguucucagggugaaacuuuaggcgaaaaguggaagaagaaauuaaaccaguuaucucgaaaagaguucgauuuauacaagaaaucgggaauaacugaaguggaucgcacugaagcgaaggaaggguuaaaacguggcgaaacaacccaccaugcggucagcagggguucagcaaaacuccaaugguuuguugaacgaaauaugguaauuccagaagggcggguaauugauuuaggcugugggcggggaggauggaguuauuauugcgccggccucaagaaaguaacggaggucagaggauauacuaaagggggaccaggacaugaagaaccagugccaauguccaccuacggauggaauauaguaaaacuuaugucgggaaaagauguguuuuauuuaccaccugagaaaugugauacauuacuaugcgacaucggagaaucaaguccaucacccacugucgaagaauccagaaccaucaggguacuuaaaauggucgaaccguggcuuagaaauaaccaguuuugcauaaaaguguugaaucccuacaugcccacaguaauugaacaccuugagcgauuacagcgaaaauacgguggaauguuaguccgcaauccauuaaguagaaauucaacacaugaaauguacuggauaucaaacggaacugggaauauaguaagcucuguuaauaugguuucacgacuucuacuaaacagguucacaaugacucauagaagaccuacaauagagaaagacguagauuuaggugcuggaacaaggcauguuaaugccgagccagaaacaccaaauauggauguuauaggggagagaaucaaaagaaucaaagaggaacauucaucgacguggcauuaugaugaugaaaacccauauaaaacaugggcauaucauggaucauacgaaguuaaagcgacgggauccgcaagcagcaugaucaaugggguagugaagcugcuaacaaagcccugggauguuguuccuaugguaacacaaauggcgaugacagacacaacgccuuucggacaacagcguguuuucaaagaaaaaguagacacacgaacgccccguccaaugcccggcacucguaagguaauggaaauaacugccgaaugguuguggcgaacauuaggaagaaauaagaaaccaagauugugcacaagggaagaauuuacaaagaaaguuaggacaaacgcagcaaugggggcaguguucacagaagaaaaucagugggauucagcgagagcugccguugaagaugaagaauuuuggaaacuuguagaccgagaacgagaauuacauaaauuaggcaaaugugguaguuguguauauaauaugaugggaaaaagagagaagaaauuaggagaguucgguaaagcuaaaggcucacgagcgauuugguauaugugguuaggagcacguuaucuugaguucgaagcacuuggauuucuaaacgaggaucacugguuuucgagagaaaauuccuauagugggguugaaggcgaaggucuacauaaacuggguuauauacuuagagauauaucuaaaauacccggaggugcaauguaugccgaugauacggcaggaugggauacccgcauaacugaagaugaucuucauaaugaggagaaaauuacccaacaaauggaccccgagcaucgucaacucgcaaaugcuauuuucaaacuaacuuaucaaaacaaagugguaaaagugcaacgaccaacaccaaaaggcacuguaauggacauaaucucuaggaaagaucaacgggguucggggcaaguagguacauacggccuaaauacauuuacgaacauggaagcucaauuaguccgacaaauggaaggugaagguguucuuaguaaagccgacuuagaaaacccacaucuauuagaaaagaaaauaacacaaugguuagaaacuaagggaguugaaagguuaaaacgaauggcuaucagcggggaugacuguguaguaaaaccaauagaugacagauucgccaaugcucugcuugcauuaaaugauaugggcaaggucagaaaagacauaccccaauggcaaccaucuaaaggguggcacgauuggcaacaaguaccauuuuguucacaccauuuucacgagcucauuaugaaagacggucgaaaauuaguagucccuugcagaccccaggacgaacucauaggucgcgcacggauaagucaaggcgcugguuggagucuuaaagaaacugccugcuugggaaaagcguaugcccaaauguggucccuaauguauuuucaucgccgcgacuuacgauuggcaucuaaugcgauauguagugcggucccggugcacuggauaccaacuagccgcacuacauggagcauacaugcacaccaucaauggaugacgacagaagauaugcuaaccguauggaaccgagucuggauugaagacaauccauggauggaagacaaaacaccugucacaacuugggaagacgucccuuacuugggaaaaagagaagaccaauggugcgguucauugauaggucuaaccagcagagcuacuugggcucaaaacauccuuacugcgauacagcaagugaggucacuaauaggggaugaagaguucuuggauuauaugcccucaaugaagcgauucaggaaagaagaagaaagugaaggagcaauaugguga

SEQ ID NO: 23120 - RNA, 9873 nt, Artificial Sequence
  derived and/or modified CDS sequence (opt6) from DENV-3__GU131943__SS-prME
acuagcuuaugucucaugaugaugcuacccgcaaccuuagccuuccaucucacaucacgcgauggagaaccucggaugauugucgggaaaaaugaacggggaaaaucacuauuauucaaaacugcgucuggaaucaacaugugcacuuuaauagccauggaucucggagaaaugugcgacgauaccguaacauauaaaugccccuugauugcggaagucgagccugaagauauagauugcugguguaaccugacaucaacauggguuacauacggaacuuguaaucaagcgggggaacacagaagagacaaaagaucgguagcccuggcaccccauguaggaaugggauuagacacacgaacacaaacguggaugucugcugaaggcgcguggagacaaguagaaaaagucgaaacaugggcacuaagacauccaggcuuuacgauacuugcuuuauuuuuggcucacuacaucgggacaucccucacacagaaaguuguuauauuuauucuacuaauguuagugacuccaaguaugacaaugcgguguguaggagucgguaauagagacuuuguugaaggccugaguggagccacguggguggacguaguuuuggaacauggaggcugcguaacaacuauggcaaaaucuaaacccacacuugauauugaacuucagaaaacugaagcgacgcaauuagcaacgcugagaaaauugugcauagagggcaaaauuaccaacauaaccacugauagucguugcccuacccaaggcgaagcuacuuugccagaagaacaggaucaaaacuauguauguaaacauaccuaugucgauagggguugggguaacggcuguggauuguucgguaaaggcagcuugguaaccugugcgaaauuccaauguuuagaaccaauagaaggcaaaguaguucaauacgaaaauuuaaaauacaccguuauaauaaccguccacacaggcgaucaacaccaaguagguaaugacacucaaggugugacuguggaaauuacaccacaagccaguacaguagaagcaguguuacccgaauacgggaccuuaggacuugaauguucaccacgaacuggucuagacuuuaaugaaaugauacuauuaacaaugaaaaauaaagccuggaugguacacagacaaugguucuuugauuuacccuuaccuuggaccuccggugcaacuacugaaacucccauuuggaaccgaaaagaacuauuaguaacauuuaaaaaugcacaugcuaagaaacaagaaguaguaguccuaggaucgcaagaaggagcuaugcauacagcacuaacgggagcuacagaaauacaaaauucaggcggaaccagcauuuucgcugggcacuuaaaaugucgguuaaaaauggauaaauuagaacucaaagggauguccuacgcgaugugcuugaauacuuuuguucuaaagaaagaggucucagaaacgcaacacgguaccauuuugaucaaagucgaauacaaaggcgaagaugcaccauguaaaauacccuucucaacugaagacggacaaggaaaagcgcacaauggucggcuuauaacagccaacccagucguuacuaagaaagaggagccaguuaauauagaggcagaaccacccuuuggcgaaucgaauauuguuauuggaaucggcgacaaggcuuugaaaauaaauugguauaagaaagguuccucuaucgguaaaauguuugaggcaacagcccgaggagcucgacguauggcaauauuaggugauacugcaugggauuuugggagugugggcgggguacuaaauuccuuagggaaaaugguccaucaaauuuuuggcagugcguacacagcacuauucagcgguguuucguggauuaugaaaauagggaucggaguuuugcugacauggauuggcuuaaauaguaaaaacacuucuaugucauuuucuugcaucgucauagggauuauaacguuauacuuaggggcgguuguacaagcagauaugggaugugcuauaaacuggaaaggaaaagaacuaaaaugugguucaggaauauucguuacaaaugaaguacacacuuggacugagcaguacaaauuucaagcagacucuccuaaaagacuggcaacugcuauagccggugcaugggaaaaugguguauguggcauuagaaguaccacuagaauggaaaaucuacuuuggaaacaaauagcaaaugagcuaaauuacauacuaugggagaauaacauaaaacuaacagucguaguaggcgauauaauuggaguucuggaacaggggaaaagaacacugacaccucaaccuauggaguugaaauacucauggaaaacauggggaaaggcaaaaauaguaacagcugaaacacaaaacucuucuuucaucauagacggaccaaauaccccagaauguccuagcgcuucacgggccuggaaugugugggagguugaagacuauggauucggaguguucacgaccaacauuugguugaaauuacgcgaaguauacacacagucgugugaccaucgauuaaugucagcagccauaaaggaugaacgagcaguucaugcggacaugggguauuggauagaaucacagaaaaaugguucauggaagcuagaaaaggcuucguucauugaagucaaaacauguacauggccgaaaucucauacacucugguccaacggcguucuugaaagcgauaugauuauaccuaaauccuuagccgguccaaucagucaacauaaucaccggccuggauaccauacacaaacagcagggcccuggcauuuaggaaaacuugaacucgacuuuaauuacugcgaagguacaaccguuguaauuaccgagaauugcgggacgagagguccaaguuuacguacaacuacaguaucgggcaaauuaauucaugagugguguugcagaucauguacccuacccccacuucgauacaugggagaagacggauguugguauggcauggaaaucaggccaaucaaugagaaagaagagaacaugguaaagagccucguuagcgcuggaagcggaaaaguagauaauuuuacaaugggaguuuuauguuuagcgauccuauucgaggaaguaaugcguggaaaauuuggcaagaaacauaugauagcggguguacucuuuacauuuguucuguuauuaucuggacaaaucacauggcgugauauggcacauacacuuaucaugauagguucaaacgcuucagaccgaauggggauggguguuacauauuuagcacugauugccacauuuaaaauccaacccuuuuuagcccucggcuucuuucuccgaaaauuaacaucucgagaaaaucuacugcuugguguggggcuggcaauggccacaacacuacaauuaccugaagacauagaacagauggccaaugggaucgcccuaggcuuaaugacauuaaaacucauaacgcaauuugaaacauaucaacuuugggcugcucugguaaguuuaacauguucuaauacuauauucacauuaacaguugcguggcguacugccacauuaauccuugccgguguaucccuuuugccauugugucaaucaucgucaaugcgcaagacugacugguuaccgaugaccguagcagcuauggguguuccuccuuuaccccuguucaucuuuagucuuaaggacacaccgaagagacgcucuuggccacugaacgaggguguuauggcaguuggcuuaguaaguauacuugcuucauccuuacuacgaaaugauguaccaauggcagggccccuagucgcuggcgguuugcucauugcaugcuacguuauaacagggacaucagcagaccuaacgguugaaaaggcugcugacgucacgugggaagaagaagcagaacaaacaggugugucucacaauuuaaugauaacugucgaugaugauggcacaaugagaauuaaagaugacgagacggagaacauucuaacaguacugcuaaaaacagcgcuccuaauugucagugguauuuuccccuacuccauccccgcuacacucuuaguauggcacacauggcagaaacaaacacaacgcaguggcgugcuaugggauguuccaagucccccugaaacucagaaagcagagcuagaggaaggaguguaccgaauuaaacaacagggaauauuugguaagacucaaguagggguuggcguccaaaaagaaggaguauuccauacgauguggcacgucacacgaggagcgguauugacgcacaacggcaaacgauuggaaccuaauugggcuagugucaagaaagauuuaauaucuuacgguggcggguggcgauugaaugcacaauggcagaaaggagaagaaguccaagugauugcuguagaaccugguaaaaacccgaaaaauuuucagaccaugccuggaauauuucagacaacuacuggcgaaaucggagccauagcacuggauuucaaacccggcacgucggggaguccuaucaucaacagagaagggaaaguaguaggacuuuacggaaacggaguagugacgaagaacgguggcuaugugaguggaaucgcacaaacgaacgcagaacccgacggacccaccccagaguuagaagaagaaauguuuaaaaagaggaaucucaccauaauggaucuacauccgggcagcggaaaaacaagaaaauauuuaccggcaauuguuagagaagcaaucaaaagacgauuaagaacuuuaauacucgcaccaacacgugucguagcugcagagauggaggaggcuuugaaaggcuuaccuauaagauaccagacaaccgcgacaaaaagugaacauacagggcgggaaauaguagaucucaugugucaugcaaccuucacuaugagacuacuaagcccggucagaguuccgaacuauaaucucguaauaauggaugaagcccauuucacagacccugcauccauagcggcuagagguuauaucaguacccgaguugggaugggugaggcggcugccauauuuaugacugcgacgccaccuggaacugcagaagcauuuccacaaagcaacgcaccaauucaagacgaagaacgagauaucccagagagaucuuggaacucgggaaaugaauggauuacugauuucguaggaaaaacuguuugguuuguaccaagcauaaaagccggaaaugacauugccaacuguuuacgcaaaaacggcaagaaagucauccaauuaaguagaaaaaccuuugauacagaauaucaaaagacacgucuaaacgauugggacuucguagucacuaccgauauaucagaaaugggugcaaauuuuaaagcggauaggguaauagacccacgucgcugccucaaacccgucauauuaacagacggacccgaacgagugauuuuggccggaccuaugccaguaacagcagcauccgcagcgcagcgcaggggucgaguaggccgcaauccgcaaaaagagaacgaccaauacauauucacaggucaaccauuaaacaacgacgaagaucaugcgcacuggacagaagcuaaaaugcucuuagacaauauuaacacuccggaagguauuauucccgcguuguucgaaccggaaagagaaaaaucagcagcgaucgacggagaauaucgauugaaaggggaaucccgaaaaacauuuguagaacuaaugcgaaggggcgaucuuccaguuuggcuggcacauaagguagccuccgaaggcaucaaguauacagaucgaaaaugguguuuugauggagaacgaaauaaucaaauuuuagaagagaacauggacguagaaauuuggacaaaggaaggcgagaggaagaaauuaagaccgcgauggcuugaugcaaggacauacucggauccguuagcauugaaagaauuuaaagacuuugccgcgggacgcaaaucaauugccuuagaucucgugacggaaauagggcgggugccuucccacuuagcacauagaacaaggaacgcgcuagauaauuuagucauguuacauacuucggaacacgggggaagggcauacaggcaugcgguugaagaauuaccggaaaccauggagacauuauuacuacuuggucuaaugauacuguuaacaggaggagcgauguuauuucucaucuccggaaaggguaucgguaaaacaaguauaggauuaaucuguguaauagucagcaguggaauguuguggauggcugacguaccucuacaauggaucgcuagcgcaauaguucuugaguucuuuaugaugguacuacuaaucccggaaccugagaaacaaagaacaccccaagacaaucaauuagcauauguagucaucgguauauuaaccuuagccgcaauaguagcugccaaugagaugggacuguuagaaacaacaaaaagggauuuggggauguccaaagagccaggagugguaagccccacaucauaucuugauguugaccuacauccugcuagugcauggacucuauaugcaguagcgacuacggugaucacucccaugcuccggcacacaauagaaaauucaacugcgaauguuagucuggcggccaucgcgaaccaggccgugguacuaaugggacuagauaaaggguggccgauaaguaaaauggauuuaggaguuccuuugcucgcucucggauguuauucacagguuaacccucugacucuaaccgcagcuguacuguuauugguaacucauuaugcaauuauuggaccaggacuccaagcuaaagcuacaagagaggcgcagaaaagaaccgcagcaggaauaaugaaaaauccuacuguagacgguauuaugacaauugaucuugacccaguaauauaugauagcaaauucgaaaaacaauugggucaagucauguuacuuguucugugcgcaguacaauuacugcugaugagaacaucaugggcuuuaugugaggcuuuaacauuagcaacuggaccuauaacaacucuuugggagggaucgccaggaaaauucuggaauacgacaauugcaguuaguauggccaauaucuuucgugguucauauuuagccggagcugguuuagccuucucaauaaugaaaucaguagguacaggccgaagaggaacuggaagucaaggagaaaccuuaggagaaaaauggaagaagaaacuaaaucaacuaaguagaaaagaauuugaucuauauaagaaaaguggcauaaccgaaguagacagaacugaagcgaaagaaggccuaaagagaggagaaaccacgcaucaugccgucucaagagguagugcuaaauuacaaugguuugucgaaaggaauaugguuauuccggaaggcagagucaucgaucuggggugcgguagagggggauggaguuauuauugugcaggucuaaagaaagugacagaagucaggggauauaccaaaggaggaccaggacacgaagaacccguucccaugucgaccuaugguuggaacauagugaaacugauguccgggaaggauguauucuaccuacccccggaaaaaugcgauacuuuauuaugugacaucggugaaagcuccccgucgccaacaguagaagaaucacgaaccauuagaguguuaaaaaugguugagcccuggcuuaggaauaaccaguuuuguauuaaaguacuuaacccauacaugcccacaguuauugaacauuuagagcgucuccaaagaaaauacggcggaauguuagugaggaauccacuaagccgaaacuccacucaugaaauguauuggaucucuaaugguacuggaaauauaguuucauccgugaacaugguaucucgacuccucuugaacagauuuacuaugacucaucguagaccuacaaucgaaaaagacguagauuugggcgcaggaacucgucacguaaacgcggaacccgaaacaccaaacauggaugucauuggagaacgaauaaagcgaauaaaagaagaacauucauccacuuggcacuaugacgacgaaaauccauauaagacuugggcauaccauggaaguuaugaggucaaagcaacuggguccgcaucauccaugauaaacgguguagugaaacuucuaacaaaaccaugggauguuguuccgaugguaacucaaauggcgaugacugacacaacccccuuugggcagcaacgcguauucaaagaaaaaguggauacgcgcaccccaaggccgaugccgggaacaagaaaaguaauggaaauaacagcagaaugguuauggcggacgcugggaagaaauaagaaaccacguuuguguacgcgagaagaauuuacuaagaaaguccgcaccaaugcugccaugggggccguauuuacagaagagaaucaaugggauucugccagagccgcagucgaagaugaagaauuuuggaaauuagucgauagggagcgagaauugcauaaauuaggaaaaugugguucuuguguuuacaacaugauggguaaaagagagaagaaacuaggcgaguucgggaaagcaaaaggcucuagagccaucugguacauguggcuaggugcaagguacuuggaguucgaggcuuuaggauuucuaaaugaagaccacugguuuucaagggaaaauaguuacucugggguagaaggugagggccugcacaaauuaggauacauuuugcgagacauuaguaagauaccugguggugcuauguacgcagacgauacagcaggaugggauacaaggauuacagaggaugauuuacacaacgaagaaaagauaacacagcaaauggauccugaacaccgucaguuggcgaacgccauauucaaauuaacauaucaaaauaaaguaguaaaaguacagaggccuaccccuaaaggaaccgucauggauaucauaagucgaaaagaucaaagagguaguggacaggucgggacguauggucucaacacguuuacuaauauggaggcucaguuaguacgucagauggaaggugaaggugugcucucgaaagcagaccuagaaaauccccacuugcucgagaagaaaauaacccaaugguuagaaacaaagggugucgaaagacuuaaaagaauggcgauaucaggagacgacugcgugguuaaaccuauagacgauagauuugcaaacgcauuacuggcauugaacgacauggguaaagugagaaaggacauuccgcaauggcaaccaucaaaaggguggcacgauuggcagcagguccccuuuugcucacaucacuuccaugaacucauuaugaaagaugggaggaaacucguaguaccauguaggccucaagacgaacuuauagggagggcucgaauuucgcaaggcgcuggauggucacucaaagaaacagcauguuuagggaaggcauaugcacaaauguggucucugauguauuuccaccggagagaucuaagauuagcgucaaaugcaauuugcucagcuguccccguacacuggauacccacaucacgcacgacuuggaguauccaugcacaccaucaauggaugacgacugaggauaugcuuacuguauggaauagaguguggauugaggacaacccauggauggaagauaaaacaccaguuacaacuugggaagaugugccauaucugggaaaaagagaggaucaauggugcggaucguugauaggauuaacuuccagagcuacuugggcucaaaacauucuaacagccauacaacaaguacgaagucuaaucggcgacgaagaguuucuggauuacaugcccucgaugaagcguuucaggaaagaagaagaaucggaaggagcaauaugguaa

SEQ ID NO: 23121 - RNA, 9873 nt, Artificial Sequence
  derived and/or modified CDS sequence (opt6) from DENV-3__GU131945__SS-prME
acuucucuauguuugaugaugauguugccugcgacccuagcauuucaucuaacaucucgcgacggagaaccaagaaugauaguuggaaaaaacgagagagguaagucacuacuauucaaaacugcgaguggaaucaacaugugcacacugauugcaauggacuuaggugaaaugugcgacgacacuguaacuuauaaauguccacuaauugcagagguggaacccgaagauauagauugcugguguaaucuaacaagcaccuggguaacuuacgggacaugcaaucaagcaggagagcauagacgggauaaacgaaguguugcccucgccccucauguugguauggguuuagauacuaggacacagacauggaugagcgcugagggcgcguggcgucaaguagaaaaaguagaaacuugggcucugagacauccuggguucaccauucuagcuuuguuuuuagcgcauuacauugggaccucccuuacucagaaaguuguaaucuuuauccuauugaugcuaguaacuccaucaaugacaaugaggugugucggaguuggaaauagggauuucguggagggucuaagcggcgcgacuuggguagacguagugcucgaacacggcggaugcguaaccacgauggcgaaauccaaacccacacuugauauagaacuacaaaaaacagaagcaacucaacucgccaccuugcgcaaacuuugcauagaaggaaaaauaacaaacaucacaacagauucgagauguccaacucaaggagaggcaaccuuaccagaggagcaagaucaaaauuaugucugcaaacauacguauguugacagaggauggggcaauggauguggcuuguuugggaagggaucacugguaacaugcgcuaaauuucaauguuuggaaucgaucgaagggaaagucguucaguaugagaaccuuaaauauacugucauuaucacgguucauaccggugaucaacaucaaguuggaaaugacacacaaggaguuacaguagaaauaacuccucaggcaucgacuguugaggcgguccuaccugaauauggaaccuugggcuuagaauguucccccagaacaggucuugacuuuaaugaaaugauauuacuaacaaugaagaacaaggcauggaugguacaccgacagugguucuuugacuuaccacuaccuuggacaaguggcgcgacgacggaaacgccuacguggaauaggaaggaauugcuggucacauuuaagaaugcucaugcaaagaaacaggaaguagucguuuugggaucgcaggaaggugcuaugcauacugcacuuaccggagcgacagaaauucagaacucaggagguacaucuauuuucgcagggcacuuaaaaugucgauuaaagauggauaaacuagaacuaaaggguaugucauaugcaauguguuuaaauacauuuguuuuaaaaaaagagguaucagaaacucaacaugggacgauucuaauaaagguugaguauaagggcgaagacgcaccaugcaaaauaccauucucuaccgaggauggccagggcaaggcccauaaugguagacugauuacggcaaauccuguaguaacaaaaaaagaagagccagucaauauagaggcggaaccaccauuuggagaaucaaauauagucauuggaauaggagauaaggccuuaaaaaucaacugguacaagaaaggaucgucuauuggaaaaauguuugaagcgacggccagaggagcucgaagaauggcuauccuaggagauacagcaugggauuuuggauccguggguggagugcuaaauucacucggaaaaaugguccaucaaauuuucggaucagcuuauaccgccuuauucucuggaguaaguuggauuaugaagauuggaauaggaguacuccuuacauggauaggauuaaacucuaaaaauacgucuaugucauuuucauguauuguuauaggaauaauaacauuauacuuaggggcaguaguccaagcggacauggguugugucauaaauuggaaagguaaagaacuuaaaugugggaauggaaucuuuguaacuaacgaaguccacacuuggacagaacaauauaaguuucaagcggauucgcccaaacgacucgcuacagcgauagccggggcaugggaaaacggaguuugugguauacguucuacaacucguauggaaaaucuguuauggaagcaaauagcuaacgaacuuaauuacauauuaugggaaaauaauauaaaauugacaguagucguuggcgauauaauuggugugcuagagcaaggcaaacgugccuuaaccccccagccuauggaauuaaaguauucuuggaaaacaugggguaaggcuaaaauagugacagccgaaacucaaaauagcucguuuauaaucgaugggccgaacacgccugaguguccaagugcuuccagagccuggaacguaugggagguugaagauuauggauuuggaguguucaccacaaauauauggcuuaaauugcgugaaguguacacgcaaucgugcgaucacaggcucaugagugcagcaauaaaagaugagagagcaguacacgcagacaugggguauuggauugaaagccaaaaaaacggaucauggaaacuagaaaaagcgucauucauugaaguaaagacauguacauggcccaaaucucauacauuauggucuaacggaguuuuagaaagcgauaugauuauaccgaagagccuugcugggcccauuucgcaacauaaucaccguccuggauaucauacgcaaacggcgggaccuuggcaucuugggaaacuagagcuggauuuuaauuacugugaagguacaacagucgugauagcagagaauugcgggacacgcggcccaagcuugcggacuacgacgguuagcggaaaacuaauucaugaguggugcuguaggucauguacacuuccuccccuuagauauaugggcgaggauggcugcugguacggaauggaaauaaggccuauaaaugaaaaagaagaaaauaugguaaaaagccucgucucugcaggaucagguaaaguagauaacuucacgaugggcgugcuauguuuagcuauacuauuugaggaagucaugcgaggaaaguuugggaaaaaacauaugaucgccggcgucuuauucacuuuuguacugcuucugagcggacaaauuacuuggcgugauauggcgcauacucucauaaugauagguucuaacgcgagugaucguaugggaaugggggucacuuacuuagcccuuauagcgacuuucaagauucaaccuuuccuagcucugggauuuuuccuacguaaacuaacaagucgugagaaucuccuuuugggcguaggacuagcaauggcaacuacuuuacaauugccugaagauauugaacaaauggccaauggaaucgcauugggauuaaugacucuaaaauugaucacgcaauucgaaacauaccaacuuuggacugcgcuuguaucucuuacuugcaguaauacaauauuuacucuaaccguagcauggcguaccgcgacacuaauucuagcaggaguuagcuugcuaccucugugccaaucgucauccaugagaaagacggauuggcuacccaugacgguggcagcaaugggugugccaccacucccauuauuuaucuuuagucuaaaggacacaccaaaacgucgauccuggccgcuaaaugaagguguaauggcagucggguugguauccauauuagcgucaucauuacugcguaacgaugugccuauggcaggacccuuaguagcgggaggacuucuaauagcauguuauguaauuacaggcaccucagcagaucuuacuguagaaaaagcagcugacguaacuugggaagaagaagcugaacaaacaggcgugucacauaaccuaaugauuaccguugacgaugauggaacuaugaagauuaaagacgaugagaccgagaauauacuaaccguauuacugaaaacagccuuacuaauugucuccgguauauuuccguacagcauuccagcaacacugcuagucuggcacacuuggcaaaaacaaacucaacgcucagguguuuuaugggacgugccgucuccuccagaaacucaaaaagcagagcuagaagaaggaguauaccgcauaaaacaacaaggaauauucgguaaaacccaggucggcguuggaguucaaaaagaaggaguauuccacacgauguggcacguaacccgaggugcuguacuaacucauaacggaaaacgucuagagccaaacugggccaguguuaaaaaggaccuuauuucauauggaggaggguggagauuaucagcacaauggcaaaaaggcgaggaaguacaaguaaucgcaguagaaccaggaaagaacccaaagaacuuucaaacgaugccagguauauuccagaccaccacaggggaaauuggcgcgaucgcucuagauuuuaaaccaggaaccuccgggaguccuaucauaaaccgcgaagguaaaguagugggacuuuauggcaauggagucguaacuaaaaacggaggcuacguuucuggaauugcucaaacaaaugccgagccagacgguccaacaccagaacuugaggaagaaauguucaaaaaaagaaaccuuacaauuauggacuuacacccagguagugggaaaacgcggaaauacuuaccagccauaguuagagaagcaaucaagcguagacugcgaacgcuuauauuggcaccaacaagagucguagcggcagaaauggaggaagcccuaaaaggucuuccuauccgcuaucaaacgacugccacuaaaagcgaacacacaggaagggaaauaguggacuugaugugucacgcaacguuuacaaugaggcuacuuagcccugugagaguacccaacuauaaucucguaauaauggaugaagcacauuuuacugacccagcaucaaucgcggcgagggguuauauauccacaagaguuggcaugggagaagccgcugcaaucuucaugacugcaacaccuccagguaccgcagaggcuuuuccucaaucgaaugcaccgauacaagaugaagagcgcgacauuccagaaagaaguuggaacagcgggaaugaauggauaacagacuucgucgggaaaaccguaugguuuguaccuagcaucaaagcagguaaugauauagcaaauugcuuaaggaaaaacggaaaaaaaguaauacaguuaaguagaaaaaccuucgauaccgaauaucaaaagacaaggcuaaacgauugggauuucguaguuacgacagauauaucugagaugggagcuaauuucaaagcagaccggguuauagacccuaggcgcugucuaaagcccguaauuuuaacggaugggccggaaagaguuauuuuagcagguccaaugccugugacggcagcauccgcagcacaaaggagaggucgaguuggcaggaauccucaaaaggaaaaugaucaauauauauuuaugggacagccauuaaauaaugacgaggaccaugcacauuggaccgaggcaaaaaugcuccuagacaauauaaauaccccagaagggaucauuccugcauuauuugaaccugaaagagaaaagucagcugcuaucgauggugaauaucgauuaaaaggagaaagucguaaaacuuuuguagaacucaugagaaggggugauuuacccguauggcuagcccauaaaguagcuucggaaggcauaaaauacaccgauagaaaauggugcuucgacggcgagcguaauaaucaaauacuagaagagaauauggacguagaaaucuggacaaaggaaggggaaagaaaaaaacuuaggccacgauggcuugaugccaggacguauucagacccauuagcucuaaaagaauucaaagauuuugccgcaggacguaaaucaauugcacuggauuuagucacugaaauaggaagggugccgucccaucuagcgcauagaacgcgcaacgcacucgauaauuugguuaugcuacauacaagugaacacggagguagagccuauagacaugcgguggaagaauugccagagacaauggaaaccuugcuuuuacuaggccuaaugaucuuauuaacgggaggggcuaugcucuuuuuaauuaguggaaaaggcauaggaaagaccagcauugguuuaauauguguuauagucagcagcggaaugcuguggauggccgauguucccuuacaauggauagcuagcgcaaucguguuagaauuuuucaugaugguacuauuaaucccugaaccagagaaacaacggacaccgcaagacaaccaauuagcauauguagucauaggaauuuuaacauuggcggcaauuguggcugcuaaugagaugggcuugcuagagacaacaaaaagagauuuaggaaugagcaaagaacccggaguuguaucacccacguccuauuuggauguagauuugcaucccgcuucagcauggacucuauacgcaguugccacuaccguuauaacaccaauguugcggcauaccauagagaacagcaccgcgaacguaagcuuagcagcuauugcuaaucaagccguaguauuaauggguuuagauaaaggauggccuauaagcaagauggaccugggaguuccacuacuggcgcuaggcugcuauucgcaagucaacccacuuacuuuaaccgcugcgguucuccuucuugugacucauuaugcaauaaucggaccuggacuacaagcaaaagcuacaagggaagcacagaaaaggacagcugcaggcaucaugaaaaaccccacaguagacgggauaaugacaauagaucuagauccaguuauuuacgacaguaaauucgaaaagcaauuaggacaggugaugcuucuugucuuaugcgcaguacaauuauuacuaaugagaacaaguugggcacuuugcgaggcacuaacacuggcaacugguccaauaaccacacuuugggaaggcucaccaggaaaauuuuggaauacgaccauagcuguuaguauggcuaauaucuuuagaggcaguuaucuugcaggugcaggcuuagcuuuuucgauaaugaagaguguggguacagggcguagggguacuggcagucaaggcgagacauugggagaaaaauggaagaagaaacugaaucaacuaucacgaaaggaauuugaccuuuauaaaaaaucagggaucacugagguggacaggacggaagcgaaagaaggacuaaaaaggggagaaacuacucaucaugccguaucgaggggauccgccaaacuacaaugguucgucgaacgcaauaugguaauuccugaagggagaguuauugaccuagggugugggagaggagguuggucuuauuauugugcuggacuuaagaaaguaacagaaguucgaggauacaccaaaggaggaccaggucaugaagaaccuguuccuaugagcacguacggcuggaacaucguaaaauugauguccgguaaagauguguuuuaccucccaccagaaaaaugugacacucucuuaugugauauaggagaaucuaguccaucuccgacagucgaagagaguagaaccauuagaguacugaaaauggucgaaccuugguuacgaaguaaucaguucuguauuaagguacuuaauccauauaugccuacgguaaucgaauacuuagaacgacuccagcgcaaguauggggguauguuaguccgaaauccucuuaguaggaauucaacccaugaaauguauuggauuucuaaugggacugggaauauuguaaguaguguaaacauggucucgagauuauuacuaaaccgauuuacuaugacgcauagacgaccaacuauugagaaagacguagaccuaggagccggaacgcgacauguaaaugcagagcccgaaacuccaaacauggacguuauuggugagcgaauaaaacguaucaaggaagaacauaguucuacguggcauuacgaugacgaaaacccuuauaagaccugggcauaccacgggagcuaugaaguaaaagcaacagguuccgcauccucaaugauaaauggggugguaaaauuacucacaaaaccaugggacguaguuccaaugguuacacaaauggcuaugacagauacaacuccguuuggucagcagagaguauuuaaagaaaagguggacacucgaacuccucggccaaugccggguacccguaaaguuauggaaaucaccgcggaauggcuauggcggacgcuaggaagaaacaaaaaaccaagguuauguacaagagaggaauuuacuaaaaagguucggacaaaugcggcaaugggugcuguauucacagaggaaaaucaaugggauucagcacgugccgccguggaagacgaagaauuuuggaaacuuguagauaaagagcgggaacuucacaagcuuggcaaaugugguucaugcguauauaauaugaugggaaaaagagaaaagaaguugggagaguuugguaaagcgaaagguaguagggcgauuugguacaugugguuaggagcccgauauuuagaguucgaagcuuuaggguuuuuaaacgaagaccacugguucucgcgugaaaacucguauucuggaguggaaggcgaaggguugcauaaacuuggauauauccuuagagauauuagcaaaauccccggcggagcuauguacgcugaugauacugcugggugggauacuagaauaacugaggacgaucuacauaacgaagaaaaaauaacccaacagauggauccagaacaucgucaacucgcaaacgcaaucuucaaauuaacuuaucaaaauaaaguaguaaaaguucaacguccuacgccuaagggaacuguuauggauauuauaucuagaaaggaucaacguggauccggccaaguaggaacauacggacucaauaccuuuacuaacauggaagcacaauuaguacgccaaauggaaggagaaggugugcuuagcaaagcagaccuggagaauccccacuuguuagagaaaaaaauaacacaauggcuugagaccaagggaguggaaagauuaaaaagaauggcaaucucaggagaugacuguguaguuaaaccuauugaugauagguuugccaaugcucugcuagcuuugaaugacaugggcaaaguucgaaaagauauuccacaguggcaaccuaguaagggauggcacgacuggcagcaagugccauucuguucacaccacuuccaugaauuaauuaugaaggauggaagaaaacucguuguacccugcagaccccaggaugaacuuauaggacgugcgcgaauaucucaaggagcagguuggucacugaaggagaccgccuguuuaggaaaagcguaugcccagauguggucauugauguacuuccauagaagagaucuucguuuagccuccaaugcuauuuguucagcaguacccguacacuggaucccaacgucucgaacaaccuggaguauacacgcccaccaccaauggaugacaacagaagauaugcuuacaguauggaaucgaguuuggauagaggauaauccauggauggaggauaaaaccccagugacgacaugggaggaugucccauaucucggcaaaagagaagaucaauggugugguucuuugauaggccuuacuagcagagcaacuugggcucaaaacauucuaacagcgauacagcaaguaagaaguuuaaucggagaugaagaauuuuuagacuauaugccaagcaugaagcgauuccguaaggaagaggaaacagaaggugcaauuugguga

SEQ ID NO: 23122 - RNA, 9873 nt, Artificial Sequence
  derived and/or modified CDS sequence (opt6) from DENV-3__GU131946__SS-prME
acaagucuuuguuuaaugaugauguuaccugcaacguuagcauuccauuuaacguccagggacggugaaccgcgaaugauuguugggaaaaaugaaaggggaaaaucuuugcucuuuaaaacagccucaggaaucaauaugugcacgcuaaucgcaauggaccugggugaaaugugugaugacacaguaacuuacaaaugcccuuuaauagcugaaguagaacccgaagacauagauuguugguguaaucugacguccacauggguaacauacgguacuuguaaucaagcuggugaacauagacgagauaagcguaguguugcguuagcgccgcacguaggaaugggacuagauacuagaacacaaaccuggauguccgcagaaggugcauggagacaagucgaaaaaguagaaacaugggcuuugaggcaccccggauucacaauucuugcacucuuucuugcucauuauauaggaacaagccuaacucaaaaagucgucauauucauauuacucaugcuggugacccccuccaugacuaugcgguguguugggguaggaaaucgcgauuuuguugagggacuaagcggugccacguggguugacguagugcuggaacacggaggauguguaacuacuauggcgaaaucuaaaccgacauuagacauugaauuacagaaaacugaggcaacucaauuagcaacuuuacggaaacuuuguauagaagggaaaauuacaaauauaaccacagacucuagaugccccacccaaggagaagcaacauugccugaagaacaagaccaaaauuacguuuguaaacacacuuacguagauagaggauggggaaauggcuguggguuauuuggaaaagggucguugguaacgugugccaaauuccaauguuuagaaccaauugaaggaaaaguugugcaauaugagaaccugaaauauacaguaauuauaacaguccacacuggagaccaacaccaaguagggaaugauacccagggaguuaccgucgaaauuacaccacaagcgucaacuguagaagcagugcugccggaauacgggacucuaggguuagaauguuccccaagaacaggccuagacuucaacgaaaugauucuauuaacuaugaaaaacaaagccuggaugguccacagacagugguucuucgauuugccgcuuccauggacaaguggggcgacuacagagaccccuaccuggaaccgaaaagagcuucuaguaacauuuaaaaacgcacaugccaagaagcaagagguaguugugcuugggucgcaggagggagccaugcacaccgcucuuacgggagcaacugagauccaaaauucuggaggaacgagcauauucgcuggacauuuaaaaugcaggcuuaagauggauaaauuagaacuaaaggguaugucauacgccaugugucuuaacacauuuguacuaaagaaagagguuucagaaacccaacacggaacgauauuaaucaagguggaauacaaaggugaagacgccccuuguaaaauaccguucaguacggaggacggacaaggaaaagcucauaaugggagacuaauuacagcgaauccggugguaaccaagaaagaagaaccaguaaacaucgaggcugaaccaccauuuggcgaauccaacaucguaauuggaauaggcgauaaagcucuaaagauaaauugguacaagaaagggucuagcaucgguaaaauguucgaggcaacggcaagaggggcaagaaggauggcuauccucggugacacagccugggauuuuggaucaguaggugggauauuaaacaguuuagguaaaaugguucaucaaauauucggcucugcuuauaccgcauuguucucaggugugaguuggauuaugaaaauagguauaggaguccuacucaccuggauuggccuaaauagcaaaaauaccucuaugagcuuuagcugcauaguuauaggaauuauaacccuguacuuaggagcggucgugcaggcagacauggguugcguaauuaacuggaaagguaaagagcuaaaauguggaucaggaauuuucguaacaaacgaaguacacaccuggacugagcaguauaaauuccaagcugauagcccaaagcggcuagcgaccgcaauagcuggcgcaugggaaaacggggucuguggaauuagaagcacuaccagaauggaaaaucuucuuuggaaacaaauugcuaacgagcuaaauuauauauuaugggagaauaauauaaaauugacaguaguaguaggggauauaauaggaguucuagaacaagggaaaagaacuuuaacaccucaaccaauggaauuaaaauauuccuggaaaaccuggggaaaagcucggauagugacugcagaaacacaaaacucuagcuuuauaaucgacgggccgaauacgccugaauguccaagugcuucucgugcauggaacguaugggaaguugaggacuacggcuuuggaguauuuacgacaaauauauggcuuaagcuacgcgaaguauauacacaauccugugaucacagauugaugagcgcugcuauuaaagaugagcgggccgugcaugcggauaugggguacuggauugaaucacagaaaaacggaucauggaaauuggaaaaagcaucuuuuaucgaaguaaaaacgugcacuuggccgaaaucacauacauuguggucaaaugguguacuggaaucagacaugauuauucccaaaucacuugcuggacccaucagccagcacaaccaucguccuggguaccauacucaaacugcgggcccguggcaucuaggaaaauuagaacuagacuucaacuauugcgagggcacgacaguuguaauaacugaaaauugugguacacguggaccaucucuaagaacaacaacagucucgggcaaauuaauacaugaauggugcugucguagcugcacgcuacccccucuucgauauaugggcgaagacggaugcugguacggcauggaaauucgaccaauuaacgaaaaagaagaaaauaugguuaaguccuuaguaagugcuggaagugguaaaguggacaacuuuaccauggguguacuuugccuagcuauacuuuuugaggaaguaaugagaggaaaauucgguaagaaacauaugauagcugguguucuguucacauuugugcuuuuauugaguggacaaauuacuuggcgugacauggcccauacgcuaauaaugauagggucaaacgcaucagaucgaaugggaaugggaguaacuuacuuagcacugauugcgacauucaaaauucaaccauuucuagcguuaggcuuuuucuuaaggaaacuuacaucgagagaaaauuuacuacucggcguuggccuugccauggcaacaacacuucaacuccccgaagauaucgagcaaauggcuaauggaauugcgcugggccuaaugaccuuaaaacuuauaacucaauucgaaacguaucaauuauggacagcacucgugucacuaacauguucaaauacgauauucacgcugacgguggcauggaggaccgcgacgcugauuuuagcuggcguaucuuuacuucccuuaugccaguccucaucaaugaggaaaaccgauugguugccuaugacaguggcagccaugggggucccaccccugccauuguucauauuuagucuaaaagauacacccaagagacgaaguuggccacuuaacgagggcguuauggccguuggacucguuagcauucuugcaucuagucuucugcggaacgacguuccuauggcuggaccacuuguagcaggcgggcuauuaauagccuguuauguaauaacaggaacgucugcagaucugacgguugaaaaggcagcagauguuaccugggaagaagaggcugaacaaacuggcgugucacauaauuuaaugauuacaguagaugaugacgguaccaugcgaaucaaagacgaugaaaccgaaaauauauuaaccgucuuauuaaaaaccgcauugcucauaguaagcggcauauuuccauauaguauuccugcgacauuauuagucuggcacacauggcaaaagcaaacgcaaagaaguggaguuuugugggacgugccuaguccaccagaaacccaaaaagcagaacuggaggaagguguauaucggauaaaacaacaggguauuuucgggaaaacucaagucggugugggaguacaaaaagaaggugucuuccauaccauguggcacgucacaagaggagcagucuuaacgcauaacgggaaaaggcuugaaccaaauugggcaucaguaaagaaagacuuaaucuccuacgguggcggcuggagacuaagcgcucaauggcagaaaggagaagaaguucaagugauagcgguagaaccagggaaaaaucccaaaaauuuucagaccaugccaggcauuuuccaaacuacaacgggugaaauaggggcaauagcacucgauuucaaaccuggcacaucaggaagcccuauuaucaauagggaagguaaaguuguuggccucuaugguaacggggucguaacuaaaaaugguggauacguaucagggauagcgcagacaaaugcugaaccugacggaccaacgccggaauuggaagaagaaauguuuaagaaacgcaaucugacaauaauggaccuucauccuggaucaggcaaaacgagaaaauacuuaccagcuauagucagagaagccauuaaaagaagauuaagaacguugauacuggcuccuacucgaguaguagcggcggagauggaggaagcauugaaaggacuaccgauacgguaccaaacuacggcaaccaaaagcgaacauacuggucgugaaaucguggaccuaaugugucaugcaacauucacaaugagauugcuaucuccugugagaguaccaaauuacaaccugguaaucauggacgaagcucacuucacugacccggcaagcauugcagcaaggggcuauaucucgacccguguaggaaugggagaagcggcagcuauauucaugaccgcaaccccaccugggacugcggaggcuuuuccacaaagcaaugcaccuauacaagaugaggaaagggauauaccagaacguucauggaacucugggaaugaauggauaacagauuuugugggaaaaacaguuugguuuguucccucaauuaaggcgggcaaugauauagcuaacuguuuaaggaaaaacggcaagaaaguaauucaacuaucgaggaaaacguuugauacugaguaucaaaagacccguuuaaacgacugggacuucguuguaacaacagacaucucagagaugggagcaaacuuuaaagcagauagaguaauagacccacgccguugucugaaaccaguaauacuaacugauggacccgaacgggucaucuuagcagggccgaugccuguaacugcggcuucugcugcucaacgcaggggucgagucggccguaacccgcaaaaagaaaacgaccaauacauauucacuggucagccacuuaauaaugaugaagaucaugcccauuggacugaagcuaaaauguuacuugacaacaucaacaccccugaaggaauuauucccgcacucuucgaaccggaaagggagaaaucagcagcaauugauggagaauacagacucaaaggggagagucgaaagacguuucuugagcuaaugcggcguggugaccuaccaguaugguuagcacauaaaguagcgagugaaggcaucaaguauacagauaggaagugguguuucgauggcgaaaggaauaaucaaauacucgaagaaaacauggacgucgaaauauggacuaaagagggugaaagaaagaaauuacgaccacgauggcuagacgcucgaacauauucagaucccuuagcgcuuaaagaauuuaaagacuuugcagcagggcgaaaaaguauagcccuugaucugguaacagaaauagggcguguaccuucacacuuagcccaccgcacuagaagugcacuagacaauuuagucauguugcauacaagcgaacacggcggacgugcauacaggcaugcuguugaagaauugccggaaacaauggagacacucuuacuccuuggucucaugauacuuuugacagguggagcuaugcuguuccuaauaucuggaaaggguauuggaaaaaccagcauaggauugauuuguguuauaguaucaucgggaaugcuauggauggccgauguuccacuacaauggauagcuucagcaauaguuuuagaguucuuuaugaugguucuauugauaccugaaccagaaaaacaacgcacuccccaagacaaucaauuagcuuauguuguaauuggcauacugacacucgcugcaauaguugcggcaaacgagauggguuuauuagaaacgacaaaaagggaccuaggcaugaguaaagaaccuggugugguuaguccaacgagcuaucuagacguagaccuacauccagcuucagccuggacauuguaugccguugccacaacggucauaacuccaaugcuuaggcacaccaucgaaaacagcaccgcaaacgugagccuagcugcuauugccaaccaagcuguaguguuaaugggcuuggacaaaggauggccaauaagcaaaauggaccuaggaguaccccuauuagcauuggggugcuauagucagguaaauccucuaacauuaaccgcagcuguucuucuuuuaguuacucauuaugcuauaauugguccgggucuacaggccaaagcuacucgagaagcucagaaaaggacagccgcuggaauuaugaaaaacccaacuguagauggaauaaugacuauagauuuggauccgguaauauacgacuccaaauuugaaaaacaacuagggcaagucaugcuauuaguacuaugugcugugcaacuucuacuaaugcgcacuagcugggcacuaugugaagcacuaacuuuagcaacaggaccaauuacuacguugugggaaggaucuccaggaaaauucuggaacacaacaauagcuguaucgauggcaaacaucuuccgaggcaguuaucuagccggugcaggacuagcguucaguauaaugaaaagcguagguaccggucgaagagggacuggaagucagggagaaacgcuaggagaaaaauggaagaagaaauuaaaucaauuaaguagaaaggaauuugauuuguacaagaaaagugguauuacugaaguagauagaacagaagcuaaagaagggcuaaagagaggagagaccacacaccaugcuguuaguagagggucagcaaaauuacaaugguuuguagaaaggaauaugguaauacccgaaggccggguuauagauuugggaugcgggagggguggauggucuuacuacugugccggccuaaagaaggucacagaaguccgaggauacaccaaagguggaccugggcacgaagaaccuguacccaugucuacauauggauggaauauaguaaagcucaugagcgggaaagaugucuucuaucuaccgccagaaaaaugugacacauuauugugugacauuggagaaucaucucccaguccaaccguugaagaaagcagaacaauaagaguucuaaagaugguugaacccuggcuccguaauaaucaauuuuguauaaaaguauuaaacccauacaugccuacaguuauagaacauuuggagagacuucaacgaaaauauggugguaugcuaguacgcaauccguuaagucgcaauaguacccaugaaauguauuggauuucaaaugguaccggaaacauuguuagcucaguaaacauggugucgagacucuugcuaaacagauucacuaugacgcauagaagaccaaccauagaaaaagacguagaucuaggcgcaggcacgagacauguaaaugcagaaccagaaaccccgaauauggacguaauaggugaaaggaucaaacggauuaaggaggaacauagcucuacauggcauuaugaugaugagaacccauauaaaacgugggcauaccacggauccuaugaaguaaaagcaacagguagugcgagcaguaugauuaacggagugguuaagcuacuaaccaaaccuugggacgucguuccaaugguuacccaaauggcuaugacagacacuacaccauuuggucagcaaagaguuuuuaaagaaaaaguagacacacguacuccgagaccgaugccaggaacuagaaaagucauggaaauaacagcugaauggcuguggaggacucuaggccggaauaagaaaccccgucuaugcacacgcgaagaauuuacgaagaaaguacguacaaaugcugcaaugggcgcaguauucacggaagaaaaucaaugggacaaugcgcgugcugcaguagaagaugaagaauuuuggaaacuuguugaccgugagagagagcuccauaaacuuggaaaauguggcagcuguauauacaauaugaugggaaagcgggagaagaaauugggggaguucggaaaagcaaaagguuccagggccauaugguauaugugguuaggagcacguuacuuggaauuugaagcucuuggauuucucaacgaagaucauugguuuucaagggaaaacaguuacaguggaguagaaggugaaggauugcauaaacuuggguauauucugagagauauuucaaaaauacccggcggugcgauguaugcggaugauacagccggcugggauacaagaauaaccgaagacgauuugcauaaugaggagaaaaucacacaacaaauggauccagagcauagacaacuagccaaugcgaucuucaaauuaaccuaucagaacaaaguuguuaaaguucaacgaccaacaccuaaaggcacuguaauggacauaaucagucguaaagaucaaagggguuccggacaagugggcacuuacggacuaaacacauucacuaauauggaggcucaauuaguaagacaaauggagggagaaggcguguugucaaaagcugacuuagaaaauccucaccuacuagagaagaaaauaacacaguggcucgagacaaaaggaguagauagauugaaacgcauggccauuucaggcgaugauugugucguaaaaccgauugacgacagauuugcgaacgcuuuauuagcauuaaacgauaugggcaaagucaggaaagauauuccacaguggcaaccuaguaagggguggcaugacuggcaacaaguaccauuuugcucacaucauuuucaugagcugauaaugaaagauggccgaaaauugguaguuccuugucgcccacaggacgaacucaucggucgugcccgaauuagccaaggugcuggcuggucuuuaaaggagacagcauguuuggguaaggcuuacgcacaaauguggucacuaauguacuuccacagaagagauuugagacuagcgagcaacgcaauuugcagcgccguuccuguacacuggauaccaacaagucggacaacauggucaauacaugcacaucaccaguggaugacgacggaggauauguuaacggucuggaaucgaguguggauugaagacaauccuuggauggaggauaaaacgccaguuacaacaugggaggacguaccauauuuagggaaaagggaagaccaguggugugguagcuuaauaggacuuaccucucgagccacaugggcucaaaacauauuaacugcuauacaacagguacgcucgcuaaucggagaugaagaguuccuagauuauaugccuaguaugaagagguuucgaaaagaagaggagucagaaggugcaauuugguga

SEQ ID NO: 23123 - RNA, 9873 nt, Artificial Sequence
  derived and/or modified CDS sequence (opt6) from DENV-3__FJ639712__SS-prME
acuagcuuaugcuuaaugaugauguuccccgcaacauuagcguuccacuugacuucaagagauggggaacccagaaugauaguagggaaaaacgagagagguaaaucuuugcuauucaaaaccgcuucaggaauaaacaugugcacguuaauugcuauggaucucggagaaaugugugacgacacaguaacuuacaaaugccccuuaauugcagaaguagaacccgaagauauugauuguugguguaaucuaacaaguacgugggugacauaugggaccugcaaucaggcaggagaacaccgucgugauaaacgaucuguagcgcuagcaccacacguggguaugggauuagauaccagaacccaaacauggaugucggcggaaggugcauggaggcaaguggagaaaguggaaacgugggcucuacggcacccaggauuuacgauccuagcacuguuuuuggcucacuauaucggaacaaguuuaacccaaaaaguuguuauuuucauacuuuugaugcuugugacuccaucuaugacuaugagauguguaggaguuggaaaccgugacuucguggaagggcuaaguggugcuacauggguggaugucguauuagaacauggagguugugucacaacgauggcuaagucaaaaccgacuuuagauaucgaguuacaaaagacagaagcuacccaacuagcaaccuuacggaaguuaugcauagaaggaaaaauuacuaauauaacaacggacaguagaugcccuacgcagggagaagcaacacuuccagaagaacaagaucaaaauuacguaugcaaacacacguauguggaucgaggguggggaaauggaugugguuuauucggaaaaggaaguuuagugaccugcgcgaaauuucaauguuuagagccuauagaaggaaagguaguacaguacgaaaaucuuaaauacacuguuaucauaaccguccauaccggcgaucagcaucaaguggggaacgauacacaaggaguaaccguagaaauuacuccacaagcaucuacuguggaggcaguacuuccagaauacggcacauuaggucuggaauguagcccgaggacuggguuagacuuuaaugagaugauauuauuaacgaugaagaauaaggcuuggaugguacaccgucaaugguuuuucgaccuuccacuaccauggacaucuggugcuacuacugaaacaccgacauggaacaggaaggaacuauuaguaacuuuuaaaaacgcucaugcuaaaaagcaagagguaguaguauuaggaucccaagaaggagcaaugcacaccgcacuaacgggagcaacagaaauucaaaauaguggagggacauccaucuucgcuggucaccugaaaugcagacuaaaaauggauaaauuagaacuaaagggaaugaguuacgcaaugugucugaacacuuuuguacuuaaaaaggaaguaucagaaacacagcauggaacaauacuaauuaagguggaauauaaaggugaagaugcacccuguaaaauccccuucucaacugaagacggucaaggaaaagcccacucuggaagacucauuaccgccaauccaguuguaacaaagaaggaagaaccaguaaacaucgaagcagaaccaccuuucggagaaagcaauauagugaucggaaucggugacaaagcauuaaaaauaaacugguauaaaaagggaucaagcauuggaaaaauguuugaagcaaccgcaagaggagcaagacgaauggcgaucuugggcgauaccgcgugggauuuuggaucaguagguggcguacuaaauucgcuaggaaagauggugcaccaaauuuuugggagcgcguacacagcucuauuuucaggcguuuccugggucaugaaaaucggaauagggguauuacugacauggauaggauuaaacucaaagaauacaagcaugagcuuuuccugcauaguuaucggcauuauaacacuuuauuuaggagcaguaguacaagcagauaugggcuguguaauaaacuggaagggaaaagaauuaaaauguggaucaggaauauuuguuaccaaugaaguccauaccuggacugaacaguauaaauuccaggccgauagucccaaaagauuagcaaccgccauugcgggugccugggaaaacggagucugcgguaucaggucuacuacacggauggaaaaucuguuguggaagcaaaucgcaaacgaacucaauuacauucuaugggagaauaacauuaaguuaacugucguggugggcgacaucauaggaguacuugaacaagggaaacgcacacuuacaccacagccaauggaacuaaaauauuccuggaagacaugggguaaagcuaaaaucgucacggcagaaacccagaauaguucuuucaucauugacggaccaaauacaccugaauguccaucugcaucacgcgcguggaacguaugggaagucgaggauuauggauuuggaguguuuacaacaaacauuuggcuaaaacuacgagaaguauacacucaaucgugugaucaccgacuaauguccgcggcgauaaaagaugagagggcuguucacgcugauaugggcuauuggaucgaaucgcagaaaaacggaucuuggaagcuagaaaaggccagcuuuauugaaguaaagacaugcacauggcccaaaagucauacacuguggucuaauggaguacuagaauccgauaugauaauaccuaaaucacuagcaggcccaauuagucaacacaaucauagaccuggauaucauacgcaaacagcgggccccuggcauuuaggaaaguuagaguuagauuucaacuauugugagggaacuacaguuguuaucacugagaauugcgggacacgaggaccaagucuacgcacuaccacaguaaguggaaaacuaauacaugaauggugcugucgcaguuguacgcuacccccuuuaagauauaugggugaagacggauguugguacggcauggaaaucagaccaauaaaugaaaaagaagaaaauaugguuaagagccucguauccgcaggaaguggcaaaguggacaacuucacuaugggcguguuaugccuugcgauccuauuugaagaagugaugagaggaaaauuuggcaagaaacauaugauugcaggcguuuuauuuacauucgucuuguuauuaucuggacaaauaacuuggagagacauggcccauacauuaauaaugauugguucaaacgcguccgacaggaugggaaugggaguaacauaccuagcauuaauagcuacauucaaaauacagccauuucucgcccucggcuuuuuccuacguaaauuaacgagccgagaaaauuuacuucuuggaguaggucuagcgauggccacuacacuacaacuaccagaggacauagagcagauggcaaacggaauagcccuuggucuaaugacuuuaaaacuaauaacacaauuugaaacguaucaacuauggacugcauuaguaucacuuacuuguucaaacacuauauucacacuaaccgucgcguggagaaccgcgacucuaauacuggccgguguaucauuauuaccacugugucaaucaucgaguaugagaaaaacugauugguuaccuaugaccguugcagcgaugggaguacccccguuaccucuuuucaucuuuucuuugaaagacacgcccaaacgaagaagcuggccccucaaugaaggaguuauggccguugggcucgugucuauccuagcauccagucuacuaagaaaugauguaccgauggcaggaccuuuagucgcaggaggcuuacuaauagcuugcuacgucauaacugggacuucagccgaccuaacaguagaaaaagcagcagaugugaccugggaggaggaagccgaacaaaccggggugagucauaacuugaugauaaccguugaugaugauggaacaaugagaauaaaagaugacgagacggagaacauccugacaguacuguuaaaaacugcacuauugauugugucagggauauuuccuuauucuauaccugcgacccuccuaguuuggcauaccuggcaaaaacaaacucaacgcaguggaguuuugugggauguuccuucaccgccugaaacacaaaaagcugaguuggaagagggcguguaucgaauuaaacaacaaggcauuuuugggaaaacgcaaguggguguaggaguccaaaaagagggaguauuccacacaauguggcauguaaccagaggagcaguacuuacacauaaugggaaacgucuugaacccaauugggccagugucaagaaagacuugauuagcuacggcggaggauggcgauugaaugcccaauggcagaaaggagaggaaguccagguuauagcaguugaaccaggcaaaaauccuaaaaacuuccaaaccaugccuggaauuuuccaaacuacaacaggagaaauaggagccauagcgcuagacuucaaaccuggaacgucaggcagcccgauaauuaaucgagaagguaaaguuguuggccucuauggaaauggaguaguaacaaagaacggggguuacguuagugggaucgcccaaacaaaugccgaaccagaugguccaacgccagaacuggaagaagaaauguucaagaaaagaaaccuaacaauaauggaucuucauccaggcucggggaaaacuaggaaauaucugcccgccauuguuagagaggcgauaaagcgacguuuaaggacauuaauuuuggcaccuacucgaguaguagccgcagaaauggaagaagcguuaaaaggguuaccgaucagauaucaaacuacugcuacaaaauccgaacacacgggaagagaaauuguagacuugaugugccaugccacuuucacaaugcgauuacucagucccgugcgagugcccaacuacaacuuaguuauaauggaugaggcucauuuuaccgauccggcgagcauagcggcucgaggauacauaucaacacggguuggaaugggcgaggcggcugcaauauuuaugacagcaacgccacccgguacggcagaagcauuuccacaaaguaaugcaccaauacaggacgaagaacgcgacauaccggagaggaguuggaacuccgguaaugaauggaucacugacuuuguuggcaaaacaguaugguuugucccuucuauaaaagcuggaaacgauaucgcgaauugucuaaggaaaaaugguaagaaaguuauacaauuaagccgcaaaacguuugacacagaguaccagaagacucgauuaaacgagugggauuuuguugucacaacggacaucucggagaugggagcaaauuucaaagcagacagaguaauagacccacgcagaugucugaaaccugugauauuaacagauggaccugagcgugucauauuagcaggcccaaugcccguaacagccgcuucagcugcccagagaagaggacgaguuggaagaaauccacaaaaggagaaugaccaguauaucuuuacaggccagccuuugaauaaugaugaggaucaugcucacuggacggaagccaagauguuacucgauaauaucaacacaccugaagguaucauaccagcacuguuugagccggaacgagaaaaaucagcagcaauagacggugaauacaggcuaaaaggagaaagccguaaaaccuucguagaacuuaugcgaagaggcgaccuaccaguuuggcuggcucacaaaguugcaucugaaggaauaaaguaugcugacaggaaauggugcuucgacggugaacguaauaaucaaauuuuagaagaaaauauggacguagagauauggacaaaagaaggugaacgaaagaaauuacguccucgauggcucgaugccaggacauauagcgacccauuggcccuuaaagaguuuaaggauuuugcagcuggcagaaaaucuauagcguuagauuuaguaaccgagaucggcagaguaccaagucaucuagcucaccguacuagaaaugcacuugacaacuuggucauguugcauacgucagaacacggaggucgugccuauagacacgcaguggaagaacucccggagacaauggaaacccuacugcucuuaggccuuaugauacuacuaacuggcggggcaauguuauuucuuauaaguggaaaaggaauagggaaaacuucaaucggguugauuuguguaauaguuagcuccggcaugcuuuggauggcggacgucccguuacaauggauagcuucugcaauuguauuagaguucuucaugaugguccucuugauuccugaaccagagaaacaacgaacuccgcaagacaaucagcuugcauacguagucaucggcauucuaacacuugcagcgauaguugcggcaaaugaaaugggucuauuagaaacuacuaaaagagacuuaggaaugagcaaggaaccuggaguaguuuccccaacgucguauuuagauguagauuugcacccagcuucugcauggacgcuauaugcaguugcaacaacuguuaucacccccauguuaagacacaccauugaaaacagcacugcuaaugugucuuuagcagccauugcuaaccaagcagugguauuaaugggacuagauaaaggcuggccaauuagcaaaauggauuuaggaguaccgcuacuagcuuuaggauguuacagucaaguuaacccguugacauugacugcggcgguacuucugcucguaacccauuaugcaauaaucgguccaggcuuacaagcaaaagcuacacgggaagcucagaagcguacagcugcagguauuaugaaaaacccgacuguagacgguauaaugacaaucgacuuagacccagucauauacgacagcaaguuugaaaaacaauugggccaaguaauguugcuaguucuaugugccguacaguugcuauuaaugagaacaucaugggcauuaugugaagcucuaacauuagcuacaggccccauuacaacacucugggaaggcaguccuggaaaauuuuggaacacgacuauugcagucucaauggccaacauauuucggggcaguuauuuggccggugcaggcuuagcauucuccauuaugaagucaguagguacagguagacgagguacaggaucucagggugaaacuuuaggcgaaaaauggaagaagaaauuaaaucaauuaagucguaaagaguucgaucuuuauaagaaaagugguauaacagagguagauagaacagaagccaaagaaggccugaaacguggggaaacuacgcaucacgcaguaagucguggaucagcaaaacugcagugguucguagagagaaauauggucauuccugaaggaagggugauugauuuaggcuguggucguggaggauggucuuauuauugugcgggacuuaagaaaguuacggagguaagaggauauaccaaaggcgguccaggacacgaggagccuguaccuaugucgacauaugguuggaacauagugaaauugaugagcgggaaagauguauuuuacuuaccgccagaaaaaugugacacauuacucugugacauuggcgaauccaguccuagucccacaguagaagagucaaggacaauccgaguccuaaaaaugguagagccguggcuaagaaauaaucaauucuguauaaagguacucaaccccuauaugccuacugugauagagcauuuggagcgucuacagcgaaaguauggagguauguugguuagaaauccucuaagucgaaauaguacacacgagauguacuggauaagcaauggcaccgguaacauuguuucgagcguuaacauggucaguagauuauuauugaauagauuuacgaugacccauagacgaccaacaaucgaaaaagauguagauuugggugcuggaacuagacaugugaacgcugagccugaaacaccgaacauggacgugauuggagaacgcauaaaacgcauaaaagaagaacauucuucgacuuggcacuaugacgacgaaaacccauacaaaacuugggccuaccaugguucguaugaaguuaaagcaacagguuccgcuucaagcaugaucaauggaguugucaaacucuuaacuaagccgugggauguuguuccaaugguuacacagauggcgaugaccgacacaacaccuuuuggccaacagagaguguuuaaagaaaagguagauacaagaacuccacguccgaugccgggaacaagaaaggucauggaaauaacugcagaaugguuauggagaacacuuggaagaaacaagaaaccaagauugugcacucgagaagaguuuacuaagaaaguacguaccaacgcugcaaugggugcaguguucacugaggaaaaucaaugggacucagcaagagcagcuguagaagaugaagaauuuuggaaacucguagaucgagaacgcgaacuccauaagcucggaaagugcggcucauguguuuacaacaugaugggaaagagagagaagaaacucggcgaguuugggaaagcgaaagggucccgagcuauuugguacaugugguuaggugcuagguaccuggaauuugaagcguuaggauuccuaaaugaagaucacugguucagucgggaaaauucuuauagcggaguagagggggaaggucuacauaaacuaggauauauauugcgugacauaaguaaaauuccggguggcgcuauguacgcggaugauacugcgggaugggauacgcgcauaacugaagaugaucuucacaaugaagagaaaaucacacaacaaauggacccugaacauagacaauuagccaaugcaauauucaaauuaaccuaucaaaacaaggugguuaaaguccaaagaccaaccccgaaaggaacaguuauggauauuauaaguagaaaagaccaacguggaucaggucaaguggggaccuauggccuuaauacauuuacuaacauggaagcgcaguuaguacgacaaauggagggggaaggaguccuaucuaaagcagauuuagagaacccacauuugcuagaaaagaaaauuacacaauggcuagaaacuaagggcgucgaacggcuuaaaagaauggcuauaucuggcgaugacugugucguaaagccaauagacgaucgguuugcgaaugcauuguuggcacuaaacgauaugggaaaagugcgcaaggacaucccacaguggcaaccaagcaaaggauggcacgauuggcaacagguaccguuuugcucgcaucacuuucacgagcuaauuaugaaagacggacgaaaauuagucguucccugccggccacaagacgaacugauaggcagagcaaggauaucccaaggcgcaggauggucucuaaaagagacugcuugucuugggaaagcauaugcccaaauguggucgcuuauguacuuccaucgacgugaccuuaggcuugcauccaacgcaaucuguucggcugucccuguucacuggauaccgacaagucgaaccacauggaguauucacgcgcaucaucaguggaugaccaccgaagauaugcucacgguuuggaaccggguuuggaucgaagacaauccauggauggaggauaagacacccguaacaacaugggaggacguuccauacuuaggaaagcgagaagaucaguggugcggcucccuaauagggcucacaagucgggcaacaugggcgcagaacauauugacggcaauccaacaaguaagaagccucauuggggaugaggaauuuuuagauuacaugccaagcaugaaaagauuucggaaagaagaggaaagcgagggugcaauuugguga

SEQ ID NO: 23124 - RNA, 9873 nt, Artificial Sequence
  derived and/or modified CDS sequence (opt6) from DENV-3__FJ639713__SS-prME
acaagccuuugcuugaugaugauguuaccagcaacguuagcauuucaccuaacuucaagggacggagaaccuagaaugauaguugguaaaaaugaaagaggaaaaucacuccuguuuaaaacagcuagcgggauaaauaugugcacauuaauugcuauggacuuaggagaaaugugugaugacacaguaacauauaaauguccacucauagcagaaguugaaccugaagacauagauuguuggugcaauuuaacaaguacaugggucacguacgggaccuguaaccaagcuggugaacauagaagggauaaacguucuguagcauuagcaccccauguaggaaugggauuagauacaagaacacaaacauggaugucagcagaaggugcuuggaggcaagucgaaaaaguggaaacaugggcccuuagacauccaggauuuacaauccuagcauuguuuuuagcccauuauauagggaccucgcuaacacagaaagucguaauuuuuauacuauuaaugcuuguaacuccgagcaugacgaugcgaugugucggaguaggaaaucgcgacuucguagaagguuuaagcggugcgacauggguggaugucguauuagaacacggaggguguguaacuacaauggcgaaaucgaaaccgacguuagauaucgaacuacagaaaacagaagcaacacaacuagcaacccuaagaaaauuauguauugaaggaaaaauaaccaauauaacaacugauagucgcugcccgacgcaaggggaagcuacacuucccgaagaacaagaucaaaauuauguuugcaaacauacauacgucgaucgaggaugggguaacggauguggacuguuuggaaaaggcagcuuagugacaugugcuaaauuucaaugucuagaaccaauagaagguaaaguugugcaauacgaaaauuugaaauauacaguuaucauaacuguucacacgggagaucaacaucaaguagguaaugauacucaaggaguuacaguugaaauuaccccgcaagcgaguacaguugaagccguacucccugaauaugggacacugggcuuggaauguuccccacgaacaggacuugauuuuaaugaaaugauccuguuaacaaugaaaaauaaagcguggaugguacauaggcaaugguuuuucgaucucccacucccuuggacaagcggcgccacaacagaaacuccaacauggaaucgaaaagaacugcuggugacauuuaaaaacgcucaugccaagaaacaagaaguagucguccuagggucccaagaaggagccaugcacacugcguuaaccggagcaacagaaauccaaaacagcggaggcacauccauuuuugcagggcacuugaaaugccguuuaaaaauggauaaacuagaacugaaaggaauguccuaugcgauguguuugaauacauuuguacuaaagaaagaaguuucugaaacucaacauggaacaauacuaauaaaagucgaauauaaaggagaagaugcaccaugcaaaauaccauuuucaaccgaagacggucagggcaaagcgcacaacggcaggcuuaucacggcuaauccaguagucaccaagaaagaggaaccaguuaacauagaagcugaacccccuuucggagaaagcaacauagucauaggcauaggagauaaggcuuuaaaaaucaacugguauaagaaagguucaaguaucggcaaaauguuugaggcuaccgcuaggggcgcaagaaggauggccauccuuggugacacagcuugggauuucggauccguuggaggugucuuaaauucacugggaaaaauggugcaccaaauauuuggcagugcuuacacagcccuuuucucaggagugucuuggauaaugaaaauaggaauagguguauuacucacauggaucggacugaauagcaaaaauacaaguaugucauuuucauguauaguaauagggaucaucacacuauaccuuggggcagucguucaagcagacaugggauguguaauuaacuggaaaggaaaagaacuaaaauguggcaauggaauauucgucaccaaugaaguccacacguggacugaacaauauaaauuccaagcagauaguccuaaaagacuugcuacugcuauugccggggcaugggaaaauggagucugcgguauaagaaguaccacacggauggagaauuuauuauggaaacaaauagcuaaugaacuaaauuauauauuaugggagaacaauauaaaauuaacagucgucguaggugacaucauaggcguuuuagagcaaggcaaacguacgcuaacgccacaaccgauggagcuaaaauacucuuggaaaacuuggggaaaagcgaaaauuguaacagcagaaacgcaaaacagcucauucauaauugaugguccuaauaccccagaaugccccuccgcuucuagagcauggaacgucugggaaguugaagauuauggguuuggggucuucaccacaaauauaugguuaaaacuaagagaagucuacacacaaucgugcgaucauagguuaaugucggcugcgauaaaagaugaacgagcaguacaugcagacaugggauauuggauagaaagucagaaaaauggaucuuggaaauuggagaaggcaaguuuuauagaagugaagacguguacauggccaaaaucucauacauuguggucuaacggcguacuggaaagugauaugauuauccccaaaucguuggccgguccaaucucgcaacauaaccacagaccaggguaucauacgcaaaccgcaggcccguggcauuugggaaagcuagagcuagacuuuaacuacugcgaaggaacaacaguagugaucgcagagaacugcgggacacggggaccuagucuacguaccacaacaguuagcggaaagcuaauucacgaaugguguugucgaaguuguacucucccaccacuaagguauaugggugaggacggaugcugguacggaauggagaucagaccuauaaacgaaaaagaagagaacaugguuaaaucauuaguauccgcagggucuggaaaaguagacaauuucaccaugggaguacuaugccuagcaauucuguuugaggaaguaaugagaggaaaguuuggcaagaaacauaugauagcgggaguacuauucacuuucguucuucuucucucaggccaaauaacguggagagacauggcgcacacucugaucaugauaggcuccaaugcgucagaccgcauggguaugggaguaacuuauuuggcuuuaauagcaaccuuuaaaauccaaccguucuuggcacucggcuucuucuuacguaaauuaacgucucgagagaaccuccuacucggagucggacuggccauggcaaccacucuucaacuaccagaagauaucgaacaaauggcaaauggaauugcccucggucuaaugacacuaaaguugaucacacaauucgagaccuaucaauuguggacagcauuaguaagccuuaccugcagcaauacaauuuuuacacugaccguagcauggagaaccgcaacguuaauauuagcaggaguuaguuuauuaccccuaugccagucaaguucaaugaggaaaacggacuggcuaccuaugaccguugccgccaugggagucccuccccuacccuuauuuaucuucucucuuaaggauacgccaaaacgaagaucuuggccacucaacgaggguguaauggccguaggcuuaguaaguaucuuagccucaucgcuauuacguaacgauguaccgauggcugggccauuaguagcgggaggacuucucauugcaugcuacguaauaacaggaacgagugcugauuugacaguggaaaaagccgcugacgugacaugggaggaagaggccgagcagacagguguaagucauaaucuuaugauuaccguugacgaugaugggacaaugcgaaucaaagacgaugaaacagagaacauuuuaacgguucuacuaaagacggcguuacuaauaguaucaggaaucuucccuuauucaauaccugcaacauuacuuguauggcauacguggcagaaacaaacucaacgaagcggcgucuuaugggacguuccuagucccccugaaacgcaaaaggcggagcuugaagaggguguauaccggauaaaacagcagggcauuuucggaaaaacucaggugggaguuggaguacaaaaagaagguguauuucacacaauguggcauguuacaagaggagcuguacuaacacacaacggcaaacgacuagagcccaauugggcaagcguaaagaaagauuugauuaguuacgguggaggauggaggcuuuccgcccaguggcaaaaaggugaagaagugcaagugauagcugucgagccaggcaaaaaccccaaaaauuuccaaaccaugccuggaauauuccaaaccacuaccggagagauaggggcaauagcacuugauuuuaagccugggacuucuggcagcccgauaauuaaucgagagggaaagguuguuggacuuuaugggaauggaguaguuaccaaaaacggugguuauguaucggggaucgcgcagacaaaugcugaaccagaugggcccacuccugagcuggaagaagaaauguuuaagaaacggaauuuaaccauaauggauuugcacccgggaaguggcaagaccagaaaguauuuaccagcaaucguuagagaagcaauuaagcgcaggcuuaggacauuaauucuagcuccaaccagaguaguugcagcugagauggaagaggcucugaagggcuugccaauuagauaccagacgaccgcuacaaaaucggaacauacaggccgcgagaucguagaucugaugugucaugcaacauucaccaugcgguuauuaucaccaguacgaguaccaaacuacaacuuaguaauuauggaugaagcucacuuuacggacccugcuaguaucgcugcaagaggauacauaucaacacgggucggaaugggagaggcugcugccauauuuaugacagcaacuccuccuggaacagcugaggcauucccgcaaagcaaugcucccauacaagacgaagaaagagauauucccgaaagaucauggaacucaggaaacgaauggaucacagauuuuguaggaaaaacugugugguucguacccucaauaaaggccgguaacgauaucgcgaauugucugaggaaaaacggaaagaaaguaauacaacuaucaaggaaaacauuugauaccgaauaucagaaaacccgacucaaugacugggacuuuguuguaacaacugauaucagugaaaugggagccaacuucaaggcggaucgcgugauagauccgaggagauguuuaaagccuguuauccuuacagauggacccgaacgaguuauccuggcuggcccaaugccugugacagccgcaucggcugcccaacgacgaggacgcguaggaagaaauccacaaaaagaaaaugaucaauauauauucacugggcagccacucaacaacgaugaagaucacgcucacuggacggaagcgaagauguuacuugauaauauaaacaccccagaagguauaauuccagcguuguuugaaccugaacgagagaagucggcagcaaucgacggggaauaccgauuaaaaggggaaucaagaaaaacuuucguagagcuuaugaggagaggagauuuacccguaugguuggcacacaaagucgcaucagaagguaucaaauauacggaucgaaagugguguuucgauggugaacgaaacaaccaaauucuggaggagaacauggauguggaaauauggacaaaagagggagaaaggaagaaacuaagaccaagauggcucgaugcaagaacuuauagugacccgcuggcacuuaaagaguucaaggauuuugcugcggggagaaaaucaaucgcauuggaccuugucacagaaauugggcguguaccgucccaccuggcucauagaacacgcaacgcgcuugacaauuuaguuauguuacacacaucagaacauggaggacgggcuuaccgucacgcagucgaagaacugccagaaaccauggagaccuuacuacuauuaggucuuaugauccuacuuaccggcggugcaaugcucuuucuaaucucuggcaaagguaucgguaaaacgagcauaggucuaaucuguguaaucgucaguagcgggauguuauggauggcagacguaccguuacaauggauugcuucugcuaucguucuagaauuuuucaugaugguauuacuaauaccagaaccagaaaagcaaaggacaccucaagacaaccaacuugcauaugugguuaucggaauauuaacuuuagcagcaaucgucgcagccaacgagaugggcuuauuagaaaccacaaaacgagaccucgguaugaguaaggaacccggaguaguauccccaaccagcuaccuugauguggaucuacauccggcuucagcguggacacuauacgcaguagcuacaacaguuauuacgccaaugcuacgacacacgaucgaaaauuccacagcuaauguaucccuagcggcuauagcaaaucaagcagucguacuuaugggauuagauaaaggauggccaaucaguaaaauggaucucggaguacccuuacuugcgcuuggcugcuacagucaaguuaauccauugacccuaacugccgccgucuuauuauuaguaacucacuacgcuauaauaggaccgggucuccaggcuaaagcgacucgggaggcucaaaaacgaacugcagccggaauaaugaagaauccaacgguggacggaaucaugacaauagacuuagacccgguuauauacgacagcaaauuugaaaaacaauuaggacaaguaaugcuauuagugcuaugugcagugcagcuauuacuuaugagaacuucaugggccuuaugcgaagcacuaacccuagcuacagggccaauaacuaccuuaugggaagguucuccaggaaaauuuuggaauacuaccaucgcagugagcauggccaacauauuccgagggucguaucuugcgggggcaggacuagcauuuucuauaaugaaaucuguaggaacgggucgacgugguacugggucacaaggugaaacucuuggcgagaaguggaagaagaaacuuaaucaguuaucccgaaaagaguucgacuuauauaagaaaagcggcauuacagaaguugaucgaagugaagcaaaggaaggauugaaaagaggggaaacuacacaucacgcuguaucacgagguagugcaaaauuacagugguuuguagagagaaacaugguaauaccugagggaagaguaaucgauuuagguugugggagaggaggauggucguauuauugugcgggguuaaagaaagugacagaagucaggggauauacaaaaggcggaccaggacaugaagaacccguuccuaugucuacauauggguggaacauagugaaacuaaugaguggcaaagacgucuuuuaccuaccuccugaaaaaugugauacauuacuaugugacauaggggagucaucaccuucaccuacuguugaagaaaguagaacaauccgcguauuaaaaaugguagaaccauggcugagaaauaaccaauuuuguaucaaaguauuaaaucccuacaugccuaccguaauugagcacuuggaaaggcuacaacgaaaacacggaggaaugcuagugaggaauccacuuucacgaaauucaacacaugagauguacuggauuucgaauggaacgggaaauauuguuucaucaguaaauaugguaaguaggcuucuacugaaccgauuuaccaugacacacagaagaccuacuauugaaaaggauguagacuugggugcaggaacaagacaugucaacgcagagccggaaacaccuaacauggacguaauuggcgaaaggauaaaacggaucaaagaggagcauucuucgacguggcauuaugaugacgagaauccauacaaaacaugggcauaccacggcucuuacgaaguuaaagcaaccgguucugcaucaaguaugauaaaugguguugucaaauuauugacaaagccaugggacgucgucccaauggucacccagauggccaugacagacacgacccccuuuggacaacagaggguauuuaaggagaaaguugacacacguacaccucggccgaugccagggacuagaaaagucauggaaauuacugcagaaugguuguggcgaacacucggacgaaauaagaaaccacgccuguguacacgugaagaguuuaccaagaaaguacguacuaaugccgcgaugggggcaguguucacggaagaaaaccaaugggauagcgcacgugccgccguggaggaugaagaguucuggaaauuagucgauaaagaacgggaguugcauaaauuaggaaaaugugggaguugcguauauaacaugauggggaaaagagagaagaaacuaggagaauuuggcaaagcaaaaggaucaagggcuauuugguauauguggcuaggagcccgauauuuagaauuugaagcauuaggcuuucuuaaugaagaccacugguucaguagagaaaacuccuacucugggguagagggggaaggccuccauaaauuaggauacauuuuacgggauauaagcaaaauaccgggcggggcgauguacgcagaugacacugcugguugggauacgcgcauaacugaggaugaccuacauaacgaagagaaaauuacucaacagauggaccccgagcacaggcagcucgcaaaugcgauauuuaaacuaacguaucaaaacaaagugguuaaaguacagcgaccaaccccaaaggguacuguuauggacauaaucucccgaaaggaccaacgcggaagcggacaaguuggaacauauggucugaauacauuuacaaauauggaagcucaauuggucagacaaauggaaggugaagguguauugucaaaggccgaucuagaaaauccccauuuacuugagaagaaaauuauucaauggcucgaaacuaaaggaguagaacgauuaaaaaggauggcgauuucgggggacgauugugugguaaaacccauugaugauagauucgcgaaugcauuauuagcccucaacgauauggguaaaguaagaaaagauauaccacaauggcaaccuagcaagggcuggcaugauuggcaacaagucccuuuuugcagccaucauuuccacgaacuaauaaugaaggaugggagaaaacucguaguaccaugucgaccacaagaugaacugauuggacgagccagaaucucucaaggcgcuggauggucuuuaaaggaaacagcaugucuaggaaaggcuuaugcccaaauguggagucuaauguacuuccauaggcgugacuugaggcuagcauccaacgcuauaugcagugcugucccgguucauuggaucccuacaucacguacuacauggucaauacacgcgcaucaccaguggaugaccacugaggauaugcugagcguauggaauagaguuuggauugaagauaauccauggauggaagauaaaacaccagugacaacaugggaagaugucccguauuuagguaaacgggaggaccaguggugcggaucgcucaucgggcuaacuagccgugcuacaugggcgcaaaauaucuuaacagcaauacaacaggucagaucucuaauaggagacgaagaguucuuagauuauaugccuucaaugaaaagguuucgcaaagaagaagaaucagagggugcaauuugguaa

SEQ ID NO: 23125 - RNA, 9873 nt, Artificial Sequence
  derived and/or modified CDS sequence (opt6) from DENV-3__FJ639714__SS-prME
acgucauuaugucucaugaugaugcugccugccacauuagcuuuccacuugaccagccgcgauggagaaccccgaaugauaguagggaaaaacgaacgaggaaaaaguuuauuauuuaaaacagcaagcggaauaaauauguguacauugauagcaauggacuugggggaaaugugugaugauacaguuacauauaaaugcccacuuaucgccgaaguagaaccagaagauauagacugcuggugcaauuuaacaagcacauggguuacuuaugggacuugcaaucaagcaggcgaacaccgaagagauaaacguagcguugcucucgcaccccauguaggaaugggccucgauacccgaacgcaaacauggaugucggcugaaggggcuuggagacaaguugaaaaaguggaaacaugggcucuacgacaccccggauuuacgauauuagcacuauuuuuagcacacuauauaggcacaagucuaacacaaaaaguagucaucuuuauauugcuaauguuagugaccccaucaaugacaaugcguuguguaggagugggcaaccgcgauuuugucgaaggacuaucaggggcaacauggguagauguugugcuagaacacggggguuguguaacgacaauggcaaaaaguaagcccacacuagauauagaacuacagaaaacugaagcaacccaacuugcuacuuuacguaaacucuguauugaagggaagauuacaaauaucacaacugauucgcggugcccgacacaaggagaagcaacacugccagaagaacaggaucaaaauuacguuugcaagcauacuuacgucgauaggggauggggaaacggauguggccucuuugguaaaggaagucuaguaacgugcgcuaaauuccaaugccuugagcccauagaaggaaaaguaguacaguaugaaaaccucaaauauacagucauuauaacaguacauacuggggaucaacaucaaguuggaaacgacacacaaggcguuacgguugaaauaacuccacaagccaguacuguggaagcuguguuaccugaauacgguacuuuagguuuagaaugcaguccgcgaacgggacucgauuuuaaugagaugauacugcucacaaugaagaauaaggcuuggaugguacauaggcaaugguucuuugacuuacccuugccuuggacaagcggggcgacgacggaaacaccaacuuggaauagaaaggaauuacuuguaacauucaagaacgcgcaugcuaaaaagcaggaggugguggucuugggaucacaggaaggagccaugcauacugcgcuuacaggagcaacugaaauucaaaauucaggagguacaaguauauuugcuggacaccuuaaaugucgauuaaaaauggauaagcuggaacuaaaggggaugagcuacgcaaugugcuugaauacuuuuguacuuaagaaagaggugagugaaacccaacauggaacgauucuaauuaagguggaguacaaaggggaagaugcacccuguaaaauaccauucucaacggaagauggacaagggaaggcccacaacggacgacuuauuacggccaacccgguaguaaccaagaaagaagaaccggugaauauugaagcagagccgcccuuuggggagaguaacauuguaauugguaucggagauaaggcacuaaaaauaaauugguauaagaaaggaagcuccauagggaaaauguuugaggcaaccgccagaggagcucgaaggauggcaauauuaggagauacugcuugggauuucgggucaguagguggaguacuaaauucacuagguaaaaugguucaucaaauauuuggaucugcuuauacugcucuauuuucuggaguaucauggauuaugaaaauugggaucggaguacuuuuaacguggaucggacuuaauaguaaaaauacuagcaugucauucagcugcaucgugauagguauuauuacucuauaucucggagcaguaguacaagccgacaugggaugcguuauaaauuggaaagggaaagagcuaaagugcggaaauggaaucuuuguaacaaaugaaguacauacuuggacugagcaauacaaauuucaagccgacucccccaaaagacuugcgacagcaauugccggagcaugggaaagcggaguaugcggaauuagaucaacgaccaggauggaaaaccugcuauggaagcaaauugcaaaugaauuaaauuauauuuuaugggaaaauaacauaaaacuaacuguugugguaggggauauaauaggagucuuagagcaaggaaaaagaacuuuaaccccucagccuauggaacuuaaguauucguggaaaacguggggcaaagcgaagaucgugacagcggaaacgcagaacucaucuuucauaauagauggaccuaacacaccugaauguccaagugcaucucgagcauggaacgucugggaagucgaggauuacggauuugguguauuuacaacgaauauaugguuaaaacuucgagagguauauacacagucgugcgaucauagacuaaugucagccgcaauaaaagaugaacgggccguccaugcugauaugggcuauuggauagagucccaaaagaaugggucauggaagcuagaaaaggcuuccuuuauagaggucaaaacauguacuuggccaaaaucgcacacguuauggucaaaugguguucucgaaagugauaugauaauuccgaagucacuagcugguccgauaucucaacauaaucauagaccuggauaucauacccaaacagcggguccauggcaucuaggaaaauuggaauuagauuucaauuauugugagggcacuacugugguaaucgccgaaaauuguggcacuagaggaccaucacuuaggacuacuacaguauccggcaaacuuauacaugagugguguugcagaucaugcacuuugccgccauuaagauauaugggugaggauggguguugguacggcauggaaauuagacccauaaaugaaaaggaggaaaacaugguaaaaagccuugucagugcaggcagcgguaaggucgacaauuucaccaugggcgugcuauguuuagcuauauuguuugaagaaguaaugcgagguaaauuugggaagaaacauaugauagcaggaguucuauucacuuucguacuacuacuaucaggacaaaucacguggagagauauggcacacacacuaauaaugaucgguaguaacgcuucugauaggaugggaauggggguuacauaccucgcacuaauagcaacguuuaaaauacaaccguucuuagcauuaggauucuuccucaggaaauuaacaucaagggagaauuuacuccuugggguaggucuugcgauggcaacuacuuuacaauugccagaagauauagaacaaauggcuaacggaauagcucugggccuaaugacccuaaaacuaauaacccaauucgaaacguaucagcuuuggacugcuuuaguaaguuuaaccuguagcaacacaaucuuuacuuuaaccguagcauggaggacagcaacuuuaauauuggcaggaguauccuugcuaccuuuaugccagucuucaagcaugaggaaaacagauugguuacccaugacgguagcagcuauggggguuccgccauuaccguuguuuauauuuucauuaaaagacacaccuaaaaggcgguccuggccacuaaacgaagggguaauggcgguagggcugguaagcauucuggcgucgucgcuacugagaaaugacguuccaauggcaggaccguugguggccgggggucuauuaaucgcguguuacguaauuaccggaacaucagcggaccuuaccguggaaaaagcggcggaugucacaugggaggaagaagcagaacagacaggaguaucgcauaacuuaaugaucacgguagaugaugacgguacgaugcgaaucaaagaugacgaaacugaaaauauucuuacaguccugcuaaaaacugcccuacuaauaguaucagggauauuuccauauucaauuccagcaacccuacuugucuggcauacuuggcaaaaacaaacacaaagaagcggaguacuuugggaugucccuagcccgccagaaacgcaaaaagccgaacuugaagaagguguuuacagaauaaaacagcaaggaaucuuuggaaaaacucaaguaggagucggaguucaaaaagaaggcguuuuccauacuauguggcacgucacuagaggcgcaguguuaacacauaauggcaagcgauuggaaccuaauugggcaucaguaaagaaagaccuaauaagcuacggagggggauggcgacucagugcgcaauggcaaaaaggcgaggaaguucagguaauagcgguagaaccaggcaaaaauccaaagaauuuucaaacaaugccgggaaucuuccagacuacuacuggugaaauaggcgcaaucgcacuagacuuuaagcccggaacaucagguucucccaucauuaaucgggaaggcaaagugguggggcuguacgguaacggcguaguuacuaaaaauggaggguauguuagcggcauugcacagacgaaugcugagccugaugguccaacucccgaauuagaggaggagauguuuaagaaacgaaaccucacuaucauggaucuucacccuggaucgggcaaaacaaggaaauaucuaccagcaauagugagggaagcaauaaaacguagacuaaggacauuaauacuggcaccaacucgaguuguugcagccgaaauggaagaagccuuaaaaggacucccgauacgauaucaaaccacggccacuaaaucagagcacacugguagggaaauugucgaccuaaugugucacgcaacguucacgaugagauuacucucacccguucguguaccaaacuauaacuuagugauaauggaugaagcacauuuuacggauccggccucaauagcagcaaggggauacauaucuaccaggguuggaaugggugaggcagcugcaauuuuuaugacagccaccccaccuggaacagccgaagccuucccacaaucaaaugcuccuauacaagaugaagaacgcgauauccccgagcguucguggaauagcgggaacgaguggauaacagauuuugugggaaaaacggucugguucguuccauccauuaaagcgggcaacgauauagcaaauugccugaggaaaaacggcaagaaagucauacagcuaucaagaaagacauuugacacagaauaccagaaaacaagacucaacgacugggauuuuguaguaacaacagacauuagcgaaaugggagcgaacuuuaaagcagaucgaguaaucgauccaagaagaugccuuaaaccuguaauacuuacagauggccccgagcgaguaaucuuggcuggaccaaugccaguuacagccgccucugcagcacaacggagagggagaguuggccgaaauccccaaaaagaaaacgaccaauauauuuuuacuggacaaccacucaauaaugaugaagaucacgcucauuggacagaagcuaaaaugcuauuagauaauauaaacacaccggaggggauuauacccgccuuauucgaaccggaaagagaaaagucggccgcaaucgauggugaguauagguugaaaggagaaucacgcaagaccuuuguagaauugaugaggcgaggugacuuacccgucugguuagcacacaaaguugcuagcgaaggcauuaaauauacagacagaaagugguguuucgauggggaacguaauaaccaaauauuggaagaaaauauggacguggaaauauggacaaaggagggugaacgaaagaaacucagaccacgauggcuggacgcaaggacauauucagacccuuuagcuuuaaaggaauuuaaagauuucgcugcaggcagaaaaucaauagcauuagauuugguaacagaaauaggacggguacccagucacuuagcacaccgaacgagaaaugcgcuugacaaucuaguaaugcuacauacgagugaacauggcgguagagcguaucgacacgcaguugaagaacuaccagaaacgauggaaacauuacuuuuauugggccuaaugauacuacuaacaggcggagccaugcuauuucuaauaucagggaaaggaauuggaaagacaaguauuggauugaucugcguuauaguaucuuccggaaugcuauggauggcagacguaccacugcaguggauugcaucugcaaucguacuugaguucuuuaugaugguacuacuaauucccgaacccgaaaagcagcggacaccccaagacaaucaacuugcguauguuguaauaggaauacuaacauuggcagcuaucguugcagcgaaugaaaugggauuguuagaaaccacuaaaagagauuuagguaugagcaaagaaccagggguaguaucaccaacaaguuaucuagacguagauuuacauccugcaucggcguggacauuauaugcuguugcaacgaccauaauuacaccuauguuaagacauacaaucgaaaauagcaccgcaaacguuucacuugcagccauagcaaaucaggccguaguucuaaugggacuggauaaaggguggccgauuucuaaaauggaccugggagucccuuuauuagcuuuggguuguuauucccaagucaacccauuaacauuaacugcagccguauuacucuuaguaacacacuacgcgauuauugguccugggcuacaagccaaagcgacaagggaggcgcagaaaagaacggcagcaggaauaaugaagaacccuacaguggauggcauaaugacuauagacuuagauccagugauauaugauucaaaguucgaaaaacaauugggccaagucauguugcucguacugugugcggugcaauuacuucuaaugagaaccucaugggcauuaugugaggcgcugacccuagcuacuggaccaauuacgacucuaugggaagggagcccaggcaaguuuuggaacacaacaauagcggugagcauggcgaacauauucagggggaguuaccuugcaggagccgguuuggccuucucgauaaugaaaucaguagggacuggacgaaggggaacagguagucaaggugaaacguuaggcgaaaaguggaagaagaaauuaaaucaguuaucaagaaaagaguucgaccuuuauaagaaaaguggaauaaccgaagucgaccgaacugaagcaaaagaaggauuaaaacggggagaaacaacacaucaugcgguaucacgaggaagcgcaaaacuacaaugguucgucgaaagaaauauggugauuccggaagguagagugauagaucucggcuguggacgagguggauggucuuauuauugugcaggcuuaaagaaaguuaccgaaguacggggauacacgaaaggcggcccgggacacgaagaaccaguucccaugagcaccuauggguggaacauuguuaaauuaaugucaggaaaagauguuuucuauuuaccaccagagaaaugugacacguuacuuugugacauaggggaaaguucaccgucaccaacagucgaagaaucaagaacaauacgaguauuaaaaaugguagaaccuuggcuccggaauaaucaauuuuguauaaaagucuuaaaucccuacaugccaaccguaauugagcauuuagaaagacuccaacgcaaauauggaggaaugcuuguacgaaaucccuugucaagaaauucaacacaugaaauguacuggaucucaaauggaaccggaaauauugucaguucuguuaauauggucucucgauuacuccuuaaccgauucacaaugacacaucgccgaccuacgauagaaaaagacguagaucuuggagccggaacgagacacguaaaugcagaacccgaaacaccuaauauggauguuauaggggaaaggauaaaaagaauuaaggaagaacauaguaguacauggcacuaugacgacgagaauccuuacaaaacaugggcauaucaugguuccuacgaaguaaaagcaacgggcagugccaguucuaugauaaacgguguuguaaaacugcugacaaaaccgugggaugugguuccgaugguuacgcaaauggcuaugaccgauacaacaccuuucggucaacagagggucuuuaaagaaaaaguagauaccagaacuccccgaccgaugccaggcacuagaaaaguuauggaaauaacagcagaaugguuauggcgaacccucggucgaaacaaaaagccuagacuauguacgagagaagaguucaccaagaaaguuagaaccaaugcugcaaugggugcgguuuucacagaagaaaaccaaugggacucugcgagagcugccguggaagaugaagaguucuggaaauuaguugauaaagaaagagaauuacauaagcuggggaaauguggaaguuguguguauaacaugaugggaaaacgggagaagaaacucggcgaguuuggcaaagcgaaggggucccgugccauaugguacauguggcuaggcgcaagauaucuagaguuugaagcauuagguuuccuuaaugaagaucacugguuuucuagagaaaauucuuacagcggaguggaaggagaaggccuucauaagcuaggauauauacucagggauauaucuaaaauaccaggaggugccauguacgccgaugauaccgcggguugggauaccagaauaacugaagacgauuuacauaacgaagagaaaauaacucagcaaauggauccuggccauagacaacucgcaaaugcaauauucaaacugacguaccagaauaaagucgugaaggugcagcgcccaaccccaaaagguacaguaauggauauaauaucgaggaaagaccaacgcgggucagggcaaguaggaaccuauggacuaaacacguucacaaauauggaggcucaguugguacgacaaauggaaggcgagggaguguugucuaaagcugaucucgagaauccgcaucuauuagagaagaaaauuacgcaaugguuagaaacaaaaggggucgagagacugaaacgaauggcuauaaguggcgaugacuguguaguaaaacccauagaugauagauuugccaacgcguuacuggcccuaaaugauaugggaaaaguucguaaagauaucccacaguggcaaccguccaaaggcuggcaugacuggcaacaaguaccauucuguagucaucauuuucacgaacuuauuaugaaagaugguaggaagcuagugguaccaugucggccacaggacgaacuuaucgguagagcaaggauuagucagggugcgggguggaguuuaaaagaaacugcaugucucggaaaagcauaugcgcaaauguggaguuuaauguacuuucacagacgugauuuaagacuggcaagcaacgcaaucuguagugcagugccuguucacuggauccccacguccaggacaacuuggaguauccaugcacaucaccaauggaugacaaccgaagauaugcugacgguauggaauaggguuuggaucgaagauaacccguggauggaagauaaaacgccaguaaccaccugggaagacguaccauacuuggguaaaagggaagaucaauggugcggauccuuaauaggacuaacgucccgggcuacaugggcccaaaauauuuuaacagcuauucagcaagugaggucacugauaggugacgaggaguuccuugacuauaugccaaguaugaaaagauucagaaaggaagaggagacagagggagcaauaugguag

SEQ ID NO: 23126 - RNA, 9873 nt, Artificial Sequence
  derived and/or modified CDS sequence (opt6) from DENV-3__FJ639715__SS-prME
acgucucuuugccuuaugaugauguuaccugcaacauuagcauuccauuugaccagucgagauggagaaccacguaugaucguaggcaaaaacgaaagaggaaaaucauugcuuuuuaaaacagcaagugguauaaauauguguacgcuuauagcaauggauuuaggagaaaugugcgaugacacagugacauauaaaugccccuugauagcugaaguugaaccggaagauauagacuguugguguaauuuaacuagcacguggguaacguacgguacaugcaaccaagcaggcgaacaucgaagggauaaaagaucaguggcacucgcgccucaugugggaaugggccuugacacgagaacucaaacuuggaugagugcggaaggggcauggagacaaguagaaaaaguugaaaccugggccuuacggcauccgggguuuacaauucuagcucuauuuuuagcgcacuauauaggaacaagucuaacacagaaaguugucauauuuaucuuacuaaugcuaguaacaccgaguaugacaaugcgaugcgucggugucggaaaucgugauuucguagaaggauugaguggagcaacguggguagacguaguacuagaacauggcggguguguaacuacuauggcaaaaaguaaaccaacacuagauauugaacuacagaaaacugaagcaacucaacucgcuacuuuaagaaaauugugcauugaaggaaaaauaacaaacauuacgaccgacaguagguguccuacacaaggagaggccacacuuccggaagaacaagaccaaaauuaugucugcaaacacacauaugucgacagaggauggggaaacggcugugggcucuuugggaaagguucacuuguuaccugugcgaaauuccaaugcuuggaaccaauagaaggaaaaguuguacaauacgaaaauuugaaauauacagugauuauaaccgugcauacaggugaucaacaucaaguaggaaaugauacacaaggaguaacugucgaaauuacgccucaagccuccacaguggaggcgguuuuaccugaauacggcacguuagggcucgaaugcagcccgcgcacaggucuggacuucaaugaaaugauauugcugacaaugaaaaauaaagcguggaugguacacagacaaugguucuuugaucugccucucccuuggacaaguggugcaacuaccgaaacgccaacguggaauagaaaagaguuauugguaacauuuaaaaaugcucaugcuaagaaacaagaagucguaguauugggaagccaagagggcgccaugcacacggcccucacaggggcaacggaaauacaaaauaguggagguacaaauauuuuugcuggacaccuuaaguguagguuaaaaauggacaaacuugaguuaaagggaaugucuuacgcaaugugcuugaauacauuuguccuaaagaaagaaguuuccgagacucaacacgguaccaucuugauuaaaguugaauauaagggagaagaugcaccauguaaaauuccauuuagcacggaagaugggcaaggaaaagcgcauaacgggagguuaauuaccgccaacccggucguaacuaagaaagaggaacccauaaauauugaagcggagccgcccuuuggagagucuaacauuguaauaggcauuggggauaaagcauuaaaaauaaauugguacaagaaaggcagcagcauagguaaaauguuugaagcaacagcaagaggagccagaagaauggcaauucucggagacacugcaugggacuucggaucggucgggggaguuuuaaauagucucggaaaaaugguccaucaaauuuuuggaagcgcauacaccgcacuauuuucgggagucaguuggauuaugaaaaucgguauuggcguacuacucacuuggauaggacuaaauucgaaaaauacaaguaugucuuuuuccuguauaguuauuggaauaaucacacuuuauuuaggagcuguaguccaagcggacaugggcuguguaauuaacuggaagggaaaagaguuaaaaugcggaaacggaauuuuuguaacaaaugagguacacacguggaccgagcaauauaaauuccaagcagacagccccaaacgauuagcuacagcuauugccggagcgugggaaaacgguguaugcggaaucagaagcacaacacgcauggaaaaucuauuauggaaacagauagcaaaugaguuaaacuacaucuuaugggagaauaauauaaaacuuacgguuguaguaggcgacauaauaggcguauuagaacaggguaaaagaacucuaaccccgcaaccaauggaacugaaauacucuuggaagacauggggcaaagcaaaaauaguuaccgcugagacccaaaauucgucauucauaaucgauggaccuaacacaccugaguguccuagcgcuucucgagcauggaaugugugggaagucgaagauuacggauuugguguuuuuacuacgaacaucuggcuaaagcuacgagaagucuauacacaaucaugugaucauagacugaugagugccgcaauaaaggaugagagggccgugcacgcggauauggguuacuggaucgaaagucagaaaaauggcuccuggaaauuagagaaagcaucauuuauagaaguuaagacaugcacuuggcccaaaucacacacacuauggucaaauggagugcuggaguccgauaugauaauaccaaaaucauuagcugggccaauaucacaacauaaucaccggccugguuaccauacacagacagcaggaccauggcacuuggguaaacuagaauuagauuucaacuauugcgaagguacgacaguagugauagcagaaaauugcgggacuagagggccaucacuacgaacuacaacagugagcggaaaacuuauacaugaaugguguugccgcagcugcacccuaccgccuuuacgauauaugggugaagacgguuguugguauggaauggaaauuagacccauaaaugaaaaggaagagaacaugguaaagagcuuagugagugcaggaagcgguaaaguugauaauuuuacuauggguguacuaugucuagcaauauuauucgaagaaguaaugaggggaaaauucggaaagaagcauaugaucgccgguguacuauuuacauuuguauuauuguugucuggccaaauaacauggcgggauauggcgcauacacuaauaaugauaggauccaaugcaucugauagaauggguauggguguaaccuaccucgcacucauagcaacauuuaaaauacagccuuuucucgcccuuggauucuuucuccgaaagcuaacaagucgagaaaaccuacuuuuagguguaggacuugcaauggccacaacacuacaacuaccagaggacauagaacaaauggcgaauggcaucgcccugggucuuaugacauuaaaauugauuacccaauuugaaaccuaccaauuauggacagcguuaguaucucugaccuguucgaauacuauauucacauugacagucgcauggagaacagcuaccuuaaucuuagcaggcguuagccuccucccucucugucaaucaucaagcaugcgcaaaacagauugguuaccuaugaccguagcugcaaugggcguaccgccucugccccuguucauauuuucauugaaggauacuccgaaacgaaaaaguuggccccuaaaugaaggcguuauggcgguaggcuuaguuucaauacuggcaagcagcuuacuacgcaaugaugucccaauggcagguccacuugucgccggugguuuauuaauugcuugcuacguuaucacagggacaagugcugaccuaacaguugagaaggccgcagacguaacgugggaggaagaggccgaacaaacuggaguaagccacaauuuaaugaucaccguugacgacgaugguacaaugaggauaaaagaugacgaaacagaaaacauacuuacaguguuacuaaaaacggcacuuuuaauuguaaguggaauauucccuuacucuauacccgcaacgcuauugguuuggcauacauggcaaaaacaaacucagagaagugggguauugugggacguacccuccccgccagaaacucaaaaggcagagcuagaagaaggcguauaccgaauuaagcaacagggcaucuucggaaagacacaagugggagugggugugcaaaaagaggggguauuucauacaauguggcaugugacucguggagccguacuuacacauaauggcaaaagauuagaaccaaauugggccucugucaagaaggaucuaauuucauacggugguggcuggcgacuaagugcacaauggcaaaaaggcgaagaagugcaaguaaucgcaguagagcccgguaaaaaucccaaaaauuuucagaccaugccgggaaucuuccaaacaacgacgggugaaauaggagcaauugcuuuagauuucaagccgggaacaagugggucucccauaauaaauagggaaggcaaagucgugggguuguauggaaauggcguagucacuaagaacgguggcuaugugucaggcauugcacagacaaaugccgaaccugaugggcccacaccggaacucgaggaagaaauguuuaagaaacgaaaucuaacuauuauggauuuacauccagguagugggaagacucgcaaauaucucccagcaaucgugcgagaagccaucaaaagaagacuaaggacacucauuuuggcuccaacgaggguugucgcugcagaaauggaagaagcucuaaaagguuugccgauaagauaucagacgacagcaacgaaaagcgaacauacaggaagagaaauugucgaucuaaugugccacgcaacauuuaccaugagauuguuaucucccguaagagucccuaauuacaacuuaauaauuauggaugaagcccauuucacagaucccgccucgauugcagcuagaggguauauaucuacucgaguaggaaugggugaagccgcagcaauuuuuaugacggcuacaccaccugguacggcugaggcuuucccacaaucuaaugcaccuauucaggacgaagaaagagauauaccagagcggaguuggaauaguggaaaugaauggaucacugauuucguugguaaaacaguaugguuuguucccucuauaaaagcagguaaugauauugccaauugucuccguaagaauggcaagaaagucauccaacucaguagaaaaacauucgauacugaguaccaaaagacaagguugaaugacugggacuucgucguaacaacagacauaagugagaugggggcaaauuucaaagccgaucgaguaaucgaucccagacgaugucucaaaccaguaauauuaacggacgguccagaacgaguuauauuagcagguccuaugccuguaacagcggccucagcggcccaaagacgugggagaguuggccgaaacccgcaaaaagagaacgaucaauauauuuucacagggcagccauuaaauaacgaugaagaucacgcacacuggacugaagcuaaaaugcuacucgauaauauuaauacgccagaaggaauaauaccggcuuuguuugagccggaaagggaaaagucagccgcuauagacggugaauauagguuaaagggagagucacgcaaaaccuuuguagaguuaaugagaagaggagacuuaccagucugguuagcacauaaaguagcgucugaaggcauuaaauacacugacagaaaauggugcuuugacggagaaagaaauaaccagauauuggaagagaauauggacguggagauauggacgaaagaaggggagcgaaagaaauuacgaccgagauggcuagacgccaggacauacagcgauccuuuggcuuuaaaagaauuuaaggauuuugcugccggacggaaaucaaucgcuuuagacuugguuacagaaauaggacgaguuccaucucaccuugcgcauaggacacgaaacgcauuagacaaucuaguaaugcuacauaccagcgagcauggugguagagcguaucgccacgcaguggaagaacuaccagagacuauggaaacuuuauuacuauuaggccucaugauuuuauugacgggcggagcaaugcuauuucuaauaucagguaaaggaauugguaagacaaguaucggacucauuugugucaucgugucuucaggaauguuauggauggcggauguaccacuacaauggauagcaagugcuauaguucuagaguucuuuaugauggugcuacuaauaccagagccggagaaacaaagaacgccacaagacaaucaacuagcuuauguaguaauaggcauauuaacccuggcagccauaguagcugcaaaugaaaugggguuauuggagacgacaaagagagacuuaggaaugaguaaagaacccgggguaguaucuccuacuagcuacuuggacgucgaccuucauccagcuucugcuuggacguuauaugcgguagcuaccaccguaaucacuccaauguugcggcacacaauagaaaauucaaccgcgaacguaucucuugcugcaauagcgaaccaagcaguggucuuaaugggauuagauaaagguuggcccaucaguaaaauggauuuagguguaccccuccuagcguuagggugcuauucucaagucaacccuuuaacguuaacggcagcuguuuuguuauuagugacacacuaugccauaauaggucccggacuacaggcaaaagcaacacgggaagcacagaaaagaaccgccgcugguaucaugaaaaauccaacuguagauggcaucaugacaauagaccuagauccugugauauacgauagcaaguucgaaaaacaauuaggccagguaaugcuauuagugcucugcgcaguccaacuguuacucaugagaacuagcugggcucuaugcgaagcccuaacgcucgcuaccggcccaauaacaacuuuaugggaaggaaguccaggcaaguucuggaacacaacaauugcagugaguauggcaaacauuuuuagagggucauacuuagcgggcgcaggucuagccuucagcauuaugaagaguguagggacggggagaagaggaacggguucucaaggagaaacacucggugaaaaauggaagaagaaacugaaccaacuguccagaaaagaguucgauuuauacaagaaaucaggaauaacagagguugauaggacagaagcaaaagagggauugaaacgcggagagacaacccaucacgccguaucgagaggcuccgcaaaguuacagugguuugucgaacgaaauaugguaauaccggaaggaagaguaaucgaucucggcuguggccggggaggguggucauauuacugcgcagggcuuaagaaaguuacugaaguucgagguuauacuaagggaggaccaggucaugaagaaccaguucccaugagcacauacggcuggaauauaguaaaacuuaugucugggaaagacguuuucuaccuaccaccggaaaaaugugauaccuuguuaugcgauaucggggaaaguucuccgucaccaacagucgaagaaagucgaacaauuagaguauuaaaaaugguggagccauggcuaagaaacaaccaguuuuguauuaaagugcuaaacccuuauaugccaaacguaauagaacaucucgagagacuccaaagaaaguacggcggcaugcugguuagaaacccccucucaagaaacucaacacaugaaauguauuggauaucuaacggcaccggaaacauaguaaguucaguuaauaugguaucacgcuuguuacuaaaucgcuuuacaaugacacaucgaagaccgacaauugaaaaagacguugaucuaggugcagguacgcgacauguaaaugcagaacccgaaacacccaauauggauguaauaggcgaaaggaucaaaagaauaaaagaagaacauucaucaacauggcauuaugaugaugagaauccauacaaaacaugggcuuaucauggaucguacgaaguaaaagcgacaggcuccgcauccucaaugauuaauggaguuguuaaacuacuuacuaagccgugggauguaguaccgauggugacccaaauggccaugacagauacgacccccuucggacaacagcguguauuuaaagaaaaaguugauacacguacaccgcguccgaugccagguacaaggaaaguaauggaaauuacugcagaguggcuuuggcgaacacucggacguaacaagaaaccgcgacucuguacacgggaggaguucacuaagaaaguuaggacgaacgcagcaaugggcgcuguuuucacagaagaaaaucagugggauucagcuagggcggcuguagaggaugaagaauuuuggaaacuuguugauaaagaacgcgaauuacauaaguuggguaaaugcgguagcuguguguacaauaugaugggcaaacgagagaagaaacuaggagaguucggcaaagcaaaaggaucucgggcaaucugguacaugugguuaggggcuagauaucuggaauuugaggcauuaggcuuucuuaaugaagaucacugguuuucuagagaaaauucauacucaggaguugaaggugagggucuccacaaacuuggauacauauuacgagauauaaguaaaaucccgggaggagcaauguaugccgaugauacagcugguugggauacaagaauuacugaggaugauuuacauaacgaggagaaaauuacgcaacaaauggacccggaacacagacaguuagcaaacgccauauuuaaacuaacauaccaaaacaaaguaguuaaagugcaacgucccacaccaaaagguacaguaauggacauaauaucgagaaaagaccaacgagguagcggccaggucggaacuuacggauuaaauaccuuuacuaacauggaagcucaauugguaagacaaauggagggcgagggaguacuaagugaggcagaucuagaaaauccucauuuauuagagaagaaaauaacucaauggcuugagacuaaagggguagaaagauuaaagagaauggcuauuucgggagacgauugugugguaaaaccaauagaugaccgauuugcuaaugcacuucuagcauuaaaugauaugggcaaagugcggaaagauauaccucaauggcaaccaaguaagggcuggcaugacuggcaacaaguaccauuuugcucccaucauuuccacgaacugauaaugaaagaugggagaaaauugguggugccuugcagaccccaagaugagcuaauaggcagggcgcgaaucagccaaggcgccggauggagccugaaagaaacagcaugucuagggaaagcauaugcucaaauguggucucuaauguauuuccauagaagagacuugcggcuagcgagcaaugccauuuguucugccguucccguacauuggauaccgacaucccgaaccaccuggucaauacacgcccaucaucaguggaugacuacagaagauaugcuaacugucuggaacagaguauggauagaagacaauccauggauggaagacaagacuccuguaacuacuugggaagauguuccuuaccuaggaaaacgagaagaucaauggugcggcucuuugaucggauuaacuucccgagcaacaugggcacaaaauauauuaacggcaauccaacagguucgcaguuugauaggagaugaagaauuucuugauuauaugccaucuaugaagcgauuucguaaggaggaagaaucugagggagcaaucugguaa

SEQ ID NO: 23127 - RNA, 9873 nt, Artificial Sequence
  derived and/or modified CDS sequence (opt6) from DENV-3__KF955461__SS-prME
acuucgcugugucuuaugaugaugcuuccugcaacauuagcauuucaucuaacuucacgugacggcgaaccucgcaugauagucgguaaaaacgaaagaggcaaaucccuauuauuuaaaacagcaagugguauuaauaugugcacacuaaucgccauggauuuaggagaaaugugugaugauacagugacguauaaaugcccacuaauagccgaaguugaaccagaagauaucgauugcuggugcaauuuaacaagcacuuggguaacuuacggaacguguaaucaagcaggagaacauagacgagauaaaaggucaguugcacuugcaccacaugucggaauggguuuagauacaaggacccaaacauggaugucagcagaaggcgcauggcggcaaguagagaaaguugagacgugggcucuacgacauccagguuuuacaauuuuagcgcuuuuucuagcacauuauaucgggacgucucuuacgcaaaaaguuguaauauuuauccuguuaauguuaguaacgccaagcaugacuaugagaugugugggaguugggaacagagauuuuguagaagguuuaagcggcgcgacuuggguugauguaguccuugaacacggaggauguguuacgacuauggcuaaaaacaaaccaacucucgauauagaauuacagaaaacugaggcaacgcaacuagcaacguuacguaaauuguguauagaagguaagaucacaaauaucaccacugauagcagauguccaacucaaggagaagcaacauugcccgaagaacaagaccaaaauuauguaugcaaacacacguacguagaucguggaugggggaacggauguggucuauuuggcaaaggaucacucguaacaugugccaaauuccaaugccucgagccgauagaggguaaaguaguucaguaugaaaaccuaaaauauacaguaaucauaacuguacacacaggagaccagcaucaaguagggaaugauacucagggaguaacaguugagauuacaccccaggcuuccacgguagaagcuguacuacccgaguauggaacauuaggauuagaauguagcccuagaacuggcuuagauuuuaacgaaaugauacuucuuacaaugaaaaauaaagccuggaugguucaucgacaaugguucuuugacuuaccuuugccauggacaucuggugcaacuacugagacaccaacguggaacagaaaggaauuauuaguuacauucaaaaaugcccaugcaaagaagcaagaaguugucguauuagggagucaggagggcgcuaugcauacagcguuaacaggggcaacggaaauucaaaauuccggagggacuucaauauuugcaggacaucuuaaauguagauuaaaaauggacaagcuagagcuaaaaggaaugucauaugcaaugugucucaacacguucgucuuaaagaaagaaguuagcgagacacagcauggaacgaucuuaauuaaaguggaguacaaaggagaggacgcaccuugcaaaauaccguucagcacugaagaugggcaaggaaaggcgcacaacggaagguuaauuacagcuaauccaguaguuaccaagaaagaagaacccguaaauauagaagcagaacccccuuucggcgagucaaauauagugauaggaauuggugacaaagcguuaaaaauaaacugguacaagaaaggaucuucaauaggaaaaauguucgaagcaacugcaagaggugcgagacgcauggcaauacugggagauacugcuugggacuucggaucaguagggggaguccuuaacagcuugggaaagaugguacaucaaguuuucggaagugcauacacggcgcucuuuucagguguauccuggauaaugaaaauaggaauagguguguuguuaacauggauaggcuugaacucuaagaauacguccaugagcuucucauguauuguaauaggaauaauaacccuauauuuaggggccguuguacaagcggacaugggauguguaauuaauuggaagggcaaagaacugaaauguggcuccggcauuuucguuacuaaugaagugcauacguggacggagcaguacaaauuccaagccgauagucccaaacgauuagccacagcgauagcaggggcaugggaaaacggcguuugugggauccgcaguaccacaaggauggagaacuuacuuuggaaacaaauagcaaacgagcuaaauuacauacuaugggaaaauaauauaaaacuuacuguaguugucggcgauauuauaggaguguuagagcaagguaaaaggacguugacaccacagcccauggagcuaaaauacuccuggaaaacguggggaaaagcaaaaauuguuacggccgaaacacaaaacaguuccuucauaaucgauggccccaauacaccugaauguccuagcgcuucaagagccuggaaugucugggagguagaagauuauggcuuuggagucuuuacuacaaauaucuggcuuaaauuaagagagguauauacacaaagcugcgaucaucgacuuaugucugcugcuauaaaagaugaaagagcaguccaugcagacaugggguauuggauagagucccaaaagaaugguagcuggaaacuugagaaagcgucauuuauagaagucaagaccuguacauggccuaaaucucacacgcuauggaguaauggcguucuagaaucugauaugauaauaccaaaaagucuagcaggacccauuucccaacacaaccacaggccagguuaucacacacaaacagcuggaccuuggcaccuuggcaagcucgaacuagauuucaauuauugcgagggaacuacaguagcaauaacagaaaauugcggaacccgcggaccgucgcuaagaacuaccacuguaaguggaaaacucauucaugaauggugcugucgauccuguacacucccaccauuaagauacaugggagaagacggauguugguauggcauggaaauaagaccaauuaacgagaaagaagaaaacauggugaaaagucugguaucugcgggcucaggaaagguggacaauuuuacgaugggaguucuuuguuuagcaauacuuuuugaggagguuaugcgaggaaaguuuggcaaaaagcacaugauugcugguguacuauuuacuuucgucuuacucuuauccggucagaucacuuggcgugacauggcucauacauuaauuaugauuggaaguaaugcuagcgacagaaugggaaugggaguuacguauuuagcacuuauugccacauuuaaaauucagccauuccuugcucucgguuucuuccuaagaaaacuuaccagucgagaaaaucuauuacucgggguuggacuagcaauggcaacaacauugcaauuaccugaggauauugaacaaauggcgaauggcauagcauuaggacuuaugaccuuaaaacucaucacacaauucgaaacauaucaacuuuggacggcauuagugucgcugacuuguucuaacacuaucuucaccuugacuguugcauggcgaaccgcaacucucauauuagccggugucucccuauuaccauugugucaaaguucaaguaugcguaaaaccgauuggcugccgaugacuguugcggcgauggguguacccccacugccacuauucauuuucucccuaaaagauacuccgaaaagaagaagcuggccacuaaacgaaggcguaauggcaguaggguuaguaagcauucuggcgaguucacuacuacgcaaugacguaccgauggcaggaccacugguggcugguggauuauugauagcgugcuauguuauaaccggaacaucugcagaucuuacaguagaaaaggccgccgauguaacgugggaagaagaggcggaacaaacuggagugagucauaaccuaaugaucacagucgacgacgacggaacgaugagaauuaaggacgacgaaaccgaaaacauucuaaccguucuacuaaagacugcauuacugaucguaucugguauauuuccauacucgauaccugcaacucuauugguauggcauacguggcaaaaacaaacucaaagaucuggagugcuaugggauguuccaagcccuccagaaacacagaaggcagaauuagaagagggugucuaccgaauuaaacaacaaggaauauucgguaaaacacagguuggugucgguguacaaaaagaagggguauuucacaccauguggcauguaaccagaggcgccgucuugacgcauaauggaaaaagacuagaacccaauugggcuucagugaagaaagaccuuauaucauaugggggcggauggcgacuuagugcacaauggcaaaaaggagaagagguccagguaauagcgguggagccaggcaagaauccgaaaaacuuccaaacuaugccgggcauauuucaaaccacuacuggagagauaggggcaauugcgcuagacuucaaaccaggaacaaguggaagcccuauaaucaauagggaaggcaaaguugucggguuguaugguaauggagugguaaccaagaacggaggauacgucucaggaauagcacaaacgaaugcagagccagauggcccaacgccggaauuagaagaagaaauguucaagaagagaaauuuaacgauuauggaucugcacccgggcucugguaaaacccguaaauacuuaccugccauaguuagagaagcuaucaaacgucgacuucggacauuaauauuagcaccaacgcgggugguggcggcagaaauggaagaagcacuuaaaggccuaccuauuagauaccagaccaccgcaacuaaaucagaacacacaggacgagaaauaguggaucuaaugugucaugcuacuuuuacaaugcgucuccuaucuccugugcguguacccaacuacaaucugguuaucauggaugaagcacacuucaccgacccugcgucgauugcggcgagagguuacauuaguacccgaguagggaugggagaagcagcugcuauauuuaugacggccacuccuccaggaacggccgaggcuuuuccacaaucuaacgcgccuauacaagacgaggaacgugauauaccagagaggagcuggaauagcggcaaugaguggauuacagauuuugucggaaaaaccguaugguucgugccuagcauaaaggccgggaacgacaucgccaacuguuuacguaaaaacgguaagaaggugauacaauuaucgagaaaaaccuuugauacagaguaucagaaaacaaggcuuaacgauugggauuuuguaguaaccacagacauuagugagaugggagcgaauuuuaaagccgaucgcguuaucgacccuaggagaugccucaaacccguuauacuaacugauggaccugagcgaguaauauuagcuggaccaaugccuguaacggcggcuucagccgcucaaagacgcgggagagugggcagaaauccacaaaaagagaaugaucaauacauauuuacaggacaaccucugaauaaugacgaagaccaugcucacuggacggaagcuaaaaugcucuuagacaauauaaauaccccugaaggaauuauaccagcguuguuugaaccugaacgugaaaagagugcugcaauagacggagaauacagacugaaaggagaaagccgaaaaacuuuugucgaacuaaugagaagaggagaccucccggucugguuagcacauaaaguggcaagugaaggcauaaaauauacugaucguaaauggugcuucgacggugaacguaacaaccaaauacuagaggaaaauauggacguagaaauauggacaaaagaaggggaacgcaagaaauuaagaccaagauggcuagacgcacgcacauacucagauccacuagccuuaaaggaauuuaaggauuucgcagcaggccgcaaaagcauugcgcuagauuuaguaaccgaaaucggaagaguuccaucacacuuagcccaucggacuagaaaugcucuagauaaucuuguuaugcuucauacgagcgaacacggagggagggccuaccgccaugcagucgaagaacuaccggaaacuauggaaacauuacuucuguuagguuuaaugauucuauuaacuggaggggcgaugcuguuuuuaauaaguggaaaaggaaucgguaaaacgagcauuggacuaauuugcguaauaguaaguaguggaaugcuguggauggccgacguaccgcuucaguggauugcgagcgccaucguuuuggaguucuuuaugaugguguugcugauuccagaaccggaaaaacaaagaacaccacaagacaaucaauuggccuauguaguaauuggcauauuaacauuagcggcaaucgucgcugcuaaugaaaugggcuuguuggaaacuacaaaaagagaucucgguauguccaaagaacccgguguuguaaguccuacaagcuauuuagauguagaccuucauccggccagcgcauggacacuauaugcuguggcgacaacagugauaacccccaugcuacgccauacgauugagaacucaacagccaacguaagucuagcagcaaucgcgaaucaagcuguaguuuuaaugggacuagauaaagguuggccuaucaguaaaauggaucugggcguaccucucuuagcuuuaggaugcuacagucaaguuaacccauugacucucaccgcugcgguucuacuucuaguuacacauuacgcaauaauaggaccgggacugcaagcaaaagcuacacgcgaggcccaaaaacgcacagcagccgggaucaugaaaaauccaacgguggacgguauaaugacgauugaccuagaucccguaauuuacgacaguaaguucgagaaacaacuaggccaagucaugcuguugguauugugcgcgguacaauuguugcucaugagaacguccugggcucugugugaagcauugacacuggcaaccggaccuaucacaacauuaugggaggguagcccuggaaaauuuuggaacaccacuauagcagucucuauggcuaauauauuucgggguuccuaucuugcaggcgcuggacuugcauuuagcauaaugaagucaguugguacaggaagaaggggaacgggaucucaaggugaaacucuaggggaaaaguggaaaaagaaacuaaaccaacuuucaagaaaagaguucgacuuguauaagaagaguggaauuacugagguugaccgaacugaagccaaagaagguuuaaaaagaggagaaacaacucaucaugcuguuagcaggggaucagcaaaacuacaaugguuuguggagaggaacauggucaucccagagggccgagugaucgaucugggauguggacgaggaggauggucauauuauugugccggucuaaagaaagugacugaagucaggggcuauacgaaggguggaccaggacaugaagaaccagugccuauguccacauacggcuggaauauuguaaaacuaaugagugguaaagacguauuuuauuugccuccugaaaaaugcgauacacuacuaugugauauuggcgaaucgucgcccaguccuacaguagaagaaagucguacaauaaggguccucaagauggucgagccguggcuuaaaaauaaucaauuuuguauaaaaguccuaaaucccuacaugcccacuguaauugaacauuuagaaaggcugcaaagaaaauacggaggaaugcuaguucguaacccccuaagcagaaauucaacucacgaaauguauuggauaucuaacggcacggguaauauugugucuucaguuaauaugguaaguagguuacuacuaaauagguucacaaugacgcaucggcgucccacuauagaaaaagacguagaucuuggagcgggaacacgucauguuaacgcugaaccagaaacgccaaacauggauguaaucggugaaagaaucaaaaggauaaaagaagaacacucauccacauggcauuaugaugacgaaaauccguauaagacaugggcuuaucaugguucauacgaaguaaaagcaacuggcagugcaaguaguaugauuaauggaguagucaaacuacuaacaaaaccaugggauguuguaccuaugguuacacaaauggcaaugacugauacaacaccguuuggucaacagcgaguauuuaaagaaaaaguugauaccagaacuccuagaccaaugccaggcacaagaaaaguuauggaaaucacugccgaauggcuauggagaacucuuggucgcaacaagaaaccaagauuauguacaagagaagaguuuacaaagaaaguccggacaaacgccgcaaugggugcugucuucacagaggaaaaucaaugggauucggcuagggccgcagucgaagaugaagaguucuggaaauuaguagacagagaaagagaguuacauaaacuugggaaaugcggaaguugcguauacaacaugauggggaaacgagagaagaaacuaggggaguucggaaaagcaaagggaagcagagcaauaugguauauguggcuaggagcgagauacuuagaauuugaggcgcuaggauuuuuaaaugaagaccauugguuuaguagggaaaauucuuacagcgggguggaaggugaggguuugcauaaguuaggauauauacuaagagacauaaguaaaauaccagggggagcgauguacgcagaugauaccgcgggaugggauacgaggauuacugaagacgaucuccauaaugaagaaaagauaacucaacaaauggacccagaacauagacaauuagcaaaugcuauauuuaaacugacuuaccagaauaaagucguaaaaguacaaaggcccacuccgaaggggacaguaauggauauuauaucaagaaaagaucaacgaggaucagggcaaguaggaacuuacgguuuaaauacuuucacaaacauggaggcacaacuugugcgacaaauggagggagaagggguguugaguaaggcagauuuggagaauccucaccaacuggaaaagaagauaacucagugguuggagacaaagggggucgaacgacuuaaaagaauggcaauuucaggcgaugauugugugguuaaacccauagaugacagauuugcuaaugcauugcuagcgcugaacgacaugggcaaaguacgaaaagacauaccgcaauggcaaccauccaaaggguggcaugacuggcagcaaguuccauucuguagucaucauuuucaugaacuuauaaugaaagauggacgaaaguuagucgugcccugcaggccacaagaugaauugauuggaagggcacguaucagccaaggggcaggguggaguuuaaaggaaacugcauguuuagggaaggcauacgcccaaauguggucguuaauguauuuccauagacgagacuuacgauuggcaucuaacgccauauguucugcaguaccaguccauuggauacccacgagccggacaacauggaguauacacgcccaucaucaauggaugacaaccgaggauauguuaacugucuggaaccgaguauggaucgaagacaauccguggauggaagacaaaacuccaguuaccacaugggaagauguaccauacuuagguaaaagggaagaccaauggugugggaguuuaauugguuuaacaucacgggcgacuugggcccaaaauauccuaacggccauacagcaaguuagaaguuuaauuggagaugaagaguuuuuagauuacaugcccagcaugaaaagguuuagaaaagaggaggagagcgaaggagccauaugguaa

SEQ ID NO: 23128 - RNA, 9873 nt, Artificial Sequence
  derived and/or modified CDS sequence (opt6) from DENV-3__FJ639719__SS-prME
acuucacuaugccuuaugaugauguuaccagcaacauuagcauuccaucuaacuucaagagauggugaaccacgaaugauuguaggcaaaaaugaaagagguaaaucgcuacuuuucaaaacagcuacuggaauuaauauguguacguuaauagcaauggaucuaggggagaugugugaugacacgguaacguacaaauguccgcuuaucgcugagguugaaccugaggacaucgacuguugguguaauuuaacuucuacaugggugacauacgggaccuguaaucaagcaggagagcaucgacgagauaaaaggucuguggcauuggcgccacauguaggaauggguuuagauacuagaacucaaacauggaugagugcggaaggagccuggagacaaguagaaaaaguggaaacaugggcucugaggcacccaggauuuacaauacucgcacucuuccuagcacacuacaucggcaccaguuuaauucaaaaaguaguuauauucauauuacucauguuaguaacuccauccaugacaaugcguugugugggagugggaaauagagacuuuguagaaggacucagcggagcuacauggguugauguagugcucgagcacggagggugugucacuacuauggcuaaaaauaaaccaacacuugauauugaauugcagaaaaccgaagcaacacaacuugccacauugagaaaacucuguaucgagggcaaaauaaccaauaucacaacggauucuagauguccaacgcaaggcgaagcaauacugccagaagaacaagaucaaaauuauguauguaaacauaccuauguggauagaggcuggggaaacggguguggauuguucggcaaaggcagcuuaguaacaugugcaaaauuccaauguuuagaaccaaucgaaggcaaaguaguacaauacgagaacuuaaaauauacaguaauuauuaccguacauaccggagaucaacaucaaguaggaaaugacacacagggcgucacuguggagauaacaccucaggcuucaacuguagaggcaguacuucccgaguacggcacguugggacuagaaugcucaccacgaacaggccuagauuucaaugaaaugauccuccuaacuaugaaaaacaaagcauggaugguucauagacagugguuuuucgauuuaccacuaccauggacuagcggagcaaccacagaaacuccaacuuggaauagaaaagaacuucuugugacuuucaaaaaugcacacgcgaagaaacaagaaguaguuguucucggaucccaggaaggugcaaugcauacugcacuaacuggugcaacagaaauccagaacaguggagguacuucaauuuuugcaggucaucuaaaauguagguuaaaaauggacaaauuagaguuaaaagguaugucguaugcuaugugccuaaauacauuugugcuuaagaaagagguaagugagacgcaacacgggacuauauugauaaaaguagaauauaaaggugaggacgcucccuguaaaauaccauucucgacagaggacggacaagggaaagcacauaaugggaggcuuaucaccgcuaaucccguagucacuaagaaagaagaaccagucaacauagaggcugaaccaccauuuggagaaucgaacauaguaauagguauaggcgacaaagcauuaaaaauaaauugguauaagaaaggaucuagcauuggaaaaauguuugaagcaacagccagaggagccagaagaauggcuauacuuggggauacagcaugggauuuuggcucgguuggcggaguuuuaaauucacucggaaaaauggugcaucagauauucgguagugccuacacagcgcuauuuucagggguuucauggauaaugaaaauagguauuggaguacuucuuacuuggauaggccugaacaguaaaaacacgucaaugucuuuuagcugcauagucauaggcauuaucacacucuaccuuggugccguggugcaagcugauaugggaugcguaauaaacuggaaagggaaagaauuaaaauguggaucugggauauuugugaccaaugagguacauacauggacagaacaauacaaauuucaagccgacagccccaagaggcuagccacagccaucgccggagcuugggagaaugggguaugcggaauuagaucuacaacucgcauggaaaaccuguuauggaaacaaauugcgaacgaauuaaauuauauucucugggaaaacaauaucaaacuaacuguaguagugggagauaucauugguguccucgaacagggcaaaaggacuuuaacaccacaaccaauggaacuaaaauacucauggaaaaccugggguaaagcgaaaauagugacagcggaaacccaaaauaguaguuuuauuauugacggcccgaacaccccugagugucccagcgcgagucgggccuggaacgugugggaaguagaggacuauggauuuggaguauucacgacaaacauauggcucaaacugagagaggucuacacacaaucgugcgaccauagacuaaugucggcggcgauaaaggacgaaagagcaguucaugcagauaugggauacuggauagaaucacagaaaaacggaagcuggaaauuagaaaaggcuucuuucauagaaguaaagaccuguacauggccgaagucacacacauuauggaguaauggagucuuggaaagugauaugaucauuccgaagaguuuagcgggaccuauaagucaacacaaucauaggccuggcuaucauacgcaaacggcaggcccauggcaucuuggaaaacuggaauuagauuuuaacuauugugaaggaacaacuguuguuauuacagaaaauugugguacacgcgggcccucucucagaaccacaacaguaagcggaaaacugauacaugagugguguuguagaucgugcacuuuaccuccauugagguacaugggagaagauggcuguugguauggaauggaaauaagaccgaucaaugaaaaagaagagaauaugguaaaaagccuagugucagcgggaagcggaaaagucgauaauuucaccaugggagugcuaugccuggccauauuguuugaagaaguuaugcgggggaaauucggcaagaaacauaugauagcagggguuuuguuuacauuuguucucuuacuuaguggacaaaucacuuggcgagauauggcacacacacuuauaaugaucggcagcaaugcaagcgaucguauggguauggggguuacucaccuugcauuaauugcaacauuuaagauucaacccuuucucgcguuaggguucuuucuucgaaaacuuacaucuagggaaaaucuauuauuggggguggguuuagcgauggccaccacucuccaacuucccgaagacauagaacaaauggcaaauggaaucgcacuaggacuaaugaccuuaaaacuuauuacacaguuugagacauaucagcuauggacagcccuaguaucacuaacuuguaguaauacaaucuuuacucugaccguugcauggcgaaccgcuacacugauucucgccgguguuucuuuauuaccacuaugucagaguucaucaaugagaaaaaccgauuggcuaccaaugacgguggcugcuaugggcgugccaccguugccacuguucauauucucauuaaaagauacaccaaagagacgcaguuggccauuaaaugaagggguaauggccgugggucucguaucaauucucgcaucuucccuucuacgcaaugacguaccgauggcaggacccuuggucgcaggaggacuauugauugcaugcuacguaauuacugguacgucagcugauuuaacuguagaaaaagcagccgauguaacuugggaagaagaagcggaacaaacuggcgugagucacaaccuaaugauuacaguugaugaugaugguacuaugcggauuaaggacgaugaaacagaaaacaucuuaaccguccuccugaaaacagcauuacugauuguuagcggcauauuucccuauucgaucccugcuacuuuauuaguuuggcauacauggcagaagcaaacucaaaggagcgggguccuaugggacguuccaucaccgccagaaacacaaaaagcagaauuagaagagggaguauacaggauaaaacagcagggaauuuucggaaaaacccaagugggagucggugugcagaaagagggaguauuccacaccauguggcacguaacgcgaggugcaguauuaacacauaauggaaaaagauuagaaccaaacugggccagugucaagaaagaccuaaucagcuacggagggggauggcgcuuaucuacucaauggcaaaagggagaagaggugcaagugauagcaguagagccgggcaaaaaccccaaaaauuuccaaacuaugcccggcauuuuucaaacuacaacuggagaaauuggagcaauagcccuagacuuuaaaccagggacaagugguucucccauaauaaaccgugagggcaaagucguuggacuauacggcaacggaguaguuacuaagaacggugguuacguaucaggaauugcucaaacaaacgcagaaccagaugggccaacgccagaauuggaagaagagauguucaagaaacgaaaucucaccauaauggaccuacaucccggaagcggaaaaacuagaaaauacuugccugcgauugucagagaagccauaaaacgaaggcuucgaacacugauucuggcgccaacgagaguuguugccgcggagauggaagaagcacuuaaagguuuaccuauaagguaucaaacuaccgcaacgaaaucagaacacacaggcagagagaucguggaucucaugugucacgccacguucaccaugcgacuuuuaaguccaguacgcgugccaaauuauaauuugauuauaauggaugaagcacauuucacagauccugcaucaauagcggcuagggguuauaucuccacaagaguaggaaugggugaggcugcugccauauuuaugacagcuacaccuccugggacagcagaagcauuuccccaaucaaacgcacccauacaagacgaagaacgugacauacccgaaagaagcuggaacucgggaaaugaguggauaaccgacuuuguaggcaaaacagucugguuugugcccaguaucaaagccggaaaugacauagccaauuguuuacggaaaaauggcaagaaaguaauacaacuaucuagaaagacauucgacacagaguaucaaaagacuagacuuaaugacugggacuucgucguuacaacagauauuagcgaaaugggggcaaauuucaaagcagaccguguaauugauccuagacgcugucucaaaccgguuauacuaacugaugggccugaaagagucauucuagcagggcccaugccaguuacagccgcauccgcugcacagaggcgagguagagucggacgaaacccacagaaggaaaacgaccaauacauauuuacgggucaaccgcucaacaaugaugaagaccacgcucauuggacugaagcuaaaauguugcuugauaauaucaauaccccugaaggaaucaucccugcacuauucgaaccggaaagagagaaaagugcugcuauugacggagaauauagacugaaaggagaaucaagaaaaacuuuuguggaacugaugcgucgaggugaccucccuguuuggcuggcacacaagguagcaagugaggguauuaaauacacagauagaaagugguguuucgacggcgaaagaaauaaccaaauacuugaggagaacauggacguagaaauauggacgaaagagggagaacggaagaaacucagaccacgcugguuggacgcucgaacauacucagacccccuagcacugaaggaguucaaagauuuugcugcuggaagaaaaucgauagcuuuagaucuuguuacggagauugguaggguaccgucgcacuuggcacacagaacacgcaaugcauuagauaaucuaguaauguuacacaccagugaacauggugguagggcguacaggcaugcaguugaggaacuaccagaaacuauggaaaccuuacuccuauuggggcuaaugauucuacucacaggaggagcuauguuauuuuuaguuucagguaaagguaucggaaagacaacuauagggcuuauaugcguaauagucuccagcggcauguuguggauggcagauauucccuuacaauggauagcaucugcaaucguuuuagaguucuucaugaugguacuauugauaccggaaccagagaagcaaagaacaccacaagauaaucaacuagccuacgugguaaucgggauucucacccuagcagcuauagucgcugcuaaugaaaugggacuguuagaaaccaccaaaagggaucuagguaugucgaaagaaccaggaguuguaucuccuacuucauacuuggacguugaucuucacccugcauccgcauggacucuauaugcgguugcaacgacaguuauuacaccuauguuacgacacacaauugaaaauagcacugcaaauguguccuuagcagcaauagcgaaccaagccguaguucugauggggcuagauaaaggauggccgaucaguaagauggaucucggaguaccucuacucgccuuaggauguuauagccaaguaaauccauuaacacugacggcagcuguucuccuauuaguuacacacuaugcgauaauaggaccgggacuccaagcaaaagcaaccagagaagcacagaagcgaacugcagccggaaucaugaagaacccaacgguugauggaauuaugacuauugaccuggacccugucauuuacgauucuaaauucgaaaaacaacucggacaaguaaugcuauuaguacuaugugcuguacaguuacugcugaugagaacauccugggcccuaugcgaagcauuaacccuugcaacugggccaauuacaacgcuaugggaaggaaguccuggcaaauuuuggaacacuacaauugcagucucuauggcaaauauauucagaggcaguuaucucgcaggcgcuggauuagcuuuuuccauuaugaaaaguguuggaaccgguagaagggggacagggagccaaggggaaacucugggugaaaaauggaagaagaaauuaaaucaacuaucucguaaagaauuugaucuguacaagaaaaguggaauuacagaaguugaucgcacugaagccaaagaagggcuaaaaagaggugaaacaacacaucaugccgugucuagaggaagcgcuaaacuccaaugguuuguagagagaaacaugguuauaccagaaggaaggguaauugauuuagggugcgguagagggggcuggucuuacuacugugcugggcucaagaaaguuacagagguacggggauacacgaaggguggucccggucacgaagaaccgguacccauguccacuuacgguuggaacaucgugaaacuuaugagugggaaagacguuuucuaucugcccccagaaaagugcgacacacuauuaugugacauuggagaaagcucaccauccccaacagucgaggaaucaagaaccauacgcguacugaaaaugguugaaccuuggcucaaaaauaaucaauuuuguauuaaaguguuaaaucccuauaugccgacaguuaucgaacacuuagaaagacugcagagaaaauauggaggcauguuaguuagaaacccacugucgcgaaacagcacccaugaaauguauuggauaucgaacggaacugggaacaucgugagcucggucaacauggugucacgacuccuauuaaaccgauuuacaaugacacaucguaggccaacaaucgaaaaagaugucgaccuaggcgcuggaacccgacacguaaacgcugaaccggaaacaccuaauauggaugucauaggagaaagaauaaaacggauuaaagaagaacacucgucaacuuggcauuacgaugaugaaaauccguauaaaacgugggcauaccaugguucuuacgaggucaaagcuacagggucugcaagcaguaugauaaacgguguuguaaaguuacugacaaagcccugggauguagucccaauggugacacagauggccaugaccgauacuacaccauuuggucaacaacgaguauucaaagagaaagucgauacuagaacuccgcgucccaugccaggaacgcguaaggucauggaaauaacagcggaauggcuguggcguacccuagggcgaaacaagaaaccaagguugugcacuagggaagaauuuacgaaaaagguuagaacaaaugcugcaaugggugcaguguucaccgaggaaaaucaaugggauagcgccagagccgcggucgaggaugaagaguuuuggaaguuaguagauagagaacgcgaauuacauaaauugggaaaguguggaucuuguguuuacaacaugaugggaaaaagggaaaagaaacuaggggaauuugggaaggcgaagggaaguagggcuaucugguauauguggcucggagcaagauuuuuagaguuugaagccuuaggauuuuuaaaugaagaucacugguuuagucgagagaauaguuacagugggguagaaggagaaggguuacacaaacuugguuauauacuacgggauaucaguaagauuccggguggugcuauguaugccgacgacacggcugggugggauacacguauaacugaagaugaucugcacaacgaagagaaaauuacucaacagauggacccagagcaccgacaauuagccaaugcaaucuucaagcuaacuuaucagaauaaggucgucaagguacaaagaccgacuccuaaaggcacagugauggauauaauuucaagaaaggaucagagaggaucugggcagguaggaacguacggacuaaauacuuuuacaaauauggaagcacaguuagugagacaaauggaaggugaaggaguacuuaguaaagcagauuuagaaaauccucauuuacuugagaagaaaauuacucaauggcuagaaaacaaaggaguagaaagguuaaaaagaauggcaaucucaggcgacgacuguguuguaaagccgauagaugauagauucgccaaugcgcuauuagcacuaaaugacaugggaaagguaagaaaagacauaccccaauggcaaccuucaaaagguuggcaugacuggcagcaagucccuuuuugcucgcaucacuuccaugaauuaauuaugaaagauggaagaaaguuagugguacccugccguccacaagaugaauuaauagggagggcgaggauaagccaaggugccgguuggagucuaaaagaaaccgcuuguuuaggaaaggcuuacgcacaaauguggucuuuaauguacuuucaucguagagacuugcguuuagcaucgaaugcuauuuguucugccguuccuguacauugggucccaaccucacggacuacguggucuauucacgcgcaucaccaauggaugacaacggaagacaugcugacuguuuggaacagaguauggauagaagauaauccuuggauggaagauaaaacacccguaaccacuugggaagacgucccguaccuaggcaagcgugaagaucaguggugcggaucucuuauuggauuaacuucucgggcaacaugggcgcagaauauauugacagcuauacagcagguacguaguuuaaucggggacgaagaauuuuuagauuacaugccaucgaugaaaagauuucgaaaggaagaagaaagcgagggugcaaucugguaa

SEQ ID NO: 23129 - RNA, 9873 nt, Artificial Sequence
  derived and/or modified CDS sequence (opt6) from DENV-3__KF955332__SS-prME
acgagucuuugucuaaugaugaugcugccggcgacccuagcuuuucaucuaacaucacgcgacggagaaccaagaaugauuguugguaaaaaugaaagggggaaaucuuuguuauuuaaaacagcaacagguauaaauauguguacgcuaauagccauggacuugggugaaaugugcgacgacaccguuacuuauaaauguccacuaauagcagaaguugaaccugaagauauagacuguuggugcaaucuaacgucuacauggguaacauaugguacauguaaucaagcaggagaacauaggcgagacaaaaggagcguggccuuggcaccacacguugguaugggguuggacacaagaacacaaacauggauguccgcggaaggagcauggcgacagguagaaaaaguugaaacuugggcucugagacacccagguuucacaauacuggcgcuauuucuagcccacuacauaggaacuucgcuuauucaaaaagucgugauuuucauacucuuaaugcuaguaaccccgucgaugacuaugaggugcguuggagucggaaacagagauuuuguugagggccucaguggagccacaugggucgaugucguauuagagcauggagguuguguuacgacaauggccaaaaacaaacccacuuuggauauagaauuacagaaaacagaagccacacaauuggcaacgcuaagaaaauuguguauagaagguaaaauuacaaauaucaccacugacaguagauguccgacgcaaggagaggcgauuuuaccugaagaacaagaucaaaauuacgucugcaaacacacauauguagacagaggaugggguaacggauguggacuuuuugggaaagguagcuuaguuacaugugcuaaauuucaauguuuggaaccaauugaagguaaaguugugcaauaugaaaaucuaaaauauacagucaucauuaccguacauacuggagaucaacaucaaguugguaaugauacgcaagggguuaccguugaaauuaccccucaggcuucaacuguggaagcgguacuuccagaauaugguacuuuggggcuagaguguaguccuagaacaggacuggacuuuaacgaaaugauccucuugacuaugaaaaauaaagcauggaugguucaccgccaaugguucuuugaccuaccuuuaccauggacgucgggagccaccacagaaaccccuacuuggaauagaaaagaacuauuagugacguuuaaaaacgcucaugcgaagaaacaagaaguaguagucuuaggaagccaggagggagcaaugcauacggcauuaacaggugcaacagaaauccagaacucuggaggaacauccaucuuugcgggacauuuaaaaugccgucuuaaaauggacaaauuagaacuuaaaggaaugaguuacgcuaugugucugaauacauucguacugaagaaagaaguaucagaaacacaacaugggaccauacuuauaaaaguagaauauaaaggugaagacgccccaugcaaaauaccuuuuaguacagaagauggucaaggaaaagcccacaacgggagauuaaucacagcaaacccaguuguaacuaagaaagaagaaccaguuaauauagaggcagagccuccauuuggugaaaguaacauagugaucggaaucggcgacaaggcuuuaaaaauaaacugguauaagaaaggguccagcauuggaaaaauguucgaagcaacugcuagaggagcacguaggauggccauccuaggggacaccgcaugggauuuuggaucaguuggagguguuuuaaacucacuuggaaaaaugguccaucaaauauuugguucugcauacacugcucucuucagcgguguuucauggauuaugaaaauugguauagggguccucuugacuuggauuggauugaauagcaaaaacacuucaaugaguuucucaugcauaguuauuggcauaauaacguuauauuuaggggcugugguacaagcggacauggguugugugauaaauuggaaaggcaaagagcuaaaauguggaagugggauuuuugucaccaacgaaguccacacauggacugagcaauauaaauuccaagcagauagucccaagaggcucgcuacugcaauugccggugcgugggagaaugguguaugcggcauaagaucaacuacacgcauggagaaccugcuguggaaacaaaucgccaacgaacucaauuauauauuaugggaaaauaacauaaagcuaaccguggucgucggagauauuaucggaguacucgaacaagguaaaaggacacucacaccgcagcccauggaguuaaaguacucauggaagacguggggaaaagcaaaaauaguaaccgcagaaacacaaaauucaucguuuauaauugauggucccaauacgcccgaaugcccgucagcgucgcgcgcauggaacguaugggaaguugaagauuauggcuuugggguguuuacgacuaacauuugguuaaaacuucgagagguuuacacccaaucaugcgaucauaggcuaaugucagcugcaaucaaagaugagagagcuguacaugcugacaugggauauuggauagagucacagaaaaaugguucuuggaaacucgaaaaagcaucauuuauagaaguaaaaacguguacauggccuaaaagccauacauuauggagcaauggcguccuugaaucugauaugauaauaccuaaaucccuagcgggaccaauaucucaacacaaccacagaccggguuaucacacucaaacagcagggcccuggcaucucggcaaauuagaacuagauuuuaauuauugcgaaggaacuaccguaguuauaaccgaaaacugugggacucguggaccguccuuacgcacuacaacuguaagugguaaacuuauucaugaaugguguugcaggagcuguacccuaccgccauugagauacaugggugaagauggauguugguaugguauggaaauaagacccauaaacgaaaaggaggaaaauaugguuaaaucucuugucucugcagguucaggaaaaguagacaacuucaccauggguguacuaugcuuagcuauacuuuuugaagaaguuaugcgagggaaguuuggaaagaaacacaugauugcagggguucucuuuacauucguauugcuccugucuggacaaauaacauggagagauauggcucacacacuaauuaugauagguucuaaugccagcgaccguauggggauggggguuacuuacuuagcguuaauagccacguuuaaaauccaaccauuccuagcauuaggauucuuucuaaggaaauugacaucacgugaaaaucuacuacucgguguugggcuagcaauggcaacaacucuacaguuaccugaggacauugagcaaauggcaaacggaauagcccuagguuugaugacauuaaaguugaucacucaauuugaaacguaccaacuguggacagcgcuaguaagucuuacgugcucaaauaccauauucacacucacaguagcuuggaggacagcaacguugauauuagcaggggugucuuuauuaccgcuaugccaaaguagcucaaugcgcaagacggauuggcugccuaugaccgucgccgcaauggguguuccgcccuugccacuauuuauauuuagucuaaaagacgcucccaaacgucgcucguggccguuaaaugagggaguaauggccguaggucuugugucaauauuagcaagcaguuuguugcgaaaugauguuccaauggcaggucccuuaguagcuggagguuugcucaucgcuuguuauguaauuacggguacaucagcagaccugacuguagaaaaagcugcagaugugacaugggaagaagaagcagagcaaaccgguguaagccacaaucuuaugauuacaguagaugacgauggaacgaugagaaucaaagaugacgaaaccgaaaauaucuuaacaguauugcucaaaacagcguuacuuaucgugucaggaauauuuccguacaguauaccagcaacacugcuuguguggcauaccuggcaaaagcagacucaacgaucagguguuuugugggaugucccaagcccaccggaaacccaaaaagcagaacuagaggaggguguuuacagaaucaaacaacaagggaucuuuggaaaaacucaaguaggaguagguguacagaaagaaggaguuuuucauacuauguggcacguuacgcguggugcuguccuaacucauaacggaaagagacuugagccuaacugggcuagcgucaagaaagaucuuaucucauacggaggugguuggagacuaucuacccaauggcaaaaaggugaagaaguucaagucaucgcaguagaaccuggaaagaaccccaaaaauuuucagacaaugccagggauauuucaaacuacgacaggcgagauuggcgccauagcgcuagacuucaaacccggaacaagugggaguccaauaaucaaucgagaagguaaaguaguuggccuuuauggcaacggaguuguaacuaaaaacggaggcuacguaucugggauugcacaaacaaaugccgagccagacggaccuacccccgaauuggaagaagaaauguucaagaaaagaaauuugacgauuauggaucugcaucccgguucagggaaaacgagaaaauauuugccagcgauaguaagggaagcaauuaagagaagacuaaggaccuuaauccuggcuccgacacgugugguagcagcugaaauggaagaggcucugaaaggucucccuauaagguaucaaacuacugcaacuaaaucugagcauacaggaagagaaaucgucgaccuuaugugucaugccacuuuuacuaugaggcuucucucaccaguacguguuccaaauuacaaccuuaucaucauggaugaagcccacuucacggauccagccucgauugcggcucguggauauauuuccacaagaguaggcaugggagaagccgcugccaucuucaugacagcuacaccuccaggcacagcugaggcuuuuccgcaaagcaacgcaccaauccaagaugaagagagagauauaccugaaaggucauggaacucuggaaaugaguggauaacugacuuugucggaaagacaguuugguuuguacccucaauaaaagcugggaaugacauagccaauugcuuaagaaagaaugguaagaaaguaauacaacuuucccguaagacguuugauacugaauaucaaaagaccagauuaaacgacugggauuuuguggucacaaccgauauuucggaaaugggcgcaaauuucaaagccgacaggguaauagaccccagaaggugucuaaaaccaguuauccucacugacggacccgagcgcgugauauuagcuggacccaugcccgucacugcagcuucugcggcacagcgcagaggacguguaggaaggaauccacagaaggaaaacgaccaauauauuuucacuggacaaccauuaaacaaugaugaggaucaugcccacuggaccgaagcaaaaaugcuacuagacaauauuaacacacccgaggggaucaucccugcauuguuugaaccugaaagagagaaaagugcugcgauugauggagaauaucgacuuaaaggagaaucgagaaaaacuuucguagaauugaugcggcgaggcgaucuuccgguauggcuggcucacaaaguagccagcgaaggaauuaaauauaccgaccgcaaaugguguuucgauggcgaacgaaacaaucaaauacucgaggaaaacauggacguggaaauauggacgaaggaaggugaaaggaagaaacuucgaccaagauggcuugacgcacgaacuuacagugaccccuuagcauugaaggaguucaaagauuucgcagcggguagaaaaucgaucgcuuuagaucuggucacggaaauaggucguguccccagucaucuugcccauaggacgcguaacgcgcuggauaaucuuguuaugcuccacacgagcgaacaugguggcagggcuuaccgacacgccguagaagaacuacccgaaacuauggaaacauuauuauuauuagguuuaaugauauugcucacgggcggggcaauguuauuccucguguccgguaaagguauuggcaagacgacuauaggcuugaucugcguuauuguaucuuccggcauguuguggauggcggauauaccacugcaauggauagcauccgcaauagucuuagaauuuuucaugaugguacuccuuauuccagaaccggaaaaacagcgcaccccacaagauaaucaauuggcauacguuguaaucgguauuuuaacacucgcggcaauaguagccgcgaaugaaaugggacuacuugagacuacuaaaagagauuuaggcaugucuaaggaaccgggaguggucagcccuacaucguaucuagauguagaccuacauccagcaagcgcuuggacccucuaugcaguagcaacgacaguuaucacaccuauguuaagacacaccauagaaaauucuaccgcgaauguuagcuuagcugcgauugcgaaucaagcaguaguacuaaugggacucgacaaaggcuggccuaucucgaaaauggacuuaggaguuccccugcuugcauuaggauguuacagccaaguaaacccguugacauugacagcagcaguauuauuacuugucacccauuaugccauaauaggaccgggguuacaagcuaaagccacacgggaagcacagaaacggacagcggcaggaauaaugaaaaauccaacaguagaugguauaaugacuauagaucuagacccaguuauuuaugauuccaaauuugagaagcaauuaggucaaguaauguuguuaguauuaugugccguacaacucuuauuaaugaggacuucaugggcacuaugugaagcguugacacuggcgacugggccaauaacuacuuuaugggaaggcucaccggguaaguuuuggaauacgacaauagcuguaucuauggcuaauauuuuucguggaucauaccucgcgggagcaggguuggccuuuuccaucaugaagucaguaggaacgggaagacgcgggacagggagccagggggaaacacuaggagaaaaauggaagaagaaauuaaaucaguugagcagaaaagaauuugaucuuuauaagaaaucaggaauaacugaaguagaucgcacagaagcuaaagaaggacucaaaagaggugaaacaacgcaucacgcagugagcaggggaucagccaaacuucaaugguucguagagagaaauaugguuauuccagagggucgcgugauugauuuaggauguggaaggggaggauggagcuauuauugugcuggacucaagaaaguaacagaaguccgaggauauacaaaaggagggccaggacacgaagaaccaguaccaaugucaacuuaugguuggaacaucgucaaacuaaugagcgggaaagacguauuuuauuugcccccggagaaaugugacacuuuacuaugcgauauuggggaaagcuccccaagucccaccgucgaagaaagucguacuauacggguacuuaaaauggucgaaccguggcuuaagaauaaucaguuuuguauaaaaguauugaacccuuauaugccaacagucauagagcaccuugaacguuuacaacguaaauaugguggaaugcuaguuagaaauccacucagccgaaauucgacucaugaaauguacuggauuucuaacgguaccgggaacaucgucaguucagugaacauggucagucgacugcuauugaacagauuuacgaugacacacagaaggccuacaauugaaaaagauguagacuuaggagccgggacuaggcauguaaaugccgaaccugagacuccuaauauggauguuauaggugaacggauaaaacgaauaaaagaagaacauagcucuacauggcauuacgaugaugaaaauccauauaaaacaugggcauaucacgguucuuacgagguuaaagcaacgggaucagcuaguucaaugaucaacgguguuguaaaacuauuaacaaaaccaugggauguuguuccuaugguaacucaaauggcaaugacggauacuacacccuuuggccaacaaaggguuuucaaagaaaagguagauacaagaaccccucgaccaaugccaggaacacgaaaaguaauggaaauaacagccgaguggcuuuggcgaacauuagguagaaauaagaaaccuagacuauguacuagggaagaauuuacaaagaaaguacgaacaaaugcagccaugggcgcgguuuucacagaggaaaaccaaugggacucugcucgcgcagcaguggaagacgaagaguucuggaaauuagucgaucgagagcgcgaacuacauaaauuaggaaaaugcggaucaugugucuauaacaugauggguaaaagggagaagaaauuaggugaauuuggaaaagcuaaaggaucucgggcuauuugguacaugugguugggggcacgauuucuagaauuugaagcucuuggauuucugaaugaggaucacugguuuucgagggagaacucuuacucagguguggaaggagaaggacuacauaaauuaggauauauucuacgggauauauccaaaauaccagguggagcaauguaugcagaugauaccgccgguugggauacacgaauuacagaggaugaccuccauaaugaggagaaaaucacgcaacaaauggauccggaacauagacaacuagcgaacgcaaucuucaaacuaaccuaucagaacaagguagucaaaguacaaagaccaacuccaaaaggaacgguaauggauauuauuaguagaaaagaucaaagggguucagggcaaguagggacguauggucuuaauaccuuuacaaauauggaagcccaguuggugagacagauggaaggagaagggguauuaagcaagacggaccucgagaauccccaccuccuggagaagaaaaucacucaaugguuagagaacaaaggaguggaacgccuaaaacgaauggccauuagcggagaugauugcgugguaaaaccaauagaugaccgauucgcgaaugcgcuucuagcuuugaaugacaugggaaagguaagaaaagauauuccacaauggcaaccuuccaaaggauggcacgacuggcaacaaguuccguucuguucucaucauuuccacgagcuaaucaugaaggacggacgaaaauuaguuguacccuguagaccacaagaugaacugauuggcagggcaaggauuucucagggggcuggauggucacuaaaggaaaccgcaugccuagguaaagcguacgcacaaauguggagucuuauguauuuucacagaagggauuugagguuggcuuccaacgcaaucuguagugcaguuccgguccacuggguuccuacaucaaggacuaccuggaguauacacgcucaucaccaguggaugacaaccgaagacauguuaaccgucuggaauagaguauggaucgaagauaauccauggauggaagauaagacaccuguuacaacaugggaagacguuccguaccucggaaaaagagaagaucaauggugugggagucuaaucggucuaaccucgcgagccaccugggcacagaacaucuuaaccgcaauucagcaagucagaaguuuaauuggcgacgaagaauuucuugauuauaugccauccaugaaacgauuucgaaaagaagaagaaagugagggugcaauaugguag

SEQ ID NO: 23130 - RNA, 9873 nt, Artificial Sequence
  derived and/or modified CDS sequence (opt6) from DENV-3__FJ639720__SS-prME
acuucacuaugucugaugaugauguuaccagcaacauuagcguuucauuuaacaaguagagauggugaaccacguaugauuguuggcaaaaaugaaagagggaaaucauuacuuuucaaaacagcaacuggcauuaauaugugcaccuugauagcaauggaccuaggggaaaugugugacgauacaguuacuuauaaaugcccauuaauugcagaaguggaaccagaagauauugauuguugguguaaucuaacaucgacuugggugacguaugguacgugcaaucaagcuggugagcaucggagggacaaaagaagcguugcacuagcaccgcacguaggaaugggacucgauacaagaacacaaaccuggaugucagccgaaggagccuggagacaaguugaaaaaguagaaacuugggcacugcggcauccagguuucacuauacuggcacuauuccuggcgcacuauauagggacuuccuuaauacagaaaguugugauauucauacuauugauguuagugacaccaaguaugaccaugagaugugugggggugggaaaucgagauuuuguagaagguuugagcggagcaacguggguagacguaguccucgaacacggaggaugcguaacaacaauggccaaaaauaaaccaacccuugauaucgaacuucagaaaacugaggcaacccaauuggcaaccuuaagaaaacuguguauugaaggaaaaauaacuaauauaacuacugauucgagauguccgacacaaggagaagccaucuuaccugaagaacaagaccaaaauuauguguguaaacauacuuacguggaucgagguugggguaauggauguggcuuauucgguaaagguucucuaguuacuugcgcaaaauuucaauguuuagagccaauagaagguaaaguuguucaauaugagaaucuaaaauacacugugaucauaacaguacacacgggugaucaacaucagguagggaaugacacacaagguguaacaguagaaauuacuccucaggcgucaacuguagaggcaguccucccagaauauggaacccuuggauuagagugcagccccagaacaggacuagacuuuaaugaaaugauauuauuaaccaugaaaaauaaggcuuggaugguacaccggcaaugguucuuugaucucccacuuccguggacaucuggugcaacaacggaaacuccaacuuggaaucgaaaagaauuauuaguaaccuuuaaaaaugcacacgcuaagaaacaagaggucguuguauuggguagccaagaaggugcaaugcacacggcauuaacgggggcaacugaaauccaaaauagcggggguacgagcauauuugccggacacuuaaaaugccgcuuaaaaauggauaaacucgaacugaaaggcaugucauaugcaaugugccuaaauaccuuuguauuaaagaaagaagugagcgagacacaacacggcacuauacugauaaaaguagaauacaaaggcgaagacgcgccuugcaaaauaccuuucucaaccgaagauggccaaggaaaagcucacaacggaagacugauaacagccaacccugucgucaccaagaaagaagaaccuguaaauauugaagcugaacccccguucggagaaaguaauauaguaauaggaauuggggacaaggcuuuacggaucaauugguauaagaaagggaguucgauaggaaagauguuugaagccacagccagaggagcccguagaauggccauuuuaggcgauaccgcaugggauuuugggagcgugggaggaguccuuaacucauuagguaaaaugguucaucaaauauuugggagcgcguauacggcauuguuuucaggaguaucuuggauaaugaaaaucgggauuggaguacuacugacuuggauaggcuuaaacagcaaaaauacauccauguccuucaguuguaucguaauuggaauaauaacuuuguaucuaggugcagugguacaggcugauauggguugcguaauaaauuggaaaggaaaagaacuaaaauguggaaguggaauauuuguaacgaaugagguucauacauggacugaacaauauaaauuccaggcagacucaccaaaacgacuggcaaccgcgauagccggugcaugggaaaaugggguuugcggaauuagaaguacaacacgaauggagaacuuacucuggaagcaaaucgcaaacgaauuaaauuacauacuaugggaaaauaacauuaaauuaacuguaguaguaggugauauuauagguguacuagaacaaggaaaacguacauuaacgccacaaccuauggaacugaaguauucguggaaaacaugggggaaagcuaagauugucacugcggagacacaaaauucaucuuuuaucauagauggaccaaacacaccugaaugcccuucagcaagcagagcguggaauguaugggaaguagaagacuacggauuuggaguuuucacuacaaauauaugguuaaaacugagggaaguauauacucaaaguugugaucauagacuuaugucggccgcuauaaaagacgagcgagcagugcacgcagacaugggguacuggauagaaucucagaaaaacggaaguuggaagcuagaaaaagcaucguuuaucgaggucaaaacauguacauggccuaaaucacacacacuauggaguaaugguguauuagaaucagauaugauaauaccgaaaucauuagcagguccuauaagucaacacaaucauaggccagguuaucacacgcaaacggcagguccuuggcauuugggcaaguuagaauuggauuucaauuauugugaagggacuacagucguaauuacggaaaauugcgguacuagagggcccagucugcguacaaccacaguuucaggcaaacuuauccaugaaugguguuguagaucuugcacgcuuccaccuuuaagauauaugggcgaagacggauguugguauggaauggaaauccgaccuauaaaugaaaaagaagaaaauaugguaaaaaguuuaguuuccgcaggaucaggcaaaguggacaauuucacaaugggaguacuaugucuagcaauccuauuugaagaaguaaugcgaggaaaauuugggaaaaagcauaugauagccgguguacucuuuacauucguguugcuacucuccggacaaauaacuuggcgggacauggcucacacgcugaucaugauuggcucgaacgccagugaucguauggguaugggcguaacauaucucgcacuaaucgcaacauuuaaaauacaaccauuucucgcacucggauucuucuuacgaaaauugaccuccagagaaaaucucuuauuaggaguaggacucgcaauggcuacaacgcuucaauuacccgaggacauugaacagauggcaaacggaauugcauugggacuaaugacguuaaaacuaauaacacaauucgagaccuaccagcuauggacagcccuaguaucacuaacuuguagcaacacaaucuuuacacuaacgguagcauggcggacagcuacacuaaucuuagccggagucucacuuuugccucuuugccaauccaguucuaugagaaagacagacugguuaccaaugacaguagcagccauggggguaccgccacuaccucuauuuaucuucucucugaaagacacaccuaaaagaaggucguggccucuaaacgagggcguaauggcaguaggcuuaguuuccauauuggcuaguucacucuuaagaaaugauguuccgauggcggguccuuuagucgcaggagggcuuuuaauagcuugcuacgugaucacagguacaucagcagaccuuaccguagaaaaagcggcagauguaacuugggaggaagaagcugaacaaaccggagucagucacaaucuaaugaucaccguagaugacgaugggacuaugcguaucaaagaugaugagacagaaaauauauuaacaguguuacugaaaacggcguuauuaauaguaucugggaucuuuccauauaguauuccugcgacgcuccuaguauggcacaccuggcaaaaacaaacacaacgaucaggaguacuaugggaugucccuuccccaccagaaacucagaaggcagaacuagaagaagguguauaccgaauaaaacaacaagggaucuucggaaaaacccaggucggaguugguguucaaaaagaagggguguuccauacaauguggcacguaaccagaggggcgguauugacacauaaugguaagcgacuggaaccaaacugggcgagcgucaagaaagaccuuauuucauauggagggggcuggaggcuuucuacacaauggcaaaaaggugaagaagugcaagugauagcaguggagccugggaaaaaccccaaaaauuuucaaacuaugccaggcauauuccaaacaacgacaggagaaauaggagcaauugcauuagauuuuaagccaggaacaaguggguccccuauaauuaauagggaggguaaaguaguaggacuauauggcaauggaguaguaacgaaaaacggcggauauguauccggaauagcgcagaccaaugcagaaccagauggucccacaccagagcuagaagaggaaauguucaaaaagcguaaccucacaauaauggaccuacauccggguucggguaaaacuagaaaauaucugccagcuauaguacgcgaagccauuaaaagacgguuaagaacacuuauucucgcuccaacaaggguaguggcagcagaaauggaagaggcuuuaaagggauuaccaauuagguaucagacuacugcuacuaaaucugaacauacaggucgugaaauuguugaucuaaugugucaugccacuuucacuaugagguuauugagccccgucagagucccuaacuacaauuuaauaauaauggaugaagcacacuucacugaucccgccaguauagcugcgaggggauauaucagcacaagaguugguaugggugaagcugcagccaucuuuaugacugcaacacccccaggaacugcagaggcauucccacaaagcaaugcaccgauacaagaugaggaacgugauauaccggagaggucauggaacuccggaaacgaauggauaacagauuuugugggcaaaacgguuugguucguaccuagcauuaaagcagguaacgacauugcaaauugcuugcgcaaaaauggcaagaaaguaauacaacuaucacggaagacauuugauacggaauaccagaaaacucggcuaaaugacugggauuuuguugugacuacagacauuucagaaaugggagcaaauuuuaaagcugacagaguaauagauccaagacgaugccugaaaccugugauccucacugacgggccagaaagagucauacuugcaggucccaugccaguaacagcagcauccgcugcacaaagacgcgggcgaguaggacgaaauccacaaaaagaaaacgaccaauauaucuuuacuggucaacccuugaacaaugaugaagaccaugcccauuggacugaagcgaaaaugcuacuagacaauauaaauacucccgaaggcauuauacccgcccucuucgaaccggagcgagagaaaagugcugcgauagauggagaauacagauuaaaaggagaaucacgcaaaacuuucguggaacugaugcgcaggggagaccuaccgguaugguuagcacacaaaguugcaagcgaaggaauaaaauacacugacaggaaaugguguuucgauggcgaacguaacaaucaaauuuuagaagaaaacauggauguagaaauauggacaaaagagggagagaggaagaaacuaagaccgaggugguuagacgcaagaacauacagugauccguuagcacuuaaagaguucaaagauuucgcagcagguagaaaaucuauagcaauugacuugguuacagaaauaggacgcguaccuagucacuuggcucacagaacacggaacgcacuagauaacuuaguaauguuacauacaucggagcacgggggacgagccuacagacaugcaguggaagaauugcccgagacaauggaaacacucuugcuucucggacuuaugauacugcuaacuggcggugcaaugcuauucuuaguuucuggcaaaggcauaggaaagaccaccauagggcuaauuugcgucauaguuagcucaggcaugcuauggauggcggacauuccacuacaauggaucgcauccgcgauaguauuagaguucuuuaugaugguucuguugauaccagaaccugagaaacaaagaaccccucaagacaaccaacuagccuauguaguaauagguaucuuaacuuuagccgcaaucgucgccgcaaaugaaaugggguuauuagagacaacgaagagagauuugggcaugucgaaggagccgggggugguaucccccacuucguauuuagacguggaucuucauccagcauccgcuuggacacuauacgcaguagcaacuacuguaauaacaccaaugcuaagacauaccauagaaaacagcacagcuaauguuucacucgcagcuauugcaaaccaagcaguaguacuuaugggacuugauaagggauggccuauauccaaaauggaccuaggugucccacuucuagcacuaggauguuacucacagguuaacccacuuacccucacagcugcuguacuacuguuaguuacucauuacgccaucaucgguccuggauuacaagcaaaagcgacaagagaggcacaaaaacgcacggcagcaggcauaaugaaaaauccaaccguagauggaauuaugacaauugauuuagacccuguuauauacgauucaaaauucgaaaaacagcucgggcaagucauguugcuuguauuaugugcaguacaacuucuacuuaugcgcacaucaugggcucuuugcgaagcacucacauuggccacggguccuauuaccacguuaugggaagguagcccugggaaauucuggaacacuacaauagcagugaguauggcuaauaucuuuagaggcaguuaccuggccggugccggguuagcguucucaaucaugaaaucaguuggaacugggagaagagguacuggaucccaaggagagacacuaggggagaaguggaagaagaaacucaaccaacucucgagaaaagaauuugaucuauacaagaaaucugguauaacggaaguagaucgaacggaagccaaagaaggauuaaaacguggggaaaccacgcaucaugcagugagccgcggaagcgcaaaguuacaaugguuugucgaacgaaacaugguuauccccgaagggcguguaauagauuuaggcugcggaagaggaggauggucguauuauugcgcuggucuaaagaaagugacugaaguucgaggauauacuaaaggaggaccuggacacgaagaaccgguuccaaugaguacauauggguggaacaucguaaaacuuaugucggggaaagauguauucuaucuuccaccagagaaaugcgauacacucuuaugcgauauuggagaaaguucaccgagucccacuguggaagaaucuagaacgauucgaguccuuaaaaugguagaacccuggcucaaaaauaaucaauucuguauuaaagucuugaaccccuauaugccgacugugauugaacaccuggagagacugcaaaggaaauaugggggcauguugguacgaaauccgcuuucuagaaauaguacucacgaaauguacuggaucucaaacgggacaggaaacauuguuagcucuguuaacaugguguccagacuccuacuaaauagguuuaccaugacacauaggcguccaacgauugaaaaagaugucgaucucggagcugguacacgacaugucaaugcggaacccgaaacucccaauauggauguaauaggagaacgcaucaaaagaauuaaagaagaacacuccagcacuuggcauuaugacgacgaaaacccauauaagaccugggcuuaucaugggucguacgagguaaaggcaacaggcucugcaaguucuaugauaaacggggucguuaaauuacuaacuaaaccaugggauguaguucccaugguuacacaaauggcuaugacggauacaaccccauuuggacagcaacggguguucaaggaaaagguagauacucggacacccagacccaugccugggacaagaaaaguaauggaaauuacagcugagugguuguggcgaacauuagggcgaaacaagaaaccgaggcucuguacaagagaagaauuuaccaagaaaguaagaaccaaugcugcaaugggagcuguguuuacugaagaaaaccaaugggacucggcuagagcagcaguugaagaugaggaguucuggaaacugguugaccgugaacgugaguuacauaagcugggaaaaugugguucgugcguguauaacaugauggguaaacgggagaagaaauuaggggaguuuggaaaagccaaagggucccgcgcuaucugguacauguggcuaggugcaagauucuuggaauuugaagcauuaggguuccucaacgaggaucacugguucagucgggaaaauucuuauucuggcgucgaaggcgaaggccuacacaaacuagguuauauacuacgcgacauuucaaaaauaccaggaggugcaauguaugcagacgacacagccggcugggacacaaggauaacagaagaugacuugcacaaugaggagaaaauuacgcaacaaauggacccagaacaucgccaacuugccaaugcaauuuucaagcucaccuaccaaaauaaaguaguaaagguucaaagaccuacacccaaggggacaguaauggauauuauuucucggaaagaccaaagaggaucaggacagguagggaccuacgguuuaaacacuuuuacaaauauggaagcacaauuagugcgucaaauggaaggggaaggcguacucagcaaaacugacuuggaaaacccacaccuucuagagaagaaaaucacccaauggcuagaaaauaaaggcguagaaaggcucaaaagaauggccauaucuggagaugacugcguuguuaagccuauagaugauagauucgcaaaugcacuauuggcuuuaaaugacauggguaagguaagaaaggauauaccacaauggcagccaucuaaggguuggcacgauuggcaacaaguaccguucugcucacaccauuuucacgaacuaauuaugaaagacgggagaaaacuuguuguaccuuguagaccucaagaugaauuaauuggacgagcgaggauaucacagggagccggauggucgcuuaaggaaacugcuugcuugggcaaggcauaugcccagauguggaguuuaauguauuuucauaggagagaucuccgacuugcaucaaaugcaauauguagcgcuguuccgguccauuggguaccuaccucacguacaacguggucaauacacgcacaccaucaauggaugaccacugaagacauguuaacaguauggaaucgugucuggauagaagacaacccauggauggaagauaaaaccccugucacuacuugggaagacgugccguaccucgggaaacgagaagaccaguggugugguuccuugauaggccucaccucgagagcaacaugggcucaaaauauauuaacagcgauccagcaaguuagaucucugaucggggacgaagaguuucuggauuauaugccuagcaugaaaagauuccgaaaagaagaggaaucagagggggcaauaugguga

SEQ ID NO: 23131 - RNA, 9873 nt, Artificial Sequence
  derived and/or modified CDS sequence (opt6) from DENV-3__GQ868626__SS-prME
acgaguuuauguuuaaugaugauguuacccgcaacguuagcguuucauuuaaccaguagagauggagaaccaagaaugauaguaggcaaaaaugaaaggggaaaaaguuuauuguuuaaaaccgcuacaggaauuaauauguguacacucaucgcuauggaucugggagaaaugugugacgacacuguuacuuauaaauguccucuaauugcagaaguagaaccagaagacauagacuguugguguaaucuuacgucuacguggguuacauauggaacuuguaaucaagcaggagaacaccgaagagacaaacgaucaguugcacuagcgccacaugucggaaugggacuagacacacguacacaaacuuggaugagugcggaaggagcuuggagacaaguugaaaaaguggaaacaugggcacugcgacauccaggguuuacuauacuugcacuauuucuagcgcacuauaucgguacaaguuugauucaaaaaguaguuaucuucauacucuuaauguuaguaacuccauccaugacuaugagaugcguagguguaggaaauagagauuuuguugaaggauuaaguggagcaacuuggguggauguuguucuagaacauggaggauguguuacaacaauggcuaaaaauaaaccaacauuagacauagaauugcagaaaacggaagcaacacaacuagcaacauuaagaaaauugugcauagaggggaaaaucacaaauauaacaacagauagccguugcccaacacagggagaggcaauauuaccugaagaacaagaucaaaauuaugucuguaaacauacuuaugucgauagaggauggggaaauggguguggacucuucgggaaaggguccuuaguaacuugugcaaaauuucaaugucuugaaccaauugaagguaaaguuguacaauaugaaaaucuaaaauauacagugauuauaacgguccacacgggcgaucaacaucaaguuggcaacgacacucaaggagugacgguggaaauuacaccccaggcaagcacaguagaagcgguacugccagaguauggcacacuaggauuagagugcagcccgagaacuggguuggacuucaaugaaaugauacugcuaacaaugaaaaacaaagcauggauggugcaccgucaaugguucuucgaccuuccacuuccuuggacaucaggcgcaacaauugaaacuccuacuuggaauagaaaagaacucuuggugacauucaaaaaugcacaugccaagaaacaagaaguagucguacugggaucacaagagggugcgaugcauacugcauugacaggugcuacagaaauucaaaacucaggugggacuucaauauucgcaggccaccugaaaugucgacuaaaaauggauaaacuugaacucaaagggaugaguuacgcaaugugccuaaauacuuucguuuuaaggaaagaaguuucggagacucagcacgggacuaucuuaauaaaaguugaauacaaaggggaagacgcuccuuguaaaaucccauucucaacugaagacggacaagguaaagcacauaauggcagacugaucacagcaaauccaguuguuacuaagaaagaagaaccggugaacauagaagcagaaccacccuucggggaaaguaauauaguaauaggaauaggagauaaagcucugaaaauaaacugguauaagaaagguucaucgauuggaaaaauguuugaagcaacugcgcgaggcgcacggcgaauggcaauccuuggagauacagcaugggauuuuggaucgguuggaggggugcuaaauucuuuaggaaaaaugguucaucaaauauucgguuccgcauacaccgcgcuuuucaguggggucagcuggauaaugaaaauugggauugguguacugcuaaccuggauaggacucaauaguaaaaacacaaguaugagcuucucgugcauugucauuggaauaauaacauuguaucuaggagccguagugcaagcagauauggggugcgucaucaauuggaaaggaaaagagcuaaaaugugggaguggaauuuucguaacgaaugaaguucauaccuggacagaacaauacaaauuccaggcggauucaccuaaaagguuagcaaccgcaaucgcuggugcaugggaaaacggcguauguggcaucagaaguacuacgcgaauggaaaauuuacuauggaaacagaucgcaaaugagcuuaacuacauacuuugggaaaacaacauuaaacugacagugguugucggugauaucaucggagugcucgagcaaggaaaacgcacauugaccccacagcccauggaauuaaaauacaguuggaaaacuuggggaaaagcaaaaauaguaacugcugaaacacagaacaguucuuuuaucauagacggcccaaauacaccagaaugcccaucagcuagcagggcguggaacguaugggaaguggaagacuacgguuuugguguauucacaaccaauauaugguuaaaauuaagagaaguuuauacacaaucaugcgaccaucgcuuaaugagugcugccauaaaagaugagagggccgugcaugcagauauggguuauuggauagaaucgcagaaaaauggaucauggaaacucgagaaagcaucauuuauagaaguaaaaacguguacguggccaaaaagucauaccuuauggucuaauggaguacucgagagcgacaugaucauuccaaaaucucuggcgggacccauaucgcaacauaaccauagaccaggauaccacacgcaaacugccggaccauggcaccuuggaaaauuagaacuagauuuuaauuacugcgaaggcacuaccguagucauaaccgaaaacuguggaaccagagguccaaguuuaaggacaacaacaguuucagguaaacuaauacacgaguggugcugcagaucaugcacauuaccgccuuugcgauauaugggagaagacggaugcugguacgggauggaaauaagaccaauaaaugagaaagaggagaauauggugaaaucucucguuucagcugguaguggcaagguagauaacuucacaaugggagucuugugccuggcaauuuuguucgaagaagucaugcgugggaaauucggcaagaaacauaugauugcuggcguccuuuuuacguuuguacuauuacuaucaggucagaucaccuggcgggauauggcucauacgcuuauaaugauuggaucuaacgcaagugaucgcauggguaugggugucacuuacuuagcuuugauagcuacauuuaaaauucaaccguucuuagcacucggauucuucuuaagaaaauugacuuccagagagaaucuucuauugggcguugguuuagcgauggcuacaacacuucaauuaccugaagauauagaacaaauggcaaacggcauugcuuuaggauuaaugacguugaaacuuauaacgcaguuugagacauaccaguuauggaccgcucuaguaucgcuaaccugcaguaauaccauuuucacgcuaaccguggcuuggaggacggcuacgcuaauauuagccgguguaucuuugcuaccuuuaugccaaucuucuucaaugaggaaaacagacuggcugccuaugacgguagcagcuaugggggucccuccacugcccuuauucauuuuuagucugaaagauacaccgaagcgucgcagcuggccauugaaugaagguguuauggcaguaggacucguuucaauccucgcaagcucauugcugagaaacgacgucccaauggcugguccccuaguagccggaggucuccuaauagcguguuacguaauaacuggaacaagugccgacuugacaguugaaaaagcagccgacgugacuugggaggaggaagcggaacaaacaggaguuucacauaacuuaaugauaacagucgaugacgauggcacuaugagaauaaaggacgaugaaacugaaaacauacucacuguccuauuaaaaacagcacuauuaaucguaagcgguauauuuccguauaguaucccagcaacucuccuggucuggcauaccuggcaaaaacaaacacaacguucuggcguacugugggaugugccgucaccaccugaaacacagaaagcggaguuagaagagggagucuaucguaucaagcaacaaggcauauucgguaaaacucaggugggaguggguguacaaaaagaaggcguguuccauacuauguggcacgugacucguggagcaguacuaacgcacaauggaaagagacuugagccuaacugggcaagcguaaagaaagauuuaauaucuuauggcgguggguggcgguuaaguacucaauggcaaaaaggagaagaagugcaaguuauagcuguugaaccagguaaaaauccuaaaaauuuccaaacuaugccaggaauuuuccaaacaacaacaggagaaauaggugccauagcgcuggacuuuaagccggggacaagcggauccccgauaauaaauagagaaggaaaaguuguaggacuauaugguaauggugugguuacuaaaaacggugguuauguuucugguauagcacagacuaaugccgaacccgacggcccaacaccagaauuagaagaggagauguuuaaaaagagaaauuugaccauuauggacuuacacccagguagcggaaaaacucggaaauaccuuccugcaauaguuagagaagcuaucaaacggaggcuaagaacacuaauuuuagcuccgacacgggugguggcggcagagauggaagaggcacuuaaaggacugccaauacgguaucaaacuacagcuaccaagagcgagcauacaggcagagaaauuguggacuugaugugccacgcaacauucacaaugagauugcucagucccguccgagugcccaauuauaaucucauuauuauggaugaggcucauuucacagaccccgcgucuauugcggcgcgaggauacauaaguaccagaguagggaugggagaagcggcugccauuuucaugacggcaacgccuccgggaacagcagaagcauuuccacaaagcaaugccccuauacaagacgaggaaagagauauaccagaaaggucuuggaacuccggaaaugaauggauuaccgauuuugugggcaaaacaguaugguuuguuccuucgauaaaagcaggaaacgauaucgcgaacugucuucgaaagaaugguaagaaagucauccaguuaagcaggaaaacauucgacaccgaauaccagaaaacucgucuuaacgauugggacuucguaguaacuacugacauaagcgaaaugggagcgaauuuuaaagcagacagaguaauugacccuagacgaugccuuaaaccuguaauuuuaacugauggcccagagcguguuauacuugcggggccaaugccaguaacagcagccagugcugcucaaagacggggccguguaggcaggaauccccaaaaagagaacgaucaauauauauucacaggucaaccuuuaaacaaugaugaagaccaugcccacuggaccgaagcaaaaaugcuacuggauaacauuaauacccccgaggguauaauuccagcacuauucgaacccgaaagagaaaagucugcggcaauagacggagaauauagguuaaaaggagaaucucgcaaaacauuuguggaauuaaugcggagaggcgaccugcccguaugguuggcauauaagguggcuuccgaaggaauaaaauauaccgaucgaaaguggugcuuugacggagaaagaaauaaucaaauccucgaagaaaauauggacguagagauauggacaaaggaaggagaacguaagaaauuaaggccaagaugguuagacgcuaggacuuacagugauccguuagcgcucaaagaguucaaggauuuugcugcaggaagaaaaaguaucgcguuagauuugguuacagagauugguagaguuccaagucaccuugcacaucgaacucggaaugcguuagacaacuuaguuauguuacacacgucugaacauggaggccgggcguauagacaugccguugaagaacuuccugagacaauggaaacacuuuuacuucuagguuuaaugauacuccucacaggaggagcgaugcuguucuuaauaaguggaaaaggaauaggcaaaaccaccauaggacucaucuguguaaucguuucgagcgggauguuauggauggcugacauuccauuacaauggaucgccucggcgaucgugcuagaguucuuuaugaugguuuuacucauaccagaaccagaaaaacaacgaacaccucaagacaaccaacuagcguauguaguuauuggaauacuaacgcuagcggcaauaguagcugcuaaugaaaugggguuauuggaaacgacuaaacgagauuuggguauguccaaggaaccuggaguaguaagcccaacgagcuauuuggacguagaucuacauccugccagcgcauggacccuuuaugcuguagcgacuacaguaauaaccccgauguuacggcacacaauugagaacucaacagccaauguaagccuggcagccauagcaaaccaagccgucguuuuaaugggauuagacaaaggcuggccuauaaguaagauggaccuaggaguaccguuacucgcauuagguuguuauucccaagucaauccuuuaacgcucacagcagcuguacuacuauugguuacacauuaugcaaucauugguccaggucuacaggcuaaggcgacaagagaagcacaaaaacgcacagccgcaggaaucaugaaaaaccccacggucgauggaauaaugaccauugacuuagauccaguaauuuaugauaguaaauuugaaaagcagcuagggcaaguaauguugcucguacuuugugccguacagcuauuauugaugcguacuucaugggccuugugugaagcacugacacuugcaacaggacccaucacaacuuugugggaaggcaguccuggaaaauuuuggaauacaacuauagccguuucgauggcaaauauuuucagaggcagcuaucucgccggagccggacuugcauucuccauaaugaagaguguuggcacgggacggcguggcacagguucacagggcgaaacccuaggggaaaaauggaagaagaaauuaaaccaauuaagcagaaaagaauuugaucuuuacaaaaagaguggcauaacagaaguagaucggacugaagcuaaggaaggccucaaacguggagaaacuacucaccaugcaguaucucgcgguucggcaaaauuacagugguucguggaacgcaacaugguaauaccggagggaagggugauagacuuaggauguggacgggguggauggaguuauuauugugcaggacuaaagaaagucacggaagucagaggauacacaaaaggagggccaggccaugaagaaccaguuccaaugaguacauaugguuggaauaucguaaaacuaaugagcggcaaggacgucuuuuaccuacccccagagaaaugugauacuuuauuaugugauauaggggagagcucaccuagucccacagucgaggaaagcagaacuaucagaguacugaaaaugguugaaccauggcuaaagaauaaucaauuuugcauaaaaguguuaaauccuuauaugcccacaguaaucgagcaccuugagagauuacaaagaaaauacggaggaaugcuuguaagaaauccgcuaagcaggaacucuacucaugaaauguauuggaucucaaauggaaccggaaacauaguaucuaguguuaauaugguuuccagauuacuacuuaaccgcuucacaaugacucauaggagaccgacaauagaaaaagacguugaucuaggagcugggacucgacacguaaaugcagaaccugagacacccaauauggacguaauaggggagagaauaaaacguauaaaagaagaacacagcucuacuuggcacuaugaugacgaaaaucccuacaagacgugggcuuaucaugguucauacgaaguuaaagcaacgggcagcgcgucauccaugauaaauggugucgucaaacuacugacgaaaccuugggaugucguuccuaugguuacacaaauggcaaugacagauacuacucccuucggccaacagagagucuucaaggaaaagguagauaccagaacuccaagaccaaugccaggaacaagaaaaguuauggaaauaacagcggaguggcuauggcgaacacuagggcgaaauaagaaaccucgucucuguacaagggaggaguucacuaagaaagugaggaccaaugcugcuaugggugcuguauucacagaagaaaaccaaugggauagcgcuagggcagcuguugaggacgaggaguucuggaaguuaguugauagagaaagagaauuacauaaauuaggaaaaugugguucauguguuuacaauaugauggggaaacgcgagaagaaacugggcgaguucggcaaagccaaggguucacgagcgauaugguacauguggcuaggagcgagauucuuagaauuugaagccuuaggauuucuaaacgaagaucauugguucucaagagaaaauucauauucuggcguagaaggagaaggacuucauaaguuagguuauauauuacgugacauaaguaaaauaccaggaggugcaauguaugcagacgacacugcagggugggacacacgaauuacugaggacgauuuacauaaugaagagaagauaacacaacagauggaucccgaacaucgacaacucgccaacgcaauauuuaaacuuacuuaucaaaacaaaguuguuaagguacagcgaccaacaccaaaaggcacugucauggacauuauauccagaaaagaccaacgggggucaggucaaguagggacguauggccucaacaccuuuacgaauauggaagcccaauugguacgacagauggaaggcgagggaguacuaucaaaggcugauuuagaaaacccacacuuacuugagaagaaaauuacgcaauggcuggaaaacaaaggugucgagagguuaaagcguauggccauaucgggcgaugauugcguagucaagccaauagaugacagauucgcaaacgccuuauuggcacuaaaugauaugggcaaaguaagaaaggacaucccacaauggcaaccaaguaaagguuggcaugauuggcagcaaguuccauuuugcagccaucacuuucaugaacuaaucaugaaagacggaagaaaacugguuguaccuuguaggccgcaggaugagcucauagguagagcaaggauaagccaaggcgcuggauggucauuaaaagaaacagccugucuaggaaaagcauaugcucagauguggagucuaauguauuuccacaggagagauuugagacuugcuaguaaugcaauuuguagcgccguccccguucacuggguucccaccucccgaacuaccuggagcauacaugcucaucaccaauggaugaccacggaagacaugcucgcuguauggaauaggguuuggauagaagacaauccuuggauggaggauaaaacgccaguaacaacaugggaagacguuccauaccuaggaaaacgcgaagaucaguggugcggaucacuuauuggcuugaccucacgcgcuacuugggcacaaaacauuuuaacggcgauacaacaaguacguuccuugauaggagaugaagaguucuuagauuacaugccuucaaugaaaagauuccgcaaagaagaagagucggagggagcaauuugguga

SEQ ID NO: 23132 - RNA, 9873 nt, Artificial Sequence
  derived and/or modified CDS sequence (opt6) from DENV-3__GQ868627__SS-prME
acaucauuaugccuaaugaugaugcuuccagcaacguuagcuuuucacuuaacgucacgggauggagaaccucgaaugauaguuggcaaaaacgaacggggaaaaucauuacuuuuuaaaaccgcaacaggaauaaacauguguacccuuaucgcaauggacuuaggagaaaugugcgacgacacuguaacauacaaaugcccacuuaucgcagaagucgaaccagaagauaucgauuguugguguaaccuuacuuccacauggguaacguacgguacuuguaaucaagcaggagagcaccguagagauaaacggucuguggcacuugcaccacaugucggcaugggauuggacacaaggacucaaacauggaugucugcugaaggagcguggcgacaaguggaaaaaguugaaacaugggcauugcgucacccuggauuuacuaucuuggcauuguuuuuagcucacuauaucggcacaucacuaauacagaaaguuguuauauucauacuucugauguuaguuacuccuagcaugacgaugcgguguguuggaguaggaaaucgcgauuucguagaaggcuugaguggcgcuacaugggucgauguuguauuggagcauggaggcuguguuaccacgauggcuaaaaacaaaccuacucucgacauagaacugcagaaaacggaggcuacacaacuagcuacuuuacguaaacugugcauagaagguaaaauaaccaauaucacuacggacucacgaugcccgacgcaaggugaagcaauauugccggaagaacaggaccaaaauuauguaugcaaacauacuuacgucgaucguggaugggguaaugguuguggacuauucgguaaaggaucccuaguaacaugcgcaaaauuucagugccucgaaccuauagagggaaaagugguccaauaugaaaaucuaaaauacacagucaucauuacaguacacaccggcgaccaacaucagguggggaacgacacacaagguguaacagucgaaauaacaccccaggcaaguacgguagaagcgguacuuccagaguauggaacauuaggccucgaaugcaguccacgcacuggccuugacuucaacgaaaugaucuugcuaaccaugaaaaacaaggcuuggaugguacauagacaaugguucuuugauuugccacuaccauggacaucuggugcaacgacagaaacucccacuuggaaccgaaaagaacuauuaguaaccuuuaaaaaugcacacgccaagaaacaggaaguaguuguucuaggaagccaagaaggugcgaugcacacagcccucacaggugcaacagaaauccaaaauucaggagguacguccauauucgcagggcaucuuaaauguaggcuaaaaauggauaaauuagaauuaaaaggaaugagcuaugcaauguguuuaaauacguucguguugagaaaagaaguaucagaaacgcaacauggaacgauacuaauaaaaguagaguauaaaggagaagacgcgccauguaaaauaccuuuuucuacagaagacggccaaggaaaagcacauaauggucgacuuauaacagcaaacccuguugugacgaagaaagaagaaccagucaauaucgaagcugaacccccguuuggagaaagcaacauugugauagguaucggcgauaaagcauuaaaaauaaacugguacaagaaaggcucaucuaucggaaaaauguuugaggcuacagcucguggagcaagacguauggccauacuuggagauacagcaugggauuuugggucagucgguggaguuuuaaacagucuagggaaaaugguacaucaaauauucgguagcgcauauacagcucuuuuuagugguguauccuggauuaugaaaaucggaauagggguauuguuaacuuggauagguuugaacagcaaaaacaccucaaugaguuucagcugcauagucauagggaucauuacccuauaccugggagcgguugugcaagcggacauggguugcguaauaaacuggaaaggcaaagaacuaaaauguggaucagggauuuuuguuacgaaugaaguucauacauggacagaacaauauaaauuccaagcugacucaccgaaaagauuagcgacagcgaucgcgggagcuugggaaaacgguguauguggcauacguagcaccaccaggauggaaaaucucuuauggaaacagauagccaaugaguuaaauuacauuuuaugggagaacaacauaaaauuaacuguagucguuggagacauaauaggaguacuagagcaaggcaaaagaacauuaaccccacaaccaauggaguuaaaauacuccuggaaaaccugggguaaagcaaaaauaguuaccgccgagacacaaaauagcucauucauaauagauggcccaaacacacccgaauguccgagugcaucccgugcuuggaauguaugggagguagaagauuacgguuucgggguauuuacaacaaauauauggcuaaaacuaagagaagucuacacucaaucgugugaucaucguuugaugucggcagcaauuaaagacgagcgugccguacaugcagacaugggauauuggauugagagucagaaaaacgggucguggaaauuggaaaaagcaucguuuauagagguuaaaacuuguacguggccuaaaagccauacguuguggucaaacggaguauuggaaagugacaugauaauaccaaaaaguuuagcggguccuauaagucaacauaaucacagaccaggauaucauacucaaacugccggcccauggcauuuaggaaagcucgagcuugauuucaacuauugcgaaggaacaaccgugguaauaacugagaacugcgggacgagggggccguccuuaagaacuaccaccguaucaggaaaguuaauccaugaaugguguugucguagcuguacauugccaccacuaagauauaugggagaggacggaugcugguacgguauggaaauucgacccauuaacgaaaaagaagaaaacaugguaaagagcuuaguuucugcggguucugguaaaguugauaacuuuaccauggguguacuaugucuggccauuuuauucgaagaaguaaugagagggaaauuugggaaaaagcauaugauagccgguguacuuuuuaccuuuguacucuuauuaagugggcaaauaacauggcgagauauggcacauacauuaauuaugauaggaucgaacgccucagaccgaaugggcaugggggugacguaucuagcacugaucgcgacuuuuaaaauacaaccuuuucuugcacuuggcuucuuucugaggaaguuaacuagcagagaaaaucuacuacuuggcguaggauuggcaauggccacgacuuuacaauugccggaagauauagaacaaauggcuaauggaaucgcacuaggauuaaugacguuaaaguugauaacacaauucgaaacauaccaauuauggacagcgcuuguaucccucacuugcagcaacacuauauuuacuuuaaccguugcuuggaggacugcuacauuaaucuuagccggagucucacuucuacccuugugucagucgucaucgaugaggaaaacagauuggcuacccaugacagucgcagcuaugggcgucccuccacuaccacuauuuauauuuucauuaaaagauacgccaaagcggcguuccuggcccuuaaaugaggguguaauggcuguuggauugguaaguauucuugcgaguucccuacuuagaaaugacguacccauggcagguccgcugguagcuggaggacuuuugauagcaugcuauguuaucaccgggacaucugcagaccucacuguugaaaaagcagcagauguaacuugggaagaagaagcagaacagacagguguaagucacaaucuaaugauaacaguagaugaugauggaacgaugagaauaaaagaugacgaaacagaaaauauucuaaccguacuauugaagacagcacuauuaauaguauccggaauauuuccguacucaauuccagccacgcuccuaguauggcauacauggcagaaacaaacacaaagaucagggguacuuugggacguaccuaguccuccggagacacaaaaagcagaauuagaagaggggguuuaucguauaaaacaacagggaauauuuggaaagacacaaguaggcguuggaguacaaaaggaggggguauuucacacaauguggcacgucacgaggggugcuguucuaacucacaacggaaagagacuagagcccaauugggcaucaguuaagaaagaucuaauuaguuauggcgggggauggcguuuaucgacacaauggcaaaagggcgaagaggugcaaguaauagccguugaaccaggcaaaaaucccaaaaauuuccaaaccaugccggguauauuccagacuaccacaggagaaauuggcgcuaucgcgcuagauuucaaacccggaacgagcgggucgccuauuauaaacagggaaggcaaagucgugggccucuaugguaauggugucgugacuaaaaacgguggauacguaaguggcauagcucagacgaaugcagaaccagaugggccuacaccagaacucgaagaagaaauguuuaagaaacgaaaucucacaauaauggacuugcaccccgguagugggaaaacaagaaaauaccugccugcaauaguuagagaagcaauaaaaaggagauuaaggacacucauccuggcuccaacgcgaguaguggcagcagaaauggaagaagcauuaaagggguuaccgauacguuaucaaaccacggcaacaaagagugagcacacgggccgugaaauaguugauuuaaugugucacgcaacauucacaaugcggcugcuaaguccugugagagugccaaauuauaacuuaauaauuauggaugaagcucacuuuacagacccggcuucaauugcagcaagggguuacauuucuacacgaguagguaugggugaagcugcagcaauauucaugacagcgacaccaccggguacggcagaggcguucccccaaucgaacgcaccuauacaagaugaggaacgugauaucccugaaagaaguuggaacucgggaaaugaauggauuaccgauuuuguuggcaaaacagugugguuuguaccgucaauaaaagcggggaaugacauugcaaacugucuccgcaaaaauggcaagaaaguuauacaguuaaguagaaagacauucgauacagaauaucagaaaacgagacuuaaugacugggauuuuguuguaacaaccgauauaucggagaugggugcuaacuucaaagcagauagaguuaucgauccgaggcguugcuuaaagcccguuauacuaacagauggaccagaacgcguaauacuugcagggccgaugcccguaacggcggccucggcagcgcaaagaagagguaggguugguaggaacccacaaaaagaaaaugaccaauauauuuucacgggccaaccguuaaacaaugacgaggaccacgcacauuggacagaagcuaaaauguuacuugauaacauaaacacuccugaaggaauuauaccggccuuauuugagccugaaagagaaaagucggcagccaucgauggggaauacagauuaaaaggcgaaagcaggaaaacuuucguugaacuaaugaggcgaggugaccuuccaguaugguuagccuauaaaguugcauccgaaggcauaaaauauaccgaucgcaaaugguguuuugauggggagagaaacaaucagauauuggaagaaaauauggacguugaaauauggacuaaagaaggagagcguaagaaauugagaccuagauggcuagaugcacggaccuauucagauccauuagccuugaaagaauuuaaggauuucgcagcaggccguaaaaguauagcauuagaccuuguuacagaaauugggagagucccuagucauuuagcgcaucgaacaagaaaugcucuagauaauuuagugaugcuacacacaagcgaacauggcggccgagcauaccgucacgcaguugaggaacucccagaaacuauggaaacgcuguugcuacuuggacuuaugauacuauuaaccgguggugcaaugcuuuuucuuauuucugguaaaggaauagguaagaccaccauuggacuuauaugugucauaguaucuaguggaauguuauggauggccgacauaccacuacaauggauugccagcgcuauagugcuggaguucuuuaugaugguacuauugauaccugaacccgagaaacaaagaacaccccaagacaaucaacuggcguacguugucaucggaauauuaacauuggccgcuauaguugcggcgaaugaaauggggcuucucgaaacuacgaagagggaccuaggaaugagcaaagaaccugguguaguaucaccgacuucauaucuggacguugaucuccauccagcauccgcauggacgcucuaugcuguugcuaccaccguuaucacgcccauguuaaggcacacuaucgaaaauuccacagcuaacguaucacuugcagccauagcgaaccaggcugucguguuaaugggucucgauaagggguggccaauaagcaaaauggaucuuggcguaccuuuacuugcacuagguugcuauagucagguaaauccacuaacauuaacagcugcuguuuuguuacuugugacgcacuaugcgauaauuggcccaggacugcaggcaaaagccacaagggaagcacaaaaacgaacagcagcaggcauuaugaaaaaucccacugucgacgguauaaugacgauagauuuggauccaguaauuuacgauaguaaguucgaaaaacaguuaggacaagucaugcuacuuguguuaugcgcagugcaauuauuacuaaugcggaccucaugggcccugugcgaggcucuaacucuugcaaccggcccgauaacuacucuuugggaagguucuccgggaaaauuuuggaacacaacaauugcagugagcauggcaaacauauucaggggaaguuauuuagccggagccgguuuggcguucaguauaaugaagaguguuggcacagggaggagaggaacuggaagccaaggagaaacacugggugaaaaauggaagaagaaacucaaucaacucucacgcaaagaguucgaccuauacaagaaaucugggauaacugaggucgacaggacggaagccaaggaaggauuaaaacguggcgaaacgacccaucacgcugugucuagagggagugccaaacuucaaugguuugucgaaagaaacaugguaauuccugaaggacgaguaauugaccuuggaugcggacgagggggauggucuuacuauugugccggucugaagaaagucacugaaguuagaggcuauacuaaaggaggaccaggacaugaggagcccguuccgaugucaaccuacggauggaauauuguuaagcugaugucugguaaagauguauucuaccuuccaccagaaaagugugacacucuguuaugcgauauaggugaaagcagcccaucaccaacuguggaggagucgaggacaauuagaguuuuaaagaugguagaaccuuggcuaaagaauaaucaauuuuguauuaaaguauuaaauccuuacaugccaacaguuaucgaacaccucgaaaggcuacaaaggaaauacggagguauguuaguacggaacccauuaucuagaaacuccacucaugaaauguauuggauaucaaauggaacagguaauauaguuucauccgugaacauggucagucgacuguuacugaaccguuuuacgaugacccaccgacgaccuacgauugaaaaagauguagauuuaggcgcgggaaccaggcaugugaaugcugaaccagaaaccccaaauauggauguuauuggagaacgaauaaaacgaaucaaggaagaacacucauccacauggcauuacgaugacgaaaauccuuauaaaacaugggcauaucauggaaguuacgaagucaaggcaacuggaucagcauccucgaugauuaacggaguagucaaacuacugacuaaaccaugggauguagucccaaugguaacucaaauggcuaugacugauacuacgccauuugggcaacaaagaguguuuaaagaaaaaguagauacgagaacaccaagaccaaugccggguacacgaaaagugauggaaauaacagcagaguggcuguggagaacacuuggcagaaacaagaaaccccguuuauguacaagggaggaauuuacgaagaaagugaggacgaaugccgcaaugggcgcuguguucacugaggaaaaucagugggauagugcaagagcagcuguugaagaugaagaguucuggaaguuagucgacagagaaagagagcuacacaaauuagguaaauguggaucguguguuuauaauaugauggggaaaagagagaagaaacuaggagaguucggaaaagcaaaaggaaguagagcaauaugguauaugugguugggcgcaagauuucuggaguuugaggcacuuggauuuuuaaacgaagaccacugguucuccagggaaaauucuuauuccgggguagaaggagaaggucugcacaaauuagguuacauuuugagagacauauccaaaauuccuggcggagcaauguacgcggaugacacugcagggugggacacucggauaacugaggaugaucugcauaaugaagaaaagauaacacagcaaauggauccagaacaucgucaauuagcaaacgccauauuuaaacuaacauaccagaacaaggucguuaaaguacaaaggcccacaccgaagggaacaguaauggauauaauaaguaggaaagaccaaagaggcaguggacaaguaggaacuuacggauugaauacauuuacaaacauggaagcacaauuaguucgucaaauggagggggaaggcguauuaucgaaagcugacuuagaaaauccgcaucuacuugagaagaaaauaacucaaugguuagagaacaagggaguagagcgucuaaagaggauggcaaucucaggagaugauugcguaguaaaacccaucgacgacagauuugcaaaugcacuacuugcacuaaaugacauggguaagguucgcaaagauauaccacaguggcaaccuaguaaaggguggcaugacuggcaacaagucccauuuugcucucaccacuuucaugaauuaauaaugaaagauggaagaaaauuaguuguaccuugcagaccacaagaugaacugauaggucgggcccgaaucagccaaggggcaggauggagccuaaaggagacugcuuguuuaggaaaggcuuaugcacaaauguggaguuuaauguacuuccauaggagagaccucagauuagcaaguaaugcuauaugcucggcgguuccagugcauuggguaccgacuuccagaacaacauggucaauacaugcacaccaccaauggaugacuacggaagauaugcuagcagucuggaaucgcguauggauagaagacaaucccuggauggaagauaaaaccccuguaaccacuugggaggaugucccauacuuagguaaacgcgaggaucaguggugcgguucauuaauugguuuaacauccagagcaaccugggcgcaaaacauuuugacugcuauccaacaaguucgaucucuaauaggcgaugaagaauuuuuggauuacaugcccucaaugaaacguuucagaaaggaagaggagagcgaaggagcuauuugguaa

SEQ ID NO: 23133 - RNA, 9873 nt, Artificial Sequence
  derived and/or modified CDS sequence (opt6) from DENV-3__FJ639721__SS-prME
acaaguuuauguuugaugaugauguuaccugcaacacucgccuuucauuuaacaucuagagauggcgaaccaagaaugauaguagguaaaaaugaacgagggaaauccuuguuauuuaaaacagcuacgggaauuaauaugugcacguuaauagccauggauuuaggagaaaugugcgaugacacaguaacauauaaaugcccucucauaguagaaguugaaccugaagacauagauuguugguguaaucuaaccucgacauggguaacguaugguacuuguaaccaagcaggagaacauaggagagauaaaagaucgguagcuuuagccccucauguggguaugggcuuagauacccguacucaaacguggaugucugcagaaggggcuuggagacaaguagaaaaaguggaaacaugggcuuuacggcacccaggauuuaccauacuagcuuuauuuuuggcccauuacaucggaaccaguuuaauucaaaaaguaguaauuuucauauuauuaauguuagugacaccuucaaugacaaugcguugcgucggagucgggaacagagauuuuguagaagguuuaucuggggccaccuggguagauguuguccuugaacacggggguugugucacuaccauggcuaaaaacaaaccaacgcuugauauugaacuucagaaaacugaagcaacacaacuagcuacccuaagaaaauuguguauagaagggaaaauaacaaauaucacuacagauagucgauguccuacacaaggugaagcuauacugcccgaagaacaagaucaaaacuacguguguaaacauacuuauguugaucgaggauggggcaauggaugcgggcuguucggaaaaggcucauuaguaacaugugcgaaauuucaauguuuagaacccauagagggaaaagucguacaauacgagaaucuaaaguacacagugauaauaacagugcauacgggagaucaacaucaaguagguaaugauacacaaggugucacaguagaaauuacgccacaggcuucuacuguagaggcgguacucccggaguauggcacuuuaggguuggaaugcucaccccguacaggacuagauuucaaugaaaugauauugcuaacaaugaaaaauaaggcguggaugguucauaggcaaugguucuuugaccucccguuaccauggaccaguggagcaacuaccgaaaccccaacauggaauagaaaagaguuguugguaacauuuaaaaaugcacaugcuaagaaacaagagguaguugugcucggaagucaagagggagcgaugcacacggcguuaacgggugcaacggaaauucaaaauucaggagggacuucgauauucgcuggucacuuaaaguguagguugaaaauggacaaguuggaauugaagggaaugucuuaugcuaugugucuaaauacguuugugcucaagaaagaaguuucugagacacaacauggaacgauccugauuaaaguagaguauaaaggagaagacgcaccauguaagaucccauuuaguacugaagacggacaagguaaggcucauaacggacgucucauaacggcaaauccaguaguaaccaagaaagaagaaccuguuaacauugaagcagaaccgccuuuuggugaaaguaacauagucauugguauuggcgauaaagcucuaaagauaaacugguauaaaaagggauccucaauagggaaaauguucgaagcaaccgcaagaggugcucggcggauggcaauauuaggggauaccgcaugggacuuugguagcgucggagguguauuaaacagucuaggaaaaaugguucaucagaucuuuggaagugcauacacagcguuauuuucuggugugucauggaucaugaagaucgguauuggaguauuacuuacauggaucgguuuaaacucaaagaacacgaguaugucauuuuccuguauagugauaggaauuauaacuuuguaucugggagcaguaguccaagccgacaugggaugcguaauaaauuggaaaggcaaggaauuaaaaugugguaguggaaucuuugugacuaaugaaguucauacauggacugagcaguacaaguuucaagcagacucuccuaagcgucuggcuacggcuaucgccggcgcgugggaaaauggaguaugugggauucgcaguacaacucggauggaaaaucuuuuauggaaacaaauugcuaaugaacuaaacuauaucuugugggagaauaacauuaaacuuacagucguugucggagauauaauuggcgucuuagagcaaggaaaacgaaccuugaccccucaacccauggaauuaaaauacucguggaaaacgugggggaaagcuaaaauagugacggcagaaacucaaaacucaaguuuuaucauugauggcccuaacacaccugaauguccuagugccagccgagcauggaauguaugggaagucgaggauuacggauuuggcguuuucacaacaaacaucugguuaaaacuaagagaaguauauacacaauccugcgaucauaggcuaaugagugcagccauaaaagaugaacgugcagugcaugcagauaugggauauuggauagagucgcagaaaaaugguagcuggaaacuagaaaaagccuccuuuauugagguaaaaaccugcacuuggccgaagucgcacacauuguggaguaauggaguguuggagucggauaugauuauuccaaagucguuggcgggacccauaagccagcauaaucauaggccuggauaucauacacaaacggcagguccauggcauuuagggaaacucgaguuagauuuuaauuacugugaaggaacuacgguggucauaacagaaaauugcggaacaagagguccuucacuucgaacaaccacggucuccggaaaacuaauacaugaaugguguuguagauccuguacacuaccgccguugcgguacaugggugaagacggaugcugguacgggauggaaaucagaccaauaaacgaaaaggaggaaaauaugguaaaaucacuuguuuccgcggguucagguaagguugacaauuuuacaaugggaguguuaugucucgcaauacuuuuugaggagguuaugagagggaaauuugguaaaaagcacaugauugcaggaguauuauucacuuuuguuuuguuauuaagugggcaaaucacguggcgagauauggcccacacauuaauuaugauagguucaaaugccagugaccgaaugggaaugggcgucacauaucuggcacuuaucgcaaccuucaagauacaaccuuuucuaacucuuggguucuuuuugcggaaacuaacaagccgggagaauuugcuuuuagguguuggauuagcuauggcaacuacacuucagcugccugaagauaucgaacaaauggcaaacgguauagcguuaggacuaaugacuuuaaagcucauaacccaauuugagaccuaccaauuguggacagcauuagugucacugacuugcucaaauacgaucuuuacuuuaacaguugcauggagaacagcuaccuugauuuuagcagggguaagucucuuaccacuaugucagaguucuucuaugcguaaaacagauugguuaccaaugacuguagccgcaauggguguuccuccacuaccucuauuuaucuuuucucugaaagaugcuccuaaacguagaucauggccccugaaugaaggcguaauggccguagggcuaguaucgauacuugcaucuagccuacucagaaaugauguaccuauggcagggccgcucguagccgguggauuauuaauugcaugcuauguaaucacaggaacaagugccgaucuaacaguugaaaaagcagcggauguuacgugggaggaagaagcagaacaaacagguguaagucauaauuuaaugauuaccguagaugaugauggaaccaugcgaauaaaagaugaugagacagagaauauucuaacuguacuauuaaaaacggcgcuacuaauaguuucaggaauuuuuccguauaguauuccagcgacgcuauuaguauggcauaccuggcaaaaacaaacccaaagaaguggugucuuaugggauguaccuuccccgccagaaacucaaaaggcugaacuggaagagggugucuaucgaauaaaacaacaaggaauuuuuggaaagacacaaguggggguaggaguccaaaaggaaggggucuuccauacuauguggcaugucacccgaggugcuguacuaacucauaauggcaagagauuagaaccuaauugggcaucugucaagaaagaucuuauuuccuacggugggggcuggcgauuaucaacacaguggcaaaaaggugaagaagugcaaguuauagcggucgaacccgguaagaacccgaaaaauuuucaaacuaugcccgggauuuuccaaacuacuacuggugagauaggagcuauagcucuugacuuuaaacccgguaccuccggaucaccaauaauaaauagagaaggaaaaguagucggauuauauggcaacggcguaguaacgaaaaauggaggauauguaagcggaaucgcucaaacaaacgccgaaccagacggcccaacucccgaguuagaggaggaaauguucaagaaacgaaauuuaacuauaauggacuuacaucccggcuccggaaaaacacgaaaauauuugccugccauuguuagagaagcaauaaaaagacgcuuaagaacauuaauuuuagcuccaacacgaguuguagcagcagaaauggaagaagcacuuaagggauugccaauacguuaucagacaacugccacaaaaucagaacacacgggacgcgaaauuguugaucuaaugugucaugcgacguucacuaugcggcuacugucacccgucaggguaccaaauuauaauuuaauaauuauggaugaggcucauuuuacggacccugccucaauagcagcaagaggguacauaucaacacgcguuggaaugggcgaggcagcagccauauucaugaccgccacgccgccugguacagcugaggcuuuuccgcagagcaaugcaccgauucaagacgaagaaagagacauuccugaaagaucuuggaacagugguaaugaauggauaaccgacuuugucggcaaaacaguaugguuuguucccagcauuaaagcggggaacgauauagcaaacugcuuacggaaaaaugguaaaaaggucauacaacuauccagaaaaacauucgauacagaauaucagaaaacgaggcugaaugauugggacuuuguugucacuacagacauaucagaaaugggcgcaaacuucaaagccgacagaguaauagauccgcggcguuguuuaaaaccgguaauacuuacugauggaccggaacgugucauuuuagcaggaccuaugccgguaacagccgccucggccgcacagcggcgagggcgugugggacgaaauccacaaaaagagaacgaucaauauauauuuacuggacaacccuuaaauaaugacgaggaccaugcucauuggacggaggccaaaaugcuauuagacaacauaaauaccccagaaggaauuauuccagcacuuuuugaaccggaaagggagaaaagcgcggccauugauggggaauaccgucucaaaggcgaaucuaggaaaacuuuuguggaguuaaugcgccgaggggacuuacccguuuggcuggcacauaagguggcaagcgagggcauuaaguauacagauagaaaauggugcuuugacggcgaacgcaauaaucaaauauuagaagaaaauauggacgucgagaucuggacaaaggaaggagaacggaagaaacuacgcccaagaugguuagaugcucgcacuuauagugacccauuagccuuaaaggaauuuaaagacuuugccgcggggcguaaaucaauugcucuggaccuugucacagaaaucgguagagugcccucccaucuagcccaccguacacguaaugcauuagacaacuuaguaauguuacauacuucagaacauggagggagagcguaucgacacgcuguugaagaacucccagaaacaauggaaacucuucuucuucuaggguugaugauacuucugacuggaggugccaugcuauucuuggucuccggaaaggggauagguaaaacaacuauuggacucaucuguguaauaguauccucgggaauguuauggauggcagacauuccauuacaauggauagcauccgcgaucguauuggaguuuuucaugaugguuuuauugaucccggagccagaaaaacaaagaacaccucaagacaaucaacuugcuuacguagugauagggauuuuaacccucgcggcaauaguggcagcaaaugaaauggguuuauuagaaacuacuaagagagacuuggguaugucaaaagaaccaggcgucguuucgccaacaucauacuuagauguggaccuucauccagccuccgccuggacccuuuaugcaguagcaacaacaguuauuacaccaauguuaagacacacaauagaaaacucaacagcaaauguaucauuagcagccauagcgaaucaggccgucguauugaugggcuuagauaaaggauggccgauuaguaaaauggauuuaggcgucccuuuguuagcccuagguugcuauucgcaaguaaauccguuaacgcuaacugcagcagucuuauuacuggucacacacuaugccauaauagggccuggcuuacaagcaaaagcaacacgugaagcacaaaagagaacagcugccggaaucaugaagaauccaacgguagacggcaucaugacaauagauuuagauccgguaauauacgauaguaaguuugaaaaacaacuuggccaaguaaugcuguuagugcugugcgcaguacaacuuuuauuaaugagaacuucaugggcguuaugcgaagcgcucacauuagcuacagguccuauuacuacucuaugggagggcuccccugguaaguuuuggaauacaacaauagcgguuaguauggcaaauauuuuucgagguagcuaccucgcaggcgcuggacuugcuuucucuauuaugaaauccguggguacaggucgaagaggaacggggucacaaggagagaccuuaggcgaaaaauggaaaaagaaacucaaucaacuuaguagaaaagaauuugacuuauacaagaaaagugggaucaccgagguggaccgaacugaagcuaaagaaggacuuaagcgaggagaaacuacacaucaugcaguaucaagaggauccgccaaauuacaaugguuuguagaaagaaacaugguuauuccagaaggacgaguaauagacuuagguuguggacguggaggguggucauauuacugcgcaggacuuaagaaaguaacugagguaaggggauauacaaaaggaggccccgggcacgaagaaccaguaccaaugagcacauacggauggaauauuguaaaguuaaugucagguaaagaugucuucuauuuaccgccugaaaagugugauacucuauuaugugacauaggugagucaaguccaagcccaacaguagaggaaucgaggacaauccgugucuuaaaaaugguagaaccauggcugaaaaauaaccaauuuugcauuaaaguguuaaauccauacaugccgaccgugauagaacauuuagaaagacuccagagaaaauacggagguaugcuuguucguaauccuuuaucucggaacucuacacaugaaauguauuggauaaguaacggaacuggaaauauagucaguucaguaaauaugguaucgagacuacuacuaaaucgauucacaaugacgcacagaagaccaacaauagaaaaggacguagauuugggggcgggaacccgucaugucaacgcagaaccggaaacaccaaauauggacgucauuggugaaagaauaaaaagaauaaaagaagaacacagcucuacuuggcacuaugaugacgaaaaucccuauaagacaugggcauaucacgggaguuaugaaguaaaagcuacagggagcgccucaucgaugaucaacggaguagugaaacuauuaacuaaacccugggaugucguaccaaugguaacccaaauggcaaugacggacacuacuccauucggacaacagcgagucuucaaagaaaaaguugacacacguacuccacguccuaugccaggcacacggaaagugauggaaauuacggcggaaugguuauggcguacacuggguagaaauaaaaagccaagauuaugcacgagagaggaauuuacuaagaagguuagaacaaaugcagccaugggcgcuguauuuacagaagaaaaucagugggacucagcgagagcagcgguagaagaugaagaguucuggaaacuugucgaucgugagcgugaacuacacaaacuaggcaaaugugggaguuguguuuauaacaugauggguaaacgcgagaagaaacuuggagaauuuggcaaagcaaaagguucacgagcgaucugguacaugugguuaggagcuagauuucuagaauuugaagcacucgguuuucuaaaugaagaccauugguucucaagagaaaauucguauagcgguguugaaggagagggucuccacaaguuagguuauaucuuaagagauauaagcaaaauucccggaggggcgauguacgcggaugacaccgccgggugggacacgaggauuacagaggacgaccuccauaaugaagagaaaaucacacaacaaauggauccggagcaucgccaguuggcuaaugcaauauuuaaauugacauaccagaauaaaguagugaaagugcaaagaccuacacccaaaggaacagucauggacauaauaaguagaaaagaucaaagagguucuggacaagucgggaccuacggguugaauacguucacaaauauggaagcacaguuaguacgacaaauggaaggagaaggaguuuuguccaagacagaccuagaaaauccucaccucuuagagaagaaaaucacgcaaugguuggagaacaaaggagucgaaagauugaaaagaauggcuauaucuggugacgacugcguaguaaaaccaaucgacgauagguucgccaacgcauuauuagcucugaacgauauggggaaaguccgcaaagauauuccacaauggcagccaaguaagggauggcaugacuggcaacagguacccuucuguagucaccauuuccacgaguuaauuaugaaagauggcagaaaguugguaguuccgugucgaccccaggaugaacuuauugggagagcacguauaucccagggagcggguuggagucucaaggaaacagcuugccuuggcaaggcguaugcacaaauguggucgcuuauguacuuccaucgccgugauuuaagauuagcgucuaaugccauauguucggcuguaccggugcacuggguacccaccaguaggaccacuuggucaauucaugcgcaucaucaauggaugacaacggaagauauguuaaccgucuggaaucgugucuggauagaagacaacccauggauggaagauaagacaccuguuacgacaugggaagaugucccuuaucuagguaaacgugaagaccaaugguguggaagucucauagguuuaacaucaagggcuacaugggcacaaaauaucuugaccgcgauacaacaaguaaggaguuuaauaggggaugaagaguuccuagauuacaugcccucuaugaaaagauuuaggaaggaagaagaaucagagggagcuauaugguag

SEQ ID NO: 23134 - RNA, 9873 nt, Artificial Sequence
  derived and/or modified CDS sequence (opt6) from DENV-3__FJ639722__SS-prME
acuucucuaugccuaaugaugaugcuaccugcaacauuagcauuucauuugacaucuagagacggagaaccaagaaugauuguggguaaaaaugaaagaggaaaaucauuacucuucaaaaccgcuacaggaauaaacauguguacucuaauagcuauggacuuaggagaaaugugugaugauaccgucacuuauaaaugcccguuaauagcggaaguugaaccggaagauauugauuguugguguaaucucacauccacaugggugacguauggaacauguaaucaagcaggcgagcacagacgggauaaaagaagcguagcacuagcuccucacguugguaugggucuugacacuagaacccaaacauggaugucagcagaaggagcauggagacaagucgaaaaaguagagacaugggcccuucgacauccaggauuuacaauauuagcucucuuucuagcccauuauauugguacuagcuuaauucaaaaagugguuauuuucauauuacucaugcuagucacgccaagcaugaccaugcgcuguguagggguggggaauagagacuucguagaagggcugagcggugcuacauggguagacgugguucuagaacacggaggaugcgugacaacuauggcuaaaaacaaaccuacgcucgacaucgaacugcagaaaacggaagcaacacaauuggcgacauuaagaaaacuuuguauagaaggaaaaauaacaaacauaacuacugauagcagaugccccacacaaggcgaagcaauacuucccgaagaacaagaccagaacuacguauguaaacacacauacguugauaggggaugggguaauggguguggauuauuuggaaaagguucacuugucacaugugcgaaauuccaguguuuagagcccaucgagggcaaagucguacaguaugaaaacuuaaaauacacuguaauaauuacgguccacacaggugaucaacaccaaguggguaacgacacgcaagguguaacaguugagaucacgccacaggcaaguaccguugaagccguacuucccgaauauggaacccuaggucuugaaugcaguccacgcacuggauuagacuucaaugaaaugauccuccuaacaaugaaaaacaaagcauggauggugcaucgucaaugguucuucgaccuuccauugccuuggacaucuggagcaacaacugagacaccgacauggaauagaaaagaauuguuaguuacauuuaaaaacgcgcacgccaagaaacaagaggucgucguguugggaucacaagaaggagcuaugcauacagcuuuaacaggugcaacugaaauucaaaacaguggaggaacgaguauuuuugcuggucauuugaaaugcagauugaaaauggacaaacuagaguugaaagguaugagcuaugccaugugccucaauaccuucguuuuaaagaaagaaguaucggaaacacaacacggaacuauucuuauaaaaguagaauacaaaggagaagacgcaccauguaaaaucccauucucuacggaagacggacaaggaaaagcacacaaugggcgacuaauuaccgcaaauccugucguaaccaagaaagaagaaccagucaauaucgaagcagagccuccguucggcgaaucaaacauaguaauugguauuggggagaaagcacucaaaauuaacugguauaagaaagggaguucaauaggaaaaauguuugaggcaaccgcgcgcggagcacgucgcauggcaauacuuggggauacugcaugggauuucgguucaguuggagguguauuaaauagccuaggaaaaaugguacaucagaucuucggcagcgcuuauacugcauuauucucgggaguuuccuggaucaugaaaauuggaauuggaguuuuguugacauggauuggacuaaauagcaaaaauacgucgaugucguuuucauguauagucauuggaaucauuacccuguacuugggcgcaguaguccaagcugacaugggaugcguuaucaacuggaaagggaaagaguuaaaaugcgguucaggaauauuuguuacaaaugagguucacacguggacugaacaauauaaauuucaagccgauaguccuaaaagacuggcaacugccauagcaggcgcaugggagaauggcgucugcgggauaagaucaacaaccagaauggagaaucuauuguggaaacaaauagcgaacgaguuaaauuauauucuaugggagaacaauauaaaacugaccguugucguaggcgacauuauagggguucuagaacagggaaaaaggacuuuaacuccucaaccaauggagcucaaauacucauggaaaaccuggggaaaagcaaaaauagucacagcagagacgcagaacagcagcuucauaauagacgggcccaacacaccugaauguccaucugccucacgugcguggaacguuugggaggucgaggacuacggauucgguguauuuaccacuaauaucugguugaaauuacgagaaguguacacccaaagcugugaucauagguuaaugagugcagcaauaaaagaugaaagagccguucacgcugauaugggauacuggauagaaagucagaaaaauggauccuggaaacucgaaaaagcaaguuucauagagguuaaaacuugcacauggccuaaaagccauacucucuggucaaacgguguacuagaaagugacaugauaauaccaaaaaguuuagcaggcccaauaagucaacacaaucauagaccuggauaccauacccaaaccgcgggucccuggcaucuugguaaacuagaacuagauuucaauuacugcgaaggaacuacaguuguuauuacugaaaauuguggaacaagaggcccaaguuuacggacuacaacaguuucaggaaaauuaauucaugaaugguguugucgaagcuguacacucccgccacuccgcuacaugggugaagaugguugcugguacgguauggagauuagaccgauuaacgaaaaagaggaaaauaugguuaaaagccugguaagugcggguucuggcaaagucgauaacuuuacaaugggugugcuuuguuuggccaucuuauuugaagaaguaaugcgugguaaauuuggaaagaaacacaugaucgccggcguacuauuuacguucguacuauuauuaaguggacaaaucaccuggagagacauggcucauacauugauaaugaucgggucaaaugccuccgaccgaaugggaaugggaguaacuuacuuggcucuaauagcaacuuucaaaauacaaccguuuuuagcauuaggauucuuucuuagaaaacuuacuucucgggaaaauuuauuacuaggaguuggacuugcaauggcuaccacguuacaauuaccagaagacauagaacaaauggcaaacggcauagcauugggccuaaugacacucaagcuaauaacacaguuugaaacauaucaauuguggacugcucugguuucucuuacuuguucuaauaccauauucacauuaacaguugcuuggaggaccgcaacuuuaauacuagcaggaguuucucucuuaccgcugugucaaucaucaucuaugcgaaaaaccgauuggcuaccuaugacuguugcggcaaugggugucccuccacugccacuauucaucuuuagucucaaggaugcuccgaaaagaaggucuuggccguugaacgaaggcguaauggcgguggggcuuguaucuauacuagcaagcucuuugcuacggaacgauguaccaauggcaggcccguuaguagcagggggucucuugauagcuugcuacguaaucacaggcacaagugccgacuuaaccguagaaaaagcagcugauguaacuugggaagaagaagcagaacagacaggugugucucacaaucuuaugauuaccgucgacgaugaugggacaaugagaaucaaggacgacgaaacagaaaauauauuaacuguguuacuuaaaacagcucugcugauaguaucggguauauuucccuauaguauaccagcgaccuuauugguguggcacacuuggcaaaagcaaacucaaagaucaggagucuugugggauguaccaagcccacccgagacucagaaggcagaguuggaagagggugucuauagaauuaaacaacaaggaauuuuuggaaaaacacaagucgggguagguguucagaaagagggcguauuucacacaauguggcauguaacaagaggugcaguccucacucacaauggaaagaggcuagaaccaaacugggcgucggugaagaaagacuuaauaucauauggaggaggcuggagauuaagcacacaauggcaaaagggugaggaaguucaagugaucgcuguagagcccgguaaaaacccgaaaaacuuccaaacgaugccggggauauuucaaacaacaacaggcgaaaucggugcuauagcauuagauuuuaaaccgggaacaagugguaguccuauuauuaaucgcgagggaaaagucguggguuuauaugguaauggaguaguaaccaaaaauggaggcuaugucaguggcauugcucagaccaaugcugagcccgaugggccaacaccugaacuggaagaagagauguucaaaaagcgcaaucuuaccauaauggauuuacacccggggaguggaaagacuagaaaauaccucccugcuaucgugagagaagcuauaaaacgaagacuccguacacuuauuuuggcuccgacacgaguaguagccgccgaaauggaagaggcauuaaagggauuacccauacguuaucaaaccacggcaacuaaaagcgaacauacaggaagagaaaucgucgaucuaaugugccaugccacauucacaaugagacuauuaagcccaguacgagugccgaauuauaaucugauaauuauggaugaagcccauuuuacagacccagccucuauagcugcccguggauauauaucuacaagagugggaaugggagaagcugcagcgauauuuaugaccgcaacacccccagguacugcagaagcauuuccacaauccaacgcgccaauccaagaugaagaaagggacauccccgagcguucguggaacuccgguaaugaauggauuacggacuuuguggguaaaacaguaugguuuguuccgucgaucaaagcuggcaaugacauagcuaauugucuuaggaaaaacgggaagaaagucauccaacuuucaagaaagacuuuugauacagaauaucagaaaacgcggcuuaacgauugggacuucguuguuacuacugacauaagugaaaugggagcuaauuuuaaggcugacagagugauugauccacgaagaugcuuaaaaccugucauuuugacggauggcccggaaagaguaauuuuagcuggaccaaugccugugaccgccgccucagcggcucagcguagaggucgaguaggacgaaacccacaaaaagaaaaugaucaauacauauucaccggacagccccuaaauaacgaugaggaucaugcacauuggacugaggcaaaaaugcuuuuggacaauauaaauacuccagaggguaucauuccagcucucuucgaacccgaacgagagaagucugcugcaauagacggagaauaccgcuuaaaaggcgaaaguagaaaaacuuucguugaauuaaugagaagaggugauuugccaguaugguuagcccauaaagucgcgagugaaggaauuaaauauacggacaggaaaugguguuuugauggugagagaaacaaccaaauauuagaagaaaauauggauguugaaaucuggacaaaggaaggcgaacgcaagaaacugcgaccccgauggcuagacgcaagaacuuacucagauccacuugcuuuaaaggaauuuaaggauuuugcagcaggcaggaaaucuauagcacuagaucucguuaccgaaauuggcagaguccccagucaucuggcacaucguacuaggaaugcucuggacaaucugguaauguugcauacaagugagcacggcggucgcgcauacagacacgcagucgaagaguugccggagacaauggaaacucuacuguuacuaggacugaugauacuauugacaggcggggcuauguuguucuuagucagcggaaaagguauagggaaaacaacgauagguuugauaugugucaucgucucgucaggaauguuauggauggcagacaucccacuccaauggauugccagugcaaucguguuggaguucuuuaugaugguccugcucauaccagagcccgaaaagcaaagaacgccacaagacaaccagcuagcauauguagugauaggcauucugacucucgcugccauugucgcugccaaugagaugggacuacuagagacaaccaaaagagaccucggaaugucgaaggaacccggaguggugucacccacgucauaccucgauguagauuuacauccggcaagcgcuuggacauuauaugccguugcuacaacagucauaacgccuauguuaagacauacaaucgaaaacuccacagcuaauguaagucuggcagcaauagcaaaucaagcagugguucuuaugggauuagauaaagguuggccuaucucuaaaauggacuugggaguaccgcuguuggcgcuaggcuguuacucacaagugaacccucuaacacucaccgcggcaguuuuacuauuagucacucacuaugccaucauuggcccaggauuacaagcuaaagcaacucgagaggcacaaaaacgaacggcggcagguaucaugaagaacccgacaguagaugguauuaugacaauagacuuagaccccguuaucuaugauucaaaauuugaaaagcaacuuggacaaguuaugcuccuagucuugugcgcuguucaguuauuauuaaugcgaacaagcugggcauuaugcgaagccuuaacccuugcgacaggaccuauaaccacauuaugggaagguucaccaggcaaauucuggaacacgacaauugccgucaguauggcaaauaucuuuagggggucauaccuggcaggagcuggacuugcuuucaguauaaugaaaagcguagguacaggacgacggggcacaggcagucaaggcgagacucuaggagaaaaauggaagaagaaacuuaaccaauuaucaaggaaggaguucgaucuuuauaagaaaagcggaauaacggagguagaucgaacugaagcaaaggaaggauugaagcgaggagaaacaacacaucaugcaguaaguaggggaagugcgaaacuacagugguuuguugaaagaaauaugguaauacccgagggucgggugauagaucuugggugcgguagaggaggauggagcuauuauugugcaggucuuaagaaaguuacggagguuaggggauauacgaagggagggccaggucacgaggagccagugccaaugucaacuuacggcuggaauauagucaaacuuaugucaggcaaagauguuuucuauuuaccaccagaaaaaugcgauacauuauuaugcgacauaggagaaaguucgcccucaccgacuguagaagaaucucgcacuauaagaguauuaaaaauggucgaaccauggcucaagaacaaucaauuuugcauaaaagugcuaaacccauauaugccaacaguuauagagcauuuagaacgauuacaaagaaaauauggagggaugcuagucagaaauccguuaucccgaaauaguacucaugaaauguacuggaucucaaaugggacuggcaauaucguguccagcguuaauaugguuagucgucuauuacuaaauagauuuaccaugacacacagacgcccuacuauugaaaaggauguugacuuaggagcaggcaccaggcaugugaaugcggagccagaaacaccaaauauggacgugauaggcgaacggauuaaacgcauuaaagaagaacacucuaguacauggcauuaugacgaugaaaaucccuacaaaacaugggcauaccacggcucauaugaaguaaaggcgacaggaagcgccaguagcaugaucaacgggguggugaaacuguuaacgaaaccuugggauguaguaccaaugguuacacaaauggcaaugacagauaccacuccauuuggucaacaaaggguauucaaagaaaaaguggauacucgaacuccgagaccuaugccugguaccagaaagguuauggaaauuacagcagaguggcuauggcguaccuuagggaggaauaagaaaccacggcuuuguacaagagaagaauuuaccaagaaaguaagaacuaaugcagcgaugggugcggucuuuacagaagaaaaucaaugggauagugccagggcagcagucgaagaugaagaauuuuggaagcugguagaucgugagagagaauuacacaaauuaggaaaaugugggucaugcgucuauaauaugaugggaaaaagagagaagaaacuaggggaguucggaaaagcaaaaggaucaagagcaauuugguacaugugguuaggugcaagauuccuggaguucgaggcacuugguuucuugaaugaggaccauugguucuccagggaaaauagcuauaguggugucgagggagagggacuucauaagcucggauauauuuuaagggauauuucuaagauaccuggaggagcgauguacgcugacgacaccgcaggaugggacacucguauuacggaggacgaccuucacaaugaagagaaaauuacccaacaaauggacccagaacaucgacaacucgcaaaugccauuuuuaaauuaacuuaucaaaauaaggucgugaaaguacagagaccaacgccaaagggcacaguaauggauauuauaucucgcaaagaucaacgaggaucgggucagguaggaacuuacggacuuaauaccuucacaaacauggaagcccagcucgucagacaaauggaaggagaagggguacuaaguaaaacggacuuggagaacccacaccuuuuagagaaaaagauuacccaauggcuagagaauaaggguguagaaagacuuaaacguauggcuauaagcggagacgacugcguaguaaaaccuauagacgauagauuugcaaacgcauuacuagcauuaaaugauauggggaaagucagaaaagauauuccgcaauggcaacccaguaagggauggcacgauuggcaacagguaccauuuugcagccaccacuuucacgagcuaauaaugaaagacgguagaaaauuagucgucccgugucggccacaagacgagcuaaucggcagagcacgaaucucucagggggcaggcuggagucuaaaagagacugccuguuuggggaaagcauaugcucagauguggucguugauguacuuucauagaagagaccuacgauuagcuagcaaugcaauuuguagugcggucccggugcauugggugccuacgagucgcacaaccuggagcauucacgcacaccaccaauggaugaccacagaagauaugcuaacaguauggaauagaguuuggauugaagauaaucccuggauggaagacaaaacgccuguuacaacaugggaagauguaccuuacuuaggaaaaagggaagaucaauggugcgggagccuaauaggauuaaccagccgcgcuacaugggcucagaacauuuuaacagcuauacaacaaguucggagccuuaucggagaugaggaguuuuuagacuacaugccuucaaugaaaagauucagaaaagaagaagaaagugaaggugccauaugguaa

SEQ ID NO: 23135 - RNA, 9873 nt, Artificial Sequence
  derived and/or modified CDS sequence (opt6) from DENV-3__FJ639723__SS-prME
acaucauuaugcuuaaugaugauguuaccggcuacuuuagcauuucaccuuacaucaagagauggagaaccgcgcaugauagucgguaaaaaugaaagaggaaaaucgcuccuuuuuaaaacagccacaggaaucaacaugugcacacuaauagccauggauuugggagaaaugugcgaugauacgguaacauauaaauguccacuaauagcagaaguggaaccugaagauauagacugcuggugcaaccugaccagugcguggguaaccuacggaacaugcaaucaagcaggagaacaccgccgugauaaaagaucaguagcacuagcgccucacguagguaugggucuagauacgcguacacaaacuuggaugucagcagaaggagcguggcgucaaguugaaaaaguagaaaccugggcucuuagacauccgggguuuacuauccuagcuuuauuucuagcucacuacauagguacaaguuuaauucaaaaaguaguaauauucauuuuguuaaugcucgugacaccuaguaugacgaugagguguguaggggugggaaauagagacuuuguugaaggacuaucaggagcuacauggguagauguaguguuagagcacggaggcugcgugacuacaauggcuaaaaacaaaccgacacuagauauugaacuccagaaaacagaagcaacacaacuagcaacguugagaaaacuguguaucgaagggaaaauuacgaauaucacaaccgauaguagauguccaacacaaggcgaggcaauuuugccagaagaacaagaccaaaauuauguguguaaacauacauacguagaccgcggcuggggaaacggcugcggauuguuugguaaaggaucuuuggucacgugugcaaaauuccaaugucuggaacccauagagggaaaaguuguccaauacgaaaauuuaaaauauacaguuauuaucacgguacacacgggagaucaacaucaaguaggaaacgacacacaaggaguaacaguagaaauuaccccacaggcaucaacugucgaagcaguauuaccagaguacggcaccuuaggccuggaauguaguccuagaaccgggcuagauuucaaugaaaugaucuuacuuacaaugaaaaauaaggcuuggaugguccauaggcaaugguucuucgauuuaccuuuaccuuggacuucuggagcaacaacggaaaccccgacauggaaucguaaagaauuauugguuacguucaaaaaugcucacgcgaagaaacaagaagugguaguuuugggaucacaagaaggagcaaugcacaccgcguuaacaggggccacagagauacagaauagugggggaacuucaauuuuugcgggccaccugaaaugccgauuaaaaauggacaaauuagaacucaaagggauguccuaugcaauguguuuaaacacguuuguuuuaagaaaagagguuagcgaaacacaacauggaacgauauuaauuaaaguagaauacaaaggggaggacgcuccauguaaaauuccauuuucaaccgaggacggccaaggcaaagcucacaauggacgucuuauaacagccaacccaguaguuaccaagaaagaagaacccgucaauauugaggccgaacccccuuucggggaaucuaauaucguuauuggaauuggugauaaagcacuaaaaauaaauugguauaagaaaggauccucaauuggaaaaauguucgaagccacugcaagaggugcgcgacgaauggcuauuuuaggugauacugcaugggauuuuggcucagucggaggaguguuaaauucacuaggcaaaaugguacaccaaaucuucggguccgcuuauaccgcacuauuuuccgguguuucuuggaucaugaaaauugggauagggguuuuauuaacauggauuggucuaaauagcaaaaacaccagcaugaguuuuucuuguauaguaauaggaauuauuacacuguaucuaggcgcugugguucaagcagacauggggugcguaauaaauuggaaaggaaaagaauugaaaugugggucuggaauauuuguuacuaacgaaguacacaccuggaccgaacaguacaaauuucaggccgacaguccaaaaagguuggccaccgcaauagcaggagcaugggaaaaugguguuugugggaucagauccacgacgcgcauggagaauuuauuauggaaacagauagcuaaugaacucaauuauauccuuugggaaaauaauauaaaacuaacagucguaguuggugauauaauaggcguucucgaacaaggaaaaagaacucuaacuccacaacccauggaacuuaaauauucuuggaaaacguggggaaaagccaaaauaguaacagcagagacacaaaacagcuccuuuauaauagaugggcccaacacaccugaguguccaagugcaucgcgggcauggaauguuugggaggucgaggauuacgguuuuggcgucuuuacaacuaauauuuggcuaaaauuacgugaaguauacacacaaucuugugaccaucgucuaaugucugcugcaauuaaagaugaaagggcaguacaugcagauaugggauacuggauugaaucacagaagaauggcucguggaaauuagaaaaagcaaguuuuauagagguaaaaaccugcacauggccgaaaucacauacauuaugguccaaugguguacuggagucagauaugauuauuccaaaaagucucgcagggccaauaucgcagcauaaucaccgacccggauaucauacacaaacagcggguccuuggcacuuagguaaacucgagcucgauuuuaauuauugcgaaggcacuacuguagucauuacagagaauugcgggacuagggguccguccuuaaggacaacaacaguaucuggaaaauugauacacgaaugguguugucguucuuguacguuaccuccauugcgauacaugggagaggacggcugcugguacggaauggaaauacgaccgacuaaugaaaaggaagaaaauaugguuaaaucuuuaguaagugcuggcagugggaaaguagacaacuuuacuauggguguucuaugucuagcuauccuauucgaagaagugaugagagguaaauucggaaagaaacauaugauagcaggaguacuuuuuacuuuugucuuacuguugucgggacaaauuacuuggagggacauggcacauaccuuaauaaugauaggcagcaacgcaagcgauagaauggguaugggaguaacuuaccuagccuuaaucgcaacauucaaaauccaaccguuuuuggcuuuaggguuuuucuuaaggaaauuaacaagcagagaaaaccucuuguuggggguuggguuagcgauggcaacuacucuacaacuucccgaagauauagaacaaauggccaacggaauugcacuuggacuaaugacacuuaaacuaauaacucaauucgaaacguaccaguuguggacggcuuuaguaucgcugacguguuccaacacgauuuuuacccucacaguagcauggcgaacugcgacucuaauucuggcagggguaaguuuauugccucugugucagucaucauccaugagaaagacugauuggcuaccuaugaccguggcggcaaugggaguuccacccuuaccucuguuuauauuuaguuuaaaggauacuccgaaaagaaggucauggccucugaacgaagguguaauggccguuggucuugucaguauacuugcuucuagucuacuucggaacgauguccccauggcaggacccuuaguggcaggaggguuacuaauagcuugcuauguuauaacagggacaucagcagaccuaacgguggaaaaagcagcggauguaacaugggaagaagaagcagaacaaacaggugucucccacaauuuaaugaucacggucgaugacgauggaacaaugagaauuaaagacgaugaaaccgagaacauuuugacaguuuuacugaaaacagcauugcuuauugugucaggaauauuucccuacaguaucccagcuacguuguuaguauggcauacuuggcaaaaacaaacucagcgaucuggaguucucugggauguaccaucaccaccagaaacucaaaaagcagaguuagaagaaggaguguauagaauaaaacagcaaggaauauucgggaaaacucagguggguguaggagugcaaaaggagggaguauuccauacuauguggcacguaacccgcggggccguguuaacacauaacgggaagagauuagaaccuaacugggcuucagugaagaaagaucugauuucauacggcggugguuggagauuaucaacccaguggcagaaaggagaagaaguccaggucauagcaguagagccaggcaaaaauccaaagaauuuucagaccaugccagguauauuucagacgacuacaggagagauaggugcaauagcauuagauuuuaaaccuggaacaucggguucaccgauaauaaaccgugagggaaaagugguaggucuguacgguaaugguguggucaccaaaaacggagguuacgucucggguauugcucagacgaaugccgaaccugauggaccgacuccugaacuugaagaagagauguuuaagaaaagaaaucuaacaauaauggaucuacacccuggaucaggcaagaccagaaaguaccuuccugcaauuguaagagaagcaauaaagcgaagauugcguacacuuauucucgcaccuacacgcguaguagcugcagaaauggaagaagcucuaaaggguuuacccauacgauaccaaacgacagcuacaaagagugaacauacgggacgugaaaucguagaccuaaugugccacgcuaccuuuacuaugcgacuccuuagccccguucgcgucccgaauuauaaccuaaucauaauggacgaggcacacuuuacugacccggcaucaauagcagccaggggguacauaucgacacgagucgguaugggugaagcugcugcgauauuuaugacugcaacaccacccgggaccgcagaggcuuucccacagucaaacgcgccuauccaagaugaagaacgggauauaccagaaagaaguuggaacagugguaaugaauggauuaccgauuuugucggcaaaacaguaugguucguacccaguauaaaagcagguaacgacaucgcaaacugucuuagaaagaauggcaagaaaguaauacaacucucucgcaagacuuuugacacugaauaccagaaaacacguuuaaaugauugggauuuuguuguaacuacugacauaucagaaaugggugccaauuucaaggcugauagaguaauagacccaaggagauguuuaaaaccagucauucuuacggacggaccagaaagggucauacuggcaggucccaugccaguuaccgcagcaucagcggcacaaagacgagggagaguuggaagaaacccccaaaaagaaaacgaucaauacauauuuaccggacaaccccuaaauaaugaugaagaucacgcacacuggaccgaagcuaaaaugcuguuagacaauauuaauacaccugagggaaucauaccggccuuauuugagccugaacgugaaaagucagcagcaauagacggagaauauagguuaaaaggagaaucacguaagacauucguagaauuaaugcgacgaggagaucuaccaguauggcuugcguacaaaguggcgucggaaggcauaaaauacacugauaggaaaugguguuuugacggagaaagaaacaaucaaauucuagaagaaaauauggacguggaaauauggacuaaagagggagagaggaagaaacuacgaccuagguggcuagaugcaagaacauauagugaccccuuggccuuaaaagaguucaaggacuucgcagcaggaagaaagucuauagccuuagaccuaguaaccgaaauaggucguguuccuagccacuuagcucaccgaacaaggaaugcccucgauaaucucguaauguugcauacuucagaacacgguggcagagccuauaggcacgccgucgaagaacucccggagaccauggaaacuuuguuauuauugggccuaaugauauuacuuacaggaggugcuauguuauuuuugaucuccgggaaggggauaggaaaaaccacaaucggccuaauauguguaauaguaaguucaggaauguuauggauggcggacaucccccuacaguggauugcaucugcgauaguucuagaauuuuucaugaugguucuccugauaccugagccagaaaagcaaaggacuccccaagauaaucagcuugcuuacgucgucauaggaauauuaaccuuggccgccaucguagcagcaaacgaaaugggauuacuagagacaacuaaacgugaccuagggaugucaaaagagccaggagugguaucgccuacuucauaucuugaugucgaucuacauccagcgucagcauggacacuauaugccguagcaacaacaguuauaacucccaugcuaaggcacacuauagaaaacaguacugcuaacguaagccuagccgcuauagcuaaucaagccgugguacugauggguuuagacaaaggauggcccauaaguaaaauggauuuaggaguuccacuccuagcuuuaggaugcuauucacaaguuaauccgcuaacacuaacagcagcaguccugcuacucgucacucacuaugccauuauaggaccuggauugcaagccaaagccaccagagaagcacagaaaagaacagcagcaggaaucaugaagaacccaacaguagauggaaucaugacaauagauuuagauccggugaucuaugauucaaaauuugaaaaacaguuaggccaaguuauguugcuuguucugugcgccguccaacuguuacuuaugcgaacaucaugggcucuuugcgaagcccuaacacuagcaacggguccuauaacuacccugugggaaggaucuccaggaaaauuuuggaacaccacaauagcagucaguauggcaaauauuuuucgcggaagcuaccuagcgggagcaggacuagccuuuagcauuaugaaaucaguagguacaggaagaagggguacagggucccagggagaaacgcuuggagagaaauggaagaagaaacucaaccaacucagucguaaagaauuugauuuauacaagaaaucagggauaacggaaguugacagaacugaagcaaaggaagguuuaaaacggggugaaacuacacaucacgcaguuaguagaggaagcgcaaaauuacaaugguucguggagagaaauaugguaaucccugaaggacgaguuaucgauuugggguguggucgugguggguggucauauuacugugcgggacucaagaaagucacagagguccgaggcuauacuaaaggaggaccaggacaugaggagccugugccuaugaguaccuacggguggaauaucguaaaacuaaugagcggcaaagacguguuuuauuuaccaccagaaaaaugugacacacuucuaugugauauaggugaaagcucaccuucaccaacaguggaagaaucacguaccaucagaguguuaaaaaugguugaaccauggcugaaaaauaaccaauuuuguauaaaggugcuaaacccauacaugccaaccguaauugaacaucuagaaagguuacagcgcaaauacggugggaugcucguacgaaauccgcuguccagaaacuccacucacgaaauguacuggauauccaaugguacaggaaauauaguaucaucaguuaauauggucuccagauuauuauugaauagauucacaaugacccaucgacguccgacaaucgaaaaggacguagauuuaggagcagguacaagacauguaaaugccgaacccgaaacaccuaacauggaugugauaggagaacgcauaaaacguauaaaagaagaacauaguucuacauggcauuaugacgaugaaaauccuuacaaaaccugggcauaucacggaucguacgaagucaaggccacuggcagugcaucuaguaugaucaacggagugguuaaauuacugacaaagccuugggauguaguuccuaugguaacccagauggcaaugacggacaccacgccauuuggccaacagagaguuuucaaagaaaaaguagauacucgcacaccacguccaaugcccggaaccagaaagguaauggaaaucacugccgaauggcuauggcguacguugggccguaauaagaaaccccgccuaugcacgagagaagaauuuaccaagaaaguuagaacuaacgcugccaugggagccguguuuacggaggagaaucaaugggacagugcacgagcugcugucgaagaugaagaauuuuggaaauuaguagacagagaaagagaacuacauaagcuagguaaaugcggcaguuguguauauaauaugaugggcaaaagagagaagaaacucggcgaguuugguaaagcgaaagguagccgagcuaucugguacaugugguuaggugcgagauuccucgaguuugaggcacuuggauuucucaaugaagaucacugguuuucacgugaaaacuccuauucaggagucgaaggugaaggacuacauaaacucgguuauauacuaagagauaucucuaaaauuccaggaggcgcuauguaugcggacgauacagcaggcugggacacaagaauaacagaggaugaucuacauaacgaagaaaagauaacacaacaaauggaccccgaacauaggcaauuagcaaaugcaaucuuuaaauuaacuuaucaaaacaaagucgugaaaguacaaagaccaacuccgaaaggcacuguuauggacauuauaucaagaaaagaucagaggggcaguggucagguaggaacguauggauuaaauaccuucacaaauauggaagcucagcuaguucgucagauggagggugagggcguauuauccaaagcagaccuagaaaacccacaccuucucgagaagaaaauuacgcaauggcuagaaaauaaagggguagaacgccuaaagcggauggcgauuagcggcgacgauugugucguuaaaccaauagacgaccgauucgccaaugcacucuuagcauuaaaugauauggguaagguacgcaaggauauaccccaauggcagccgucuaaggguuggcaugauuggcagcaaguaccauuuugcagccaucauuuucacgaacuuauaaugaaagauggcagaaaauuaguugucccgugccgaccccaagacgaacuaauuggacgagcacgcauaagucaaggagcaggauggagccugaaagaaacggccugccuaggaaaggcuuaugcccaaauguggucauuaauguauuuucaucgacgugauuuaagauuggcgagcaaugcuauaugcuccgcaguaccuguacacuggguaccgaccucucguacaacauggucgauacaugcacaucaucaauggaugacaacagaagauaugcucgcgguguggaauagaguuuggauagaagacaauccuuggauggaagauaaaacaccggucaccacaugggaagauguaccauacuuaggaaaacgugaggaccaauggugcggaucacuaaucggauugaccucucgcgccacuugggcucaaaauauucucacugccauucaacaaguucggucucuaaucggcgaugaagaguucuuggacuauaugccaaguaugaagcguuuuagaaaggaggaagaaucagaaggugcgauaugguag

SEQ ID NO: 23136 - RNA, 9873 nt, Artificial Sequence
  derived and/or modified CDS sequence (opt6) from DENV-3__FJ639724__SS-prME
acgucacuaugccuuaugaugauguuacccgcaacccuagcuuuucaccugacgucacgggauggagaaccacgaaugaucguagggaaaaaugaaaggggcaagaguuuguuauuuaaaaccgcauccggaauuaacauguguacgcuuaucgcuauggauuuaggggagaugugugacgacacgguaaccuauaaaugcccauugauagcagaaguugaaccggaggauauagauuguuggugcaaccuuacauccacauggguaacauacgguaccuguaaucaagcaggggaacauaggagggauaagaggucaguagcguuagcaccccauguggguaugggauuagacacuagaacgcaaaccuggaugucggcugagggugccuggcggcaggucgaacgcguugaaacuugggcucuuagacaucccggauucaccauucuagcucuauuuuuagcucacuauauuggcacgagucuaacgcaaaaaguaguaauauuuauacuucuaaugcuaguuacaccgaguaugacaaugagaugcguaggaguagggaaccgcgauuucguagaaggacuaagcggcgcgacauggguugauguagugcuugaacaugguggcuguguaacaacgauggcuaaaaguaaaccaacuuuggacauagaacuacaaaaaaccgaagcaacacaacuugcaacauuaagaaaacucuguaucgaaggaaaaauaaccaacauaaccacagacagucgaugcccaacccaaggagaagcaacauuaccagaagagcaagaucaaaacuauguauguaaacauacuuauguggauagagguuggggaaacgggugugguuuguucggcaaggggagucuggugaccugugccaaauuucaauguuuagaacccauagaagguaagguaguacaguacgagaacuugaaauauacggugauaaucaccguacacacaggugaucaacaccaaguuggcaacgauacgcaagguguaacgguagaaaucacuccacaagcaucaacuguugaagcgguauuacccgaauacggaacacuaggacucgaauguagcccuagaacgggacuugauuucaaugagaugaucuuacuuaccaugaaaaacaaggccuggaugguccaucgccagugguucuuugaucuccccuugccguggacaaguggagcgacaacugagacaccgaccuggaaucgaaaagaauuauuagugacuuucaaaaacgcacacgcaaaaaaacaggaagucgugguccuagggucacaggaaggcgcaaugcauacggccuugacgggcgcaacagaaauccaaaacaguggcgggacaaguauuuucgcgggacaucuaaaauguagguuaaaaauggauaagcuugaauugaagggcaugucauaugcuaugugccuaaacaccuuuguacuaaaaaaagaaguuucugaaacucaacaugggaccauacuuauaaagguggaauauaaaggagaagacgcgccuuguaagauaccguucucaacggaagauggacaaggaaaggcgcacaacgggagauuaauuaccgcaaauccaguaguuacaaaaaaagaagagccaguuaauauagaagcagagccuccuuuuggcgagucaaacauuguaauaggaauuggagacaaagcauuaaagaucaauugguauaagaaagguucuucaauaggaaaaauguucgaagccacagcgagaggagcgaggagaauggcaauauuaggagauacugcuugggauuucgguagcgugggaggcguacuaaauagccuaggaaaaaugguccaucaaauuuucggcucagcauauacagcuuuauucucuggugucucuuggauuaugaaaaucggcauuggaguacuucuaacuuggauaggguuaaauucaaaaaauacuaguaugagcuuuagcugcauaguuauugggauuauaacuuuauaccuuggagcggugguucaagcagauaugggcugugugauaaauuggaaaggaaaggagcuaaaauguggaaguggaauauucgucaccaaugaaguacauacauggacagaacaauauaaguuccaagcagacuccccgaagaggcuugcaacugcaauagcgggagccugggaaaaugggguauguggaauucgaaguacuacgcggauggaaaaucuacucuggaagcagauagcgaacgagcucaacuauauacuuugggaaaauaacauaaagcuaacuguugucguaggagacaucaucggcguacucgaacaagguaaaaggacccuaacaccucaacccauggaauuaaaauacaguuggaaaacuuggggaaaagcuaaaaucguuacagcggaaacgcaaaacaguaguuucaucauugacgguccaaacacuccugaaugcccuagugcuagucgagcauggaacguuugggaaguagaagacuauggauuuggaguuuuuacaacgaauauaugguuaaagcuaagagagguuuacacccagucuugcgaucauagauuaaugagcgcagccauaaaagaugaacgagcuguucaugcugauaugggcuauuggauugaaagccaaaaaaacggaagcuggaaacuugaaaaggcuaguuuuaucgaaguaaaaacauguacauggcccaaaucucauacccuguggaguaauggcgucuuagagucagacaugauaauaccuaaaaguuuagcgggccccauuucucaacacaaucauaggccuggguaccacacucaaacuacgggaccuuggcaccuggggaaauuagagcuagauuuuaauuauugcgaaggaaccacagugguaauaacagaaaauugcggaacaagaggcccgucccuuagaacaacaacaguaagugguaaauuaauacacgaauggugcuguagauccugcacacuacccccauuacgguauaugggggaagaugguuguugguacgguauggagauacgccccauuaaugaaaaagaggaaaacaugguaaagagccuaguguccgcgggcucaggaaagguagauaauuuuacaauggggguauuaugucuggcuauauuguucgaagaggucaugcgagggaaguucggaaagaaacauaugauagcgggaguacuauucacguuuguacuacuacuaucuggccaaauaacauggcgcgacauggcucacacuuugauaaugauagguucaaacgcgagugacagaaugggaaugggugugacguauuuagccuuaauagcaacauuuaaaauacaaccauuucuugcuuuaggauucuuucuuaggaaacuaacaucacgugaaaacuuauuacuagguguggggcuagcaauggcaaccacauuacaguugccugaagacauagaacagauggcaaauggcauagcacugggauuaaugacuuugaaauuaauuacccaauucgaaacauaccaacuguggacggcacuagucucccuaacuuguucgaacacaaucuuuacuuuaacuguagcauggagaaccgcaacucuuauucuagcgggagucucacuguugccuuugugccaaucaagcuccaugcgcaaaacggauuggcuaccuaugacaguugcagcaaugggaguccccccacucccguuguucauauucaguuugaaagacacaccuaaaagaagaagcuggccacuuaacgaagguguaauggccgugggauugguaaguauccuagcaucaucucuauuaagaaaugacguaccuauggccggaccguuagucgcaggaggacuauuaaucgcaugcuauguaaucacaggaacaucagcugaccuuaccguugaaaaagcugcagaugucacuugggaagaggaagcagaacaaacuggagucagucauaaucucaugauaacaguagaugaugauggcaccaugcggaucaaagaugaugaaaccgagaacaucuuaacagugcuccuuaaaacagccuuguuaaucgucaguggaauuuuuccauacaguauaccagccacgcuauuaguguggcacacguggcagaaacaaacacaacggucuggcguauuaugggacguaccaucgccgccugagacucaaaaggcagagcuugaagaaggugucuaucgaauaaaacaacagggaauuuucggcaaaacgcaaguaggagugggaguucaaaaagagggaguauuucacacaauguggcacguaacuagaggagcuguacuaacacauaacgguaaacgucuugaaccgaauugggcaaguguuaaaaaggaucuaaucucuuacggaggcgguuggaggcuuucagcacaguggcaaaagggagaagaaguacagguuauugcaguggaaccagguaaaaacccaaagaacuuucaaacaaugcccggcauuuuucaaacuaccacuggugaaauuggugcaauagcgcuagauuuuaaaccgggcaccuccgggucuccaauaauaaacagggaaggaaaaguaguagguuuguauggcaacggcguaguuacuaaaaaugguggauacguaagcggcauagcccagacgaaugcagagccagacggcccaaccccugaauuagaggaggagauguucaaaaaaaggaaccugacuauuauggaucuacacccuggaaguggaaagacaaggaaguacuuaccagcaauaguuagagaagccauuaaaaggagguuaagaacauuaauucuugcucccacacgaguuguagccgcugaaauggaagaggcgcuaaaaggcuugccuaucagauaccaaacgaccgcaacgaaauccgagcacacaggcagagaaauaguagaucuuaugugucacgcaaccuuuacgaugagauuacuaaguccaguacgagucccgaacuauaaucuaguuaucauggacgaagcucauuuuaccgauccagcaucaaucgcagcacgaggcuauauuuccacaagagucggaaugggagaagcggcagccauuuuuaugaccgcgacaccuccaggaacugcugaagccuuuccacagaguaacgcuccgauccaggacgaagagagagacauaccagagcgaucauggaauaguggaaaugaauggauaaccgauuucgugggcaagacugucugguucguacccaguaucaaggcagguaaugacauagcaaauugucuaagaaagaaugguaaaaagguuauucaacuaucacgcaaaacauucgacacugaauaucaaaaaacucgauuaaacgauugggauuuuguaguaacaacagauauuagugaaaugggggcaaauuucaaagcugauagaguuauagauccgcgaagaugcuuaaaacccguuaucuugaccgacggaccggaaagaguaauucuugcaggacccaugcccguuacagcugcaagcgcggcacaacgcagagggcgaguaggucgaaacccacagaaggaaaaugaucaauacauuuucacaggccaacccuuaaauaaugaugaagaucaugcacacuggaccgaagcuaaaaugcuuuuagauaauauaaauacacccgaagguauaaucccugcuuuauucgaaccagaaagagaaaaaagugcugcaaucgacggagaauaccgucugaagggagaaucucgcaaaacuuucguugaacuaaugaggaggggugaucuaccuguuugguuggcacacaaaguggcgucggaagguaucaaauacacagacaggaaauggugcuuugauggagaacgaaacaaccaaauauuggaagagaacauggacgucgagauuuggacuaaagagggagaaagaaaaaaacucaggccuagauggcuagaugcccggacuuacucagacccauuagcacuaaaggaguucaaagauuuugccgccggucgaaagucaauugcacuugacuuaguuacagaaauugguagaguaccaagucaucuugcacaucguacuagaaaugcucuugauaauuuaguaaugcuucacacuagugaacauggcggaagagcguaucgacaugcaguggaagaguuaccagagaccauggagacacuauuauuacuuggacucaugauccuacucacaggaggagcuauguuauuuuuaaucaguggaaaagggauaggaaaaacuucuauagguuuaauauguguaauaguuaguuccggcaugcuguggauggcagacgucccucugcaauggauagcuagugcaauuguguuggaauuuuucaugaugguauuauuaauaccugaaccggagaagcagaggaccccacaagauaaccaacuagcauauguuguaauuggaauccucacucuagcggccaucguagcggcgaacgagaugggucuauuagaaacaacgaaacgugauuuaggaaugagcaaagaaccaggagucguaucuccaacaaguuaccuagaugucgacuuacauccugcuuccgccuggacauuguacgcagucgcaacuaccgugaucacgccaaugcuaagacacacaauugaaaacagcacggcuaaugucucauuagcagcaauagcaaaccaagcaguuguucuaauggggcuggauaaaggcuggccuauuagcaagauggaccuugggguaccguuguuagcgcugggguguuauucccaaguaaacccuuuaacccuuacagcugcaguauuacuauuaguaacccacuaugcaauaauaggaccaggucuccaagcaaaagcgaccagggaagcacaaaaacggaccgcagcgggaaucaugaaaaauccgacaguagacggaauuaugacaauugacuuggauccuguuauuuacgacaguaaauucgaaaaacagcuuggucaagugauguuguuaguuuuaugugccguacaauuacuacuuaugaggacuucaugggcucuaugugaagcauugacccuugcaacugguccaauuacgacguuaugggaaggcucaccaggaaaauuuuggaauacaacuauagcggugucuauggccaacauauuuagggguaguuaucuagccggagcgggguuggcguucagcauaaugaagucuguagggacagguagaagagggacugguucccaaggagaaacuuuaggugaaaaauggaagaagaaacuaaaccaauuauccagaaaagaauuugaccuauauaaaaagucagguauuacagaagucgauagaacagaagcuaaggaaggauuaaagcggggcgagacgacgcaccacgcaguauccaggggaagcgcaaaacuucagugguuugucgaacgcaauaugguaaucccugaaggucggguaauagacuuaggcuguggcagaggaggguggucauauuauugcgcaggucuaaaaaaaguuacagagguuagaggcuacaccaaaggcggaccgggucaugaggagccggucccaaugagcacauauggguggaauauaguuaaacuaaugagcgguaaagacgucuuuuaccucccgccugaaaaaugugacacacuucuaugcgauauuggagaauccaguccgagcccuacuguagaagaaagucgaacuauucgaguucuuaaaaugguugaaccgugguugaggaacaaucaauuuugcaucaagguacuaaauccuuauaugccaacuguuauagaacaccucgagagacuccaacgcaaauacggaggaaugcuagucagaaauccucuuucccggaacucgacacaugaaauguacuggauuucaaacggaacggggaacaucguuaguaguguaaacauggugaguagauugcugcuaaaccgguucaccaugacccacaggaggccuacuauugagaaagauguagauuuaggugccggaacucgucauguaaaugcggagccugaaacaccuaauauggauguaauaggagaaaggaucaagagaauaaaagaagaacauucgucgacauggcacuaugacgaugaaaauccauauaaaacaugggcauaucauggcaguuaugaaguuaaagcaacgggaucagcaaguuccaugauaaacggugucguaaaacucuuaaccaaacccugggacguuguaccuaugguuacccaaauggcaaugaccgauacuacuccguuuggacaacaaagagucuucaaagaaaaagucgauaccagaacaccaagaccaaugccaggcaccagaaaaguaauggagauuacagcagaaugguuguggaggacguugggcagaaauaagaagccaagauuauguacuagagaagaauucacgaagaaaguuaggaccaaugccgcuaugggugccguauucacugaagagaaccaaugggacagugccagagccgcaguugaagacgaggaauuuuggaaacuaguagaccgcgaaagagaauuacacaagcuugguaaaugugggucauguguauacaacaugauggggaaaagagagaaaaaauugggugaguuugguaaggcaaaggguucuagggcuauaugguacaugugguuaggcgcacgguaccuugaauuugaagcacuagguuucuuaaaugaggaucauugguuuagucgagaaaauuccuauagcggcguggaaggagaaggacugcacaaauugggauacauuuuaagagacaucucaaaaauuccgggaggugcuauguacgccgacgacacggcggguugggacacgcgaaucaccgaagaugauuuacauaaugaagagaaaauuacccaacagauggacccagagcaccgucaacuagcgaacgccauauuuaaguuaacguaccagaauaaaguugucaaaguucaacguccuacaccaaaaggaacagucauggauauaauauccagaaaagaucaaagaggauccggacaaguaggcacuuaugggcugaauacuuuuacaaauauggaagcucaauuaguacgacaaauggagggggagggagugcuaucaaaggcugauuuagaaaacccucacuuacuagaaaaaaaaauaacacaguggcuagaaacaaaaggagucgaaagacuuaaaagaauggcaauuucuggugaugacuguguuguaaaacccauagaugacagauucgccaaugcgcuauuggcccuaaacgauaugggaaagguucguaaagauaucccacaauggcaaccaagcaaggguuggcacgacuggcaacaggugccauucugcucacaccacuuccaugaacugauaaugaaagauggacguaaacuaguagucccaugccgcccacaagacgaauuaauagguagggcucguauuagccagggcgcaggauggucacuuaaagaaacagcauguuuagguaaagccuacgcccagauguggucguuaauguauuuccaucgacgcgacuugcgauuggcaucgaacgcuauuugcucagcugucccaguccacuggauaccuacaucacgaacuaccuggaguauucaugcacaccaucaauggaugacaacugaggauaugcuaacugucuggaaccgcgucuggaucgaagauaacccuuggauggaagacaaaacaccaguaacgaccugggaagacgugccuuaucuaggaaaacgcgaagaccaaugguguggcaguuuaauagguuugacuagcagagcaacaugggcccagaauauacuaacagcaauacaacaaguacgaucacuuauuggagacgaagaguuuuuagacuacaugccuucgaugaaacgauuuaggaaagaagaagaaagugagggagcaauaugguaa

SEQ ID NO: 23137 - RNA, 9873 nt, Artificial Sequence
  derived and/or modified CDS sequence (opt6) from DENV-3__FJ639725__SS-prME
acuucauuaugcuugaugaugauguugccggcaacacuggcauuccauuugacauccagagacggugaaccaagaaugaucguugggaaaaacgaacguggaaaaucauuauuguuuaaaacagcgaguggaauaaauaugugcacguuaauagcgauggauuugggggaaaugugugaugauacugucacuuauaaauguccguuaauagcggaagucgaaccugaagauauugacugcuggugcaacuuaacauccacuuggguuacauaugguacuugcaaucaagccggugaacaccguagagacaaaagaaguguagcuuuagcaccgcaugucggaaugggacuagacacacgcacacaaacauggaugucugcagaaggagcauggagacaagucgaaaaaguugaaacgugggcacugagacauccaggcuuuacaauucuggcucuguuucuagcacacuacauagguacaagucucacacaaaaaguuguuaucuuuauucugcuaaugcuaguuacaccuucuaugacgaugcgaugcguggggguaggcaacagagauuuuguggagggacuaaguggugcuacaugggucgauguugugcucgagcaugguggaugcguuaccacaauggcgaaaucaaaaccaacgcuggauauagagcuacagaaaacggaggcaacacaacuugcaacauuacgaaaacuuuguauugaaggcaaaauaacaaauauuacgacagauucucgaugcccgacacaaggggaagcuacacugccagaggaacaagaccaaaauuacgugugcaaacacacauacguggacagaggauggggaaaugguugcggccuauuugguaaaggaagccuaguuacaugugcgaaauuucaaugccuugagccgauugaagggaaagugguucaauaugaaaaccuaaaauauacaguaaucauaacgguacacaccggugaccagcaucaagucgguaaugauacacagggagugacaguugaaauuacaccacaggcuucaacgguugaggcuguacugccugaauauggcacacuaggucuggaauguucgccucgaacgggacuggauuucaacgaaaugauuuuauugacuaugaaaaacaaagcauggaugguucaucgacagugguucuucgauuugccacuaccuuggacaucaggcgcaacaacagagacgcccacauggaauagaaaagaauuguuagugaccuucaaaaaugcccaugccaaaaagcaagagguugugguacucgguagccaagaaggcgcuaugcauaccgcuuuaacuggagccacagagauccaaaauucggguggcacaucgauuuuugcuggacaccuuaaaugcagacuaaagauggacaaacucgaauuaaaggggauguccuaugcuaugugucuuaauacuuuuguacucaagaaagagguaagcgagacacagcacggaaccaucuugaucaaaguugaauauaaaggagaagacgcaccauguaaaauuccauucucuacggaagaugggcaagguaaagcccauaauggacgccugauaacagcaaacccgguagucaccaagaaagaggaacccgucaacauagaagcagagccaccuuuuggagagucuaacaucgugauaggaauuggagauaaagcauuaaagauaaauugguauaaaaaggggucaucuauuggcaagauguuugaagcuacugcgagaggagcucgucguauggcuauccuaggugacacagcaugggacuuuggaagcguugguggagugcuaaauucccucgggaaaaugguacaucaaauauucgguucagcauauaccgcacuauucucgggagucagcuggaucaugaagauaggaaucggaguacuacugacguggauaggcuuaaauagcaagaacacauccaugaguuuuagcuguauugucauuggaauuauaacucuauauuuaggagcuguaguacaagcggacaugggaugcguuaucaacuggaagggaaaagaacuaaagugugguagugggauauuugugaccaacgaaguucauacguggacagaacaguauaaauuccaagcagauucaccaaagcgacuggcuacggcaauugccggagcuugggaaaacgguguaugugguauuagaaguacaacaagaauggaaaacuugcuuuggaaacaaauagcuaaugagcucaacuauauucugugggagaauaauauuaaacuuacaguggugguuggagacauuaucggggugcuagaacaaggcaaaagaacguugacaccacaaccuauggaacucaaauacucuuggaaaacaugggggaaagccaagauaguuacugcggagacacaaaauucuuccuuuauuaucgacgguccuaacacgccggaaugcccaagugccaguagagcauggaauguuugggaaguagaagauuauggguuuggaguauuuacgaccaacauaugguugaaguuacgagaaguauauacucaaucgugugaccauagacuuaugucugcggccauaaaagacgaaagagcuguacaugcugacaugggauacuggauugaaagucagaaaaacgggagcuggaagcuagaaaaagcaaguuuuauagaggucaaaacauguacuuggccuaaaucucauacacuaugguccaacggcguguuagaaucagauaugaucauaccaaagucuuuagcugguccuauaucacaacauaaucaccgaccaggcuaucacacucaaacagcaggaccauggcauuuagggaaauuagaauuagauuucaacuacugugagggaacgacaguagucauaacagaaaauuguggaacgagaggucccucccuuagaacuaccacaguaucgggaaaacuaauucaugaaugguguugucgcucuugcacacucccuccuuuacgauauaugggggaagauggguguugguauggaauggaaauccgcccuauaaacgaaaaagaggaaaauauggugaagucguuaguaucagcaggaaguggaaaagucgauaacuuuacuauggguguacucugcuuagccauucuuuuugaggaaguaaugagagguaaauucgguaagaaacacaugauagccggcguucuuuucacuuuuguguuacuacuuuccggacaaauaacauggcgagacauggcgcacacacuuauaaugauaggaucgaaugcgucagacagaauggguaugggagucacauacuuagcgcuuaucgcgaccuucaagauucaaccuuucuuggccuuagguuucuucuuaagaaaguuaacaucaagagagaaucuuuuacucgguguuggauuagcaauggcaaccacucugcaauuaccggaagacauagagcaaauggcaaauggaauagcacuaggauuaaugacacuaaaauuaaucacgcaauuugaaaccuaucaacuguggacagcucuaguaaguuugacguguagcaacacaauauucacucuaacaguagcauggcgaacagcgacacuaauacuagcaggcguuuccuugcuaccacuaugucagaguagcucgaugcguaaaacggauugguuacccaugacaguugcagcgaugggaguacccccacuuccacuuuucaucuuuagucugaaagacacgccuaaaagacgcucauggccuuuaaacgaaggagucauggcagucggcuuagucucaauacuagcuucguccuuacuucguaacgacguacccauggccgguccucugguagcaggcggacuuuuaauugcaugcuauguuauuacgggaacaagugcagaccuuacagucgaaaaggcugcggauguuacuugggaagaagaagcagaacaaacaggugugucccacaauuugaugauaacaguggaugaugauggaaccaugaggauaaaagaugacgaaacugaaaauauucucacagugcuuuuaaaaaccgcauuauugauagucagcgguauuuucccuuauuccaucccagcgacauuguuaguuuggcacacguggcagaagcaaacgcagaggagcgggguacuaugggaugucccgagcccaccagaaacacaaaaggcggaacuugaggaggggguuuacagaauaaaacaacaaggcauauucggaaagacucaagucggcgucggugugcaaaaagaggguguauuucauacuauguggcacguaacccggggcgcagucuuaacacauaacgggaaacgacuggaacccaacugggcaucuguuaagaaagaccugauuucuuauggaggaggguggcguuugagcgcucaauggcagaaaggagaggagguucaaguuauagcuguugaaccagguaagaauccuaaaaauuuccagacaaugccaggaauauuucaaaccacuacuggggagauaggugccauugcguuagauuuuaagccuggaaccucugguucuccaaucauaaauagagagggcaaaguugugggacucuacggaaauggggugguuacuaaaaauggcggauaugucaguggaauugcucaaaccaaugcagaaccugacgguccgacucccgaacuagaagaagaaauguuuaagaaaagaaauuuaacuauaauggauuugcauccgggcuccggaaaaacccguaaauaccuccccgcgauaguccgggaggcaauaaaaagaaggcuacgaacauugauauuagccccuacuagggugguagcagcagaaauggaagaagcacucaaaggucuacccauaagauaucaaacaacggcuacgaagucggaacauacaggaagagaaauagucgaucugaugugucaugcaacauuuacaaugagguuacuaaguccaguucgaguaccaaacuauaauuuaguuauuauggaugaggcccacuuuacggacccugccaguauagcagcgaggggguauauuagcacaagaguaggaaugggagaggcagcugcaaucuuuaugaccgcaacgccuccaggaacagcugaggcguucccgcaauccaaugcgcccauucaagaugaagaaagagauauaccugaacgcagcuggaauaguggaaacgaauggauuacagauuuuguaggaaaaaccguuugguuuguuccaagcauaaaagccggaaacgacauagccaauugucuaaggaaaaauggcaagaaaguaauccaauuaagccgaaagacauuugauacugaguaucagaaaacaagacuuaaugauugggacuuugucgucaccaccgauauuagugaaaugggagccaauuucaaagcggaucguguaauagauccuagaagaugucuaaagccuguaauccugacagauggaccugagagggugauucuggcuggccccaugccuguaacagcagccagugcggcacaacgacgcggaagaguaggcaggaauccgcaaaaagagaacgaccaguauaucuucacuggacaaccauuaaauaaugacgaagaccaugcacauuggacggaggcaaaaaugcugcuagauaauauaaacacacccgagggcauaaucccagcacuauuugaaccagaacgugagaagucagcagcuaucgauggugaauaucgacuaaaaggugaaucuagaaaaaccuucguggagcuaaugcgaaggggagauuuaccgguaugguuggcgcacaaaguagcgucugaagguauuaaauacacugaccguaaaugguguuuugacggugaaaggaacaaccagauauuagaagaaaacauggauguagaaauauggacaaaagaaggagaaaggaagaaacugaggccacguugguuagaugcucguacuuauagcgacccuuuagccuuaaaagaguuuaaggacuucgccgcaggccguaaaagcauagcacuagacuuagugaccgaaauuggacggguuccuucacaucuugcacacaggaccagaaacgcccuggacaaccugguuauguugcacacgagugaacauggagguagagcguaucgccaugccguugaggaacuaccagaaaccauggaaacacugcuuuuacuaggacuaaugauauuacuaacagguggcgcgaugcucuuucuuauaucaggaaaagggauuggaaaaacaucuauagguuuaauuuguguaauugcaucuaguggaaugcuauggauggcagacgugccauuacaguggaucgcaucugcuaucguucuugaguucuuuaugaugguauuauuaauaccagaaccugagaaacaaagaacgccacaagauaaccaauuagcuuauguugucauagggauauuaacccuugccgcuauuguagcagcaaacgaaaugggacuacuagagacgacuaaaagggaucuaggaaugaguaaagagccuggagugguuaguccuacaaguuacuuagauguagauuuacauccugcaagcgccuggacauuguacgcuguagcgacuacaguaauaacuccaauguuacgacauacuauagaaaauagcacugcaaauguuucacuugcggcuaucgcuaaccaagcaguuguucucaugggguuggauaagggauggccgauaucgaagauggauuuaggugugccucuccuagcacucgggugcuacagccaaguaaaucccuugacuuugacggccgcuguccuccugcuagucacgcauuaugcaaucaucgguccaggauuacaagcaaaggcuacaagagaggcacagaagagaaccgcagcagggauaaugaaaaacccgacaguggaugguauuaugaccauugacuuagaucccgugauauacgacuccaaauuugaaaaacaacugggccaagugaugcuguuaguucucugugcugugcaacuucugcucaugcgcacaucuugggcccuuugugaagcacuaacccuugcaaccgguccaauuacuacucuuugggaagguucaccaggaaaauuuuggaacaccacuauugcagucucaauggcgaacauauucagaggaaguuaccuagccggagcaggauuagcuuuuuccauuaugaaaucugucgguacgggccguagagguacgggaucucagggugaaacuuuaggggaaaaauggaagaagaaacuuaaccaauuaucaagaaaagaauuugacuuauacaaaaagucugguauaacugaaguagauagaaccgaagcaaaagaaggauuaaaaaggggagaaacuacacaucacgcagugagucgaggauccgcaaaacuccaaugguuuguagaacggaacauggugauuccugaaggacgaguaauagauuugggauguggucgagguggauggucguauuacugugcaggucuaaagaaagucacagagguccguggauauaccaaaggugguccaggacacgaagaaccuguacccaugucaaccuaugguuggaauaucguuaagcuaauguccggcaaagaugucuuuuaucucccuccagaaaagugugacacuuuacuuugcgacauaggagagucaagcccaaguccaacagucgaggaaucaagaacgauacgaguccucaaaauggucgaaccauggcuccgaaauaaucaauucuguauaaaggucuuaaacccguacaugcccacaguuauagaacaccuggaaagacugcaacgaaaauacgggggaaugcuaguucgcaauccgcucucacgaaacucuacacaugaaauguauuggauuucaaaugguacugguaauauaguaagcucaguaaauaugguuucucggcuccuucuuaacagauuuacgaugacucauagacgaccaacuauagaaaaagaugucgaccucggagcugggacacgccauguuaacgccgagccggaaaccccaaacauggauguaauaggcgaacguauuaaaaggauaaaagaagaacauucgagcacguggcacuaugaugacgaaaacccguacaagacgugggcauaucaugggaguuaugaaguuaaagcaacuggaagugcuagcucaaugauaaauggagucgugaaauuacuuacaaaacccugggaugucgugccgaugguaacacagauggcaaugacugauacuaccccauuuggacaacaacguguauuuaaagaaaaaguagauacaagaacuccacgaccaaugccaggcacaagaaaagugauggaaauaacugcggaaugguuauggcggacccucggaagaaauaagaaaccaagacuauguaccagagaagaauuuacuaagaaagugagaaccaacgcugcaaugggagcaguuuuuacugaagagaaccaaugggacuccgccagagcagccgucgaggaugaagaguuuuggaaacuuguggaccgugagagagaacuacacaaacugggcaagugcgguuccuguguauauaacaugauggggaaaagagagaagaaauugggugaauuuggaaaagcaaaagguuccagagcaaucugguauauguggcucggugcacgcuaucuagaguucgaagcgcuaggauuuuuaaaugaggaucauugguucucacgcgaaaauuccuauucuggagucgaaggagaaggauuacacaaauuaggauauauauuacgugacauaucuaaaauacccgguggggccauguaugcagacgauacugcgggcugggacacaagaauaacagaagaugaccuacacaaugaagagaaaauuacacaacaaauggauccagagcaccgucaacuggcgaacgcaaucuuuaaacuaacuuaucaaaauaaagugguaaaaguacaacguccgacaccaaaagguacaguuauggauauaauaucaagaaaggaccaaagagguaguggucaggucggcacauauggucugaauacuuucacaaauauggaagcccaauugguccgacaaauggaaggugaaggcgugcuaagcaaggcugaucuggaaaacccgcaucugcuagggaaaaagauuacacaaugguuagaaacaaaagguguggaaagacuaaaaagaauggcuauaucgggagaugacuguguggugaaaccgauugacgaccgauuugcuaaugcccuacuugcauuaaaugacauggguaaaguucgaaaagacauaccgcaauggcaaccuuccaaggguuggcacgacuggcaacaaguuccguuuuguucacaccacuuucaugaguuaauaaugaaagauggacgcaaauugguaguacccugcagaccucaggaugaauuaauaggcagagcaagaauaagucagggugcgggauggagucugaaagagacagcaugucuaggcaaggcuuaugcucagauguggaguuuaauguauuuucaccgccgagauuuaagauuagcaucuaacgcaauauguucagccgucccuguacauuggaucccgacaucccgcacgacgugguccauucacgcccaucaucaauggaugaccacagaagauauguuaacaguauggaaucgaguguggauugaagauaauccuuggauggaagauaaaacgccagugacuaccugggaagaugugccuuaccuagggaaaagagaagaucaaugguguggcagccugauugggcucacaucccgugcuacaugggcacaaaacaucuuaacugccauucaacaagucaggagcuuaaucggugacgaagaguucuuggacuauaugccaaguaugaaacgauuucgaaaagaagaagaaucggaaggagcuauaugguaa

SEQ ID NO: 23138 - RNA, 9873 nt, Artificial Sequence
  derived and/or modified CDS sequence (opt6) from DENV-3__FJ639726__SS-prME
acaucccuaugucucaugaugaugcugccagccacccuagcauuucaccuuaccagccgagacggggaaccgaggaugaucguaggaaaaaaugaaagagguaaaucacuucuguucaaaacagcuagcggaauuaacauguguaccuuaauugcaauggauuuaggagaaaugugugaugacacaguaacguacaaauguccucuaaucgcugaagucgaaccugaagauauugauuguugguguaauuuaacuucgacgugggugaccuauggcacaugcaaucaagcaggagaacaucgaagagacaaaaggaguguugcauuagcgccacauguagggaugggacuugacacucguacccaaacguggaugagugcugaaggggccuggcgacagguugagagagucgagacaugggcauugaggcacccaggauuuacuauauuagcauuauucuuggcgcauuacauuggaacaucucuuacgcagaaaguaguuauauuuauccucuuaaugcuuguuacuccuucaaugacaaugcgauguguaggcgucggcaaccgcgacuuuguagaaggauuaagcggugcaacgugggucgauguaguucuagaacacgguggcuguguaacgacaauggcuaaaagcaaaccgacuuuggacauagaacuacaaaagaccgaagcgacacaacuugccacgcuuagaaaacuuugcaucgaagggaagauaacaaacauuacgacggacuccagauguccaacacaaggggaagcgacucuuccggaagaacaggaucaaaacuaugucuguaaacacacauacguagaccgagguugggguaacgguugcgggcucuucggaaaggggaguuuaguuacaugugccaaauuucaaugucuagaaccaauugaaggcaaaguuguccaauaugagaacuuaaaguauacaguuauaaucacaguucauacgggagaccaacaucaagucgggaaugacacccaaggaguuacagucgaaauuacaccacaagcaucgaccguagaagcaguucuaccugaguacggaacccucggguuagaaugcaguccacguacaggguuagauuuuaaugaaaugauauuacuaacuaugaagaauaaggcauggaugguacauagacaaugguucuucgauuugccacuuccauggaccucaggcgcuacuacagagacaccgacguggaaucgaaaggagcugcuugucacuuucaagaaugcgcaugccaaaaaacaggaagucguuguacuugguagccaggagggagccaugcacacggcgcuaacaggagcuacagaaauccaaaauuccggaggaacuucgauuuuugcgggacaucugaaauguaggcucaaaauggacaaacucgagcuuaaagguaugucguaugcaaugugucuuaauacauucgucuugaaaaaagaaguaucagagacccaacacggcaccauauugauuaagguagaauauaaaggugaggaugcaccuuguaagauacccuucuccaccgaggauggucaaggaaaggcucauaauggacgauugaucacagcaaauccaguaguuacuaagaaagaagaaccgguaaauauugaagcagaaccaccuuucggagaaucaaacauagugauuggaaucggagacaaagcccuaaaaauaaacugguauaaaaaaggcucgagcauuggcaaaauguuugaggcaaccgcgaggggcgcaagaaggauggcaauucuuggagauacggcaugggauuucggaucaguuggugguguacugaauagccuaggaaaaaugguacaccaaauauuuggcucagcguauacugcccuuuucagcggaguaagcuggauaaugaagaucgguauaggaguacuuuugacuuggauaggccuuaacucaaaaaauaccaguaugucguuuucauguaucgucauuggaauaauuacucuuuaucuaggagcagucguccaagcggauaugggaugugugauaaauuggaaaggaaaggagcugaaauguggauccgguaucuuugucacaaaugaaguccauacauggaccgaacaauauaaguuucaagcggauucaccuaaaagauuagcgacugcaaucgcaggagcaugggagaacggagugugcgguauaagaaguacuacucgaauggagaaucugcucuggaagcagauugcaaaugaauuaaauuauauuuuaugggaaaacaacauaaaacugacaguagucguaggugacauuauagguguucucgaacaagguaagaggacucuuacaccacaaccgauggaauuaaaauauagcuggaagacauggggaaaagcaaaaaucgugacggcagaaacgcaaaacagcucguuuaucauagauggacccaauacuccagagugcccaucugcuucucgagcguggaauguaugggaagucgaagauuauggguuugguguuuucacaacaaacaucuggcuaaaacuuagggaaguuuacacacaaucgugugaucacaggcucaugucagcugcaauuaaagacgaaagagcuguucaugcagacaugggauacuggaucgaaucucaaaaaaaugguaguuggaagcuugaaaaagcauccuucaucgaaguaaaaacaugcacuuggccuaaaucccauacucuuuggucuaaugggguacuagagucggauaugauaauaccaaaaucacuugcuggaccuauuagucaacauaaccaccgaccuggcuaucacacccagacagccgguccauggcaucuaggcaaacuugaacuagacuucaauuacugugaaggaacaacaguaguuauaacagagaacugcggaaccagaggaccgagccuaagaaccacgacaguaaguggaaaguuaauucacgaauggugcuguagaucguguacacuacccccccugagguacaugggagaagauggcugcugguacgguauggaaauuagaccaaucaaugagaaagaagaaaauaugguuaaauccuugguaagugcagggagcgguaaagucgacaacuucacuaugggaguacuguguuuagcgauauuauuugaagaaguaaugaggggaaaauucggaaagaaacauaugauugcagguguauuauuuacauuuguguuacuguuaucuggucaaaucacuuggcgugauauggcucacacauuaauaaugauaggcagcaaugcuuccgauaggauggguaugggagucaccuaccuagcucuuauagcaacauuuaaaauacaaccguucuuagcacuaggcuuuuuucugagaaaacuuacaaguagagagaauuuacuguuagguguuggccuagccauggcaacaacucuacagcuucccgaagacauagaacagauggcuaauggcauugccuuggggcuaaugacauuaaagcucauaacucaguucgagacauaucagcuauggacagcucucguuagucugacguguagcaauacuauauuuacacuaaccguagcauggcgcacagcuacccuaaucuuggcagguguaagcuuacuaccauuaugucaaaguaguaguaugcggaaaacugauuggcuuccuaugacaguugcggcgauggggguaccaccauuaccauuguucauauuuagucugaaagacaccccaaaaagaagaucauggccuuuaaaugagggugucauggcgguaggacuuguuaguauauuagcaagcucuuuauuacgaaacgaugugccaauggcaggaccguuaguagcaggaggccuuuuaauagcguguuacguaauaacuggaacgucagcugaucucaccguagagaaagccgcagacguuacgugggaagaagaagccgagcaaacagguguaagucauaaccuaaugauaacaguagacgaugacgggacaaugagaaucaaagacgaugaaacggaaaacauucuaacagucuuauuaaaaacugcauuguuaauuguuagcggaaucuuuccguauagcauacccgcaacuuuacuagucuggcauaccuggcaaaaacaaacacagagaucugggguacuaugggacgugccaucgccuccggaaacacaaaaagccgaauuggaggaaggggucuacagaauuaaacaacaagguaucuucggcaaaacucaaguaggagugggaguucaaaaagaaggaguauuucacacaauguggcauguuacaagaggagcuguccuuacacacaacggaaaaagguuagaaccgaacugggcuagcguaaagaaggaccuuauuucauacggaggaggauggagacuaucagcacaauggcaaaaaggugaagaaguacaaguuauagccguugaaccgggaaaaaauccaaaaaacuuucagacaaugccaggcauauuccagacuacaacuggagaaauaggggcuauagcacuugauuuuaaacccggaacauccggaagcccaauuauaaauagagaggguaaaguaguugguuuauacggcaacggaguggucacgaaaaauggcggauaugucucuggaaucgcgcagacaaacgcagaaccugauggaccaacaccggaacuagaagaagaaauguucaagaaaagaaauuugacaauaauggaccuucauccuggaucagggaaaacacgaaaauaucugccagcaauagugagagaggccauuaaacgaagacugagaacucuaauauuagccccuacucgaguuguugcagcggaaauggaagaagcccuaaaagguuuaccaauuagauaucaaacgacugccacaaaauccgaacauaccggcagagaaauuguagaccuuaugugccaugcaacuuucacaaugagguuauuaucaccgguaaggguucccaacuauaaucugguaauaauggacgaagcacacuuuaccgauccagcuaguaucgcagcacgaggauacauaaguacucggguaggaaugggggaagcugcagccaucuucaugacagcaacaccaccaggcacugcggaagcuuuuccccaaucuaaugcacccauucaagacgaagaaagagauauuccugaaagaaguuggaauagcggaaacgaguggaucacggauuucguaggaaagacagugugguuugugccgagcauuaaggcaggaaacgacaucgcaaauugucuacgaaaaaacggaaaaaagguuauucaacuuagccgaaagacuuuugacaccgaauaccaaaaaacgagacucaacgacugggauuuugucguuacaacugauauauccgaaaugggggcuaauuuuaaagccgauagagucaucgauccgagacgcuguuuaaaacccguaauauuaacggauggaccagaaagaguuauacuagccgguccuaugccaguaacagcagcaagugcagcacagcgacggggaagaguagguagaaauccgcagaaagaaaacgaccaguauauauuuacaggccaaccauuaaauaacgacgaagaucacgcacauuggacagaagccaaaauguuguuggacaauauuaacacaccggagggcauaauaccagcccuauuugaacccgaaagagaaaagagcgcagcaauagauggugaguaccgucuaaaaggugaaucccguaaaacguuuguugaauugaugagacggggugacuuaccggugugguuagcgcacaaaguugcaucugaaggaaucaaguauacagauaggaagugguguuucgacggagaaagaaauaaucaaauccuggaggagaacauggauguggaaauauggacaaaggaaggagaaaggaaaaaguugcgcccacguugguuagaugcacguacauauucagacccguuagcuuuaaaggaauucaaagacuucgcugcaggacgcaagucaauagcacuugaucuaguaacagaaauagggcgaguuccuucccacuuagcgcauagaacuagaaaugcauuagauaaucuagucauguugcacacauccgaacaugguggucgugcguauagacacgcuguagaagaacuucccgaaacuauggagacacuucucuuauugggauugaugaucuuacuaaccggaggagcaauguuauucuuaauaagcggaaaaggcaucgguaaaacaucaauugguuugauauguguuauagugaguagugguauguuauggauggcugauguaccacugcaauggauagcgagugcuaucguuuuagaauucuucaugaugguguuauuaauuccagaacccgagaaacagcggacgccucaagacaaucaauuagcguauguuguaauagggauauuaacauuagcagccauuguagcugccaacgaaauggguuuacuggagacaacaaagcgggaucuaggcaugucaaaagaaccggggguuguaucucccacaucguaccuugacguugaccuacacccagcuagcgcuuggacacuuuacgcaguugcgacuacaguuauaacuccaauguuaagacacacgauugaaaacucgacugcaaauguauccuuagcugcuauugccaaccaggcuguagucuuaaugggucuugacaaaggguggccuauuuccaaaauggacuuaggcgugccauugcuggcauugggcuguuacucgcaaguuaacccauugacuuuaacugcagccguauuguuacuuguaacacauuaugcaauuauagggccugguuugcaagcgaaggcuacuagagaagcgcaaaaacgaaccgcagcaggaauuaugaagaacccuacaguagacgguauaaugacaauagaucuagauccaguaauauaugacaguaaguuugaaaagcaacuaggacaagugaugcuauuaguucuuugugcaguucaauuauuauuaaugagaacgaguugggcguuaugugaagcucucacauuagcuacugggccaauaacaacucuuugggaaggaucuccagggaaauucuggaauacaacuauugcaguuucaauggcgaacaucuuucgaggaucguaucucgcgggugcuggacuagcauucucuaucaugaagagugucggaaccggucgaagaggcaccggaucucagggagaaacacucggagagaaauggaagaaaaaauuaaaucaacuaucgcguaaagaguuugaucuauauaaaaaaucgggcauuaccgaagucgacagaacggaagcuaaagaaggacugaagcgcggagaaacgacucaccaugcaguaagucgugggucagcuaaacugcaaugguuuguugaacggaacaugguaauaccggagggucgggugauagaccuaggaugcgggagaggagguuggucauauuacugugcaggacucaagaaaguaacagaagugagaggauacacgaaagguggcccaggccacgaggagccaguaccaaugucaaccuacggauggaauauuguuaaguuaaugagcgguaaagaugucuucuaucuaagcccugaaaaaugcgacacccuacuaugugacaucggagagaguucaccaucuccaacuguagaagaauccaggacuauaagaguccuuaaaaugguagaaccuuggcuaaggaauaaccaauuuugcauaaaggucuuaaacccauauaugccaacaguaauagaacauuuagagagauuacagcgaaaauacggagguaugcuuguucgcaacccauuaagccggaacagcacacaugagauguauuggauaucaaauggcaccgguaauauuguaucaucaguaaacaugguaucucgguuauuacuaaacagauucacuaugacucauagaagaccaaccauugagaaagauguugaucuaggagccggaacuagacauguaaacgcagaaccagaaacuccaaacauggaugucauaggcgaacgaaucaagcggauaaaggaagaacauuccaguacauggcauuaugacgacgaaaauccauacaaaacaugggcauaucauggcucuuaugaagugaaggcuacggguagcgcguccagcaugauaaauggaguaguaaaauuacuaacgaaaccuugggacguagucccaaugguuacacaaauggcgaugaccgacacuacacccuuuggacagcaacgaguuuuuaaagagaaaguagauacucguacuccacgucccaugccuggaaccaggaaaguaauggaaauaacagcugaaugguuauggagaacucuaggacggaauaagaaaccgagauuaugcacacgagaagaauucaccaagaagguucgaacaaacgcggccaugggugcuguauuuacagaggaaaaucaaugggauucagcuagggcggcgguggaagacgaggaauucuggaagcuuguugaucgcgaacgagaacuacauaaacuuggcaaaugcggaucauguguauacaacaugauggguaaaagagaaaaaaaauugggugaauuuggaaaggcaaaagguucgcgugcuauaugguacauguggcuaggugccagguauuuagaauuugaagcacucggauuccuuaaugaagaccacugguuuucucgugaaaauucauauucaggugucgaaggggaaggccuucacaaauuaggcuacaucuuacgggauauauccaaaaucccaggcggagcgauguacgcagaugauacagcagggugggacacgaggaucaccgaagaugacuuacauaacgaggagaaaauuacacaacagauggacccggaacauagacaguuagcuaacgcuaucuuuaaacuaaccuaucaaaauaagguugugaaaguacagcguccaaccccaaaaggcacugucauggacauuauaagccgaaaggaucaacgaggcuccggucaaguaggcacguacgguuugaauacguucacaaacauggaagcgcaauuaguacgucaaauggagggagagggcguauuaucaaaggcagaucuugaaaauccacaccuacuggaaaagaaaauaacgcagugguuagaaacaaaagguguagagcgcuugaaaagaauggcgauuucaggugaugacugcguagugaaaccaauugacgauagauucgcaaacgcgcuacucgcgcucaaugacaugggaaaggugcgcaaggauauaccacaguggcaaccauccaagggguggcaugacuggcaacaagugccuuuuuguucgcaucauuuccaugaacuuaucaugaaagacggacgaaaacucgucgugccaugucgaccccaagaugagcucauuggaagagcuagaauuagucagggagcaggauggucacuuaaagaaacagcaugucucggaaaagcuuacgcccagauguggagucuuauguacuuccaucgcagagaccuaagacuugcuuccaacgcuauuugcucagcuguacccguccauuggaucccaacaucacgaacaacuuggucaauucacgcacaccaucaguggaugacuacggaagauauguuaacaguauggaaucgcguuuggauagaagacaauccuuggauggaggacaaaaccccaguuacuacgugggaagacguuccuuaccuagguaagagagaagaucaauggugcggaagccucauuggauugacgucccgggcuacuugggcucaaaauauauugacagcaauacaacaaguaagaucgcugaucggagaugaagaauuucuagacuacaugccgucaaugaagcgcuuucgaaaggaagaggaaucagaaggggcgauaugguga

SEQ ID NO: 23139 - RNA, 9873 nt, Artificial Sequence
  derived and/or modified CDS sequence (opt6) from DENV-3__KF955333__SS-prME
acaucgcugugucuaaugaugaugcuuccagcaacucuagcauuucauuuaacuucuagagacggagagccaagaaugauaguggggaaaaacgagaggggaaaaucccuacuauucaaaacagcaucaggaaucaauauguguacacuuaucgcuauggauuuaggcgaaaugugcgaugacacgguaacuuacaaauguccguugauugcugaaguagaaccagaagauauugacugcugguguaauuuaacaagcaccugggugacuuauggaaccugcaaucaggccggugaacauagaagagauaaaaggucuguugcacuugcaccacauguggguaugggacuagacacuagaacucaaacauggaugucggccgagggcgcguggcgacaaguagaaaaaguagaaaccugggcacuucgacauccuggauuuacaauuuuagcucuauuuuuagcucauuauauagguacaagucuaacacaaaaaguagucauauuuaucuuauuaaugcuuguaacaccaagcaugacaaugcgaugcguaggagucggaaaucgggauuuuguagaaggcuuaucgggagcuacauggguagauguuguacuagaacacggcgggugugugacaacaauggcgaaaucaaaaccuacacuagauauagaacuucagaaaacugaggcaacacaacuagcuacacuacguaaacuaugcauagaaggcaaaauuacuaauauaaccacugauagccgauguccaacgcagggagaagcuacgcuuccugaagaacaggaucaaaacuacguguguaaacacacuuauguugaccgugguugggguaacggaugcggauuauuugggaaggggucguuggucacaugugcaaaauuucaauguuuggaaccuauagaaggaaaaguuguucaauacgagaaccugaaauacaccgucaucauuacaguucauacaggagaucaacaucaagucggaaaugacacacaaggagugaccguagagauaacuccacaggcaaguacugucgaagcuguguuaccggaauauggcacccuaggacuagaguguaguccuagaacaggacuagacuuuaacgaaaugauccuucuaacaaugaaaaacaaagcauggaugguacacagacaaugguucuuugauuuaccguugccuuggaccucgggugcuacgaccgagacccccacauggaacagaaaagaacuuuugguaacguuuaaaaacgcacaugccaagaaacaggagguaguaguuuuaggaucccaagagggugccaugcauacagcucugacuggagcaacggaaauucagaacaguggagguaccucaauauuugcuggucaucuuaaaugucgauuaaaaauggacaaacuggaacuuaaaggaaugucauaugcaaugugcuugaauacauuuguacucaagaaagagguuucagaaacucaacauggcacaauacuaauaaaagucgaauacaaaggagaagacgccccaugcaaaauccccuucucuacggaggauggacaaggaaaagcccacaauggaaggcucauaaccgccaacccaguagugaccaagaaagaggaaccuguuaacauugaagcagaacccccuuucggagagucgaauauaguuauuggcauaggcgauaaggcuuuaaaaauaaacugguauaagaaaggcucaagcauagguaaaauguuugaagcaacggccaggggagcccguagaauggcaauauugggcgacacggcgugggauuuuggcaguguaggaggaguacuuaauaguuuaggaaagaugguacaccagaucuuugggucagcauauacagcccuauuuucaggaguuucauggauuaugaaaauagguauugggguacuccuaaccuggauugggcuuaauagcaaaaauacaucaaugucauuuaguugcauaguaauugguauaauaacccucuaccugggagcgguaguacaagcagacaugggaugcgccauaaauuggaaagguaaggaguugaaaugugguucuggaauauuugucaccaacgaaguacauacauggacugagcaguauaaauuccaagcagacucuccuaaaagacuagccacagccaucgcaggggcuugggaaaacggcguaugcggcauucguaguacaacgcggauggagaacuuacuguggaaacagauagccaaugaacuuaauuacauauuaugggagaacaacaucaaguugaccguagucguaggggauaucauagguguauuagaacaagguaagagaacucuaacaccacaaccaauggaauuaaaguauucauggaaaacauggggcaaagcgaaaauuguaacagcagagacccaaaauucaucauucauuauagaugguccuaauaccccugaaugucccagugccagucgugccuggaauguaugggaaguugaggauuacggguucggaguauucacaacaaauauuuggcugaaacuaagggaaguauacacccagucaugugaccaccggcuaaugagcgccgcaauaaaagaugaacgcgcggcacaugcggauaugggcuauuggauagaaagccagaaaaauggaaguuggaaacuagaaaaagccagcuuuauagaggucaagacauguacuuggccaaaaucccacacgcuauggagcaacgguguguuagaaagugacaugauuauacccaaaucacuugcuggaccuauaucucaacauaaucaucgcccagguuaccacacccaaacagcagguccuuggcaucuuggaaaacucgagcucgauuuuaauuauugcgaaggaacaacagugguaaucacugagaauugcggaacuaggggucccagucucaggacaacgacaguguccgggaagcugauccacgaaugguguugucgaaguugcacucuuccuccucuaagauacaugggugaagauggaugcugguauggaauggaaauacgaccgauuaacgaaaaggaagaaaauaugguaaagagcuugguuucugcgggcucugguaaaguugauaauuuuacuaugggaguauuaugucuggcaauauuguuugaagaaguuaugcguggcaaauucgggaaaaagcauaugauagcgggugucuuauuuacauucguacuacuacuaagcgggcaaaucacguggagagacauggcucauacauuaauaaugauaggcucaaaugcaagugauagaaugggaaugggggucaccuacuuggcuuuaauagcgacguuuaagauccagccauuucuggcgcucggauucuucuuacgaaaguuaacaucuagggaaaacuuguuacuaggcguaggucuugcaauggcuacuacgcuacaauugccggaagauauugaacaaauggcaaauggaauagcacuuggccucaugacacuaaaauuaauuacccaauuugaaacguaccaauuauggacugcauugguaucauuaacgugcaguaauacgauuuuuacguuaacagucgccuggcgaacugcgacuuuaauuuuggcaggagucucacuuuuacccuuaugucaaagcaguaguaugagaaaaacagacuggcuucccaugacaguagcagcuauggggguuccucccuuacccuuauuuauuuucucacugaaggauacgccgaaaagacguucauggccauuaaacgaagguguuauggcaguuggccuagugucaaucuuagcaucgaguuuacuacggaaugaugugccuauggcuggcccccuaguugcuggaggccuacuaaucgcguguuacguaauaacagggacgagcgcugaucuuaccguagaaaaaccagcagaugugccaugggaagaagaagcagaacaaacuggaguuucucauaauuugaugauuacuguagacgacgacgguccaaugagaauuaaagacgaugaaacagagaacauuuugacaguacuucugaaaacggcucuauuaauagugaguggcauauuccccuacaguauacccgcuacguuauuggucuggcauacuuggcaaaaacaaacccagagaagugguguacuaugggaugucccgaguccgccagaaacccaaaaagcggaguuagaagaaggcguguacagaaucaaacagcaggggauauuuggaaaaacacaaguaggaguugggguacaaaaggaagguguuuuccauacgauguggcacguaacacgaggagcuguuuugacucauaauggaaaacguuuggaaccuaauugggcaucagucaagaaagaccugauuaguuacggaggagguuggcgauuaaacgcucaauggcaaaaaggagaagaggugcaagucaucgcaguugaaccaggcaaaaaccccaaaaauuuccaaacuaugccgggaauauuucaaacgacgaccggugaaauaggcgcaaucgcacucgacuucaagccagguaccaguggaucacccauaauaaaccgugagggaaaaguugugggacucuaugguaacggggucguuaccaaaaacgguggauaugugagugguauagcccaaacuaaugccgagccagacggccccacaccggaacuagaggaggaaauguucaagaaaagaaacuuaacaauuauggauuuacaccccgguucaggcaaaacacgaaaauacuugccugccauaguacgagaagccauaaaaagacgauugcgaaccuugauauuagcaccuacucggguuguugcugcugaaauggaagaggcccuaaaaggccuaccgauaagauaccagacaacagcaaccaaaagcgaacacacgggacgagagauaguagaccuaaugugccaugcaaccuucacgaugcgacuauuaucgccuguaaggguuccaaacuacaaucuuguuaucauggaugaggcucauuuuacggacccagcaagcauagcugcacgggguuauauaagcacaaggguuggcaugggugaggcagcggcgauuuuuaugacggcaacaccaccuggcaccgcagaagccuuuccucaaagcaacgcaccuauacaagacgaggaacgagacauuccugaacguaguuggaauaguggcaaugaauggauuacugauuucguuggaaaaacagugugguucguaccgaguauaaaggcgggaaaugacauugccaacuguuuaaggaaaaacgggaaaaagguaauacagcuuucacguaaaaccuuugauacagaauaucaaaagacacgauugaaugacugggacuuugucguaacaacagauauuucagaaaugggugcgaauuuuaaggcagaucgagugauagacccuagacguugcuuaaaaccagugauacuuacugacggacccgagagggucauccuagcagguccaaugccagugacugcagcaucagcagcgcagcgacgaggacguguaggaagaaauccacaaaaagaaaacgaccaguauauuuuuacgggccaaccgcuuaacaaugacgaagaucaugcccauuggacagaagcaaaaaugcuacuugacaauauaaacacccccgaaggaauaauuccugcuuuauuugaaccggaaagggaaaaaucugcagcuauagacggagaguaccgacuaaaaggagaaucccgcaaaacuuucguugaacucaugagacgcggagaucuaccaguaugguuagcucauaaaguugcuagcgaaggcauuaaauauacugacagaaaauggugcuuugacggagagagaaacaaccaaauccuagaagagaacauggacguggaaaucuggaccaaagaaggagagcgaaagaaauuacguccacgguggcuagaugcuagaacauauagugacccguuagcucuuaaagaauuuaaagauuuugcagcaggcaggaaaaguauugcgcuugacuuaguuacagagauagguaggguaccaucacaucuagcccacagaacaagaaaugcuuuagauaacuuaguaaugcuacacacgagugaacacggugggagagcguauagacaugcggucgaagaacuaccugagacgauggaaacccuacuacuacuugguuuaaugauucuccuuacuggaggggcuaugcuauuucuaauaagcgggaaaggcauaggcaaaacaucaauuggacuuauauguguuauaguaucgucagggaugcuguggauggcugauguaccucuacaauggauugcaucagcuauuguacuugaguucuuuaugauggugcuacuaaucccugaaccugaaaaacaacguacaccgcaagacaaucaguuggcuuacguaguaaucgggauacucacucuugccgccauagucgcagcuaaugaaaugggccucuuggaaacaaccaaacgugauuuagggaugucuaaagagccgggaguugucucacccacuucuuaccuugacguggauuuacacccugccucugccuggacucuuuaugcgguggcaaccacuguaauaacaccgaugcucagacacacgauagaaaacucaacugcuaauguaagucuugcagcaaucgcgaaccaagcaguaguuuugaugggguuggauaaaggauggccaauaagcaaaauggaucuaggcgucccacuucuagcguugggauguuacucacaaguaaacccgcuuacacugacggcugcuguuuuacuccuaguaacacauuaugccauaauugguccuggacuucaggcaaaagcaacgcgagaagcccagaagagaacggccgcggguaucaugaaaaacccuaccguagacggaauaaugacgauagaccucgauccaguaauauaugauucaaaguuugagaaacaauugggacaggugaugcuauuaguacugugugccguacaauuacugcuaaugcgaaccaguugggcccuuugugaagcacuaacucucgcgaccgguccgauaacaacacuaugggaaggcucacccggaaaguucuggaauaccaccaucgcaguuucaauggcaaauauauuucgcgguaguuaccuugcaggagccggauuggcauuuucuaucaugaaaagcguagggacaggacguagaggaacaggaagccaaggugaaacauuaggagagaaauggaagaagaaauuaaaucaauuaaguagaaaagaauuugaucuguauaagaaaucuggcauuacagaaguagacagaaccgaagccaaagagggguuaaaaaggggagaaacuacgcaccacgcuguauccagagguuccgcaaaauuacaaugguuuguugaacgaaauauggugaucccagaagguagaguaauugaccucggcuguggacggggcggcuggaguuacuauugugcgggacuaaagaaaguuacagagguaagggguuauacaaaaggcggucccggccaugaagaaccaguaccaaugaguacauacggguggaauauaguuaaauuaaugagugguaaagaugucuuuuaccuaccgccugagaagugcgacacacuuuuaugugauauaggcgaaagcucuccgaguccgacugucgaagagucacgcacaaucagaguacucaaaauggucgaaccuuggcuccgcaacaaccaauucugcauaaaggugcuaaauccuuacaugccaacugugauugagcauuuggaaagacuacaaaggaaauauggaggcauguuagugagaaauccacuuuccagaaauucaacgcacgagauguauuggauaucuaacgguacugggaauauagucagcuccguaaauaugguaucuaggcuucuucucaauagguuuacgaugacccauagacgucccaccaucgaaaaagacguugaucuaggagcaggaacacggcacguaaaugcugaaccagaaacuccgaauauggacguaauaggagagaggauaaagcgaauaaaagaagaacacuccucaacuuggcacuaugaugaugagaacccauacaagacuugggcuuaucaugguucauacgagguuaaagcaaccgguucugcaaguucuaugauaaacggugucgucaaacuucuaacuaaacccugggauguaguaccaaugguaacucagauggcaaugacagacacgaccccguucggacaacaaagagucuuuaaagaaaaaguugacaccaggacuccaagaccaaugccagguacaagaaaagucauggaaauaacugcggaaugguuauggcgaacauuaggcaggaauaagaaaccuagauuauguacuagagaggaauuuacgaaaaagguaagaacaaaugcugcaaugggagcuguauucacggaggaaaaucaaugggauagcgcacgcgcugcugucgaagaugaagaauuuuggaaacuuguagauagagagagagaauuacauaaauuagguaaauguggaaguugcguauacaauaugauggguaaacgcgagaagaaacuaggagaguucggaaaggcaaagggauccagggcaauuugguauauguggcugggcgccagauaucuugaguucgaagcacuaggcuuucuaaaugaagaccauugguucucacgagaaaauucauauucgggagucgagggggaaggauuacauaaauuaggguacaucuuacgugacaucuccaaaauaccagguggugccauguacgcagaugacacagcagguugggacacaagaauaacugaggaugaccuacauaacgaggagaaaauaacagcccaaauggauccagaacauagacaauuagcaaacgcaaucuucaaacuuaccuaucagaacaaagucgugaaaguacaacggccaacucccaaaggaacagugauggauauaauuagucgaaaagaucaaagggggagcgggcagguagggacauacggacuuaacaccuucacaaauauggaagcucaguuaguccgucaaauggaaggagaagguguauugucaaaggcagauuuagaaaauccacaucuucuagagaaaaagauaacgcaguggcuugaaacaaaagguguggagagauuaaaaaggauggcaauuucaggagacgacugcguggucaagccgauagacgauagauucgcgaaugcauuacucgcuuuaaacgacauggguaagguaagaaaagauauaccgcaauggcagccauccaaaggauggcacgacuggcagcaggucccuuucuguucgcaccauuuucacgaacucaucaugaaagacgguaggaagcuaguagugcccugcagaccacaagaugaauuaaucggcagagcccgcauaagucagggcgcaggauggucguuaaaagaaacugcguguuuggguaaggcauaugcucaaaugugguccuuaauguacuuucaucgacgugaccuacguuuagcaucaaaugccauauguagugcaguaccaguucauuggauaccaacaucuagaacgacuuggagcauucaugcacaucaccaguggaugacaacagaagauaugcuuaccgucuggaaccgaguuuggauagaggauaauccauggauggaagacaaaacgccaguuacuacuugggaggauguacccuaucuuggaaaacgcgaggaucagugguguggcagucuuaucggacuaacuucgagagcaacuugggcucaaaauauauuaacugcgauacaacaaguacggucuuugauaggggaugaagaauuucuugacuauaugccgaguaugaaacgcuuucggaaagaagaagagagugaaggagcaauaugguaa

SEQ ID NO: 23140 - RNA, 9873 nt, Artificial Sequence
  derived and/or modified CDS sequence (opt6) from DENV-3__GQ868628__SS-prME
acuucccucuguuugaugaugaugcugccagcuacucuggccuuucaucuuacaagcagagauggggaaccacggaugauaguaggcaaaaacgaaagaggcaaaagccugcuauuuaaaacagcgucagguauaaacauguguacuuuaauagcgauggauuuaggggaaaugugcgacgacacaguaacauauaaaugcccauugaucgcagaaguggaaccagaagauaucgauuguugguguaaccugaccaguacauggguaacauaugguacuugcaaccaagcuggugaacacagaagagacaaacguucaguagcccuagcaccacauguaggaaugggucuugacacacgaacacaaacauggaugucagccgaaggagcuuggcgucaaguagagaaaguugaaacuugggccuuaagacaucccggguucacaauccuagcguuauuccuagcucauuauauuggaacaucacuaacucaaaaaguaguaauauucauucuacuaaugcuuguaaccccgucaaugacuaugcgauguguuggaguaggaaauagagacuuuguugaaggccucucuggagcgacauggguggacguaguccuagagcaugguggaugcguaacaacaauggcuaaaagcaaacccacacuugacauugaauuacagaaaacugaagcuacucaacucgcuacguuaaggaaacuaugcauagaggggaaaauuacaaacauaacgacagauagucggugcccgacucaaggugaagcuacacuuccugaagaacaagaucaaaauuauguauguaaacauacauauguagaucgaggguggggcaacgggugcggauuauuugguaaagggucgcucguaaccugugcuaaauuccaaugucuugaaccgauagaaggaaaagucguucaauaugaaaacuugaaauacaccgucauuauaacuguacauacaggagaccaacaucaagugggaaaugauacccagggugugacgguugaaauaacuccacaagcaagcacgguagaagccguauuaccagaauauggcaccuuaggcuuagaaugcucgcccaggacgggucuugauuuuaaugaaaugaucuugcuuaccaugaaaaauaaagccuggaugguccaccgacaaugguuuuucgacuuaccuuugccauggacuagcggagcaacaacagaaacuccaacuuggaaucgaaaagaacuuuuaguaaccuuuaaaaaugcucaugccaagaaacaagagguaguaguucuugggagucaagaaggggccaugcauacggcuuuaacuggagcgacagaaauacaaaauaguggaggaacuucaauauuugcagggcacuugaaauguagacucaaaauggauaaacucgagcuuaaaggaaugaguuaugcaaugugcuuaaauaccuuuguucuaaagaaagaaguuagcgaaacacaacaugguacaauuuugauaaaagucgaguauaaaggugaagaugcgccuuguaaaauaccauuuucuaccgaagacgggcaaggaaaagcucacaauggacgucucaucaccgcuaacccaguaguuaccaagaaagaagaaccuguuaacauagaagcagagccaccauuuggggaaagcaauaucguaaucgggauaggggauaaagcccuaaaaauuaacugguauaagaaaggcagcaguaucggcaaaauguucgaagcaacagcgagaggggcaagacguauggcuauucuuggagauacggcaugggauuuuggaagcgugggagguguucuaaauucuuuaggaaaaaugguacaucaaaucuuuggaucagcauauacugcacuguuuucgggcguuaguuggauaaugaaaauagguauagggguacuauuaacuuggauuggauugaacuccaaaaacacaucaaugagcuucucaugcauaguaauaggaauuaucacauuauaccucggagcggucgugcaagcugauauggguuguguaauaaauuggaaagguaaagaauugaaaugcggaaguggaauuuuuguuacaaaugaagugcacacauggacugagcaguauaaauuccaagccgauucgccaaaaagacuagcaacggccauugcaggagccugggaaaacggcguaugugggauuagaucuaccacaagaauggaaaauuuacuuuggaagcaaauugcuaacgaauuaaauuauauacuaugggaaaauaacaucaaacuaacuguuguuguaggugacauuauagguguauuagagcaaggaaagcggacuuugacuccacaaccgauggaacuaaaguacaguuggaaaacgugggggaaagcgaagauaguaacagcugaaacacaaaacucaucuuuuauuauagauggcccgaauaccccagaaugccccucugcauccagggcguggaauguaugggaaguugaagacuauggcuucggcguauuuaccacaaacauaugguuaaaauuacgcgaaguuuauacacaaagcugcgaucaucgauuaaugucggcagcaauuaaggacgaaagggcuguucaugcagacaugggauauuggauagaaucccagaaaaaugguucauggaaguuagaaaaagccucuuucauagaagugaaaacaugcgcauggccuaaaucacacacacuauggucaaacggagucuuagagagugacaugauaauuccuaagaguuuagccggaccaaucucucaacauaaccauagacccggguaucauacacaaacagcugggccguggcauuuaggaaaacucgaguuagauuuuaauuauugcgaaggcaccaccguagugauaaccgaaaauugugguacgcgagggccgucccuucggacuacaacgguuuccggcaaacuaauacaugaguggugcuguagaucauguacccucccucccuugagguauaugggugaagauggcuguugguaugggauggaaauucggccaauuaaugaaaaagaagaaaacaugguuaaaucguugguaucugcgggaagcggaaagguagauaacuuuaccaugggagugcuaugccuagcuauacucuuugaagaaguaaugagagggaaguucgguaaaaagcauaugaucgcugggguacuauuuacauuuguguuacuucucucaggacaaauuaccuggcgagauauggcacacacauugaucaugaucgggucuaaugcaucggaucggaugggaaugggcguaaccuauuuagccuuaauagccacguucaaaauacaacccuuccuugcucugggcuucuuucugagaaaacuaacauccagagaaaaucuacuucuagggguaggguuagcaauggcaacgacacugcaacugccagaagacauagagcagauggcaaauggaauagcacuaggauuaaugacauugaaacuuauuacacaauucgagacuuaucaauuauggacugcguuaguuucacugacguguucaaacaccaucuucacgcuaacaguagcuuggcguacugcaacccuaauuuuggcgggagucagcuuacuaccacucugucaaaguucaucuaugagaaaaacagauugguuacccaugacuguagcggcuauggguguaccaccacugccacuuuucauauuuucguugaaggauacgccgaagaggagaagcuggccuuuaaaugaaggaguuauggcaguggguuuaguuucaauucuggccaguucauuauuacgaaaugauguaccgauggcuggucccuugguagcagggggccuguugauugcaugcuacguaauuacaggaacauccgcagauuugacggucgaaaaagcagcugauguaacaugggaagaagaagcagaacaaacuggagucagccauaauuugaugauuaccguggacgacgauggaacgaugaggauaaaagacgacgagacggaaaauauuuuaacagugcuccuuaaaaccgcccuuuuaauaguaaguggcauauucccauauaguauaccggcaacacuacuuguauggcacacuuggcagaaacagacgcaaaggucgggagucuuaugggaugucccuaguccuccggaaacccagaaagcggaacucgaagaaggaguguauaggauaaaacaacaggggauauuugggaagacacaaguaggcguuggcguucagaaggagggugucuuccacaccauguggcauguuacacgcggcgcaguacuaacucauaauggaaaaagacuugaacccaacugggcgagcgugaagaaagaucucauuaguuacgguggggguuggcgacuaucagcacaauggcaaaagggugaagaaguccaagugaucgccguggagccaggcaaaaauccaaagaacuuccaaacaaugccuggcauauuucaaacaaccacaggugaaaucggagccaucgcuuuagacuuuaagccagguaccucaggaagcccaauaauaaacagagaaggaaagguaguaggauuguacgguaauggaguuguuacaaagaaugguggauauguauccggaaucgcacaaacaaacgcugaaccggauggaccgaccccggaauuagaagaagaaauguuuaagaaacgcaaucuaacaauuauggacuuacaucccgguucugguaaaacacguaaguauuugcccgccauagucagagaggcaauaaaaaggcgacuucguacacuuauucuagcuccuacucgaguuguugcggccgagauggaagaggcauuaaaaggucuucccauaagguaucaaacgacggcaaccaaaagugaacauacagguagggagauugucgaccuaaugugucaugccaccuucacaaugcgauuauuaaguccgguacggguucccaacuauaacuuaguaauaauggaugaagcgcauuuuaccgauccagcgaguauagcggcacggggauauauaaguacacgaguuggaaugggagaagcagcagcgaucuucaugacagcuacuccgccggguacagcugaagcauuuccucaaaguaacgccccaauacaagacgaagaaagagauaucccugagagaucauggaacucuggaaaugaauggauaacagacuuuguugguaaaacagugugguuuguaccgucaauaaaagcaggaaaugauaucgcuaauugcuuaagaaagaacggcaagaaaguaauacaacuguccagaaaaacauucgacaccgaauaccaaaagacacgccuaaaugauugggauuucguaguuacaacagauauuucagaaaugggugcaaauuuuaaggcagaccgaguaauagauccgagaaggugucuaaagccugugauacuuacagauggaccugaaagggugauccuagcaggucccaugcccguaacagcagcuagugccgcucaacgaagagggcguguaggacgaaauccucaaaaggaaaacgaucaauauaucuuuacaggucagccucucaauaaugaugaggaucaugcacauuggacagaggcuaaaauguuacuugauaauauaaacacaccggaaggaauaaucccugcucuauucgagccagagagagagaaaucggcggccaucgacggagaauacagauugaaaggcgaaucaaggaaaacauuugucgaacuuaugagaaggggagaucuccccguauggcuugcgcauaaaguagcaucugaaggaauaaaauacacugacagaaagugguguuucgacggugaaaggaauaaccaaauacuagaagagaauauggaugucgagauauggacaaaagaaggagaacgcaagaaacuacguccccgcugguuggaugcuagaacguauagugaucccuuggcacugaaagaauuuaaagauuuugcugcaggaaggaaaagcauugccuuggauuuaguuaccgagaucggacgggugccgucucaucuggcacaucggaccagaaacgcguuggacaacuugguaaugcuacauacaagugaacauggagggagagcauaucgacaugcaguagaagaauuaccugaaacaauggaaaccuuacuucugcuaggauuaaugauacuuuuaacagguggugcuaugcuguuucugauuucagguaaaggaauagggaaaaccagcaucggucuuauuugcguaaucgucaguucaggcauguuguggauggcagauguaccacuucaguggaucgcauccgcaauaguuuuagaguucuuuaugaugguuuuauuaauuccugaaccagagaaacagaggacgccacaagauaaucagcuugcguacguaguuauaggcauacuaacuuuagcagccauaguggcagcuaacgaaaugggauuguuggagacaacgaaacgagaccuuggaaugucaaaggaacccggaguugucucccccacaaguuaccuugacguagaccugcaucccgccucagcguggacacuguaugccguagccacaacaguaauaacgcccaugcugaggcacacaauagagaacagcacagccaacguaucguuagcagcuauugcuaaucaggcaguagugcucaugggcuuagauaaaggguggccaauaaguaaaauggaucuaggggucccacuguuggcgcuaggguguuacucacaagucaaucccuuaacacuaacagcagcgguacuguuguuaguaacacacuacgccauaauaggcccaggauuacaagcaaaagccacccgggaagcacaaaagcggaccgcagccggaauaaugaaaaauccaaccguugacggcauuaugacgauugauuuagacccagugauauaugauucaaaguucgaaaaacaauuggggcaagugauguuauuaguucuuugugcaguacagcuauuguuaaugagaacaaguugggcguuaugugaagcccuaaccuuggcuacugguccaauaaccacacuuugggaaggaucuccugggaaauuuuggaacaccacuauugcgguauccauggcaaacauauuccguggaagcuauuuggcaggagcaggacuagcguuuaguauaaugaagucagucggcacaggacgacgugggacugguagucaaggagaaacacuaggggaaaaauggaagaagaaacuaaaucaauuaucucggaaggaguucgaucuauauaagaagucuggaauaacggaagucgaccguacugaggcuaaagagggacucaaacguggagaaacaacacaccacgcaguuucgaggggaagcgcaaaauuacagugguucguugagaggaacaugguaauuccagaaggaagagugauugaucucgguuguggaagagguggcuggagcuacuacugugcgggccuaaagaaaguaaccgaagucaggggguauacaaagggaggcccaggacaugaagaaccagugccuaugucaacuuauggauggaauauaguaaaacuaaugucugggaaagauguguucuauuuaccaccagaaaaaugcgacacucuuuuaugugacauaggggaaucuaguccgucacccacaguggaagaaucgagaacgauacgaguauuaaaaaugguugaaccuugguuacgaaauaaucaguucuguaucaaaguuuugaauccuuauaugccaacuguaaucgaacauuuggaaagacuccaaaggaaauacggaggcaugcugguuagaaauccucuuucucguaauucaacacacgaaauguacuggauuagcaauggaacagguaauauaguaagcaguguaaauauggucucaagacuacuauuaaacagauucacaaugacacaucgccgaccuacgaucgaaaaagaugucgauuuaggagccgggacuagacacguuaacgcagaaccugaaacuccaaauauggauguaauaggagaaagaauuaaacgaauaaaagaagaacauagcucuacguggcacuaugaugaugaaaauccauauaagacuugggcauaucacggcaguuacgaaguaaaggccacagguucagcgucgucuaugauaaacggcguaguaaagcuacuuacaaagccuugggauguuguaccuaugguuacgcagauggcuaugacggauacuacucccuuuggacaacaacggguauucaaagaaaaaguagauaccagaacuccacggccaaugccuggaacucgaaaaguuauggaaauaaccgcagaaugguuauggagaacuuuagggagaaauaagaaaccgcgauuauguacuagagaggaguuuacaaagaaagugcgaacuaacgccgcaaugggggcgguauuuacugaggaaaaucaaugggacagugcucgagcggcggucgaagaugaagaauuuuggaaauuagucgacagagaaagagaacuucacaaacuaggcaaaugcggaucgugugucuauaacaugauggguaagcgagagaagaaacucggagaauuuggcaaggcaaaaggcagccgggccaucugguacauguggcuuggugccagauaucuagaauuugaagcucuagguuucuuaaacgaggaucauugguuuagccgugaaaauucuuacuccgggguagaaggagaaggacuacauaagcuaggguacauucugagagacauauccaaaauacccggaggggcaauguaugcagaugauacagcagguugggauacgcgaaucaccgaagaugaucuucacaaugaagagaaaauaacacaacaaauggauccagagcauagacaacuagcuaacgcgauauuuaaauugaccuaucaaaacaaagucgucaaaguucagagacccacaccaaaaggaacuguaauggacauaauaagcagaaaagaccaaagaggcuccggacaaguuggcacauaugggcuuaauaccuucaccaauauggaagcacagcuuguuagacaaauggagggugaaggaguacucaguaaagcggaccuugaaaauccacaucuccuggaaaagaaaauaacacaguggcuagagacaaaggguguugaacguuugaaacgcauggcaaucucgggggacgauugcguaguuaagccuauagaugaucguuuugcaaacgcucuauuagcacugaaugauaugggcaaaguacgaaaagauauuccucaauggcagccgucaaaagguuggcaugauuggcaacaaguaccuuuuuguagccaucauuuccaugaacuaaucaugaaagauggacguaaacucguugucccuuguagaccacaagaugaauuaauaggcagagcaaggauuucacaaggugcaggauggagccucaaggaaaccgcuuguuuggguaaggccuaugcacaaauguggucguuaauguauuuucaucguagagauuuacgacuugcuuccaaugcgauauguucagcaguaccgguacacuggauacccacuucaagaaccacguggucaauccacgcacaucaccaauggaugacgacugaagacauguuaacggucuggaaucguguauggauugaagauaauccuuggauggaagacaaaacgcccguaacuaccugggaagaugugccauaccuaggcaaacgggaagaucaauggugcggaagucuuaucggguuaacaucaagagcuacaugggcacagaacaucuuaacugcgauacaacaaguacgaaguuuaauaggugacgaagaauuucucgauuacaugccaagcaugaaacgcuuucgcaaggaggaagaaucugaaggggcaaucugguaa

SEQ ID NO: 23141 - RNA, 9873 nt, Artificial Sequence
  derived and/or modified CDS sequence (opt6) from DENV-3__FJ639727__SS-prME
acaagccuaugucuaaugaugaugcuacccgcgacacuagcauuccaucugacaagucgagacggugaaccgaggaugauagugggcaaaaacgaaagagggaaaucacuccuguuuaaaacagcaagcggaauaaauauguguacgcuuaucgcaauggauuuaggagaaaugugugaugauacagugacauauaaauguccauuaauagcagaaguugaaccagaggauauagauugcuggugcaauuuaacuucaacauggguaacguacgggacauguaaucaagcaggagaacacaggcgugacaaaagguccguagcacuugcuccacacguuggaaugggacucgauacgcgaacucaaacauggaugagugcugaaggugcauggagacaaguagagaaaguagaaacgugggcgcuuagacacccaggauuuacuauauuagcucuguuuuuagcacauuauaucggaacaucacuaacccaaaaaguggugaucuuuauacuuuuaauguugguaacgccuucuaugacaaugcgcuguguagggguaggaaacagagauuucguagaaggacuaucaggagccacguggguagauguaguauuggaacacggaggaugcguuacuaccauggcuaaaagcaaaccgacucuggauauugaacuacagaaaacugaagcaacccaacuggcuacacugcgaaaacuguguauagaggguaaaauaaccaacauaacaacggauagccgaugcccaacccaaggggaagcaacccuccccgaagaacaagaucaaaacuacguuugcaaacauacauacguggauaggggauggggcaauggauguggauuguuuggcaaaggcucucucguuacaugcgcaaaauuccaaugcuuagaaccaauugaaggaaaagugguucaauaugaaaacuuaaaauauacuguaauuauuacuguucauacaggugaucaacaccaagucggaaacgacacccaaggagucacggucgaaauuaccccgcaagcaucaacgguagaagcugucuugccagaauacgggacccuagguuuagagugcucaccuagaacuggucucgauuuuaacgaaaugauauugcuaacuaugaaaaauaaggcauggaugguacacagacaaugguuuuucgaucuaccgcuacccuggacaaguggugcaacaacugaaacaccaacguggaaccgcaaggaacuuuuaguuacuuuuaagaacgcucacgcuaagaaacaagaagucguuguauuggguagucaagaaggagcaaugcacacagcacuuacuggggcaacagagauccaaaauucagggggaacgaguauuuuugcuggucaucugaagugccgauugaagauggauaaauuagaauuaaaaggaaugagcuaugccauguguuuaaauacguucguacuaaagaaagaggugagugaaacacagcacggaacaauccucauuaagguugaauauaaaggggaagacgcgccauguaaaauuccuuucagcacggaagauggacagggaaaaagucacaauggaagacuaauuacugccaauccuguagugaccaagaaagaggaacccgugaauauugaagcggagccuccauuuggugaaucaaauauagucauuggcauaggugauaaagcauuaaagauaaacugguacaaaaaggggucgucuauaggaaaaauguuugaagccaccgcacguggugcuaggagaauggcuauauuaggugacacugcaugggacuuugggagcgucgguggcguacugaacagucucgguaaaaugguacaccaaauauucggaucugcuuacacagcauuauuuagcggaguuaguuggauaaugaaaauaggaauaggaguacuuuuaaccuggauaggacuuaauaguaaaaauaccucgaugucuuuuuccuguauugugauaggcauuaucacacuauauuugggcgccguaguacaggcagauaugggaugcguaauaaauuggaaaggaaaagaauuaaaauguggcaguggaauauucguaacgaacgagguccauacauggaccgaacaauauaaguuccaagcagacagccccaaaagauuggcaacugcaauugcgggagcuugggaaaaugguguuugcggaauaagaucuacaacgcguauggaaaaccugcucuggaaacagauagcaaacgaacucaauuacauauuaugggaaaauaauaucaaacugacagucguaguaggcgacaucaucgguguccuagagcaaggcaaacgaacguugacaccgcaaccaauggaauuaaaauacucauggaaaacuugggggaaagcaaagauugucacagcagaaacucaaaauaguucauucauaauagaugggccuaauacuccagaaugcccguccgcuagucgagcuuggaacguuugggaagucgaagauuaugguuuuggaguguucacaacgaauauauggcuaaaacuucgagaagucuauacacaauccugcgaucauagauuaaugucagcagcaauaaaggaugagcgagcuguacacgccgacaugggauauuggauugaaagccagaaaaaugguucauggaaauuggaaaaggcauccuuuauagaagucaaaacuugcacuuggccuaagagccacacauuguggucaaacggaguacuagaaagcgauaugauuauaccuaagagcuuggccgguccgaucucccagcauaaccacagaccuggauacuauacacagacagcaggaccauggcauuuaggaaaguuagaguuagauuuuaacuauugugagggaacaacaguaguaauaacagagaacuguggaaccagagggccaucacuccgaacaacgaccguaucagguaaacuaauacacgagugguguugucgaucauguacucuucccccucuuagauauaugggcgaagauggauguugguaugguauggaaauccgaccaauuaaugaaaaagaggaaaauaugguaaaaucauuaguaagugcagguucuggaaaaguagauaacuuuacuaugggaguauuaugucuggcaauacuauucgaagaagugaugaggggaaaauuuggcaagaaacacaugauagcgggggccuuguuuacauuuguauuacuacuaucaggccaaauuaccuggcgagauauggcacacacucuaauuaugauaggaucuaacgcaagugauagaaugggcauggggguuacguaccucgcuuugaucgcaacuuucaagauacaaccuuucuuagcauuaggauucuuucuacguaaacuaaccaguagagaaaaccuauugcuggguguaggacuagccauggccacaacacuccaauuaccagaagauaucgagcagauggcgaaugguauagcauugggcuuaaugaccuuaaaauuaauaacucaauucgagacauaucaguuguggacugccuuagugaguuuaacaugcaguaacacaauauuuacucucacuguagccuggcgaacugcaacauuaauuuuagcgggcguauccuugcuaccauuaugucaaucuucgucaaugagaaaaacagauugguugccaaugacaguagccgcuaugggugucccaccauuaccccucuucauauucagccucaaagauacuccgaagagaagaagcuggccccuaaacgaagggguaauggcaguuggcuuaguaucaauccuagccucuagucucuuaagaaacgacguaccaauggcugggccguuaguagcaggaggauuauuaaucgcguguuauguaauaacgggcacaucugcugaucugacgguggagaaagccgcugaugucacuugggaagaagaagcugagcaaacgggcguaagucauaaucuaaugauuacuguagacgacgacgggacuaugaggauuaaggaugacgagacggaaaauauauuaacuguacuacucaagacagcucugcuaauugugaguggaauuuuucccuacaguauaccagcgacgcuguuaguauggcacacauggcagaaacaaacucaaagaucaggcguguuaugggacguuccgucucccccugaaacucaaaaagcggaacuagaggaaggggucuaucgaauaaaacaacagggaauauucggaaagacacaaguaggcgucggaguacaaaaggaggggguauuucacacaauguggcaugugacccgcggagcagugcuuacucacaauggaaaacgccuugaaccaaauugggcgagcguuaagaaagaccuaauaagcuaugggggaggguggagacuaagugcacaauggcagaaaggagaagaaguacagguaauugcugucgaacccggcaaaaacccuaaaaauuuucagacaaugcccggaauauuucaaacuacuacgggagaaauuggagcuauugcacuagacuuuaaaccaggaacaucuggcagcccgauaauaaaccgagaaggaaaagugguaggccuauauggaaauggagucgucaccaaaaacgguggguacguaucugguauugcccagacaaacgcggagccggacgguccaacaccugagcuugaggaagaaauguucaagaaaaggaaccuaacaaucauggaccuacaucccggaagcgggaaaaccagaaaauacuuaccggcuauaguacgagaagcuauaaaacggagacugagaacgcuaauacuagccccaacacgugucguugcagcagaaauggaagaagcacugaaaggacuacccauccgguaucaaacaaccgcaacaaaaagugaacauacaggccgugagauaguggacuuaaugugucacgcaacauucaccaugcgguuacuaucuccgguaagaguucccaauuauaaucucgucguaauggacgaagcacauuucacagacccggcaaguauugcagcaagaggauacaucucaacuagaguaggaaugggggaagcugcggccaucuuuaugacagcuacuccuccaggcaccgcugaagccuuuccccaaagcaacgcucccauacaagacgaagaacgagauauaccagaaagaaguuggaauagugguaaugaauggauaacagauuuuguaggaaagaccgugugguuuguaccgucuauuaaagcugguaaugacauagcuaauugcuuaagaaagaacgguaaaaagguuauucaauuaucuagaaagacauucgauacagaauaucagaagacucgacuaaaugauugggauuucguaguaacgacagauauuucugagaugggagcgaacuuuagagccgauagaguuauugaccccagaagaugucuaaaaccaguaauauuaaccgacgggccggagagaguaauacucgcaggaccuaugccgguuacggcugcgucggcagcucaaagaagaggaagagugggaagaaacccacaaaaagaaaaugaucaauauauauuuaccggacagccacucaacaacgaugaagaucacgcucauuggacagaagcuaagaugcuucuagauaacaucaacacuccagaagguauaauaccugcacucuuugaacccgaaagggagaaaagugcggcgaucgauggcgaauaucgauuaaagggcgaauccaggaaaacguucguugagcucaugaggagaggcgauuuacccgugugguuggcacacaaaguagcuagugaaggaauuaaauauacagacagaaaguggugcuuugacggugaacgcaacaaccagauauuagaagaaaacauggacguagaaauuuggacaaaagagggugaacgaaagaaacuuaggccccguugguuagaugccagaacuuauucggauccucuggcgcuuaaggaauuuaaagauuucgcagcaggcaggaaaucaaucgcgcuagaccuaguuacagaaauuggaagaguaccaagccauuuagcgcauagaacuaggaaugcacuugacaaucucgucauguugcauacaagcgagcauggcgguagggcauacagacaugccguagaagaacuaccagaaacaauggaaacacuccuauugcuaggacuuaugauccuuuugacagguggggcuauguuauuucugauaagcggcaaaggcauaggaaaaacaucuauuggucugauauguguaauagugucauccgguaugcuuuggauggcugacguuccgcuccaguggauagcaagcgcaauaguauuagaguuuuucaugaugguguugcuaaucccugaaccagaaaaacaaagaacuccacaggauaaccaacuugcuuacguugucauugguauucuaacccuagcugcgauagucgcugcaaacgaaaugggucuguuagaaaccacuaaaagagauuuaggcaugaguaaagaaccugggguugucucacccacaucauaccuugauguugaucuucauccagcgucggcguggacccucuaugcuguagcuacaacagucauaacgccuauguuacgccauacuauugaaaacagcaccgcgaauguaucguuggcugcaauugccaaccaggccgugguauuaauggguuuagacaagggcuggccuauaucaaaaauggaccuagguguaccccuguuagcacugggauguuauucucaaguuaaucccuuaacacuaaccgcugcuguacugcuguuagugacgcauuaugcaauaauagguccggguuuacaagcaaaagcaacacgcgaggcgcagaaacgaacugccgcugggaucaugaaaaauccaaccguagauggaauaaugaccauugauuuagauccaguuauuuaugauuccaaguuugaaaaacaguuaggacaagucaugcuauuaguacuaugcgccguacaacugcucuuaaugagaaccucaugggccuuaugugaggcuuugacacucgcaaccggaccaauaacuacauuaugggaaggauccccgggaaaguuuuggaauacaacaauagcaguuucaauggcuaacauuuuccgaggaaguuauuuagcgggugcggguuuagcauucaguauaaugaaaucaguggguaccggucgaaggggaacgggcagucagggggaaacccucggugaaaaauggaaaaagaaauuaaaucaacuaagcaggaaagaauuugaccuauauaagaaaagugguauaacagaaguugauagaacugaagcaaaggaaggucuuaaaagaggggaaacaacccaucacgcuguauccaggggcucugcaaaacuccaaugguuuguagagcgaaacauggucauacccgaggggcguguaauagaucucgguuguggaagaggcggcuggaguuacuauugcgcagggcugaagaaaguaacggagguuagaggauauaccaagggaggaccaggacacgaggaacccgucccgaugagcacuuauggauggaacauaguaaaauuaaugucuggaaaggaugucuucuaccugcccccugagaagugugacacauuauuaugugauaucggcgaguccucaccaaguccuacaguagaagaaucgaggacuauaagaguacuuaagauggucgaaccgugguugcgaaauaaccaguuuugcauaaaaguucuaaaucccuauaugccaacuguaauagagcacuuagaaagauugcaacgaaaauacggaggcauguuaguacggaauccgcugucuagaaauucaacucaugaaauguacuggauuagcaauggaacaggaaacauuguuuccagcguaaauaugguaucaagguugcuauuaaaccgauuuacuaugacacacagaaggccaacaauugaaaaagauguggacuugggagccggaacgcgacauguuaaugcagaacccgagacaccgaauauggauguaaucggugaaagaauaaagaggauaaaagaagaacauucaucgacguggcacuacgacgacgaaaauccauacaaaacuugggcauaucacggcuccuacgaagugaaagccacggguagcgcaagcucaaugaucaacggaguggugaaacuuuuaacaaaaccgugggauguugucccaaugguaacucaaauggcaaugacagauaccacaccauuugggcagcagaggguauucaaggaaaaaguagauacaagaacgccacgcccaaugcccggaacgagaaaaguaauggagauaacagcugaauggcuauggcgaaccuuaggaagaaacaaaaagccgcgacuuugcacgagggaagaguucaccaagaaaguucgcacaaaugcagcuaugggagccguauuuacagaggaaaaucaaugggacagugccagagcugccguagaagaugaagaguucuggaaauuaguugacagagaaagagaacuccacaaacuugggaaauguggaaguugcguauauaauaugauggggaaaagagaaaagaaauuaggugaauuugguaaggcuaaagggagucgagccauuugguacaugugguugggugcgcgcuaucucgaguucgaagcacuggguuucuugaacgaggaucacugguucaguagggaaaauucauacucuggaguggaaggugagggguugcacaaacugggauauaucuuaagggacauuagcaaaaucccugggggagcaauguacgcagaugacacugcaggaugggauacacgaauuacugaagacgaucuucacaaugaagagaagauuacacagcaaauggaccccgaacacagacaauuagcaaacgcaaucuuuaaacucacauaccaaaauaaaguuguaaaaguacagagaccaacuccgaaagguacaguuauggacauaaucagucgaaaagaccaaagagggucuggccaaguuggaacauauggacuaaacaccuucaccaauauggaagcacaguuaguccggcagauggagggugaagguguacucucaaaagcggacuuagaaaacccacauuugcuagagaagaaaaucacccaguggcuagaaacgaaaggaguagaaagguuaaaacgcauggcuauaucuggugaugauuguguuguaaagcccauagacgauagauuugcaaacgcacuuuuagcacucaaugacauggguaaaguacgaaaggacauaccacaguggcaaccaaguaaaggguggcacgauuggcaacaggucccauuuugcucacaucacuuucacgaacucauaaugaaagaugggcgaaagcuaguagugcccugucgaccgcaagaugaacuaaucggacgcgcgcgaauaucgcaaggagcuggcuggagccuaaaagaaacagcuugcuuagguaaggcuuaugcacaaauguggagccucauguauuuccaucgucgcgacuuaagacucgcaucaaaugcgauauguucggcuguaccugugcacuggauaccaacauccagaacuacauggucuauucacgcacaccaucaauggaugacuacagaagauaugcugacuguuuggaaucgaguauggauagaagacaauccauggauggaagauaaaacgccaguuacgacaugggaagacguuccuuacuuagggaaaagggaagaccaaugguguggaucgcuaauugggcuaacaucaagggccacuugggcacagaacauauuaacagcaauccagcaaguacggagcuugauaggagaugaagaguuucuagauuauaugccgucgaugaaaagauucagaaaagaagaggaaagugagggugcuauaugguag

SEQ ID NO: 23142 - RNA, 9873 nt, Artificial Sequence
  derived and/or modified CDS sequence (opt6) from DENV-3__GQ868629__SS-prME
acuagccuaugccucaugaugauguugccggcuaccuuagcguuucaccucaccucaagagauggagaaccucguaugauugucgguaaaaacgaaagaggaaaaucccugcuuuucaaaaccgcaucaggaauaaacaugugcacuuuaauagcaauggauuugggggaaaugugcgaugauacugucacuuacaaauguccacuaauugcggaagucgaaccugaggauauagacugcuggugcaauuuaaccucuacauggguaacguauggaacauguaaucaagcgggggaacacagaagagacaaacgaagcguagcacuagcaccucacguuggaauggggcuugacaccagaacacaaacuuggauguccgcggagggcgcauggcgacaaguagaaaaaguagaaacuugggcauuaagacacccgggauuuacaauacuagcucucuuucuagcucauuauauaggaacuagcuugacacaaaaaguaguuauauucauucuauuaaugcuagucacuccaucgaugacaaugagauguguagguguuggaaauagagauuuuguugaaggauuaagcggagcaacauggguugacguuguauuggaacacggugguugugucacaacgauggcuaaaucaaaaccgacccuugacauagaacuacagaaaacggaagcaacucaacuagccacauuacggaaauuauguauugaaggaaaaaucaccaacaucacaacagauucaagauguccgacacaaggagaagcuacccuuccugaagaacaagaccaaaauuauguauguaaacauaccuacguugacaggggaugggggaauggaugcggacucuuuggcaaaggcagccuuguuacuugugcaaaauuucaaugucuugaaccaauagaagggaaaguaguacaauacgaaaaccucaaauacacuguuauaauuacaguacauacuggugaccaacaucaaguagguaacgauacacaaggugugacaguugaaaucacuccacaagcguccacaguugaagcuguauuacccgaguauggcacgcuuggacucgaaugcucuccaagaaccggacuagacuuuaacgaaaugauucugcuuacuaugaaaaauaaagcguggaugguucaucggcaaugguucuuugaccuaccacuaccuuggacgucuggugccauuaccgaaacgccaacuuggaacaggaaagaacuucuagucacauuuaaaaaugcucacgcuaagaaacaagagguuguaguccuuggcucccaagaaggagccaugcacacagcguuaaccggagcaacagagauacaaaauuccggcggaacaucuauuuucgcuggacaucuaaaaugucgacuaaaaauggauaaauuggaauuaaaaggaaugagcuacgcaaugugccuaaacacauuuguacuuaagaaagaagucucggaaacucaacauggaacaauucucauaaaaguggaauacaaaggagaagacgcuccuuguaaaaucccauucuccacugaggacggccaaggaaaggcucauaauggccggcuuauuaccgcaaauccgguugugacuaaaaaggaggaacccguuaauauugaagcugaaccaccauuuggggagaguaacauaguaaucgguauuggcgacaaggcacuaaaaaucaauugguauaagaaagguucuucaauuggcaaaauguucgaagcaacagccagaggagcgcgaagaauggcuauauugggugauacggcaugggauuucggauccguaggcggaguucuuaacagucuagguaaaaugguacaccaaauauucgguucagcauauacagcucucuuuaguggugugagcuggauuaugaagauagggauugguguuuuauuaacauggauaggacucaauagcaagaauacgaguaugucauucucuugcauaguaauaggaaucauuacauuguaccuuggagcuguaguucaagcugauauggggugcguaauaaauuggaaagguaaagaacuaaaaugcggguccgggaucuucguaaccaacgaaguccacacguggaccgaacaauacaaguuccaagcagacagcccuaaaagacuugcaacggcgauagcuggggcuugggagaauggaguuuguggaauuagaaguacaacuaggauggaaaaccugcuauggaaacaaauagcaaaugagcuaaauuacauacuuugggagaauaauauaaaacugacaguagucguuggugacauaauuggaguacuggaacaggggaaacgcacgcugaccccacaaccaauggaacuuaaauacucauggaagacuuggggaaaagccaagauugugacugcagagacucaaaauaguagcuuuauaauagacggaccaaacacaccggaaugucccucggccagcagagcauggaauguuugggaaguagaagacuacggauucgguguauuuacuaccaacauaugguuaaaauuacgagaaguguauacucagagcugugaccauagauuaauguccgccgcuauuaaagaugagagagcgguccacgcagacaugggguauuggauagaaagucagaaaaauggcagcuggaaacuagagaaagccagcuuuauugaaguuaaaacgugcaccuggcccaaaucacauacucuguggagcaacggcgugcuagaaucagacaugaucauucccaaaagucuagcaggcccuaucagucaacauaaccaucgcccgggguaucauacucaaacagcuggaccauggcaucuuggaaaacuagaacucgauuuuaauuacugugaagguacaaccguugucauaacagagaacugcgguacuagggggccuucacuucgaacuacuacaguuucgggcaaacuaauacaugaaugguguugccgaaguuguacauuaccaccauuaagauauaugggagaagauggaugcugguauggaauggaaauacgcccaauuaacgaaaaagaggaaaauaugguaaaaucuuuaguaagugcagguucagguaaaguagacaauuuuacgaugggaguccuauguuuggcgauauuauucgaagaggucaugagaggaaaauucgguaaaaagcacaugauagcgggaguacuauuuacguuugucuuguuauuaagcggucaaauuacguggagagacauggcacauacacucaucaugauuggaucgaacgcaucagauaggaugggaauggggguuacguacuuagcucugauagccaccuuuaaaauacaaccauuccuagcacuaggauucuuuuuacguaaacuaacaagcagagagaauuuauuguuagguguaggacucgcuauggcuacaacgcugcaacuaccagaagauauugaacaaauggcaaaugggaucgcucugggccuaaugacccuuaaacuuauuacucaguucgaaaccuaucaacuauggacagcuuugguaucauuaacuugcuccaauacgauauuuacacuaacugucgcguggcgaacggcuacacuaauacuagcaggggugucauuauuacccuugugucagaguucauccaugcguaaaacugacugguuaccaaugacgguggccgcaauggggguuccgccuuuaccauuguuuauuuucucguuaaaggacacgcccaaaagacgcaguuggccucucaaugaaggcguuauggcagucgguuuaguauccauucuagccucuucucuucuucguaacgaugucccgauggcugguccuuuaguagcaggaggacuacuaauugcaugcuacgugaucacaggaacaagugcagacuuaacgguagagaaagcagcagauguaaccugggaagaagaagcagagcaaaccgggguaucgcauaaucuuaugaucacaguagaugaugacggaacaaugcggauuaaggaugacgaaaccgaaaacauccucacggugcuccuuaagacagcguugcuaauaguaucaggaaucuuuccauauaguauucccgccacacuccugguguggcauaccuggcaaaagcaaacgcaaagaaguggaguuuuaugggauguaccgaguccaccugaaacucaaaaggcagaacuggaagaaggcguauauaggauuaagcagcaaggaaucuuuggaaaaacacagguaggagugggcguacagaaagagggaguauuucacacaauguggcacgugacaaggggagcaguauuaacacauaauggaaaacgguuagagccuaauugggcuagugucaagaaagacuuaauuucauaugguggcggauggagacuuucagcacaguggcaaaagggagaagaaguucagguaauagcaguugagccugguaaaaaucccaaaaauuuccaaaccaugccaggaauauuucaaacuacgaccggugagaucggugcaauugcuuuggauuuuaaaccggguacaaguggcagccccauuauaaaccgugaaggcaaaguugucgguuuauacggaaaugguguugugaccaaaaauggcggguauguuucaggaauagcccaaacaaacgcugagccagauggaccaacaccagaacuggaagaggagauguuuaagaaacggaauuuaacaaucauggaucuacacccagguucugggaaaacucgaaaauacuuaccagcaauagugagagaagccauaaaaaggcguuugcgaacacuaauacuggccccaacgcguguaguugccgcugaaauggaggaagcauuaaaaggcuuaccgaucagauaucagacaaccgcaacaaaaucugaacacaccggaagagaaauaguggaucuuaugugccaugcuacuuucacaaugcguuuguuaucacccguccgcguccccaauuauaaucuagucauuauggacgaagcccauuuuacagaucccgcaaguaucgcggcaagaggauacauaagcacgagaguaggaaugggggaagcugcugcgauuuuuaugacagccacacccccaggaacugcagaagccuucccacaaucaaacgcaccuauucaagaugaagaacgagauauaccagagcguagcuggaacagcggaaacgaguggaucaccgauuucgucggaaagacuguuugguuuguaccuucgauaaaggcaggaaaugauaucgcaaauugccuacgcaaaaauggaaagaaaguaauacaauuauccagaaaaaccuuugacacagaauaucagaaaacuagauuaaaugauugggacuucguaguaaccacagauaucucugaaaugggugcuaacuucaaagcagaccgagugauugacccuagaagguguuuaaagcccgucauuuugacggaugggccagaacggguuauucucgcuggaccgaugccaguuacagcagcuagugcggcacaacgcagaggcagagugggucgaaauccgcaaaaggagaacgaucaauauauauucacagggcaaccucucaacaacgacgaggaccaugcgcacuggaccgaagcaaagaugcuacuugacaauauaaacacacccgaaggaauaauuccugcacuuuuugaaccagaaagggaaaaaucggcggcaauagauggugaguauagacuuaaaggugaaucccgaaagacauuugucgaacuaaugcgccggggcgaucucccaguauggcuugcacauaagguagcaagugaaggcaucaaauacacugauagaaaauggugcuucgacggggaaagaaacaaccaaauucuagaagaaaacauggacguugagauauggacuaaagagggcgagagaaagaaauuacguccaagauggcucgacgcgaggacuuacucagacccuuuagcauuaaaagaauuuaaggacuucgcugcaggccggaaauccauugcacucgaucuugugaccgaaauaggccgagugccaagucaucuugcacauaggacacguaacgcccuugauaaccuggucaugcuacacaccagcgaacacgguggcagagcauaucgacaugcuguagaagaguuacccgaaacaauggaaacuuuauuacuucuaggauuaaugauauuacuaaccggcggagcgaugcuauuccucaucucgggaaaagguauagguaagaccucgauaggucucaucugcguuauuguaaguagcgguaugcucuggauggcugaugucccacuucaauggauagcaucagcaaucguauuggaauuuuucaugaugguucuauuaauaccagaaccugagaaacaaagaacuccacaagauaaccaauuagcuuauguaguaauaggaaucuuaacgcuagcugcuaucguugcggcaaaugaaaugggccuucuugaaacuacuaaaagagaucuugggauguccaaagaaccagguguuguaucgccuaccagcuauuuagauguagaccuccauccagccucagccuggacacuguaugcaguagcuacaacuguaauuacgccaaugcuccgacacacaaucgaaaauucgacggccaauguuagucucgcagccauagcuaaucaggccgucguccuaaugggucuugauaaaggguggccaauaaguaaaauggacuuaggggugccauuauuagcacugggcuguuacucucagguuaauccauuaacauuaacugcagcaguucugcuucuugucacgcauuacgcaauuauaggcccuggcuuacaagccaaagccacgagggaagcucaaaaacggacagccgcugguauuaugaagaaucccacaguugacggcauaaugacaauugaccuggacccugugauauacgauagcaaauuugaaaaacaauuaggccagguaaugcuccucguccuuugugcaguccaauuacuguuaaugcggacaucaugggcccugugcgaagccuuaacauuagcuacagguccaauaacuaccuugugggaagguucaccaggaaaauucuggaacaccacuauagcagugucgauggcgaacauauucagggguuccuaccuggcaggagcgggacuggcauuuucuauaaugaaaucaguagguacagguaggagaggaaccggaucccaaggagagacguuaggagaaaaauggaagaagaaacuaaaccaacuaaguaggaaagaauuugauuuauauaaaaaguccggcauaacagaaguagaucgcacagaagccaaagaagggcuaaaaagaggcgagacuacccaccaugcaguaucgcgcgggucugcuaaauuacaaugguuuguugagagaaauaugguaauuccugaggggcgugucauagacuuaggguguggacgagggggauggagcuacuauugugcaggccuaaagaaagugacggaaguacguggauauacaaaaggcggaccgggccaugaagaaccaguuccgaugucgacauauggauggaauauugucaaacuaaugagcgggaaagacgucuuuuauuuaccaccggaaaaaugugauacguugcuaugcgauaucggugaaagcagucccuccccgacuguugaggaaucaaggaccauuagaguccuuaaaaugguagagccguggcuaaggaauaaucaauucuguauaaaaguacucaauccuuauaugccuacgguuaucgaacaucuggaaagauuacagagaaaguauggaggaaugcuggugagaaacccgcuaucacgaaauucaacacacgaaauguacuggauaucuaaugggacagggaacauuguuuccaguguaaauaugguuuccagacuccuuuuaaaucgcuuuacuaugacucacagaagacccacuauugaaaaagacguggaccuuggagcaggaacacgucacguaaaugcagagcccgaaacuccuaauauggauguaauaggcgaaagaauaaagcgaauuaaggaagaacauuccuccacauggcacuacgacgaugaaaacccuuacaaaacaugggcauaccauggcucauacgagguaaaagcaacuggaucagccucgaguaugauaaaugggguugugaaacucuuaaccaaaccaugggacguugugccaaugguaacgcaaauggcgaugacagauacuacccccuucggacaacaaagaguauucaaggagaaaguugauaccagaacuccucgaccgaugccagggacgcgcaaaguuauggaaauaaccgccgaauggcuauggagaacauugggacgaaauaagaaaccaagacuaugcacaagagaggaauuuacaaagaaaguaagaacuaaugccgcaaugggcgcgguuuuuacagaagaaaaccaaugggauagugcucgugcagccgucgaggacgaggaauuuuggaaguuagucgaucgcgagcgugagcuccauaaauugggaaaaugcggguccuguguuuauaauaugaugggaaagcgggaaaagaaauuaggcgaguucgguaaagccaaagggucaagggcaauaugguacauguggcucggugcgcgguaucuagaguuugaagcauuaggcuuccuaaacgaggaucauugguuuucgcgugagaacucguauaguggaguugagggagaaggauugcacaaacucgguuauauuuugagagauauaucaaaaauuccuggaggggcaauguacgccgaugauaccgccggaugggacacgcgaauaacagaagacgauuuacacaaugaagagaaaauaacucaacaaauggauccggagcacagacaacuugccaaugcuauauucaaguugacuuaccaaaauaaaguaguuaagguacaaagaccuacaccaaagggaacugugauggauauuauaucucguaaggaucaacgugggucaggacaaguuggaacuuauggauuaaauacauucacuaacauggaagcgcaacugguaagacaaauggaaggugaaggcguucucaguaaagcagacuuagagaacccgcaucuguuagagaagaaaauaacacagugguuggaaacaaaagguguggagagacugaaaaggauggcuauaaguggagaugauugugugguuaaaccgauugacgacagauuugcuaacgcacuacuagcgcuuaaugauaugggcaagguacgaaaagauauuccgcaauggcagccuucuaaaggauggcacgacuggcaacaaguaccauuuuguucgcaucacuuucacgaacugauuaugaaagauggucgaaaauuagucgugccguguagaccacaagacgaauugauuggaagggcaagaauaucacaaggcgcgggauggucauuaaaggaaacugcaugccuaggaaaggcguacgcgcaaauguggagcuuaauguacuuucauaggagggaucuacguuuagccucaaaugcgauaugcucugcgguacccguccauuggaucccaacaagucgaacaacauggucaauccacgcacaccaucaauggaugacuacggaagacaugcugacggucuggaacagaguuuggaucgaggacaauccauggauggaagauaaaacuccaguuacgacuugggaggaugucccuuaccuggggaagcgggaggaccaaugguguggaucacuaauaggcuugacguccagagcuaccugggcucaaaauauauugaccgccauacaacaaguaaggucacucauaggagaugaagaguucuuagacuauaugccuaguaugaaacgcuucaggaaagaagaagaaucagagggcgcaauuugguag

SEQ ID NO: 23143 - RNA, 9873 nt, Artificial Sequence
  derived and/or modified CDS sequence (opt6) from DENV-3__FJ639728__SS-prME
acgucgcuaugucuuaugaugauguuaccagcuacacucgccuuucaccuaacaucacgugauggggaaccgagaaugauagugggcaaaaaugaaagaggaaaaucacuucuuuuuaaaacagcaagcgguauaaauauguguacacugaucgcuauggaucuaggggaaaugugugaugauacaguaacguauaaauguccccuaaucgcagaaguagaaccggaagauauagauuguuggugcaacuuaacuucaacguggguaacauauggaaccugcaaccaagcuggggaacauagacgagacaaaagaucaguagccuuagccccucacgugggaaugggauuggauacaagaacacaaacauggaugucggcagagggggccuggagacaaguagaaaaagucgagacuugggcauugcgacacccagguuuuacaauauuagcauuauuccuggcacauuauauuggaaccucacucacucaaaaagugguaaucuuuauacuacucauguuagugacuccaucgaugacaaugcgcugcguugguguaggaaaucgagacuuuguugaaggacuauccggagccacaugggucgacguaguguuagaacauggggguugcguuacaacaauggcaaaaaguaaacccacuuuagacauugaacuucagaaaacagaagcaacucaauuagcaacguuaaggaaauuaugcaucgaggguaaaaucacaaauauaacaacugacaguaggugcccaacgcaaggagaggcaacacuccccgaagaacaagaucaaaauuacguauguaaacauacauauguagaucgagggugggguaacggauguggcuuauucgguaaagguucauuaguuacgugcgcgaaauuccaaugccuggaaccaauugaagggaaaguuguacaguaugaaaaucuaaaauacacagugauuauuaccguucacacaggugaccaacaccaagucgguaaugacacccaaggugugacaguugaaauuacuccacaagcaucaacaguagaagcaguacugccagaauauggaacacugggguuagaauguagucccaggacaggucucgacuuuaaugagaugaucuuauuaacgaugaaaaacaaagcauggauggugcaccgucaaugguucuuugauuuaccuuuaccguggacuagcggggccacuaccgaaacaccuacuuggaaucgaaaagaauugcuaguuacauuuaaaaacgcgcaugccaagaaacaagaaguggucgucuuagguucgcaggaaggugcaaugcauacggcgcuaacaggagccacagaaauacaaaacucaggagguacaagcaucuuugccgggcaucuuaaaugucguuuaaaaauggauaaacuagagcucaaaggcaugucguacgccaugugccuaaacacuuuuguucuuaagaaagaagugucggaaacgcaacacgguacaauccuaaucaaaguagaauauaaaggcgaagacgcaccaugcaaaauaccuuucuccacagaagauggccaaggaaaagcacacaauggaagauuaauaacagcgaauccgguuguaacaaagaaggaagaaccaguaaacauagaagcagaaccaccauucggggagucaaauauuguuauaggaauaggagauaaagcacuaaagauaaacugguacaagaaaggcuccucuauagggaaaauguuugaggcaacagcaaggggagcaagacgaauggcgauucucggugacacagcgugggauuuuggcaguguaggaggaguuuuaaacucccuaggaaagaugguccaccaaaucuucgguucugcauauacagcccuauuuucuggagugaguuggauaaugaaaauaggcauugguguucucuugacauggauuggucuuaauagcaaaaauacuucgaugaguuuuucauguauugucauuggaauuaucaccuuguaucugggcgcgguuguccaagcagauauggggugcguuauaaauuggaaaggaaaagaacuuaaguguggaagugggauuuuugucacaaaugaaguacauacguggacggagcaguacaaauuccaagccgacaguccaaagcgucuggcgacugccauagccggagcaugggaaaauggcguauguggaauacgaucaacgacgcgaauggaaaaccuguuauggaaacaaauagccaaugaauuaaacuacaucuuaugggaaaacaacaucaaacucacagugguugucggcgauauuaucgggguacuagaacaaggaaaaagaacacuuacaccgcaacccauggaacuuaaauauagcuggaaaaccuggggcaaagcgaagauaguuacagcagagacucaaaauucaucauuuaucaucgauggaccuaacaccccagaaugucccagugcguuaagagcguggaacguaugggaaguggaagauuauggcuuuggaguuuuuacuacaaacauauggcucaaacuacgcgaggucuacacacaaucaugcgaucaccguuuaaugagcgcggcaauaaaagaugagagggcaguacaugcagauauggguuauuggaucgaaucucagaaaaacgggucauggaaacuagaaaaagcaucauuuauugaaguuaagacuuguacuuggccaaaaucgcacacacuauggaguaauggcguccuggagagugauaugauaauucccaaaucacuagcaggaccuauuagccaacacaaccaccggccgggauaccacacgcaaacggcgggucccuggcaccuuggcaaacuggagcucgacuuuaacuauugcgaagguaccacuguaguuauuacugaaaauuguggaacuagagguccaucuuuacguacgacaacgguaucggggaaacuaauacacgaauggugcuguagaaguuguacauugcccccucuucguuauaugggugaagacgggugcugguaugguauggaaauacgaccuaucaaugaaaaggaagaaaacaugguuaagagcuuaguuucugcaggaagcggcaagguagauaauuucacaaugggcgugcuuugcuuggccauuuuauucgaagaagugaugcgagguaaauuugggaaaaagcacaugaucgccggcguccuauucacauucguuuuacuucucagcggacaaauaacguggcgggauauggcacacacauuaauaaugauuggcagcaaugcaucagaucgaaugggaauggggguaacuuauuuagcgcugauugcuaccuuuaagauacaaccauuucuagcguugggguucuuucuucgaaagcucacaucacgugaaaauuuauuauuggguguugguuuagcaauggccaccacauugcaauugccggaagacauugaacaaauggcgaaugggauagcacuagguuuaaugacguuaaaacuaauuacgcaauuugagacauaucaguuauggacugcauugguuucuuugaccugcucaaacaccauauucacacuaacuguugccuggaggacggcgacuuuaauacuagcugggguuuccuugcugccacuuugucaaagcagcaguaugagaaaaacagacuggcuacccaugacaguugccgcgaugggaguaccgccauuaccacuauucauauucucucuaaaagauacuccaaaacgaagaaguuggccauuaaaugaagguguaauggcagucggacugguauccauccuggcaucgaguuuauugaggaaugacguuccuauggcgggaccuuuagucgcgggaggccuucuaauagcgugcuauguaauaacgggaacaucggcugauuuaacagucgaaaaggcugcugauguuacuugggaggaagaagcggagcaaacaggaguaucccauaacuuaaugauuacaguagacgacgauggaacuaugagaauaaaagaugaugaaacggaaaacauucuuacuguacuacuuaaaacugcucuacucauugugucggguauauucccguacagcauacccgccacuuuacugguguggcacacauggcagaaacaaacacaaaggaguggaguccuaugggacguucccuccccaccagagacacaaaaagcugaauuagaagaaggcguauacagaauuaagcagcaaggcaucuucgguaaaacgcaaguagguguuggugugcaaaaggaaggaguuuuucauaccauguggcauguuaccagaggggcaguccuuacucacaacgguaaacgccuugaaccuaauugggccagugugaagaaggacuuaauaucuuacggaggaggguggagauuaucugcgcaguggcagaaaggugaagaagugcaagucauugcaguggaaccaggcaaaaacccuaaaaauuuucaaacgaugccagguaucuuucaaacuacaacaggagagauuggggcgauugcauuagacuuuaaaccugguaccucugggucaccgauaauaaauagagaaggaaaaguaguggguuuauacggaaauggaguagugaccaaaaaugggggauauguuucaggaauagcacaaacaaacgcggaaccugacggaccuacaccagaauuggaggaagaaauguuuaagaaacguaaccucacaauaauggaccugcauccaggaucaggaaagacgaggaaauaucuacccgccauaguacgagaagccauaaaacguagacugcgcacacuaauauuggcgccuacacgggucgucgcggcugagauggaagaagcacuaaagggucucccaauucgauaccagaccacagccaccaaaagugagcauacaggaagagaaauaguagauuuaaugugucacgcaaccuucacaaugcgauuauugucaccagugagagucccaaacuacaaucuuguuauuauggacgaggcucauuucacugauccggcuaguauagcggccagagguuacauuucaacuagaguaggcaugggugaagcagcagcaauauuuaugacagcuacgccuccaggcacggcagaggccuuuccucaaagcaacgcgccaauacaggaugaagaaagggauauucccgaaaggucauggaacuccgguaacgaguggauaacugacuuuguugggaagacagucugguuuguaccuucuauaaaagcaggaaacgauauagcgaacugccuacgaaagaauggcaagaaaguaauacaauuaucacggaaaacauuugauacugaguaccagaaaacucgccugaaugauugggacuucguuguuacuacugauaucucagagaugggugcuaacuuuaaagccgaucgcgugauagacccucgaagauguuugaagccaguuauuuuaacugaugggcccgaaagaguuauauuggccggaccaaugcccguaacagcagcuucagcggcgcaaaggaggggcagggugggccggaauccacaaaaggaaaacgaucaauauauuuucacaggacaaccgcuaaauaacgaugaagaucaugcccauuggacagaagccaaaauguuguuggauaauauuaauacuccagaagguauaaucccagcacuauuugaaccagaaagagaaaaguccgcagcaauagacggugaauaccgauuaaaaggugagucuaggaagacguuuguugagcuuaugcgaagaggcgaccugccuguuugguuggcacauaagguagcguccgaaggcauaaaguacaccgacagaaaaugguguuuugauggagaacgaaauaaccaaauauuagaagaaaauauggauguagagaucuggacuaaagaaggugaacgaaagaaacuccggccaagguggcuugacgcaagaaccuauucugauccauuggcauuaaaagaauuuaaagauuucgccgcuggaagaaaaaguaucgcuuuagaccugguuacugaaaucgggcggguucccagucaucuagcacacaggacaagaaaugccuuggauaacuuaguaauguuacauacguccgagcacggggguagagcguaucgucaugcuguggaagaguuaccagaaacgauggaaacacuacuacuucuuggccugaugauccuguugacgggcggagcuauguuauuuuuaauuagcggaaaaggaauaggaaaaacuagcaucggacugauaugcguaauugugagcucagggauguuauggauggcagacguaccacugcaauggauagcuucagccauaguacuugaauuuuucaugaugguuuugcuaauaccggaaccagaaaagcaaaggacaccucaagauaaccaauuggcuuacguuguaauugggauacuaacgcuugcggccauagucgcagcaaaugaaaugggacuacuagaaacaaccaagagagaccuuggaaugaguaaagaaccaggugugguaaguccgacaaguuauuuagauguggaccuacacccagcuucagcuuggacacuguaugcagucgcaacgacgguaauuacaccgaugcuuagacauacgauugaaaacuccaccgcaaaugucucauuggccgcuauagcuaaucaagccgugguacuaaugggauuagacaaaggcuggccaauaucgaaaauggaucugggcgugccacuauuagcccuggguuguuauagccaaguaaauccucuaacauuaacagcagcaguccugcuauuaguaacacauuaugcaauaaucggaccgggcuuacaagccaaagcuacacgggaggcccaaaagcggacggcagcagguauaaugaaaaaucccacugucgaugguauaaugacgauugaucuagaucccguuauauaugacucuaaauuugagaaacagcucggacaaguuaugcuuuuagugcuaugugcggugcaauuacuuuuaaugagaaccaguugggcauugugugaagcccugacacuugcaacgggaccuauaacgacacuaugggagggguccccgggaaaguuuuggaacaccaccauagcaguaaguauggcaaauaucuuuagaggaaguuauuuagccggugcaggucuagcauucaguauuaugaaaucagugggaacaggcaggagaggaacugguucacaaggggaaacacuaggugaaaaguggaaaaagaaguuaaaucaacuaucaagaaaagaauuugaccuuuacaagaaaucugguauaacagagguggaccggacggaagccaaagaaggauuaaaaaggggagagaccacucaucaugcuguuucucgaggauccgcaaaacuucaaugguucguugaaagaaauaugguuauaccagaggguaggguaauugaucuagguugugggcggggaggauggaguuacuauugugcuggccugaagaaaguaacagagguucgggguuacacgaaaggaggaccaggacaugaagaaccgguaccuaugucgacuuacggguggaauauaguaaaacucaugucugguaaagacguauuuuacuugccuccggaaaaaugugauacucuccuaugugauauaggagaaucuucuccaagucccacaguagaagaaucuagaacuauaaggguacuaaaaaugguugagccuuggcuacgaaacaaccaauucugcauaaagguuuugaacccuuauaugccaacuguuauugagcaccuugaacgacuacaacgcaaauacggaggaaugcuaguaagaaacccacucucaagaaacuccacccacgaaauguauuggauaucaaauggcacaggaaacauuguaagcagugucaacaugguaucaagacuacuucugaauagauucacaaugacgcauagaaggccaaccaucgagaaagauguugauuuaggggcaggcacgcgccaugugaaugccgagccagaaacccccaauauggacgucaucggcgaacgaauuaagaggauuaaagaggagcauucaucaacauggcauuaugaugacgaaaauccauacaaaacaugggcauaucacggaagcuacgaaguaaaagcgacaggaucugcuagcuccaugauuaauggaguggucaaguugcuuacaaagccaugggaugucguuccaaugguaacucaaauggcaaugacugacacuacaccuuuuggacaacaaagaguuuuuaaagagaaaguggauacuagaacuccaaggccaaugccgggaacacgcaaggucauggaaauaaccgcugaguggcuauggcggacucuaggacguaacaagaaaccacgccuguguacccgagaagaguuuacaaagaaaguuagaacuaacgcugccaugggggcagucuuuacagaagaaaaucagugggauucagcuagggcagcaguugaggacgaggaguucuggaagcuaguugaucgggagagagaacuacauaaauuagguaaaugcggcaguuguguauauaauaugauggguaaaagagagaagaaacugggugaguuuggaaaagcaaaagguucgagagcuauuugguacaugugguuaggggcuagauaccuagaauuugaagcacuuggauuuuugaaugaagaccauugguuuagcagggaaaacucuuacuccggaguagaaggagaaggccuacauaaauugggcuacaucuuacgagacauaaguaaaauaccaggaggcgcuauguaugccgaugacaccgcggggugggacacaaggauuaccgaagaugaccuacauaaugaagaaaagauaacucaacagauggacccugaacaucggcaauuggcuaacgcuauauucaaacuaacauaccaaaacaaaguuguaaaagugcaaagaccgacucccaagggaacgguaauggacauaauaucuagaaaggaucaaagggggucuggucaaguugggaccuacggucuuaacacauuuacgaauauggaagcacagcuaguacgucaaauggaaggggaagggguacucaguaaggcugauuuagagaacccacaccuauuggaaaagaaaauaacacaguggcuagaaacaaagggugucgaaagacuuaaacgcauggcgauaagcggagaugacugcguaguaaaaccaauugacgaucguuucgcaaaugcauugcuggcgcuaaacgacaugggaaaagugcgaaaagauauaccgcaauggcaaccuaguaagggguggcaugauuggcaacaaguaccauucuguucacaucacuuucaugagcucauaaugaaagaugguaggaaacuuguaguaccguguaggccgcaagacgaacuaauaggaagggcgagaauaucucaaggugccgguuggucacuaaaagaaacagccugccugggaaaagcauaugcccaaauguggucacuuauguauuuucaccgcagggaccuucgccucgcuucaaaugcaauauguucagcgguaccugugcauuggauacccacuucuagaacaacguggucuauacaugcucaucaucaauggaugaccaccgaggacaugcuaaccguauggaaucgaguauggauagaggauaauccauggauggaagauaaaaccccagugacuacaugggaagaugucccauaucuuggaaaaagagaagaccagugguguggaucauuaauaggguuaacaaguagagcaacaugggcgcagaauauauuaacggccauccaacaggugagaucauuaaucggagacgaagaguucuuagauuauaugccaaguaugaaaagauuucgcaaagaagaagagucagaaggagcuaucugguaa

SEQ ID NO: 23144 - RNA, 9873 nt, Artificial Sequence
  derived and/or modified CDS sequence (opt6) from DENV-3__FJ639729__SS-prME
acaaguuuauguuuaaugaugaugcugccagcgaccuuagcauuccaucuaacgaguagagauggugaaccucguaugauaguugguaaaaaugaaagaggcaagagcuuguuauuuaaaacugcaagugggaucaauauguguacacuaauagcgauggauuugggagaaaugugugaugauacaguuaccuauaaauguccauuaauugcggaaguugaaccugaagacauugauuguugguguaauuuaaccaguacaugggucacauacggaaccuguaaccaagcuggcgaacauaggagagauaagagaaguguagcauuagcaccucauguaggaauggggcuugauacgagaacacaaacuuggaugucagcagagggugcauggagacaaguugaaaaaguggaaacgugggcguuaagacauccagguuuuacaauuuuggcauuauucuuggcacauuauauuggaaccucacucacucaaaaagucgucauauuuauuuugcuuaugcuugugacaccaaguaugacgaugagguguguaggcgucggaaacagagauuuuguugaggggcuaucaggcgccacaugggucgauguuguucuggagcauggggguugcguaacuacgauggcaaaaagcaaaccaacauuagacauagaauugcagaaaacagaggcgacucaauuagcgacccuucguaaauuaugcauagaaggaaaaauaacaaauauaacaacagauaguagauguccaacucaaggggaagcaacacuaccagaagaacaagaccaaaauuauguguguaaacauacauacguagaccgaggauggggcaaugggugcggguuauuuggaaaagguucccuuguaacaugcgcuaaauuucaaugcuuagagccaauagaagggaaagucguccaauaugaaaaccuaaaauauacgguuaucauaacgguucauacuggagaccaacaccaaguggguaaugauacucaaggcguaacaguagaaaucacgccacaagccucaaccguugaagcaguauugccugaguaugggacucuuggacuagaauguucaccccgaacaggauuagacuuuaacgagaugaucuuauuaaccaugaaaaacaaggcuuggaugguacacagacaaugguucuuugaucuaccccuacccuggacuucaggggcaauaaccgaaacuccgacauggaauaggaaagaauuauuaguaacauuuaaaaacgcacacgccaagaaacaagaaguaguuguauuaggcagccaagaaggugcaaugcauacagcguugacuggggcaacugaaauucaaaacucgggcggaaccucaaucuuugcaggucaucuaaaauguagacuaaaaauggauaaacuugaacuuaaaggcaugaguuaugcgaugugccugaauaccuuuguguugaagaaagaaguuagcgaaacucaacacggaacaauauuaaucaaaguggaguauaaaggugaggacgcuccuugcaaaaucccauuuaguaccgaggauggacaaggaaaagcucacaauggucgauuaauuacugcuaauccuguaguuacuaagaaagaggaaccagucaauauugaagcagagccgccauucggagaaucaaauauaguaaucggaauuggagacaaggcuuuaaaaauaaacugguacaagaaagggaguagcauuggaaaaauguuugaagcaacagcgcggggugcgaggagaauggcuauuuuaggagauaccgccugggauuucggaucuguaggcggaguucuaaauucacuugggaaaaugguacaccaaaucuuuggcagcgcauacacagcacuguuuucuggaguuucauggaucaugaaaauaggcauuggugucuuacuuacuuggauuggacugaauagcaaaaacacuucaaugucauuuucaugcauaguuauaggaaucauaacauuauaucuaggagcgguaguucaggcggacaugggcugcguaauaaauuggaaaggaaaagaacuaaaauguggcucggggauauuuguaaccaaugaaguacacacuuggacagagcaguauaaauuucaagcggauucgccuaaacgacucgcaacggcaauagccggggcaugggaaaauggaguaugcggaauccgcucaacaacacgaauggaaaaucuucuuuggaaacagaucgcaaacgaacucaacuacauucuaugggagaauaauaucaaauuaacagucguuguuggagauauaauaggcguacucgaacaagggaaaaggacauuaaccccucagccuauggagcuaaaauauaguuggaaaacguggggcaaagcaaaaauagucacugcugagacucagaacaguaguuuuauaaucgacgggccuaauacaccugaguguccaucagcuagccgcgccuggaacguaugggaagucgaagacuauggauucggcguauucacaacuaacauauggcuuaaacuuagagaaguguauacgcaaucaugcgaccaucgacucaugagugcagcuauaaaagaugaacgagcagugcaugcggauaugggauauuggauugagucccagaaaaauggaucguggaaguuagagaaggcuucguuuauugagguaaaaacuugcaccuggcccaaaagucacacauuauggaguaauggaguauuagaaagugacaugauuaucccuaaaagucuggcagguccuauaagucaacacaaucaccggcccggauaucauacccaaacagcaggcccauggcaccuuggaaagcuagaauuagauuuuaacuauugugaaggaaccacgguuguuaucacagaaaauuguggaacacggggaccuucucucagaacaacuacagucuccggcaagcucauucacgaaugguguugccgcaguugcacucuuccaccucugcgguauaugggcgaggauggaugcugguauggaauggaaauaagaccaaucaaugagaaggaagaaaacaugguaaaaucacuugucuccgcaggaucagggaaaguugacaacuucaccauggguguccuaugcuuagcaauacucuuugaggaagugaugagaggcaaauucggcaaaaagcacaugauagcugggguguuauuuacauuuguucuacuacuaucaggucaaauaaccuggagggacauggcucauacccuaauuaugauuggauccaaugccucagaccgcauggguaugggagugaccuaccuagcuuuaauugcaacauuuaaaauacaaccguuucuagcacugggguuuuuccuuagaaaauuaacaucgagagaaaacuuguuauugggagucggcuuagcuauggcuacaacccugcaacuuccugaagauauagaacaaauggcaaacgggauagcacucggcuuaaugaccuuaaaauuaauuacucaauuugaaacguaucaauuguggacagcacucguaucuuugacgugcagcaacacuauauucacacugaccguggcauggaggacagcgacauuaauucuagcaggcguaucccuauugccguuaugccaaagcuccucgaugaggaaaacugauuggcuaccaaugacaguagcagccaugggugucccaccucugccccuauucaucuuuagccuuaaagacacaccgaagcgacggaguuggccauugaaugagggggugauggcaguaggacuuguaaguauacuggcgaguagccuucuuagaaacgauguaccaauggcagggccccuaguagccgguggguugcuaauagcuugcuaugugauuacaggcacaagugccgaccucacagucgaaaaggcugcggauguaaccugggaagaggaagccgaacaaacaggugucucacacaacuuaaugaucacaguggacgacgauggaacuaugaggauaaaggacgaugagaccgaaaauaucuugacaguguuauuaaaaacggcacuccuuaucguuagcgguauauuucccuacaguauaccggcgacgcuuuugguauggcauaccuggcaaaaacaaacgcaaagaucagggguucuuugggacguaccaucaccuccugaaacccagaaagcagaacuugaagaaggaguguaucggauuaaacaacaagguauauuuggcaaaacccaaguaggaguaggaguucaaaaagaagguguauuucauacaauguggcaugucacuaggggagcgguauugacacacaacggaaagcgccuagaaccgaauugggcaucaguuaaaaaggaccuaauuuccuauggcggaggguggagacuuucugcgcaauggcaaaaaggagaggaaguccaagucauugcaguagagccaggcaaaaaccccaaaaauuuucagacaaugccaggcauauuccaaacuacgacaggugaaauaggagcgauugcucuggacuucaagccaggaacuucaggaaguccuauaaucaauagagaagggaaagucguaggacuuuauggcaauggaguugugaccaaaaauggagguuaugucucaggaauugcacaaacgaaugcugaaccagacggaccgacaccagaacuugaagaagaaauguuuaagaaaagaaaucuaacaaucauggaucuacauccaggaagcggcaagacucgaaaguaucuaccugcaauaguucgagaagcaaucaaacgacgcuugagaacguuaaucuuagcacccacgagggugguagcggccgaaauggaagaggcuuuaaagggguugccuauaagauaucaaacuacagcaaccaagagugaacauacagguagagagauuguagauuuaaugugucacgccaccuuuacaaugagacuucuaagccccguaagaguuccgaauuacaaccucguaauuauggacgaagcccacuuuacagaccccgcuucaauagcagcccgaggauauaucaguaccagaguggguaugggugaagcagcagcaauauucaugaccgcaacuccuccaggaacagcagaggccuucccucaaucaaacgcaccaauacaagaugaagaacgagauauuccugaaagaagcuggaacuccgggaaugaauggauuacggauuuugucggaaaaacugugugguuugucccuucgauuaaagccggcaaugauauagcgaauugcuugaggaaaaaugguaagaaaguaauucaauugaguaggaaaacauucgauacagaauaucagaaaacaagauugaaugauugggacuuuguagucacuacggauauauccgaaaugggagcaaacuuuaaggcagacagaguuauagacccccgaagaugccuaaaaccugugauauugacagacgguccugaaagggucauauuagcuggcccgaugccaguaacggcugccucugcugcgcaaagacgcgggcgggugggccguaacccucaaaaagaaaacgaccaauauauauuuaccggacaaccuuuaaauaaugacgaggaucaugcucauuggaccgaagccaaaauguuguuagauaauauuaacacaccagaagguauuaucccugcgcuauuugaaccggagagagaaaagucagccgcaauagacggagaauaccgguuaaaaggcgaaucaagaaagacuuuuguagagcuaaugagacguggagacuuacccgucugguuagcacauaaagucgcuucagaggguauaaaguauacagauagaaaaugguguuucgacggagaaaggaacaaccaaauucuugaagagaauauggauguagaaaucuggacaaaagaaggagagaggaaaaagcuacgaccuagaugguuagacgcgcguacauacuccgacccauuagcauuaaaggaguucaaagauuuugcagcuggucguaaaucuauagccuuggacuuggucaccgaaauuggaagaguaccgucucacuuggcucacaggaccagaaacgcucuagauaauuuaguaaugcuucacacuucagaacaugguggcagagcauaccggcaugcaguggaagaacuaccugagacgauggagacccuucuucuauugggguuaaugauacuucuuacagggggagcaaugcuauuccuaauaucugguaaaggaaucgggaaaacaagcaucggcuuaauaugcguaauagucucauccgguaugcuauggauggcggauguuccuuuacaauggauagcaucugcuauuguauuggaguucuuuaugaugguucuacuaauaccggaaccagaaaaacaaagaacuccgcaagacaaucaacuugcauauguaguuauaggaauauuaacgcuggcggcuauuguggcagcuaacgagaugggacuacuagaaacaacaaaaagagacuuaggcaugagcaaagagccugguguaguuuccccaacaaguuaucuagacguugauuuacacccggcauccgcauggaccuuauacgcaguugcaaccacagucaucacacccaugcuaagacacacgauagaaaauagcacugcaaauguaucuuuagcugcaaucgcaaaccaagcaguaguuuuaaugggucuagauaaaggcuggcccaucagcaaaauggauuuaggcgugcccuuguuggcuuuaggcugcuauucacaaguaaauccuuuaacuuuaacggcggcaguuuuacuguuggucacacauuaugcaauuauagggccaggccuucaagcaaaagcaacccgcgaagcucaaaaacgaaccgcagcaggcauaaugaaaaacccaacgguggauggaauaaugacaauagauuuagacccagucauuuaugauucuaaauucgaaaaacaacucggucaggugaugcuucugguauuaugugcuguccaacuacucuuaaugagaacaaguugggcgcuuugugaagcguugacccucgcgacaggaccgaucacaaccuuaugggaagguagcccuggaaaauucuggaacacaacaauagcuguuaguauggcuaacaucuuuagagguaguuaucuugcaggggcggguuuggcguucagcauaaugaagaguguggggacuggaagacgugguaccggaucacaaggagaaacauugggugagaaauggaagaagaaauuaaaccaacuaucaaggaaagaguucgauuuguacaagaaaucaggcaucacggaaguugaucguacugaagccaaggagggacuuaaacguggagaaacaacacaucaugccguuucacgagggagugccaaacuucaaugguucguggaaagaaauauggucauaccugaaggucgggucauugaucucggguguggucgugguggcuggagcuauuacugcgcaggcuuaaagaaaguuacagagguucggggguauacaaaagggggaccaggacaugaggagcccguaccuaugucuacauauggguggaacaucgugaagcugauguccggaaaagaugucuucuauuugccaccagaaaaaugugacacauuacuuugcgacauaggagaauccagcccuaguccuacugucgaagagagccggacuauacgcguacuaaaaaugguugaacccuggcucagaaacaaccaauuuuguauuaaaguacuaaacccguacaugcccacaguuaucgagcaucuggagagauugcaaagaaaguauggagggaugcuaguccggaauccacucucacguaacucuacacaugaaauguacuggauaucaaacgguacugguaauaucgucucuucaguuaauaugguaucccgcuugcugcuuaauagauuuacuaugacacauagacguccaacuauugaaaaagauguagaucuaggagcgggaacuagacaugucaacgcagagccagaaacgccuaacauggacguuaucggagaacggauaaaacguauuaaagaagaacauucaucuacauggcauuaugacgaugaaaacccauauaaaacaugggcauaucaugguagcuaugaagugaaagcaacagguucagccaguucuaugauaaacggaguaguuaaauuauuaacaaaaccgugggauguuguuccgauggucacacaaauggcuaugacagacacgaccccauucgggcaacaacguguguucaaggaaaaaguagacacacgaaccccaagacccaugccagguacacguaaaguaauggagauuacagccgagugguuauggagaaccuuggggcgcaauaagaaaccccgucugugcacgagggaagaauuuacgaagaaaguacgaacuaaugcagcaaugggugccguuuuuaccgaagaaaaucaaugggacucggcgagagcagcagucgaggacgaagaguucuggaagcuaguagacagggaacgggaacuacauaaguuaggaaaaugcggaagcugcguauauaauaugauggguaagagagagaagaaauuaggagaguuuggaaaagcaaagggaucuagagcgauuugguauauguggcuaggcgcgcgcuaccuagaguuugaagcucuaggcuuucuuaacgaagaucauugguuuucaagagaaaauucuuacucuggcguagagggcgaaggauugcacaaguugggauacauauugcgagacauuuccaagauccccggaggagcuauguaugcagacgacaccgcaggcugggauaccaggauaacagaagaugaucuacacaaugaggaaaagauaacucaacaaauggaucccgaacaucgacaauuagcaaaugcgauuuuuaaauugacauaccagaauaaagucgucaaaguacaacggccaacuccuaaggggacgguaauggacaucauaagucgcaaggaucagagagggucaggacaaguaggaacuuacggguuaaacacauuuacgaacauggaagcucaauugguaagacagauggaaggugaaggaguacuaucuaaggcagacuuggaaaacccgcaucuacuggagaagaaaauaacgcaguggcuagaaaccaaaggggucgaacgucucaaacgaauggcaauaagcggcgaugacuguguuguaaaaccuauagaugaucgcuuugcaaaugcauugcuggcguuaaaugacaugggaaaaguaagaaaagauaucccucaauggcagcccucgaagggcuggcacgauuggcaacagguuccauucuguagucaucacuuccaugaguuaauuaugaaagauggaagaaaguuaguuguuccuugcagaccgcaagacgaauuaaucggaagggcacgaauuucacagggugcagguuggaguuuaaaagagacggcuugcuuaggaaaggcuuaugcccaaauguggaacuuaauguacuuucaccgacgggaucucagguuggccuccaaugcaauuugcucagcugugccaguacacuggauucccacgucacguacaaccuggaguauacaugcgcaccaccaauggaugacgacagaagauauguuaaccguauggaauagaguuuggauagaagacaauccuuggauggaagacaagacaccaguuacaacuugggaagacguaccguaucuaggaaaacgggaggaucaauggugcgggagcuuaauaggucuaacaucacgagcaaccugggcccaaaacauacuaacagcaauucaacagguaaggucauuaauaggcgaugaagaauuucuugauuacaugccaucgaugaaacgcuuuagaaaagaagaggagucugaaggagcaauaugguag

SEQ ID NO: 23145 - RNA, 9873 nt, Artificial Sequence
  derived and/or modified CDS sequence (opt6) from DENV-3__FJ639730__SS-prME
acaucucuuugcuugaugaugauguugcccgcaaccuuagccuuccaucugacaaguagagauggugaaccacgaaugauaguagguaaaaaugaacgaggaaaaagccuauuauuuaaaacugcaagugguaucaauaugugcacgcuaaucgccauggaccuaggagaaaugugcgacgauaccguaacuuauaaaugcccacuuaucgcggaaguugaaccggaagauauagacugcugguguaaucuaaccagcacauggguaacauauggaacauguaaucaagcuggagaacacagaagagauaaacgcagugucgcauuagcaccccacguaggcaugggacuggauacucgaacacaaaccuggaugucugcagagggugcuuggaggcaaguugagaaaguggagaccugggcacuuaggcauccgggcuucacaauuuuagcacuauuccuugcacauuauaucggcacuuccuuaacacaaaaaguagucauauucauacuacuaauguuaguaacaccuaguaugacaaugcgaugcguaggcguagguaacagagacuuuguugaaggauuguccggcgcaacauggguagauguaguccuagaacauggagguuguguaacaaccauggcaaaaucaaaaccaacuuuagacauugaacuacagaaaacagaagccacacaauuggcuacgcugcguaaacuauguauagaggguaaaauuaccaauauaaccaccgauuccagauguccaacacaaggagaggcuacucuaccugaggaacaagaccagaauuauguguguaaacacacauauguagaucgggguugggguaaugguugcggacuguuugggaaaggaucgcuaguuacaugugcaaaauuccaauguuuagaaccgauugagggaaaagugguccaguaugaaaauuugaaauauacugugauaauaacaguacauacaggggaccagcaucaagugggaaacgacacacagggcguuacgguagaaauuacuccacaggcaucaacagucgaggcuguauugccagaauacgggacauugggucuagagugcagcccacguacaggacuagauuuuaaugaaaugauacucuuaacgaugaaaaacaaggcuuggauggugcauagacaaugguuuuucgaccugccuuuacccuggacaaguggugcuacuacagaaacgccaacauggaauagaaaagaauugcuuguaacauuuaaaaaugcccacgcaaagaaacaggaaguugugguacuaggaagccaggaaggagcgaugcauaccgcguuaacgggagcaacugagauacaaaacucgggcgguacaagcauauuugcaggacaucuuaaaugccgucuaaaaauggauaaauuagaacuuaaaggaaugaguuacgcaauguguuuaaauacguucguccucaagaaagagguuucugaaacacaacacggaacaauauugauaaaaguugaauacaaaggugaagaugcuccauguaaaaucccauuuaguacagaggaugggcaaggcaaagcccauaacggccgauugauaacagcaaacccuguaguaaccaagaaagaagaacccguaaacauagaagcugaaccaccuuucggugaaucgaacauagugauaggaauaggugacaaagcacuaaaaauaaauugguauaagaaaggauccagcauaggaaaaauguuugaagcuacagccagaggugccaggcgaauggcuauucuuggagacacagcgugggauuucgggucugucggaggcguucuaaauaguuuaggaaaaaugguccaucaaauuuuuggaucagcauacaccgcuuuauuuagcgguguuucguggauaaugaaaaucggcauaggaguacuauugacauggauaggucucaauuccaaaaauacaucuaugucguucucuugcauagugaucgguauaauaacauuguauuuaggagccguugugcaagcugauauggggugcgcaaucaauuggaaaggaaaagaacucaaaugcgguagcggcauuuuuguaaccaaugagguacacacguggacugaacaauauaaauuucaggcagacucaccuaaaagauuggcgacggcaaucgccggagcgugggaaaacggaguaugcgggauacgaagcacaacccgaauggagaaccuacuauggaaacaaaucgccaaugaacuaaauuauauuuugugggaaaauaacauaaaauugacaguuguggugggagacaucaucggaguacucgaacaaggaaaaaggacauugacaccacagccaauggaguugaaauacaguuggaaaaccugggguaaagcaaaaauaguaacagcagagacacaaaacuccucauuuauuaucgauggucccaauacuccagaauguccgagcgcaagccgagcauggaacguaugggaaguggaagauuauggauuuggaguguuuacuacuaauauuuggcuaaaauuaagggaagucuauacgcagucaugcgaucaucgcuuaaugagcgcugcaauuaaagaugagaaagcaguacacgcggauauggguuacuggauagaaucucagaaaaaugggucauggaaauuagagaaagcgucuuuuauugaaguaaaaacaugcaccuggcccaaaucgcauaccuuauggucuaaugggguacuugaauccgauaugaucauuccuaaaagucuagcaggcccaauaucacaacacaaccaccgucccggauaccauacacaaaccgcuggacccuggcaccuaggcaaacuggagcuugauuuuaauuacugcgaagggacaacaguaguuauaacagaaaauuguggcacaaggggaccaucccuaagaacaacaacaguuucagggaaauugauacacgaauggugcugucguucauguacucuaccuccgcugagauauaugggagaagauggaugcugguaugggauggaaauuaggccuauaaaugaaaaagaagaaaauaugguaaagaguuuaguuucagccggaucagggaaaguagacaauuuuaccaugggaguccuguguuuagcaauucucuucgaagaggucaugagagguaaguucggcaagaaacauaugauagcaggcgucuuauucacguuuguacucuuguuguccggucaaauaaccuggcgagacauggcucauacacuaauuaugauaggaagcaacgccucagauagaauggggauggguguaacuuaucuugcucuaaucgcuacauuuaaaauacaaccauuuuuggcucuugguuucuuucugcgcaaacuaaccucgcgugaaaaucugcuauugggugucgggcuagcaauggcgacaacauuacaacuaccugaggacauagaacaaauggcaaacggaauagcauuaggucuaaugacacuuaaacuaauuacacaauuugagaccuaccaacuauggacggcgcugguaucuuugacuugcaguaauacuauauuuacauuaacgguugcuuggagaacagcaacacuuauccuagccgguguaagucuauuaccgcucugucaauccaguucgaugagaaagaccgacugguuaccaaugacaguggcagcuaugggaguaccaccuuuaccucuauuuauauucucauugaaagauacgccaaaacggcggucuuggccuuugaaugaaggggucauggcaguaggccugguuucgauucucgcaaguagccuacuacggaaugauguaccuauggcuggaccguuaguugcaggaggccuauugauagcauguuacguaaucacaggaacaagugccgaucugacaguagagaaagccgcugauguuaccugggaagaagaagccgagcaaacgggaguaagccauaaucuuaugauuacugucgaugacgacggaacuaugagaauuaaagacgaugaaacugaaaauauauuaacuguauuacuaaaaaccgcgcuauugauagugaguggaauauuuccuuauagcauaccagcuacauuauuagucuggcauaccuggcaaaaacagacgcaaagaagcgguguauuaugggacguuccaucacccccagaaacacaaaaagcagaacucgaagagggaguuuaucgaauaaaacagcaaggaauauucggaaagacccaagugggggugggagugcaaaaagaagguguguuucauacgauguggcacguuacaagaggcgcgguucuaacacauaacgguaaaagacuugaaccgaauugggccagugugaagaaagacuuaauaaguuacggugguggauggagacuaaaugcucaguggcaaaagggugaagaaguccaggucauagccguggaaccggguaaaaauccgaaaaauuuccaaacuaugccagguauuuuccaaacuacaacaggagaaauuggggcaauugcccuggauuuuaaacccgguaccucagggaguccgauuauaaauaaagaagguaaaguagucggucuuuauggaaaugguguuguuacgaagaacgguggguacguaaguggaauagcucagacaaaugcggaaccugacggaccaaccccugaguuagaagaagaaauguucaagaaaagaaaccuuacuaucauggaucuucacccgggaucaggcaaaacuagaaaguaucugcccgcgaucgugcgagaagccauuaaaagaagauuaagaacucuaauacuagcaccuaccaggguuguggcagcggaaauggaggaggcauuaaaaggauuaccaauacgcuaccaaacuacggcuacaaaaagugaacauacgggacgugaaauaguagacuugaugugccaugcgaccuuuacuaugcgacugcugucuccaguacguguaccuaauuauaaucugguaaucauggaugaggcacauuuuacagacccagcaucaauagcagcaagggguuacaucaguacgcggguugguaugggggaagccgcugcuauuuucaugacugcuacaccgccgggaacugcagaggcuuuuccucagagcaaugcacccauacaggaugaagaacgugacauaccugaacguaguuggaacucuggaaacgaauggauaacggauuucguugggaagacggugugguuuguaccgucuauuaaggccggaaacgauaucgcuaauuguuugaggaaaaauggcaagaaaguaauccaacugaguagaaaaacauucgauacggaguaucaaaagacaagauugaaugacugggacuuugucguaaccacagacauaagugaaaugggggcaaacuuuaaagcugauagagucauagacccucgacggugcuuaaaacccguuauucucacagauggucccgaacgcgucauauuagccggcccuaugccaguaacagcugcuagugcugcacaacgacgcggacgggugggaagaaauccgcaaaaagagaacgaucaguacauauuuacaggucaaccgcucaauaaugacgaagaccacgcucauuggacagaggcuaaaaugcuuuuagacaauauuaacacaccggagggcauaauacccgcccuuuucgagccugaaagagagaaauccgccgcuauagauggggaauacagauuaaagggagaaucgcgaaaaacauuuguggaacuuaugagaagaggggauuugccaguauggcuagcacauaagguagcaucugaagggauaaaauacacagaccgcaaauggugcuuugacggggaacgaaacaaucagauucucgaagaaaauauggauguggagauuuggacaaaggagggggaacggaagaaauugaggccuagguggcuagaugcaagaacuuauuccgacccucucgcauuaaaggaauuuaaagauuuugcugccggacggaagucuaucgcuuuagauuuaguuacggaaauuggacgagugcccucgcacuuagcacauagaaccagaaacgcccuagauaaucuagugauguuacacaccucugaacauggaggcagagcuuauaggcaugcggucgaagaacucccagagacaauggaaacccuucuccugcuaggccuaaugauucuacugacgggaggugcaauguuguuuuuaaucucagggaaggguauagguaagacuagcauaggacucauuugcgucauagugucuagcggaauguuauggauggcugaugugccuuugcaauggauagccagcgcuauuguccuugaguucuuuaugaugguucuauuaauaccugaaccggaaaaacaacguacaccgcaggauaaucaacuugcguauguuguuauagggauuuuaacacuagcugccauaguagcagcaaaugaaaugggucuuuuggagacgacaaagagggaucuuggaaugaguaaagagccuggugucguuaguccaacuucauaucuugauguugaucuccacccugcaagugcuuggacuuuauaugcaguugcaaccacagugauaacgcccaugcuacgccacacuauagaaaauucgaccgcaaaugugucccucgccgcuauugcuaaucaggcaguaguucugaugggccuugacaaaggcuggccaauuagcaaaauggauuuaggaguacccuuacuugcauugggaugcuauagucagguaaauccacuaacacuuaccgcggcgguacuucugcuggugacacacuaugcaaucaucggaccaggcuuacaagccaaagcaacaagggaagcacaaaagcgaacugcagcugguaucaugaaaaacccuacuguggauggaaucaugaccauagaccuagauccaguuauuuacgauucaaaguucgaaaagcaauugggacaaguaaugcuccuaguauugugugcaguucaacuacuuuugaugaggacaaguugggcguuaugcgaagcacuaacgcuagcaacuggcccuauaaccacguugugggaagggucgccgggaaaauuuuggaauacaacaaucgcagugucuauggcuaacauuuucagaggcucuuauuuagcaggggcgggucuggcuuuuagcauaaugaaaucagugggaaccgguagacgagguacagggucacaaggagaaacccuuggugagaaguggaagaagaaacuaaaucaacuaucucggaaagaauuugaacuauauaagaaaucuggcauaacagaaguagaucgaacugaagcaaaagaaggucucaaaagaggcgaaacaacucaucaugcugugucuagggguagugcaaaguuacaaugguucguugaaagaaauaugguuauaccggaaggaagaguaauugauuuggguuguggcagaggcgguuggaguuacuauugcgccggacuuaagaaaguaacggaaguaaggggauauaccaagggaggcccgggccaugaagaaccggugccgaugaguacauacgguuggaauauuguaaagcuaaugagcggaaaagacguauucuaucucccaccagagaaaugugacacauuauuaugugacauaggcgagaguucuccaaguccaacuguagaagagagcaggacuauacggguacucaaaaugguugaacccugguuaagaaacaaucaguuuugcauuaagguguuaaacccauauaugccgaccguuauagaacauuuggaaaaauuacaaagaaaguaugguggaauguuaguaaggaacccuuuaucucgcaauaguacacaugagauguauuggauuucaaauggaacaggcaauauaguaaguucuguaaauauggucaguagauugcuauuaaauagauuuacaaugacccauagacgaccuacaauugaaaaagauguggauuugggagccgguacaagacacgucaacgcagaaccggaaacaccaaauauggacguaaucggagaaaggauuaaaagaauaaaagaggagcacucaucaacauggcauuacgaugaugagaauccauauaagacaugggcauaucauggaaguuacgagguuaaagcaacuggcucugcaucuuccaugauaaauggagucguuaaauuacuuacgaagccuugggacguagucccaauggucacacaaauggcaaugacugauaccaccccguucgggcagcagcgugucuuuaaagagaagguagacacccggacucccagacccaugccagguacgcgaaagguaauggaaauuacggcagaguggcuuuggagaacucucgguaggaacaagaagccucgauuauguacacgugaagaguuuacuaagaaaguuagaaccaacgcagcaaugggagccguauucacagaagaaaaccaaugggauucggcccgagcagcaguugaagaugaagaguuuuggaagcuaguugaccgggagcgagagcuccauaaauuaggcaaauguggaaguugcguguauaauaugaugggaaaaagagaaaagaaacuuggugaguucggcaaagcaaaagguagcagggccauuugguacauguggcugggagcccguuacuuagaauuugaggccuuaggauuuuuaaacgaagaccauugguuuucuagggaaaacuccuauaguggcguagagggagaaggacuacacaaacuagguuacauacuucgagauauaagcaaaauuccuggcggagcaauguacgcagaugauacggcuggaugggauacacgaauuacugaagaugauuugcacaacgaagagaaaauaacacagcaaauggauccugaacaccgacagcucgcuaaugcuaucuuuaaacuaacuuaucaaaauaagguuguaaaagugcagagaccgacaccaaaaggcacgguaauggauauuauaucgagaaaagaccaacggggaagugggcaagugggaaccuauggacuaaauacguuuaccaacauggaagcgcagcuaguccggcaaauggaaggcgaaggagugcuaucaaaggcugacuuagaaaacccgcaucuucucgagaagaaaauuacacagugguuagagaccaagggaguugaacgacuuaaaagaauggccaucagcggagaugauugugucgugaaaccgauagaugaucgauucgcuaacgcacuuuuagcacuaaaugacauggggaaaguacgaaaagauauaccucaauggcaaccaucaaaaggauggcaugacuggcaacagguacccuuuuguagccaucauuuucacgaacuaauuaugaaagaugggaggaaauuggucgugccgugcagaccacaagaugaacuaauagggcgcgccaggauaagccaaggagccggcuggagucucaaggaaacggcuugucucgguaaggcuuacgcgcaaauguggagcuuaauguacuuucacaggagagaucuuagacuggcaagcaacgcaauauguucugcagucccaguacauuggauacccacaagccgaacaacuuggucaauacacgcacaucaucaauggaugacaacagaagacaugcuuacugucuggaaucguguauggauugaggauaacccauggauggaggauaagacaccuguaacgacuugggaagauguuccauaucuugggaagcgggaagaccaauggugugggucccuaauaggccucacaucgagagcaacgugggcccagaauauuuuaaccgcaauucaacaaguuaggagcuugauaggugacgaagaauuuuuggauuauaugcccucaaugaaacgguuuaggaaagaagaagaaagcgaaggggccauaugguaa

SEQ ID NO: 23146 - RNA, 9873 nt, Artificial Sequence
  derived and/or modified CDS sequence (opt6) from DENV-3__KF955464__SS-prME
acuagccucuguuuaaugaugaugcugccagcaacccuggcuuuucauuuaacaucccgagauggugaaccucggaugauuguuggcaaaaaugaacgggggaaaucuuuacucuuuaaaacggcauccgggauuaacauguguacacucauagcgauggaucucggugagaugugugacgacacaguuacguauaaaugcccuuugauagcagaaguagaaccugaagacauagauuguugguguaaccuaacuucaacaugggucacauauggcacaugcaaucaagcuggagaacauagacgugacaaacggaguguagcccuagcaccccauguuggaaugggauuggacacgcguacccaaacuuggaugucugcugaaggugccuggcggcaaguugaaaaaguagaaaccugggcuuugcgucauccaggauuuaccauacuugcauuauuucuagcucauuauauuggaacaagucucacucaaaaaguaguaauauuuauucuauugaugcuagugacaccgagcaugaccaugcguugcgucggaguuggaaaucgggacuuugucgaaggacuuucaggagcaacguggguugauguuguuuuagaacacggaggcugcguaacaacgauggcuaaaucgaaaccgacucucgauauagagcugcagaaaacagaggccacgcaacuagcuauccuacgaaaauuauguauagaaggaaaaauaacaaacauaaccacagacucucgaugcccgacccaaggcgaggcuacgcucccagaggaacaagaucagaacuaugugugcaaacauacauaugucgacagaggauggggcaauggcuguggucuuuuugggaaaggaucucuaguuaccugugcaaaauuucaaugucuagaaccuauugaagggaaaguuguccaguacgagaauuuaaaauauacagugauaauaacgguucacacuggagaucaacaucaaguagggaaugacacgcagggagugacuguagaaaucacaccccaagcuagcacaguggaagcuguccucccagaauauggaacucuggguuuagaauguagcccaagaacgggucuugacuucaaugaaaugauucuuuuaacaaugaaaaauaaagcauggaugguucacagacagugguucuucgauuugccacuaccauggacuucuggggcaacuacagaaacuccgacauggaaucgcaaagaacuucuaguuacuuuuaaaaaugcucaugccaagaaacaagaaguaguaguucuggggucacaagagggcgcuaugcacacagcucuaacaggcgcgacugaaauucaaaauucgggaggaaccaauaucuucgccggacacuuaaaaugccgucuuaaaauggacaaacuagaguuaaaagggaugaguuacgcaaugugccuaaacaccuucguacuaaagaaagaagucucagaaacacagcaugggacgauccuaaucaaagucgaguauaaaggagaagaugccccuuguaaaauucccuuuucgacagaagauggacaggguaaagcucacaaugggcguuuaauaacagcaaacccgguugugaccaagaaagaggaaccuauuaacaucgaggcagaaccaccguucggagaaaguaacauaguuauuggaauuggcgauaaagccuuaaaaauaaauugguacaagaaaggaucaucaauugggaaaauguuugaggcgacggcccggggagcaagaaggauggcuauauugggugauacugcaugggauuuuggaucgguuggagguguauuaaacucacuuggcaaaaugguacaccagauuuuugguucugcauacaccgcccuauucucuggcgugucauggauuaugaaaauaggaauaggcguauuacuaacuuggauagguuuaaauuccaaaaacacaaguaugucauuuaguugcaucguuauugguauaauaacccuuuaucuaggagcgguuguccaagcugauaugggcugugugauuaauuggaagggaaaagagcuuaaguguggaaaugguauauucguuacaaaugaaguacauacauggacagagcaguacaaauuucaggcugauagcccaaaaagacuggcgacagcaauagccggagcaugggaaaaugguguauguggaauacgcucgacaacaagaauggaaaauuuauuauggaaacaaauugcgaaugaguuaaauuauaucuuaugggaaaauaacauaaaauugaccgugguaguuggugauaucauugguguauuggaacaggguaaaagaacucuaacaccacaacccauggaauuaaaauacuccuggaagacaugggguaaagcaaaaauugucacugcagaaacgcaaaauagcucauucauaauagaugggccuaacacgccugaauguccuucugcgagcagagcuuggaaugugugggaaguagaggauuaugguuuugguguauucacuacuaauauaugguugaaauuacgagaaguuuauacccaaaguugcgaucaucgacuaaugucugcagcaaucaaagaugaacgggcgguccacgcugacaugggauacuggauagaaucacagaaaaauggcuccuggaaauuagaaaaagcaucauuuauugaagugaaaacauguacauggccaaaaucccauacuuuguggucaaacggaguacuagagucugauaugauuaucccaaaaucauuagccggaccaauuucgcagcauaaccaucgucccggauaccauacacagaccgcgggaccuuggcaccuagggaaacuggaacuggacuuuaacuacugugagggcacuaccguaguuaucgcagaaaacugcggcacgcgggggccuucccuuagaacuacuacuguauccggcaagcuaauacaugaguggugcugcagaucauguacuuuacccccuuugcgauauaugggagaggacggauguugguauggaauggaaauaaggccuauuaaugaaaaggaagaaaauaugguaaagagcuuaguaagugcugggucagguaaagucgacaauuuuacaaugggaguacucugcuuagcuauuuuauucgaagaagucaugcgagggaaauucggcaagaaacauaugauugcuggaguauuauucacuuuuguuuuacuauuaucuggccaaauaacuuggagagacauggcacauacacuuauaaugauaggaagcaacgcaagcgaccgaauggggaugggugucacauaucuugcucuuauagcaacguucaaaauucaaccguuucuagcacugggauucuuucuaagaaaacuuacaucuagggagaauuuacuacuuggggucgguuuagcaauggcgacaacacuacaauuaccugaagauauagagcaaauggccaacgguauugccuuagguuugaugacacuuaaacuuauaacucaauuugaaacauaccaacucuggacagcacuuguaaguuugacguguaguaauacuauauucacucugacgguagcguggcguacugcgacauuaauacuugcuggaguaucucuauuaccuuuaugucaaucuucuuccaugagaaaaacugauuggcugcccaugacaguggcugcgauggguguuccaccucugcccuuauuuauauuuucauugaaagacacgccuaaaagaaaaagcuggccgcuaaacgaaggcgugauggcaguagguuuagugucgauucuagcuuccucccuuuuacggaacgacguacccauggcuggaccgcuagucgcugggggacuuuuaauagcuugcuacgucauuacagggaccucagcggacuuaacugucgaaaaagcugcugacguuacuugggaagaagaagcagaacaaacuggaguaucgcacaauuugaugaucacuguugaugaugaugguacgaugaggauuaaggaugacgaaacagagaacauucuaacuguauuauugaaaacugcucuacugauaguaucagggauauuuccauacaguauaccagcaacauuauugguguggcacacauggcagaagcaaacacaacgaagcggaguacuaugggaugucccaagcccgccggaaacacagaaagcagaauuggaagaaggcguuuacagaauaaaacagcaaggcaucuuuggaaaaacacaaguuggaguagguguacaaaaagaagggguauuccauacgauguggcacgucacgagaggagcaguacuaacccauaaugguaaaagauuggaaccuaacugggcuagcguuaagaaagaucuuauuucuuauggggguggauggagauuaucggcucaauggcaaaaaggggaagaaguccaagugaucgcuguagaaccuggcaagaauccaaagaauuuccagacuaugcccggcauuuuccaaacuacaacaggugaaauuggagccauagcguuagauuuuaaaccagggacgucaggaaguccgauuauuaauagagaaggaaaagucguaggacuauaugguaacggagugguaacuaaaaauggaggcuauguuucuggaauagcucaaaccaacgcagagccagaugggccaacaccagaacucgaagaagaaauguuuaagaaacgaaaccugacuauaauggaucuacacccuggcagcgggaaaacaaggaaguacuuacccgcaauaguaagggaagccauuaaaagaagacuuagaacuuuaauacuagcaccuacgagaguaguggcagcugaaauggaagaggcacuaaaaggacucccuauacgauaucaaacuaccgccaccaaaagcgaacacacagguagggagauagucgaucucaugugucaugcaacauucacuaugagauuacugaguccaguucguguaccgaauuacaacuugaucaucauggacgaagcacauuucacagauccagcuuccaucgcugcucgcggauauaucagcacucgaguugggaugggugaagccgccgcaauauucaugacugcaacaccaccagguacagcugaagcauuuccucagaguaaugcucccauacaagaugaggagcgugauauacccgagagaucauggaacuccgguaacgaauggauaacugauuuuguagguaaaacgguaugguuuguaccaucaaucaaagcggggaaugauauagcaaacugcuuaaggaaaaaugggaagaaagugauacaauugucccgaaaaacuuuugauacugaauaucagaaaacaagauugaaugacugggacuuuguuguuacaacugauaucucagagaugggagccaauuuuaaagcggacagagucauagaucccaggcguugucuuaaacccgugauuuugacagauggaccugaaagaguaauacuugcaggaccuaugccgguuacagccgcaucugccgcucaaaggcggggucgaguaggccgaaacccucaaaaggaaaacgaucaauauauuuuuacuggucaaccuuuaaacaaugacgaagaucacgcucauuggacugaagcaaaaaugcuccuagacaauaucaacacaccagaaggaaucauaccugcauuauuugagccggagagagagaaaucugcggccauagauggugaauaccgguugaaaggcgaaucacggaaaacauucguagaacuaaugagacgaggugauuuaccagugugguuagcgcauaaaguugcaagugaaggcauaaaauauacggacagaaagugguguuuugacggugagcguaauaaucaaauucuagaagaaaauauggauguggaaauuuggaccaaggaaggagagaggaagaaacucaggccgagguggcucgaugcacguacauacucagauccuuuagcauuaaaggaauuuaaagauuuugcugcuggccguaaaagcauagcucuagaucucguuaccgagauagggcguguaccaagucaucucgcgcauagaacaaggaaugcucuugacaaucuuguuauguugcacaccagugaacauggagggagagccuaucgacaugcgguugaggaacuccccgaaacaauggagacuuuacuucuacuaggccugaugauacuacuuacuggaggagcaaugcuauucuuaauuucaggaaaaggaauaggaaaaaccucuauaggauugaucugcguuauaguuucaagugguaugcuauggauggcugauguuccauuacaauggauagcuucagcuauuguauuggaguucuuuaugaugguguuguuaaucccagaaccugaaaaacagagaacaccacaagacaaucaacucgcguaugugguuauaggaauacucacccuagcugcaauuguugcggcaaacgaaaugggauuauuggaaacaacuaagcgcgauuugggaaugucuaaagaacccggaguuguaaguccaacauccuacuuagauguggauuuacauccugcaucggcauggacuuuguaugcgguagcaacaacaguaaucacaccuauguuaagacauacaaucgaaaauaguacggccaauguaucacuugccgcgauagcuaaucaagcuguaguacuaaugggucuagacaaggguuggccuauuagcaagauggaucuaggugucccacugcuugcuuuaggaugcuauagccagguaaauccauuaacccuuacugcagcuguauuacuucuagugacacacuacgccaucaucggaccugggcuacaagcaaaggcaacgagggaagcucagaaaagaacggcagcuggcauaaugaagaauccaacuguggacggcauaaugacaaucgaccuggaccccguaaucuacgauaguaaauucgagaaacaacuagggcaaguuauguugcuuguccucugugcaguccaguugcuucucaugagaacgagcugggcauugugcgaggcccuaacccuagcaacgggcccaauaacgacacuaugggaagggucacccggaaaauuuuggaacacuacaaucgcuguuaguauggcaaauauuuuuagagguaguuaucuagcaggagcuggacuggcauuuucaauaaugaaaucaguugguaccgguagaagaggaacuggaagucaaggagaaacauuaggcgagaaauggaaaaagaaguuaaaucagcuuagucgaaaggaauuugauuuauacaagaaaagugggauaacagaaguagacagaacugaggcuaaagaaggauuaaagagaggggaaacaacgcaccaugcaguaaguagaggauccgcaaaacugcagugguuuguggaacgaaauauggucauaccagagggacgaguaaucgaucuaggcugcgggagaggcggguggagcuacuacugugcagguuugaagaagguaacggaaguaagaggauauaccaagggcggaccuggucaugaggagccuguaccaaugucuacauauggauggaacauagucaaacucaugucuggcaaggauguauuuuaucugccaccagaaaagugugacacgcuucuuugcgauaucggagaaaguuccccaucaccaacgguugaagagaguagaaccauuagagugcugaggaugguugaaccuugguuacguaauaaccaauuuugcauaaaaguacuaaacccguacaugccuaauguaauagaacaccuagaacgacuccagagaaaauaugggggcauguuaguucggaauccauuaucgaggaacagcacccacgaaauguauuggauaucaaacggcacaggaaauauuguuagcagcgugaauaugguaagcagauuauuacuaaaucgauucacuaugacacaucggcgccccacgauagaaaaagacguagaccuuggagcaggaacccgacauguaaaugcagagccagaaacgccuaacauggauguaaucggugaacggauuaaaaggauaaaagaagaacauucuagcacauggcauuaugaugaugagaacccuuauaagaccugggcauaucacgguaguuacgaaguaaaagcaacgggauccgcuuccaguaugaucaauggugucgucaaauuauuaacgaaaccgugggauguugucccuauggugacucaaauggccaugacugauaccacaccguuugggcaacaacgcguauuuaaggaaaaaguggauacucgaacccccagaccuaugccugggacccgaaaaguaauggagauaacugcagaguggcuauggcguacccugggccgcaacaagaaaccaagguuguguacacgcgaagaguucacaaagaaagugcgaacaaaugccgccaugggagcagucuuuacggaggaaaaucaaugggauucagcaagagcugcaguggaagaugaagaauuuuggaaguugguugacaaggaaagagaauuacauaaauuaggaaaaugcggaucauguguauauaacaugauggguaaaagggagaagaaacuuggagaauuuggaaaagcaaaaggcucacgagcaaucugguacauguggcuuggggcgagguacuuggaauuugaagcguugggcuuuuugaacgaagaucauugguuuagcagggaaaauucauauuccgggguggagggcgaaggacuacauaagcuagguuauauacuaagggacaucaguaaaauuccugguggggcaauguacgcugaugacaccgcagggugggauacucguaucaccgaagaugaccuccauaaugaagaaaagauaacacagcaaauggauccagaacacagacaauuagcgaacgcuauauucaaguugacuuaucaaaauaagguaguaaaagugcaacgaccaacaccaaaaggcacgguaauggauauaauaucaagaaaagaucaacguggaaguggacaagucgguacguaugggcuaaacacauuuacaaauauggaggcacaacucguacgucagauggaaggcgaaggcguucuaucagaagcggaccucgaaaacccacaccuacuugagaagaaaauuacccagugguuagaaacuaagggaguagaacgccugaaaagaauggcgaucucaggugaugauugugucguuaaaccgauagaugacagauuugcaaaugcucuguuagcauugaaugacauggggaaaguuaggaaggauauuccgcaauggcaaccaagcaaggguuggcaugauuggcaacaaguucccuuuuguucucaccauuuucaugaguugauuaugaaggaugggagaaaauugguggugccuugcagaccucaagaugaauugauuggcagagcaagaauuucccaaggggcuggcuggagccuuaaagaaacagcuugccuaggaaaagcauacgcgcaaauguggucauuaauguauuuucaucgacgugacuuacgucucgcauccaaugccaucuguagugcaguuccugcacacuggaucccaacaucucgcacaaccuggucaauccacgcacaccaucaauggaugaccacagaagacaugcugacuguuuggaaccgaguuuggaucgaggauaauccuuggauggaggauaaaacaccaguuacgacaugggaagaugucccauacuuaggaaaacgugaggaucaguggugcggaucacuuauuggacuaaccucgagagcaacgugggcucagaacauucuuaccgcaauucaacagguacgauccuugauuggugaugaagaauuuuuagacuauaugcccuccaugaaaagauuccguaaagaagaagagagugaaggagcaauaugguaa

SEQ ID NO: 23147 - RNA, 9873 nt, Artificial Sequence
  derived and/or modified CDS sequence (opt6) from DENV-3__FJ639731__SS-prME
acaucucuaugucugaugaugauguuaccagcaacacuagcuuuucaccuaacuagcagagauggagaaccacgaaugauaguuggcaaaaaugaaaggggcaagagcuugcuauucaaaacagcuaguggaauaaacauguguacucuuaucgcuauggauuugggugaaaugugugaugauacaguuacauauaaaugcccgcuaaucgcagaagucgaaccugaagauaucgauugcuggugcaaccuuacaucaacguggguaacguacggaacuuguaaucaagccggagaacauagacgugauaagcgcucgguugcgcucgcgccacauguggguaugggauuagauacaagaacgcaaacauggaugucugcagaaggggcauggcgacaaguagaaaaaguggaaacaugggcauugagacacccggguuuuaccauucuagcauuauuuuuagcacauuauaucgggacgucacuaacucaaaaagucguaauauucauacuguuaauguuaguaacaccauccaugacuaugcgauguguagguguuggcaaucgcgacuucguugaaggacuaucgggcgcuacguggguagauguuguccuagaacauggaggcugcguaacaacuauggcuaaaagcaaaccaacucuugacaucgaacuacagaaaacagaagcgacgcaacucgcaacacuaagaaaauuauguauagaaggcaaaauaacaaacauaacaacugacaguagguguccgacgcaaggcgaagcaacguuaccagaagaacaggaucaaaacuacguuuguaaacacacuuauguagacagaggcuggggcaauggaugugggcucuuugggaaaggaucgcucguaacaugcgcaaaauuccaaugccuugaaccuauagaaggaaaaguaguacaauacgaaaaucucaaauauacuguuaucauaacaguacacaccggagaccagcaccaaguugguaaugacacgcaaggggugaccgucgaaauuacaccacaagccaguacagucgaagcgguauugccggaauauggaacguuaggccuggaaugcucaccuagaaccggccuagauuucaaugagaugaucuuauugacaaugaaaaacaaagcauggaugguucauaggcaaugguuuuucgaucuaccauuaccauggacaagcggagcuacaacagagacaccgacguggaacaggaaagaacuauugguaacuuuuaaaaaugcacacgcuaaaaagcaagaagugguuguccuaggaucacaagaaggagcuaugcauacagcauuaacaggcgcaacugaaauacagaauagcggcgguacaaguauauucgcagggcauuuaaaaugcagacuuaaaauggauaaauuggaauuaaagggaaugaguuaugcuaugugucuaaauacuuuuguacucaagaaagaaguaucagaaacccagcauggaacuguucuaauuaaaguagaauacaaaggagaagaugcgccauguaaaauaccauucucuaccgaagauggucaaggcaaagcgcauaacgguagacuuauaacugcuaaucccgugguuaccaagaaagaagaaccaguuaauaucgaggcggaaccuccuuuuggugaaaguaauaucguuauagggauaggcgacaaagccuugaagauaaacugguacaagaaaggaucuaguauaggaaaaauguucgaagccacugcgaggggugcgagaaggauggcgaucuugggugacacugcaugggauuuugguucuguaggaggaguguuaaacagccuaggcaagaugguacaccaaauauuugguagugcguacaccgcucuauuuuccggaguuagcuggauuaugaaaauaggcaucggaguacugcuuacauggauaggacuuaauaguaaaaauacgucaaugucguucucuugcauuguaauagguauaaucaccuuauaccuuggagccguaguucaagcagacaugggaugcgcuaucaauuggaaaggaaaagaacuaaaaugugguucuggaauauucguuacaaaugaaguccacacauggacagagcaauauaaauuucaggcggauucaccgaaaagacuagcuaccgcaauagccggcgcuugggagaacggcguaugugguaucaggaguacuaccaggauggagaaucuucuauggaagcaaauugcuaacgaacuuaauuauauucugugggagaacaauauuaaauugacaguugugguaggggauauaauagguguauuagagcagggaaagagaacguuaacaccucaacccauggaauugaaauacucguggaaaacguggggaaaagcaaagauaguuaccgcagaaacacaaaauucaucuuuuauuaucgacggaccgaacacaccagaauguccaucugccagccgagcguggaauguaugggaaguugaagauuauggauuuggaguuuuuacgacaaauauuugguuaaaacuacgagagguauacacgcaaucuugcgaccauagguuaaugucugcagcuauuaaagaugaacgggcuguacaugcggacaugggauauuggauagaaucgcagaaaaacgguucuuggaagcuagaaaaagcgagcuucauagaagucaaaacauguacauggccaaaaagucauacacuauggagcaauggcguccuggagucggacaugauaauuccgaaaagucuggcaggaccaauuagucaacacaaccacagacccgguuaucacacucaaacggcagguccauggcaccuaggaaaauuagaauuagacuuuaauuauugugagggaacaacaguuguaauaacagaaaacugugguacaaggggaccuucucucagaacaacgacuguaucgggcaaacugauacaugaaugguguuguagaucaugcacguuaccgccccuccgauacaugggugaagauggauguugguaugggauggagauucgaccgaucaaugagaaggaggaaaauaugguaaagagcuuggugucagcaggcagcggcaaaauggauaacuucaccaugggagugcuuugucuagcaauauuauucgaagaaguaaugcgaggaaaguucgguaagaagcauaugaucgcuggaguccucuuuaccuuugugcuucugcuaucaggacagauaacauggcgggacauggcgcauacccuaaucaugauagguuccaaugcgagcgauaggaugggaauggguguuacauaucuggcacucauagcaacauuuaaaauucaaccauuccuugcauuaggguucuuucuccgaaaauuaacaucucgggagaaucuauuguugggcguaggacuagcaauggcgaccacgcuacaauugccagaagauauagaacaaauggcaaacggcauugcauuaggauugaugacguuaaaacuaauuacccaauuugagacguaccaauuauggacggcccuaguaucauuaaccugcaguaauacgaucuuuacacuaacuguugccuggagaacagcaacccucaucuuggcugguguuucacuuuuaccacuuugucaguccucgaguaugaggaaaacugacugguugccaaugacaguagcagcaaugggaguacccccguugccguuauucaucuuuagcuugaaagauacaccaaaaagaaggagcuggccacuaaaugaaggagugauggcgguaggccucguuucaauacuggcaagcucgcuucugcgcaacgacguuccaauggcagggccacuuguugcuggcggucuguugaucgcauguuacguaaucacgggaacaucagcugacuuaacaguagaaaaggcggcugacgucacaugggaagaagaagccgagcaaacuggggucucccacaauuuaaugauuacgguagaugaugacgguacuaugcguauuaaagacgaugaaacagaaaauauacucacugugcuguuaaaaacggcacuacuuauaguuucaggaauuuucccauacagcaucccagcaacacuccugguauggcauacauggcaaaaacaaacccaaagaucaggaguacuuugggaugugccuucuccaccggaaacacagaaagcggagcuagaagaaggaguauaccguauuaaacaacagggcauauuuggcaaaacacaaguuggaguagggguacaaaaagagggcguguuucauacaauguggcacgucaccagaggagcaguacuuacccacaacgggaagaggcuagaaccaaacugggcgagugucaagaaagaucuaauuaguuauggagguggauggcgccugaacgcccaauggcagaaaggcgaagagguacaaguuauagcuguagaaccgggcaaaaacccuaaaaauuuucagacaaugccuggaauauuucaaaccacaacaggcgagauuggagcaauugcacuggauuucaaaccagguacaucaggauccccaaucauuaacaaggaaggaaagguaguuggucuauauggaaauggugugguaaccaaaaacggaggauauguuaguggaauugcucaaacaaaugccgaaccagacggccccaccccugagcuggaagaggaaauguucaagaaacgaaaucuuacuaucauggaucuacaccccggaucgggaaaaacuaggaaguaccugccugcaaucguucgagaggcuauuaaaagaagauuacgaacacuaaucuuagcaccaacucggguuguagcagcugagauggaagaagcacucaaaggucugcccauuagauaucaaacaacggcgacaaagagcgaacacacaggacgagaaauaguggacuuaaugugccacgccacauuuacuaugaggcuauuaagccccguucgugucccgaauuauaaccuugucaucauggaugaagcacacuuuacugacccagcaagcauagcagcgcggggauacaucucaacccguguaggaaugggcgaagccgcggcuauuuucaugacagcuacuccgcccggaacugcagaagcauuuccgcaaucuaaugcaccuauacaggacgaagaaagggacauuccugagagaucauggaacucgggaaaugaauggaucacugauuucguaggaaaaacaguuugguucguaccuucaauuaaagcaggcaaugauauugcgaauuguuugcguaaaaacggcaagaaagucauucagcuaagcaggaaaacguuugacacugaauaccagaaaacgcggcugaacgauugggacuucguaguaaccacggauauaagugaaaugggagccaacuuuaaagcugacagaguaaucgauccgagaaggugccuuaaaccggucauacugacggaugggccagagcgagucauacuagcuggaccgaugcccgucacugcagcgagcgcagcgcagaggcgaggacgaguagguagaaauccccaaaaagaaaaugaccaauauauauucacagggcagccucucaauaaugacgaagaccaugcacauuggacugaagcaaaaaugcugcuagacaauauaaauacgccugaggguauaauaccugcucuuuucgaaccagagagagagaaaucugcggccauugacggugaauacagauuaaaaggagaaucgagaaaaacauuuguugaacucaugagacggggagaucuuccgguauggcuugcccauaaagucgccagugaagguaucaaauauacagauagaaaaugguguuuugauggcgaaagaaauaaccaaauacuugaggaaaacauggauguggaaauauggaccaaggagggugaacggaagaaacuaagaccccgauggcuggaugcuaggaccuauagugauccguuagcacuuaaagaguucaaggacuucgcugcaggcaggaaaagcauagcacuugauuuaguaaccgaaauuggucgagucccuucucaccuagcucauagaacuagaaacgcacucgauaaucuagugaugcugcacaccucugagcacggagguagggcuuacagacaugcgguugaagaacucccagaaacuauggagacauuacuccuguuagguuuaaugauucuauuaacaggaggagcgaugcuauuuuugauauccggaaaagguauugguaaaaccagcauagguuugaucugcguaauagugucgaguggcauguuguggauggcagauguuccucuucaauggauugcgagcgcuauugucuuggaguucuuuaugaugguucuauugauaccagagccugaaaaacaaagaacuccacaggauaaccaacuagcauauguuguuauagguauuuugacacuugcggcaauaguugcagcuaacgaaaugggauuguuggaaacgacaaaacgggaccuugggaugaguaaagaaccaggggucgugaguccaacaucuuaccucgauguugaucuccauccagcgagcgcguggacacuauacgcuguugcuacuaccgucauaacaccaaugcuuagacacacaauugagaacaguacagcgaauguaagccuagcagcaaucgcaaaucaggcgguaguacugaugggccuagauaaaggauggccuauaagcaaaauggauuuagguguucccuuacuagcauuagguuguuauucacagguuaauccccugacuuuaacagcugcuguauugcuauuagucacucacuaugcgauaauuggaccgggguuacaggcuaaagcuacuagagaagcacagaaacgcaccgcggcuggaauaaugaaaaacccuacagucgaugggauaaugacgaucgaucuagauccuguaauauaugauuccaaauuugagaagcagcuaggucaagucauguuacucguauuaugugcugugcaauuguuauuaaugaggacaagcugggcccucugugaagcacuaacauuagcaacuggaccgauuacuaccuugugggaggggagcccaggaaaauucuggaacacuaccaucgccguaucuauggcaaacauuuuuagaggauccuauuuggcaggagcuggguuagcuuuuucaauuaugaaaaguguugguacuggacgacgcggaacaggaagccaaggggaaacacuaggugaaaaauggaagaagaaguugaaccaguuaaguagaaaagaguucgauuuauauaagaaaagugguauaacugaggucgauagaacugaggcaaaagaaggauugaaaagaggagaaacaacacaccaugcaguaaguagaggaagcgcaaaacuccaaugguucguugaaagaaauaugguaauuccugaaggucgagucaucgaccuaggcuguggcagagguggauggucguauuauugcgcugguuugaagaaagucacagagguacgcggauauaccaaaggagguccaggacacgaggaaccgguaccaaugagcacauaugguuggaauauaguuaaacuuaugagugggaaggauguauuuuaucuucccccggagaagugugauacauuacuaugugauauaggugaaagcagcccuaguccuacugucgaagaaagccggacgauacggguccuaaaaaugguggaaccaugguuaagaaauaaucaguucuguaucaaaguacugaauccauacaugccaacgguaauagaacaucuugaaaggcuacaaagaaaauauggcggcauguuaguacgaaacccgcucaguagaaauagcacacaugaaauguauuggauaaguaacgguacaggaaacauugucucuaguguaaauaugguguccagacuacuuuugaaucguuucacaaugacacaccguagaccaaccauugaaaaggauguagauuuaggugcaggcacuaggcacguuaaugccgaacccgaaacgccuaauauggauguaauuggugagagaauaaagcggauuaaggaagaacacucuagcacuuggcauuaugacgaugaaaacccuuauaagacuugggccuaucauggcucauaugagguaaaagcgacaggaucagcaaguagcaugauaaaugggguaguaaaacuauuaacuaaaccgugggacguuguaccaauggucacucaaauggccaugacggacacaacuccuuucgggcaacaacgaguguucaaggagaaaguagauacaagaacgccgcgaccuaugccugggacuaggaaaguaauggaaaucacugcagaauggcuauggagaacguuagguagaaacaagaaaccaagacuuuguacacgcgaagaguucacgaagaaagugcguacaaaugcagcuaugggagcaguauucacggaagaaaaucaaugggauagugccagggcugcaguagaagaugaagaguucuggaaacucguggauagagaacgagagcuccacaaacugggaaaguguggcucaugcgucuauaacaugauggguaaacgcgagaagaaacucggagaauuuggaaaggccaaaggaucccgagcaaucugguauaugugguuaggagcgcgcuaucuggaguucgaggcuuuaggguuuuuaaacgaagaucauugguuuucccgagaaaacucuuauaguggaguagaaggcgaggggcugcauaaacuaggauauauuuugcgagacauuucgaagauuccagguggcgcaauguacgccgacgauacugcagguugggauacaagaauaacagaggacgaucuacauaacgaggagaaaauaacacaacagauggaucccgaacauagacaauuggcuaaugcuaucuucaaacugacuuaucagaauaaaguugugaagguccagcguccuacuccgaaaggcacagucauggauauaauaagccgaaaggaucagagaggcaguggucaaguggggacauauggucucaacacguucacuaauauggaagcucagcuaguuagacagauggaaggggaggggguacuuuccaaagcugaccuagaaaacccacacuuacuugagaagaaaauaacacaguggcuugaaacgaaaggggucgaacgauuaaaaagaauggcuauaagcggggaugacuguguaguaaaacccauugaugauagauuugccaacgcacuucuagcauuaaacgacauggguaaaguuaggaaagauauuccacaguggcagccaucaaaaggauggcaugauuggcagcaggucccuuuuugcucacaucauuuucacgaacuaauuaugaaggauggacgcaaguuggugguaccuuguagaccgcaagacgaauuaauaggacgagcucguauaagucagggugcgggauggucacuuaaagaaaccgcaugccuuggaaaagcauaugcacaaauguggucucucauguauuuucauagaagggauuuacgacucgcauccaaugcuauuuguucggcaguaccaguacacuggaucccgaccucacggacgaccugguccauacaugcacaucaucaguggaugacgaccgaagauauguuaacuguauggaaccguguauggaucgaggauaacccguggauggaagacaaaacaccagugacaaccugggaagauguuccguauuuagguaagagagaggaccaauggugugggucgcuaauaggauugacguccagagcuacaugggcacagaauauacuuacagccauacaacaaguucgaucucucauaggagacgaagaguuccuagacuacaugccauccaugaagcgauuccgaaaagaagaagaaucggaaggugcuaucugguaa

SEQ ID NO: 23148 - RNA, 9873 nt, Artificial Sequence
  derived and/or modified CDS sequence (opt6) from DENV-3__HM181933__SS-prME
acaaguuuaugucuaaugaugaugcuuccugcuacauuagcuuuccaccuaacaucccgggacggagaaccucgaaugauuguaggcaaaaaugaacgggggaaaaguuuacuauucaaaacagcgucggggauaaauauguguacauuaauagcaauggaucugggugaaaugugugaugacaccguuacuuauaaauguccguuaauagcugaaguugaaccugaagauauagauugcugguguaaucugacuucaacauggguaacguauggaacaugcaaucaagcuggugaacauagaagagauaaaagauccguagcacuagcaccgcacgucggaaugggacuugauacuaggacacaaacauggaugucugcagaaggagcauggcgucaaguagaaaaagucgaaaccugggcauuacgacaccccggguuuacaauuuuggcacuauucuuagcgcauuauaucgguacgucuuuaacucaaaaaguaguuauuuuuauucuucuuauguuaguaacccccaguaugacuaugagguguguuggagucgguaauagagauuucguugaaggguugaguggagcgaccuggguggacguuguacuagaacacggcggcuguguuaccacaauggccaaaaguaaaccuacucuagauauugaacugcagaaaacugaagcaacucaacuagcuacccuaagaaaauugugcauagaaggaaaaaucacaaauauaaccacagauuccagauguccgacacaaggcgaagcuacacuuccagaagaacaagaccaaaauuauguaugcaaacacacuuauguagacaggggcuggggaaacggaugcggacuauuugguaaaggaagccugguaacaugugcuaaauuucaaugucuugaacccauagaagguaaaguaguccaauaugaaaaucuaaaauacacagugauuauaaccguacauacuggugaucaacaccaaguagguaaugauacucaagggguaacuguagaaauuaccccacaggcuucuaccguagaagcuguacuuccagaguauggaacacuagguuuggaguguaguccgaggacuggucuugacuuuaaugaaaugauccuccuaacaaugaaaaacaaagcguggaugguacaccgucaaugguucuuugaucuuccccugcccuggacauccggugcuacgacagaaacuccuacuuggaaccguaaagaauuacuuguuacguucaaaaaugcgcacgccaagaaacaagaagucguuguacuuggaucacaggaaggagccaugcauacugcucucacaggagcaacagagauucaaaacucuggcggaacaagcauuuucgcgggucauuuaaaaugcagacuuaaaauggacaaauuggaauugaaagggaugagcuaugcuaugugucuuaauacuuuuguucucaagaaagaggucagcgaaacacagcacggaaccauauugauuaaaguagaauauaaaggcgaggacgcaccauguaaaauaccauucaguacugaagacgggcaagggaaagcgcauaauggucgauuaauuacugcgaaucccguugucacgaagaaagaggaaccagucaacauugaagcagaaccuccauuuggugagucaaauaucguuaucgguauaggcgauaaagcucuaaaaauaaacugguauaagaaaggauccucaauaggcaaaauguuugaagcgacagcacgaggugccagaagaauggcgauacuuggagacacagcaugggacuuugggucgguuggaggaguccuaaauucauuaggaaaaaugguucaucaaauuuuuggauccgccuacacagcauuguuuaguggagugucuuggauaaugaaaauuggaauugguguuuuacugacuuggaucggccuuaauaguaaaaauaccucaaugucuuucuccugcauaguaauaggaauuauaacguuguauuuaggagcagucguacaagcagauaugggaugugccauuaacuggaaagguaaagaauuaaaaugugguagcgggauauuuguaacaaacgaagugcauaccuggaccgaacaauauaaauuucaagccgacaguccuaaacgacuagcaacggccauagccggagcaugggaaaauggaguuugcggcauucguagcacaacaagaauggaaaaucuccuauggaaacaaauugcaaacgaacuuaauuauauccuuugggaaaacaauauuaaacuuacagucguagugggugacauaauagguguuuuagaacaagguaaacgaacacugacuccgcaaccaauggaacucaaauauucauggaaaacuugggguaaagcaaaaaucguaaccgcggagacgcaaaacuccucauucauaauagaugggccaaauacaccugaauguccaucagcaagucgugccuggaaugugugggagguagaagacuauggauuuggaguuuucacaacaaauauauggcuuaaauuacgagaaguuuauacacaaucaugcgaccauagauuaaugagcgccgcaaucaaagaugagcgggcgguccaugccgacaugggauacuggaucgaaucucagaaaaauggaucauggaaauuagagaaagcguccuuuauugagguaaaaacauguacguggccuaaaucacauacucuauggucuaacggaguguuggaaagugacaugauuauaccuaagaguuuagccgguccuauaucacaacauaaucauaggccuggauaucauacucaaacugcaggucccuggcauuuagguaaauuagaacucgacuucaauuacugugaagggacuacaguaguaaucacagaaaacugcggaacaaggaggccuagucuucgaaccacaacgguaagcgggaaauuaauccaugaaugguguugcagaaguugcacucuacccccacuaagauauaugggagaggaugggugcugguacggaauggaaaucagaccaauuaacgaaaaagaggaaaacaugguuaaaagccuagucagcgccggaagcgguaagguugauaauuuuacaaugggugugcugugccuagcgaucuuauucgaagaagugaugagggguaaauucgggaagaaacacaugaucgcggggguucuauuuacguuuguauuacuucugagugggcaaauaacauggagagauauggcacauacucucaucaugauagguagcaaugcuagugauaggaugggcaugggaguaacauaucuugccuuaaucgcaacguuuaaaauacaaccuuuccuugcacuaggcuucuuuuugcgaaaauuaacuucuagggaaaaucuacucuugggcguaggauuagccauggcuaccacuuuacaguuaccggaggacauagaacaaauggcaaaugggauagcacuaggccugaugacccuuaaacuaaucacucaauuugaaaccuaccaacucuggacagcgcugguaagucuaaccuguuccaauacaauauucacguuaaccguugccuggcguacagcuacacuaauucuagcaggaguaucauuauuaccccucugccagucgucgagcaugcgaaaaacugauugguugccgaugacaguugccgcaauggggguaccaccacugccccuuuuuauuuucucuuuaaaagacacucccaaaaggcgauccuggccuuugaaugaaggugugauggcgguaggccuaguaucaaucuuagccucuagccuauugcggaacgauguaccaauggcaggccccuuagucgcaggaggucuacugaucgcuuguuaugugauaacagguaccucagcugaucugacaguugaaaaagcagcagacgucacuugggaagaagaagcagaacaaacagggguaagucacaauuugaugauaacuguugaugacgaugguacgaugagaauaaaggaugacgaaacugaaaauauccuaacaguucugcuaaaaacagcccuacuaauugugagcggaauauucccguacucuauccccgcaacccuuuuggucuggcauacauggcaaaaacaaacacagcguaguggaguucuaugggaugucccaaguccaccagagacccaaaaagcagaacuugaagagggaguauauaggauaaagcaacaggggaucuuugguaagacacaaguaggcgugggugugcaaaaagagggagucuuccauaccauguggcacgucaccagaggagcagugcuaacucacaacggcaagcguuuagaacccaauugggcuucagugaagaaagaucuaauaucauacggaggaggcuggagacucaaugcucaauggcaaaaaggugaggaagugcaggucauugcaguggaaccugggaagaauccuaaaaauuuucaaacuaugccggggauauuccagacgacaacgggggaaauaggagcuaucgccuuagauuuuaaaccagggacuucagguuccccgaucaucaaucgagaaggaaaaguuguaggcuuauacggcaaugguguggugaccaaaaacggcgguuacgugucaggaauagcacaaacaaacgcagaaccagacgggccuacuccagagcuugaagaagaaauguucaaaaagcgcaaucucaccauuauggaucuucacccaggaucuggcaaaacaaggaaguauuuaccagcaaucguuagagaagcaauaaagagaagacuaagaaccuugauacucgcccccaccagaguuguagccgcagaaauggaagaggcuuuaaaggguuugcccauucgauaccaaacgacggcgacuaaaucugaacauacagguagagaaauuguagauuuaaugugccaugccaccuuuaccaugaggcucuuaucgccgguaagaguuccuaauuacaauuuaguuauaauggaugaagcucauuucaccgacccugccucaauugcagccagaggcuauauuagcacaagaguagguaugggugaagcugcggccaucuucaugacugcaacgccaccgggaacagccgaagcauuuccgcagucaaacgcaccaauacaagaugaagaacgagacauuccagagcgaaguuggaacagugggaaugaauggaucacagacuuugucggaaaaaccguaugguucgucccauccauaaaggcggguaaugacauugcaaacugccugcgaaagaacgggaagaaaguaauacaauuaagcagaaaaacauucgauacagaguaucagaaaacaagacucaacgauugggauuuuguaguaacaacggauauauccgaaaugggcgccaauuucaaagcagaucgcguaauugacccuaggagaugucugaaaccuguaauacugacagaugggccagagcgcgugauucuugccgggccaaugccaguaacugcagcuucugcagcucaacguaggggucgaguagguagaaacccacagaaagaaaaugaucaauacauauucacuggacagccauuaaacaaugacgaagaucacgcccacuggacggaagcgaaaaugcuauuagauaacauuaauacaccggagggaauaauaccagccuuauuugagccagaacgcgaaaaaucagcagcaauagauggugaauauaggcuuaaaggagaaucgcgaaaaacguuuguagagcugaugcggagaggagacuuaccaguauggcuugcucauaaaguagcaucugaagguauuaaauauaccgaccgaaaauggugcuuugacggcgaaagaaacaaccagauucuagaggaaaauauggauguugaaauauggaccaaagaaggcgaaaggaagaaacuaaggccccgguggcuagaugcuagaacauauagugauccccuugcauugaaagaguuuaaggacuuugcggcaggacgaaaaucaauagcauuggauuuaguaacagaaauagggagaguaccaagccaucucgcucauagaacaaggaacgcucucgauaacuuaguuaugcuacauacaagcgaacauggaggucgugcauacaggcacgcuguggaggaacugccggagacaauggaaacacuacuucuguugggauuaaugauacuacuuacuggaggggccauguuauuuuuaauuucuggaaaagggauaggaaaaacgagcauuggucucauauguguaauugugucuucuggcauguuauggauggcugaugucccacuucaauggauagcaagugcuaucguacuagaauuuuucaugaugguauugcuaauaccggaaccagaaaaacaaagaacaccacaagauaaccaacuggcguacguugugauuggaauauuaacguuagcugcgauaguugcugccaacgaaaugggauuauuagaaacuacgaagcgugauuuaggaaugucaaaggaaccuggggucgugagcccuacauccuaucuagacguagauuuacacccagcgucugcguggacacuauaugccguugcaacaacuguaauaacaccaauguugcggcacacaaucgaaaauucgacugcaaaugucucguuagcugcaauugcuaaucaggcuguaguucugaugggacuagacaaggguuggccuauaucgaaaauggauuuaggcguuccccuuuuagccuuaggguguuauagucaaguuaacccacucaccuuaaccgcugccguacuacuccuaguuacgcacuaugccaucauuggcccagguuuacaagcuaaagcaacucgagaagcccagaaaagaaccgcggcaggcauaaugaagaauccaacuguugauggaaucaugacgauugaucuugaccccgucaucuaugacagcaaauucgagaaacaauugggccaaguaaugcuacuuguacuuugcgcuguucaacugcuacugaugcgaacaucuugggcauuaugugaagcccuuacauuagccaccgggccaauaacuacuuuaugggaagguucgccugguaaauuuuggaacacuacaauagcaguuucgauggcuaacauuuuucgcggcaguuaccuagcgggggcaggacuggcauuuagcaucaugaaaagcguaggcaccggcagaagagggacuggaucucagggagaaacauuaggggagaaauggaagaagaaacuuaaucaacuauccagaaaagaguucgaccuauauaagaaaucagguauaacagaaguggauagaacugaagcaaaagaaggauuaaaaagaggagaaaccacucaucacgccgugucucgcggaucugccaaguugcaaugguuugucgagagaaacaugguaauuccagagggaagaguuauagaccucggauguggucgaggaggauggucguauuacugugcaggucucaagaaaguaacggagguacgaggcuauacgaaaggcgguccgggacacgaagaaccagucccaaugaguacauauggauggaacauaguuaaguuaauguccggaaaggaugucuuuuaucuuccaccugaaaagugugacacauuauugugugauauaggugaaucuucgcccaguccaacggucgaagaaucucguacaauuagagugcuaaaaaugguagaaccauggcuacgaaauaaccaauucugcauaaaagucuuaaaccccuauaugccuacagugauagagcaccucgaaagauuacaaagaaaguacggaggaauguugguaagaaauccacuuagcagaaauuccacucacgaaauguacuggaucagcaauggaacagguaacauuguaucuucuguuaauaugguaagucgauuauuacuuaaccgauuuacaaugacccaccgucgcccuacaauagagaaagaugucgaccuaggcgcgggaacaaggcacguuaacgcagaaccagaaacuccuaauauggaugugauaggagaaagaauaaagcgaauaaaggaggaacauucaagcacguggcacuaugaugacgaaaaccccuacaaaacuugggcguaccacgguagcuaugaaguuaaagcaacuggaagugcaucaagcaugauaaacgguguagucaaauugcuaaccaaacccugggauguagugccaaugguaacccagauggcaaugacugacacaacaccauucggccaacaaagaguauuuaaggaaaaaguugacacucgaaccccuagaccaaugccaggcacccgcaaaguaauggaaauaacggcagaauggcuauggcgaacacuuggacgcaacaagaaaccucgucuuuguaccagagaagaauuuacuaagaaaguacgaacuaacgcagcuaugggagcugucuuuacagaggaaaaccaaugggauagcgcccgagcggcgguagaagaugaagaguucuggaaacucguagaucgcgagagagaauugcauaaauuggguaaaugcggaagcuguguauauaacaugaugggaaagcgagagaagaaauuaggagaauuugguaaggcuaaagguucuagagcaauaugguacaugugguuaggagcuagauauuuagaguucgaagccuuaggguuuuuaaaugaggaucauugguuuucccgagagaacagcuauucugggguugagggagaggggcuccauaagcucggcuacaucuugagagacauaaguaaaauaccaggaggagcaauguacgcugaugauacagcaggaugggauacacgaauuacagaggaugauuuacacaacgaagagaaaaucacacagcagauggacccagaacaccgacagcucgcaaacgcuauuuuuaaacuaacauaucagaauaaagucguaaagguacaacgaccuacaccgaaagggacagugauggauauaauaucacguaaagaucaacgaggaagugggcaaguaggaacauauggguuaaacacuuuuaccaauauggaagcgcagcuaguaagacagauggaaggcgaagggguauuaaguaaagcggauuuagagaacccgcaucuccuagagaagaaaauaacccaguggcuagagacuaaagggguggaaagacuaaaaagaauggcuauuaguggagaugacugugugguaaaaccuauugacgaccgauuugccaacgcucuauuggcccugaaugauauggggaaaguucgcaaagacaucccacaauggcaaccaaguaaggguuggcacgauuggcaacaggucccuuucuguagccaccacuuucaugaauuaaucaugaaggauggaaggaaacugguaguaccaugcaggccgcaagacgaguuaauuggacgggcacgaauaucccaaggagccggauggucauuaaaggaaacagccugucuagguaaggcuuaugcgcaaauguggagccucauguacuuucacagacgugaucuaagacuagcuucaaacgccauauguagugccgucccugugcauuggaucccgacgucuagaaccacuuggagcauucacgcacaccaucaauggaugacaacagaggauaugcuaacggucuggaaccgcguauggaucgaagacaaucccuggauggaggauaaaacucccguaacaacuugggaagacguaccuuaccuaggaaaaagagaagaucaauggugugggucauuaauuggccucacaucucgagcgacuugggcacagaauauauugacugcaauacagcaaguacgcaguuuaauaggugaugaagaguuccuugacuacaugccuucaaugaagcgauuuagaaaagaagaagaaagcgaaggagcaauaugguga

SEQ ID NO: 23149 - RNA, 9873 nt, Artificial Sequence
  derived and/or modified CDS sequence (opt6) from DENV-3__JF295012__SS-prME
acgucgcuuuguuugaugaugauguuacccgcaaccuuagccuuucacuuaacaagucgagauggggaaccaaggaugauagucggcaaaaaugaacgagggaaaucccucuuauuuaaaacagcaucaggaauuaauauguguacauugauagcaauggacuugggggaaaugugugacgacacuguaacuuauaaauguccauuaauagcagaaguagaaccagaagauauagauugcuggugcaaucuuacgucgacuugggucaccuaugguacauguaaccaagcuggugaacaucgcagagauaaacggucuguugcgcuagcuccacauguaggaaugggguuggauacaagaacacaaacauggauguccgcagaaggagcauggcgacaagucgaaaaaguagaaacgugggcacuucgucaccccggauucacuauucuagcacuguucuuagcacauuacaucgguaccaguuuaacacaaaaaguggugauauucaucuuacuuaugcuuguaacaccaucgaugacaaugcgcugcguagguguuggaaauagagacuuuguggaaggauuaucuggugccacauggguggaugugguccucgaacauggugguuguguaacaacaauggcuaaaaguaaaccaacguuggacauugaacuacagaaaacagaagcuacacaacucgccacccuaagaaaauuaugcauugaaggcaaaauaacuaacauuacuacagauucacgaugccccacacaaggggaagcuacuuugccugaagaacaagaucaaaacuacguguguaaacauacguauguagacaggggcuggggaaauggaugcggauuauucggaaaaggaucguuagugacaugugcgaaauuccaauguuuagaaccgauagaaggcaaagugguccaauaugaaaauuuaaaauacacaguuauuauuacuguacacacuggagaucaacaccaagucggaaacgauacgcaaggcguuacggucgaaauaacgccacaagcuaguacgguggaagcaguuuuaccugaauaugggacacuaggauuagaauguaguccaagaacgggacuagauuucaaugaaaugauccugcugaccaugaaaaacaaagccuggaugguacaccgccaaugguucuuugauuuaccgcuuccuuggacgucuggugccaccacagaaacaccuacguggaauaagaaagaauuacucguaacauucaaaaaugcacaugccaagaaacaagaaguaguaguacuuggcucucaagaaggagccaugcauaccgcacuaacaggagcaacagagauacaaaauucuggugguacaaguauauuugcuggacacuuaaaaugcagacucaaaauggacaaacuagaguuaaaagguaugucauaugccaugugccucaacacauuuguauuaaagaaagaaguaagcgaaacacaacacggaacgauacucauaaaaguagaauauaagggagaggacgcucccuguaaaaucccguuuaguacagaagacggucagggaaaggcacauaacggacgacuaauuaccgcaaacccagugguuaccaagaaagaagaaccaguaaacauagaggcagaacccccauucggcgaaaguaauauaguaaucgguauaggugacaaagcgcuaaaaaucaauugguacaagaaaggcagcucaauagggaagauguucgaagcuacagcccgaggagcccgacgaauggcaauccucggugacacagcuugggacuuuggauccguaggagguguauugaacucccugggaaagaugguccaccaaauauucggaagugcauauacagcacucuucucugguguuagcuggauaaugaaaaucggaauaggcguacugcucacauggauuggacucaauagcaaaaauacaaguaugucuuucaguuguaucgucauagggauuauuacuuuauaucuaggugcgguaguacaagcagauauggguuguguaauaaauuggaaaggaaaagaauuaaaaugcgggucggggauauucgucaccaacgaaguccauacuuggacagagcaauauaaauuucaagcugauucuccuaaacguuuagcuacagccauagcuggugcaugggaaaacggaguauguggaauaagaucaacaaccagaauggaaaacuuacuguggaaacaaauagcaaaugaacucaauuacauacugugggagaauaacauaaaauuaacuguugugguaggggauauaauuggggugcuagaacagggaaaacgaacuuugacaccccaaccaauggaguuaaaauauaguuggaagacaugggggaaagcaaaaauaguaacugcugaaacucaaaauucaaguuucauuauagauggcccuaauacuccagaguguccuucagcaaguagggcauggaauguaugggaggucgaagauuauggauuuggaguuuuuacaacaaauauaugguuaaaguuaagggaagucuauacucaguccugcgaccacagauuaaugagcgcagcuaucaaagacgagagagcaguacaugcagauaugggcuacuggaucgagucacagaaaaauggaucuuggaaacuugaaaaagcaucguucauugaagucaaaacuuguacuuggccgaaaucucauacacuauggagcaacggagugcuagaaucugauaugaucauucccaaaucacuagcaggaccaauaucucaacacaaucacagaccuggauaucauacacaaaccgcggguccauggcaccugggaaaacuugaguuagauuuuaacuacugcgaaggcacuacagucgucauuaccgaaaacugcggaaccagagguccuagucuacgaaccacgacggucucaggcaagcucauccacgaaugguguugccgaagcugcacccuaccgccauuaagauacaugggcgaggaugggugcugguacgguauggaaauccgcccaaucaaugaaaaagaagagaauaugguuaaaucucuaguuagugcagguucgggaaaaguggacaauuuuacuaugggcguauuaugccuagcuauuuuauuugaagaaguaaugaggggcaaauuugggaagaaacacaugauugcaggaguacuauuuacguuuguucuuuuguugucuggccagauaacuuggcgcgauauggcucacacauugauaaugauaggcucuaaugccagugauagaaugggaaugggaguuacauaccuagcguuaaucgcuacguuuaaaauccaaccauuucuagcucuuggauucuuucuuagaaaacuaacaucaagagaaaaccuacuacucgguguaggguuggcaauggccaccacgcuccaacugccagaagauauugagcagauggcgaacgguauugcccuagguuuaaugacuuuaaaauuaauaacgcaauuugaaacguaucaacuguggaccgccuuaguaucucugacuugcuccaacacaaucuuuacucuaaccguagcauggaggacagcgacacugauauuggcaggcgugucucuacuaccgcuuugucaaucuucaagcaugagaaaaaccgacugguuaccaaugaccguugccgcgaugggagucccgccccuaccacuuuuuauuuuuagucuuaaagacacgccuaagcggagaucauggccgcucaaugaaggcguaauggccguuggcuuagugucgauuuuagcgucaucgcuauugagaaaugauguuccaauggcuggaccacugguggcuggcggucucuuaauagcaugcuacguuauuaccggcacgucugccgauuugacaguugagaaagcugcugauguaaccugggaagaagaagcugaacaaaccggcguaagucauaacuugaugauaacuguugacgaugauggaacaaugagaauuaaagacgaugaaacugaaaacauuuuaacaguuuuacugaaaacagcauuauuaaucguaagcggaauuuuucccuauagcauaccagcaacacuucuaguauggcauacuuggcaaaaacaaacccagcgaucaggagugcuaugggacgucccaucacccccggagacacaaaaagcggaauuagaagaagguguuuaccgaauaaagcaacagggaaucuuugguaaaacucaaguagguguagguguucaaaaagaaggaguauuucacacuauguggcauguuacgagaggugcuguauuaacucauaacggaaagagguuagaaccaaacugggcaucgguaaagaaggauuuaauaucauauggcggagguuggagacugucagcacaguggcaaaagggagaagaaguucaagucauugccgucgagccuggcaaaaauccgaaaaauuuucagacaaugccggguauauuucagaccacaacaggagaaauaggcgcaauugcccuagauuucaaaccaggaacauccggaucaccaaucauuaauagagaaggaaaagucguaggacuguacgguaauggcguuguuacgaaaaacggcggauacguuagugguauagcccagacgaacgcggagccggaugggccaacaccggaauuagaagaggagauguucaaaaagcgaaaccuaacgauaauggaucuucaucccggcucugguaaaacaaggaaauauuuaccagccauuguccgagaagcaauaaaaagacgguuaaggacacuuauacuagcacccaccagaguagucgcugccgaaauggaagaggcccucaagggccuacccauaagauaccaaacaacugcaacaaagucggaacauaccgguagagaaaucgucgaucuaaugugucaugccacuuuuacaaugaggcuacucucccccguucgaguaccaaauuauaaucugguaaucauggaugaagcccacuucacugauccggcuucgauugcagcaaggggcuauauaucaacacgaguaggaaugggagaagcggcagcaauauuuaugacugccacacccccaggaacugccgacgcauuuccccagucuaacgcuccgauacaagacgaggaacgugacauaccugaacgcaguuggaacucagguaacgaguggauuacggauuuugcaggaaagacggucugguucguuccuucuaucaaagcuggaaaugauauugccaauugucugaggaagaacggcaagaaaguaauucaauuauccagaaaaaccuucgacacggaauaccagaaaacuaaacuaaacgacugggacuuugucguaacaacugauauuagcgagaugggagccaauuucaaggcagauagaguuauugacccaaggagaugucuaaaaccaguaauccuaacggacggaccagaacgaguaaucuuagcaggcccuaugccaguaacugcagccuccgcggcacagagaaggggaagagucggaagaaacccacaaaaggaaaacgaucaauauauauuuacuggucaaccuuuaaacaaugaugaggaucaugcgcacuggacugaagcaaagaugcuuuuagauaacauaaacacacccgaagggauaaucccggcuuuauucgaaccugaaagggaaaaaucggcugcaauugauggugaguacagauugaaaggugaauccaggaagacuuuuguagagcucaugagaaggggugauuuaccggucugguuagcucauaaaguagcgucugaaggcauaaaauauacugaucgaaaguggugcuuugauggagaacgaaacaaccagaucuuggaagagaacauggauguagaaauauggacuaaggaaggugaaagaaagaaauugaggcccagguggcuggaugccagaacguacagcgacccacuagcucuuaaagaguucaaagacuuugcggccggccgaaaaagcauugcauuagaccuugucaccgaaauagggcgagucccaagccauuuagcucauagaacuagaaaugcacuagauaacuugguuauguuacauacaagugaacauggaggccgcgcguauagacacgcuguagaagaacuaccggaaacgauggaaacauuacuguuauuaggauuaaugaucuuacuaacuggaggugccaugcucuuuuuaauaucagguaaagguauaggaaagaccucgauaggccuaauaugcguaauugugucuaguggaauguuguggauggcggacguacccuuacaauggauagcgagugcaaucguguuagaguucuuuaugaugguccuuuugauacccgagccagagaaacagcguacuccacaagauaaccaauuagccuacguaguaaucggaauccuaaccuuagcggcuaucguugcagcuaaugaaaugggccuguuggaaacgacaaaaagagauuuagguaugaguaaagaaccgggcgugguuagcccuaccucguaucuagauguagaucuucauccagcaagugcuuggacacuauacgcgguagccacaacaguaauaacaccuaugcuucgccauacuauugagaacucaacugccaacgugagucuagcagcuaucgccaaucaagcaguaguauuaaugggccuugacaagggauggccaauaaguaaaauggacuuggggguaccuuuacuugcauuaggcugcuauucacaagugaauccauuaacucuuaccgcagcaguauuauugcugguuacgcauuaugcaaucaucgguccagggcuacaagcuaaggcaacaagagaagcgcaaaaacgaacggcugcagggauaaugaaaaauccgacuguugauggcaucaugaccaucgaucuagaccccguaauauaugauucuaaauuugagaagcaguuaggucaaguaaugcuacuuguacuuugcgccgugcaauuguuauuaaugagaacauccugggcauuaugcgaagcucuaacucuagcaacagggccuauuacaacauugugggaaggaucaccgggaaaauucuggaacacaacgauugcagugagcauggcgaauaucuuucgaggaucauauuuggccggagcuggucuugccuucucaauuaugaagucaguaggaacaggacgacggggcacagguucacaaggagagacuuuaggcgaaaaauggaaaaagaaauuaaaccaauuaagucgaaaagaguucgaucuuuacaagaaaucaggaaucacagaaguggaccggacagaagcaaaggaagguuugaagagaggagaaacgacacaccaugccgucucucgagguucugcaaaauuacaaugguuuguagaaagaaacaugguaauaccugaaggaagaguaauagaccuaggaugcggaaggggaggguggucauauuauugugcgggauugaagaaaguuaccgaaguaagagguuauacgaaaggagggccugggcacgaagaacccguucccaugucuacauauggguggaacaucguaaagcuaaugaguggaaaagacguuuucuauuuaccaccugaaaaaugugauacuuuauuaugugacauuggggaaagcucgccuucaccgacuguagaagaaucaaggacgaucagaguuuuaaaaaugguugagcccuggcuacguaauaaucaguucuguauuaagguauuaaacccuuacaugccuacugucauagaacacuuggaaagauugcaaagaaaauacggugguaugcugguuagaaacccguuaagccgaaacucaacacaugaaauguauuggauuagcaacggaaccggaaauaucguaagcagcgugaauaugguuucccgacuuuuacugaaucguuucacaaugacacaucgaaggccuacaauagaaaaagauguugacuugggagcggguacccgccauguaaacgcagaaccagagacacccaauauggauguuauaggagagcguaucaaacguauaaaggaagaacauucuuccacguggcauuacgaugacgaaaaucccuauaagacaugggccuaccauggcucuuacgagguuaaagcuacuggcucugcuucuucuaugauaaacgguguaguaaaacuuuuaaccaagccaugggacgugguaccaaugguaacgcaaauggcuaugacagauacuacuccuuucggccaacagcguguguuuaaggaaaaaguggauacaaggacaccccgaccaaugccuggcacuagaaaaguaauggaaauaacagccgaguggcuguggcgcacguugggucgaaacaagaaaccuaggcucugcacgcgcgaagaauuuaccaagaaaguaagaacaaaugcugcaaugggugcuguauucacugaggaaaaccagugggacucagcgcgcgcugcuguagaagaugaagaguucuggaaauuaguggaucgagaaagggaauuacacaaauuagggaagugcggcucuuguguauacaacaugaugggcaagcgagagaagaaacuuggggaguucggaaaagccaaaggaucuagagcaauaugguacauguggcuaggcgcaagguaucuugaguucgaggcuuuaggauuccuuaaugaagaccauugguuuucucgggaaaacuccuauucuggagucgagggagaaggcuuacacaagcuaggauacauucuaagagauauuagcaaaauuccagguggcgccauguacgcugaugauacagcaggcugggacacgagaauaacugaagacgaucuucacaacgaggagaaaauaacucaacaaauggauccagaacauagacaacuugcgaaugccauauuuaaauuaacuuaucaaaacaaagugguaaaaguucaaaggccaacuccuaaagguaccguaauggauaucauaucacguaaggaucaacgcggaagcggccaagucgguacauauggauugaauacuuuuaccaauauggaagcccagcuaguucggcaaauggaaggugaaggcguucuaaguaaagcugaccuugagaacccccaccuauuagagaagaaaauaacgcaauggcuagaaacaaagggcgucgagcgcuuaaaaagaauggcaaucucuggagacgacugcguaguuaagccgauugaugauagauucgcaaaugcacuacuggcguuaaacgacauggguaaaguaagaaaagacauaccucaauggcaacccaguaagggcuggcaugacuggcagcagguaccauucugcucgcaucauuuucacgaauuaauuaugaaagauggcagaaagcuaguuguccccuguagaccccaagacgaauuaauuggacgagcucgcauuucacaaggagcaggcuggucucuaaaagagacugcaugccuagguaaggcauacgcccagauguggucauugauguauuuucaucgccgggaucuaagacuugcaagcaacgcuauauguucagcuguacccguacacuggauaccaacguccagaacgacuuggagcauccaugcucaucaucaguggaugacaaccgaggauaugcuaacuguauggaauaggguauggauagaagacaacccguggauggaagacaaaacucccguaacuacaugggaggaugucccauaucucggaaaacgagaagaucagugguguggcucgcugauugggcuuaccagucgagcuaccugggcacaaaauauacuaacugcgauacaacagguacgaucacugauaggugacgaagaguuccucgauuacaugcccagcaugaaacgguuccgaaaagaagaggagucagagggagcaauaugguaa

SEQ ID NO: 23150 - RNA, 9873 nt, Artificial Sequence
  derived and/or modified CDS sequence (opt6) from DENV-3__FJ898463__SS-prME
acuuccuuguguuuaaugaugauuuuaccagcagcacuugcauuucauuuaacaagcagggacggugaaccuaggaugauuguagguaaaaaugaacgcgggaaauccuuacuuuucaaaacugcuucaggaauaaauaugugcacuuuaauugcaauggacuuaggugaaaugugugacgacaccgugacauacaaaugcccacauauaacagaagucgaaccagaagauaucgauugcugguguaauuugacauccacauggguuacguauggaacuuguaaucaagcaggagaacauaggcgagauaaacgcucaguagcuuuggcaccacacgucggaaugggucuugacacaagaacucaaacauggaugucuacagagggagcguggcgccaaguugaaaaaguagaaacaugggcauuaaggcauccagguuucacgauuuuagcauuauuucucgcgcacuauauaggaacuucuuuaacacaaaaaguaguaauuuucauucuguuaauguugguaacuccaucaaugacgaugcggugcgucgguguuggaaaucgagauuucguugaaggauuaucuggcgcaacauggguagacgugguguuggagcacgggggaugcguaacuacuauggccaaaaauaaacccacguuagauauagaacuccagaaaacugaagcuacucaacucgcuacucuccguaaauuguguauugaaggcaaaaucaccaauauuacgacagauaguagauguccuacacaaggagaagcuguauuaccugaagaacaagaucaaaacuacgucuguaaacacaccuacguagauaggggguggggcaauggauguggauuguucggaaaagggucgcuaguuaccugugcuaaauuucaaugcuuagagccaauagaaggaaaaguaguacaauaugaaaaccuaaaauacacgguuauuauuacaguacauacuggugaucaacaccaagucggaaaugaaacucaaggcguaacagccgaaauuacaccacaagccaguacaacggaggcaauacuuccagaguauggaacgcuaggucucgaauguucaccuagaacagggcuagauuuuaacgaaaugauccuccuaacaaugaaaaauaaagcauggaugguccacagacaaugguucuuugacuuaccguuacccuggacaagcggagcgacuacugaaacgccgacauggaauaggaaagaauuacugguaacuuuuaaaaaugcccacgccaagaaacaagaaguaguaguauugggcucucaagagggggcaaugcacaccgcacucaccggagcuaccgagauccagaacuccggagggacaaguauauuugcgggccaccuaaaauguagacuaaaaauggauaaauuggagcuaaaagguaugucauacgcaaugugcaccaacacauuuguacuaaagaaagaaguaucagaaacucaacauggaacaauccucauaaaaguagaauacaaaggagaagacgccccgugcaaaauaccuuuuaguacggaagauggccaggguaaagcacauaacggacguuuaauaacagcuaacccagucgucacuaagaaagaagaacccguaaauauugaagcagaaccaccguucggggaaaguaacauaguaaucggaauuggggacaacgccuuaaaaaucaauugguauaagaaaggcucgaguauuggcaaaauguucgaagcaacugcaagaggagcuagaagaauggcaauacuuggugacaccgcaugggacuucggcaguguggguggagucuuaaauagucuggggaaaauggugcaucaaaucuucgguucugccuauacagcacuauucucaggcgugucaugggucaugaaaauaggaauagggguauuauuaacuuggauaggacuaaauagcaaaaauacgucaauguccuuuaguuguauagcaauugggauaauaacucuauaccucggagcaguuguccaagcugauaugggauguguaauuaauuggaaagggaaagaguuaaaaugcggcucuggaauuuuuguuacuaaugaaguacacacuuggacugaacaguauaaauuccaggcugauucacccaaacguuuagcaacggcaauagcaggagcaugggaaaacggcgucugcggcauuagaucaaccacaagaauggaaaaccuucucuggaaacaaauugccaaugaacuaaauuauauuuuaugggagaacaacauuaaacuuacaguuguaguaggugauauaauagggguccuggaacaaggcaaacgaacauuaacaccacagccaauggaacugaaauacucauggaaaacuuggggcaaagcuaaaauaguaacggcagaaacacaaaauuccuccuuuauaaucgacggaccuaacacuccagaguguccaagugcgucucgagcauggaauguaugggaaguagaagauuacggguucggcguauuuaccacaaauauauggcuaaaacuccgugaagucuauacgcaacucugugaccaccguuuaaugucagcugcugucaaagaugaacgagccguacaugcagacauggguuauuggauagaaucacagaaaaauggcucguggaaacuagaaaaggcuucuuuaauagagguuaaaacgugcacguggccgaaaagucauacccuauggucuaauggaguccuggaaagugauaugauuauaccaaaaucauuagcaggaccuauuucgcaacacaaucauagaccaggauaucacacacaaacagcgggacccuggcauuuagguaaauuggagcuggauuuuaacuauugugaaggcaccacuguggugauaacagaaaauugcgggacaagagguccuagucuuagaacaacgacaguaagugguaaauuaauacacgaaugguguugucgcucauguacucucccacccuuaagguacaugggggaagaugguugcugguacggaauggagauucgcccuaucagugagaaagaggagaauaugguuaaaucuuugguaagcgccgguagcgguaaaguagauaauuuuacaaugggcguacuauguuuggcaauacuauuugaagaaguaaugaggggcaaauuuggcaagaaacauaugauagccggaguauucuuuaccuuuguauuauuauuaagcgggcaaauuacauggcgcgauauggcucacacacugauaaugauagggucaaacgcaucagaucgcauggggaugggagucacuuaccucgcacuuauugcgaccuuuaaaauacaaccuuucuuagcauuaggauuuuuccuuagaaaacucacaagucgggagaauuuguuauuaggaguaggcuuagccauggcgacuacccuucaauugcccgaggauauagagcagauggcuaacggaauagcacucgguuuaauggcccuaaaauugauuacacaguucgaaacuuaccagcuuuggaccgcuuuaauaucuuuaacaugcucuaauaccauguuuacucuaacaguagccuggagaacagccacacuaauauuagcuggugucagcuuguugccuguuugucagucuucaagcaugagaaaaacagauugguugcccauggccguggcagcuaugggaguuccuccacugccacuauucauauuuucuuuaaaagauacucuaaagcgucggucauggccacuuaaugaaggaguuauggcugucgggcuugugucuauuuuggcgaguaguuuacuaagaaacgauguaccaauggccggaccucuaguagcuggaggauuacuaauugcguguuacguuauaacaggcacaagugcugaucuaacaguagaaaaggcagcagauauuaccugggaagaagaagcugaacaaacaggggugagucauaaccucaugaucacuguugaugaugauggaacaaugcguauuaaggacgaugaaacagaaaauauauugacuguccuccuaaaaacugcucuauuaauuguaagcggcguauucccauauaguauaccggccacguuguuagucuggcacacauggcagaagcaaacacagaggucaggaguguuaugggaugucccuagcccaccagaaacacaaaaagcagagcuagaagaagguguauaccguaucaaacagcaagggauauucggaaaaacacagguagguguuggaguccagaaagagggggucuuccacaccauguggcacgugacgagaggugcggugcuaacuuauaacgggaaaagacuggaaccaaacugggccucagucaagaaagaucuuauuucauaugguggaggguggagacuaucagcucaauggcaaaaaggggaagaaguacaggucauugccgucgaaccggggaagaauccuaaaaacuuucagacuaugccugggacuuuccaaacuacgacuggagaaauuggggcaauagcauuggauuucaagccaggcacgucagggucuccaauaauuaacagggaagggaagguuguaggacuauacggaaauggcgucgucacuaaaaauggagguuacguaucaggcauagcccaaacaaacgcugagccugacgguccaacaccagaauuagaggaagaaauguucaagaaacgcaaccuaacuauaauggacuuacauccuggcuccgguaaaacaagaaaguauuugccggcaauaguaagagaagcaauuaaacgaagauugagaacguugauuuuagcaccuacgagagucguggccgcagaaauggaagaagcucuaaaaggacugccgauuagauaucaaacgacugcuacaaaaagugagcacacaggucgagaaauuguggaccuuaugugucaugcuacauucacgaugagauuauuaagucccguaagaguaccuaacuauaaccuuauuaucauggaugaagcucauuucacagacccggcauccaucgcagcccguggauacauuucuacaagaguuggcaugggggaggcagcggcgauauucaugacagcaacgccuccggguacagcggacgcauuuccucagaguaaugcuccaauucaagaugaagaaagagacauuccagagcgcaguuggaacucuggaaaugaauggauaacagacuuugcggggaagacagugugguuugugccgaguauaaaagccgguaaugauaucgcaaauugucuacguaaaaauggcaagaaagugauacaguugucuaggaaaacauuugauacggaauaccagaaaacuaaacuaaacgauugggacuucguuguuaccacagauauaucagaaaugggggcuaauuucaaggcugaucgaguaauagauccacggcguuguuugaaaccagucauuuugacugacgguccagaacgaguuauauuggcaggccccaugccagugacugcagcaucugccgcacaaagaagggggagaguaggucgaaauucccaaaaagagaaugaucaauauauauucacgggucaaccuuuaaacaacgaugaagaucaugcacauuggacagaagcaaaaauguuguuagacaauauaaacacaccagaagggauaauaccagcgcuauucgaaccggagagagaaaaguccgcggcuaucgacggagaauaccgauugaaaggggaaaguagaaaaacuuuuguugaauugaugaggcgaggugaccuuccgguauggcuugcacacaagguagcaagcgaagggauaaaauacacagacaggaaaugguguuuugacggccaacggaauaaucaaauuuuagaggaaaacauggauguagagauauggacaaaggaaggagagaagaagaaacuucgaccucggugguuagaugcgagaaccuauucagauccguuagcgcugaaggaguucaaagauuucgcagcaggacgaaaaucaauugcauuggaccuaguaacggaaauaggcaggguaccaucucauuuggcgcaucgcacacgaaacgcucuggauaaccuuguaaugcuucauaccucugagcauggcggccgggcauaucggcaugcuguugaggaacuuccggagaccauggaaacauuauuacuauuaggauugaugauucuguuaacuggcggcgcuaugcuauuuuugauaucaggcaaggggauagguaaaaccucuauaggacugaucugcguuauugcaaguaguggaaugcuauggauggcagagauuccucugcaauggauugcguccgcaauaguuuuggaauuuuucaugaugguacuacuaaucccugaaccugaaaagcaacguacaccgcaagauaaucaacuagcauauguaguuauuggcauacuaacacuagcggcaauaauagccgccaaugaaauggggcuucuagagacgacaaaaagagauuuaggaaugucuaaggaaccagguguuguuaguccaacgucuuacuuagauguagaccuucacccggcaucugccuggacgcuuuaugcuguagcuacgacuguaauuacuccuauguuacgccacacgauugagaacucaaccgccaacguuucauuggcagcuauagcaaaccaagcgguagugcugaugggauuggauaaaggcuggccaauaagcaagauggaccuaggggugccucuacuggcgcuuggaugcuauagucagguaaauccuuuaacauugacugcagccguccuauuacuuauuacccacuacgcaauaaucgguccaggauuacaagcaaaagcaaccagagaggcacaaaaacgaaccgcagcaggaaucaugaaaaaccccacggucgauggcauuaugacaaucgaucuugaucccguuauuuaugauucaaaauuugaaaaacaguugggacaagugauguuauugguacuuugugcaguacaacuguuacuuaugcguacaucgugggcucuaugugaagcauuaacacuggccaccgguccgauaacaacauuaugggagggaucaccagguaaauuuuggaauaccacaauagcggucagcauggccaacaucuuuagggguucauaccuugcaggagcgggacuagcauucucuaucaugaaaagcguaggaaccgggaaacgagggacuggaagucaaggugaaaccuuaggcgaaaaauggaagaagaaacuaaaucagcuaucacggaaagaauuugauuuauacaaaaagaguggaauaacagaggucgaucgaacagaagcaaaggaagguuuaaaaagaggcgagaccacucaucaugcuguaagucgugggagcgcgaaauuacagugguuuguagaaagaaauaugguaauuccagagggaagaguuauagaucuuggcugcggacguggagguugguccuacuacugugccggacucaagaaaguaaccgaagucagggguuauacuaaggguggaccagggcaugaagaacccguaccgaugaguacuuacggauggaacauagugaaacuuaugucugguaaagacguuuucuaucuaccaccagaaaagugugauacccugcuuugcgacauuggggaaucaagcccaucucccacaguugaagaaaguagaacaauuaggguuuugaaaaugguagaacccuggcucaaaaauaaucaauuuugcauaaagguucuaaauccuuauaugcccacugucauugaacaccuagaaagacuacaaagaaaacauggcggcaugcuagugcgaaauccacuaucaagaaauuccacccaugagauguauuggauaucaaaugguacuggaaauauaguggcaagugugaauaugguaucaaggcuacuacuaaacagguuuacuaugacucauagacgaccaacaauagaaaaagacguagacuugggugcuggcacacgacacguaaaugcugagccggaaacucccaauauggacguaaucggagagcggauaaaacgcaucaaggaagaacauaacucuaccuggcauuaugacgacgaaaacccuuacaaaacaugggcauaccacggaucauaugaaguuaaagccacaggcucagccaguagcaugauuaacggaguugucaaauuacugacgaaaccaugggacguuguuccaaugguaacacaaauggcuaugacggauacgaccccguuuggacagcagcgaguguuuaaggaaaaaguugauacacgcacgccaagaagcaugccaggaacaagacgaguaaugggaauaacggcugaauggcuauggacuaccuuaggcagaaacaaaaagccaaggcugugcacaagggaagaauuuacgaagaaaguuaggacaaacgcagccaugggagcugucuuuaccgaggaaaaucaaugggauuccgccaaggcggccguugaagaugaagacuucuggaagcuaguagaucgagaacgugaauuacacaaacuaggaaaauguggaaguugcguuuauaauaugauggguaagcgagagaagaaauuaggagaauuuggaaaagcaaaaggaagucgggcaauaugguauauguggcuaggugcccgauaccuagaauuugaggcuuuaggauuuuuaaacgaagaccacugguuuucucgggaaaacucguauagugggguugaaggugagggauuacauaaauuaggauauauuuuacgcgauauuaguaaaauccccgguggagcaauguacgcugacgauaccgcaggcugggacacuagaauaacagaggaugaccuacacaaugaagagaagauuacccagcaaauggauccagaacaucgccaacuggcaaacgccauauuuaaacuaacauaccaaaacaaagucguuaaaguacaaagaccaacgccuaccgguacugugauggauauaauaucacgaaaggaucaacgagguucaggacaaguggguacuuaugggcucaauacguucacaaauauggaagcacaacuaauacgucaaauggagggggaaggcgucuuaaguaaagcggaucucgaaaauccucacuuaccggagaagaaaauuacacaauggcuggaaaccaaaggcguugaacgccuuaaaagaauggcuauaucuggcgaugauuguguggucaaaccaauugaugacagauuugcuaaugcguuacucgcucuuaacgauauggguaaggucagaaaagacaucccgcaauggcaaccaaguaagggcuggcaugauuggcaacaagugccguucugcagucaucauuuccaugaauugauuaugaaagacggucguaaauugguuguaccuugucguccccaagaugaauuaauaggucgugcaagaauuagucagggggcaggguggagccuaagagaaacugccuguuuaggaaaagcguaugcacaaauguggaguuuaauguauuuccaucgacgagauuuaaggcuugccucaaaugcaauaugcucagcuguaccagugcauuggguuccgacaaguaggacgacuuggaguauacacgcacaccaccaauggaugacaaccgaagauaugcucacaguguggaacaggguuuggauagaagacaauccguggauggaagauaagacaccaguaacaacaugggaaaaugugcccuaccuggggaagcgugaggaccaaugguguggcucccugauuggauugacaaguagggcgacaugggcucagaauauuccaacugcaauacagcaaguuagaucucuaaucgggaaugaggaguuucuagacuacaugccuaguaugaaacgauucaggaaggaagaagaaucggaaggugccauaugguaa

SEQ ID NO: 23151 - RNA, 9873 nt, Artificial Sequence
  derived and/or modified CDS sequence (opt6) from DENV-3__GQ868616__SS-prME
acuucccuaugucuuaugaugauucuuccugcagcauuagcuuuucauuugacuagcagagauggggaaccuaggaugauuguugguaaaaaugaacggggaaaaucucuauuauuuaaaacagcaucagggauuaauauguguacucuuauagcgauggaucucggagaaaugugugacgauacaguuacauauaaauguccucauaucacagaaguagagccagaggacaucgacuguuggugcaaccucacaaguacauggguuacuuauggaacuuguaaucaagcaggagagcaucggagggauaaaagaucugucgcauuagcgccccacgucggcaugggucuagacacuagaacacaaacauggaugagcacagaaggugcauggagacaggucgaaaaaguugaaacuugggcguuaagacauccuggauucacuauacuagcacuauucuuagcacacuacaucgggacuucacugacucaaaaaguagugauauucauacuccucaugcugguaacaccauccaugacgaugagauguguuggaguugguaauagagauuucgucgaaggauuaucaggcgcaacuugggucgaugucguauuagaacauggagggugugugaccaccauggcuaaaaauaaacccacucuagauauagagcuucagaaaacagaagcaacccaauuagcuacacuaaggaaauugugcauagaagguaaaauaacuaacauaacaacggacucuagauguccgacacaaggugaggcagugcuucccgaagaacaggaccaaaauuacgucugcaaacacacauacguugacagaggcugggguaauggauguggcuuguucggaaaagguagccuggucacaugugcgaaauuccaaugucuggaaccaauagaagggaaaguuguacaauaugaaaaucuuaaauacacagucaucauuacaguccauaccggagaucagcaccaagucgggaacgaaacccaaggagugacagcagaaauuacaccgcaagccaguacaaccgaggcaauucugccggaauacgguacauugggcuuagaguguucuccccgaacaggacucgacuuuaaugaaaugauauuacuuacuaugaaaaacaaagcguggaugguucaucgccagugguuuuucgaucuuccucuacccuggacgucuggcgcaacgaccgagacaccuaccuggaaucgcaaggaauuacugguuacauucaaaaacgcacaugccaaaaagcaggaaguuguaguuuugggaucccaagaaggugccaugcauacggcgcuaacaggagcgacagaaauucaaaauagugggggaaccucaaucuuugcuggucaucuaaaaugccgucucaagauggacaaacuagaauuaaaagguaugaguuaugcgaugugcacaaauacguuuguauugaagaaagaagucagcgaaacacaacaugggacgauuuuaaucaagguagaauauaaaggcgaagacgcaccauguaaaauuccauuuuccaccgaggauggucaagggaaagcacacaacggccggcucauuacagccaacccuguagucacaaagaaagaagaaccaguaaauauagaggcagagccaccauucggugaaucgaauauugugauugguauaggagacaaugcacucaaaauaaauugguacaagaaagguucaucgauuggaaaaauguucgaagcgaccgcacguggcgcaagacggauggcgaucuugggcgacacagcaugggauuuugguagugucggaggaguucuaaauucucuaggaaagauggugcaucagauuuuuggaucagcuuacacagcucuauuuuccggaguuucaugggugaugaaaaucgggauaggaguucuacugacauggauuggauuaaacagcaagaauacaaguaugucauuuucgugcaucgcaauaggaauaauuacgcuuuaccuuggugcugugguucaagcugacaugggauguguaauuaauuggaaagguaaagaacugaagugcgguagugguaucuucguaacuaacgaaguccauacguggacagaacaauauaaguuucaagcggacucgcccaagcggcuugcaaccgcaaucgcuggagcuugggaaaauggaguuugcggcauucgauccacuacuagaauggaaaauuugcuguggaaacagaucgcaaaugagcugaauuauauacuaugggaaaacaacauaaaauugacaguagucguaggugauauaauuggaguauuggagcagggcaagagaacgcugacuccucaaccaauggagcuuaaauacaguuggaagaccugggggaaagcgaagauuguuacagcagaaacucaaaauucgagcuucaucauagacgguccaaauacgccugaaugucccucugcaucaagagcauggaauguaugggaggucgaagacuacgguuucggcguauuuacuacaaacauaugguuaaaacuuagagaaguuuacacacaacugugcgaucaucgacugaugucagcagcuguuaaagaugaaagagcugugcacgccgauaugggauacuggauagaaucucaaaagaauggaaguuggaaguuagaaaaggcaaguuuaauagagguaaaaaccuguacguggccaaaaucacauacauuauggagcaacgguguacuagagucggauaugauuauacccaaaucucuagcaggaccaaucagccaacauaaccaucguccaggguaucacacacagaccgcugguccauggcauuugggaaagcucgagcuagacuuuaacuauugugaaggcacuacuguaguaauuacggaaaacugugggacuaggggaccuucauuaagaacaacgacggugucggguaaauugauacacgaauggugcugccggucauguacacuaccgccuuuaagauauaugggagaagaugggugcugguacggaauggaaauaaggccuaucagugaaaaagaggaaaacauggucaaaucuuuaguaagugccggcagcgguaaaguggauaacuucacuaugggaguauuaugccucgcaaucuuauuugaagaaguuaugagagggaaauucggcaagaaacauaugauagccggugucuucuuuacguuuguacuacuuuugagcggucaaauuacguggcgagacauggcacacacacucauaaugauagggucuaaugcuuccgauagaauggguauggguguuacauaccucgcgcuaauagcuaccuuuaaaauacagccguuuuuagcguuaggauucuuuuugagaaaacucacuucacgcgaaaaccuccuauuaggaguuggcuuagcaauggcaaccaccuuacaacuaccugaggacauagaacaaauggcaaacggcauagcacuaggacugauggcgcuuaaauuaauuacacaauuugaaacuuaucaauuguggacugcccugaucucucugacguguucuaauacaauguucacacucaccguagcauggagaacugccacuuuaauacuagcugguguaucauuguugccugucugccaauccucuuccaugcguaagacagacuggcugccuauggcaguggcugcaauggggguuccaccucuaccucuauuuaucuucaguuuaaaggacacauugaaaagacgaaguuggccguuaaaugaaggaguaauggccgucgggcuaguaaguauucuugcuaguagucuauuaaggaaugauguccccauggcaggaccguuagucgcagggggcuuacucauagcauguuacguuauaaccgguacgagugcggacuuaacaguugagaaagcagcggacauaacgugggaagaagaggcugaacaaacagguguaucucacaaucucaugauuacugucgaugacgaugggacaaugagaauuaaagaugacgaaaccgaaaauauucuuacaguuuugcuuaaaacggcauuguuaauaguaucugguguuuucccuuauucaauuccagcuacccucuuagucuggcauaccuggcaaaagcaaacacaaagaagcgguguauuaugggacgucccaagcccaccagagacgcaaaaagcagaauuggaggagggaguuuauaggauaaaacaacaaggcaucuuuggaaaaacgcagguagggguaggaguacaaaaggaaggaguuuuucacaccauguggcauguaacaagaggcgcuguacuuacuuacaacggcaaacgacuugaaccaaauugggccucgguaaagaaagauuugauaucauauggaggaggauggagacuuuccgcgcaauggcaaaaaggagaagaaguccaaguaauagcuguggaaccagggaaaaauccgaaaaacuuucaaaccaugccagguacauuucaaacgacaacaggcgaaauaggugcaauagcccuggauuuuaaacccggcacauccgggaguccgauuauuaauagagaaggcaaagucguaggacucuauggaaacgguguaguaaccaaaaauggugguuaugucaguggaaucgcacaaacuaaugcagaaccggaugguccgacaccagaguuggaagaagaaauguuuaagaaaaggaaccuuacgaucauggauuuacacccaggaucuggcaagacccggaaguauuuacccgcaauaguaagggaggcaauaaaaagaagguuacggacacuuauauuagcucccacaagaguaguagcagccgaaauggaggaagcauuaaaaggacugcccaucagauaucagacaacagcaacaaaaagcgaacacacaggacgggaaauagucgauuugaugugucaugcuacauuuacaaugcgacuuuuaagcccggugagaguaccaaacuauaaucugauaauaauggacgaggcucauuuuacggauccggcaucaauugcugcucgugguuauauaucaacaagaguaggcaugggcgaagcugcagcaauauuuaugacagcaaccccgccaggcacugcagacgcguuuccucaaucgaaugcuccaauucaagaugaagaaagagacauuccagaacguucauggaacagugguaacgaguggauaaccgacuucgcaggaaaaacaguaugguuugugccaaguaucaaagccggaaacgauauagcaaauugucuccguaaaaaugguaagaaaguaauacaauuaagucggaaaacauuugacacagaauaucaaaagacuaaacuuaacgauugggauuucguagucacuaccgauaucucggagaugggagccaacuucaaagccgacagggugauugaccccagaagauguuuaaaaccggugauuuuaacagacggaccugaaagaguaauucuagccggaccaaugccgguuaccgcggcaucggccgcccaaagaagaggaagaguugguagaaauucgcaaaaagagaaugaccaauacauauucacaggucaaccuuuaaacaaugaugaagaucaugcacauuggacugaggcaaaaauguuauuagacaacauaaacacgccugagggaaucauaccagcguuauuugagccagagagagagaaaagcgcagccauagacggggaguacagauuaaaaggagaaucacgaaaaacauucguagaguugaugagacgcggagaucuaccuguuugguuagcacauaaaguugcaagugaagguauuaaguauacagacaggaaaugguguuuugacgggcaacguaauaaccaaauuuuagaagaaaauauggauguggaaauauggacaaaagaaggugagaagaagaaauugcgaccaagauggcuggacgcgcgaacauacagugauccuuuagcacuaaaagaauuuaaagacuuugccgcagggcgaaagagcauagcauuagacuuaguaaccgaaauagggcgugugcccagucaucuagcacauaggacucgaaacgcgcuugauaauuuaguuaugcuacacacaucugagcacgggggaagggcuuacaggcaugcaguugaagaacugccggaaacgauggagaccuugcuacuuuuaggauuaaugauuuuacucacgggcggggcuaugcucuuucuuauuucuggaaaaggaauugguaagacuagcaucggacuuauuuguguaauagcauccucagggaugcucuggauggccgaaaucccccuacaguggaucgcgagugccauuguauuggaauuuuucaugaugguguuauuaaucccggaaccggagaaacaacguacgccgcaggauaaccaauuagccuaugucguuauagggauacuaacgcucgcggcaaucauagcagcuaacgaaauggguuuacuggaaacuaccaaaagggauuuaggaaugucgaaggaaccuggagucguuucgccaacaucauauuuggauguagaucuccauccagcaagugcauggacucucuaugcuguagccacaacaguaauuacaccuauguuacgccacacaauugaaaauuccacagcuaauguaucacuagcugcgauugcaaaucaagcuguaguccuuaugggacuggauaaagguuggccuauuagcaaaauggauuuaggaguucccuuauuagcccucggaugcuauucucaaguaaauccccucacacuaacagcagcuguuuuacuuuugaucacacacuaugcaauaaucgguccaggacuacaggcgaaggccacacgagaagcacaaaagagaaccgccgcugguauuaugaaaaauccuacgguggauggcauaaugaccauagcuuuagaucccguaauauaugauaguaaauuugaaaaacaauuaggacaaguaaugcuucuuguguugugcgcagugcagcucuugcuaaugagaacaucaugggcucucugugaggcgcuaacauuggcaacagguccuauaacaaccuugugggaagggucgccagguaaauuuuggaauaccacaauagcugucucaauggcaaauauauucagaggaagcuaccuagcuggagcaggcuuagcauuuucuauuaugaaaagcgugggaacggggaaaagaggcaccgguucccaaggugagacacucggcgaaaaauggaaaaagaaauuaaaucaacuaaguagaaaagaguucgauuuguauaagaaaucugguauaacagaaguggaccguacugaagccaaagagggcuuaaagagaggcgaaacgacacaccacgcaguuucgagaggcucagcaaaacuacaaugguuuguggaacggaacauggucauacccgaagggcguguuauagauuuagguugcggaagaggugguuggagcuacuauugugcggggcucaagaaaguuacagaaguaaggggcuacacuaagggaggaccgggacacgaagaaccaguuccaaugucuaccuaugguuggaauaucguaaaacuuaugucagguaaagacgucuucuauuuaccgccagagaaaugcgauacucuacuuugcgacauuggggaaucuucgccaucgccaacuguugaagaaagcaggacaauaagggugcuaaaaaugguugaacccuggcucaaaaacaaucaauuuuguauaaaaguguuaaauccauauaugccaacuguaauagaacaucuagaaagguuacaaaggaaacauggcggaaugcuagugcgcaauccucuuucuagaaauagcacacacgaaauguacuggauuucgaacggaacggggaauauaguagcuagugucaauaugguaagucguuuacuauuaaaucgcuuuacaaugacgcacaggcguccgacuauagagaaagauguagacuuaggggcuggaacgagacaugucaaugcagaaccagaaacccccaauauggacguuauuggugaacguauaaagaggauuaaagaagaacauaacuccacauggcauuaugaugacgaaaaucccuauaaaaccugggcauaccaugggagcuaugaagucaaagcaacuggaucagcaaguucaaugaucaacggugucgucaaauuauuaacaaaaccuugggauguuguucccaugguuacacaaauggcaaugacggauaccaccccauuuggacaacagagggucuucaaagaaaagguagauacgaggacaccgagaaguaugccagguacucggagaguaauggggaucacacccgaauggcucuggagaccacuggggcguaacaagaagccaaggcuauguccgagagaagaguucaccaagaaaguaaggacuaaugccccaaugggagcuguguuuacggaagagacucaaugggcaagugcuaaggcggcaguugaagacgaagauuuuuggaagcuagucgaucgugaaagggagcuacacaaauugggaaagugcggcucuuguguauacaauaugaugggaaaacgugagaagaaguugggagaguucgguaaagcuaaaggaaguagagcaauaugguauaugugguuaggggcaagauaucuggaauuugaagcacuaggcuuucuuaaugaagaccauugguuuucaagagagaacucauauucuggaguagaaggagaaggucucccuaagcuaggguacauauuaagggacauaucaaagauucccggcggggcgauguaugccgacgauacggcugguugggacacacgaauuacagaggaugaucuccauaaugaggaaaagauaacacagcaaauggaccccgaacaccgccaacuagcaaacgcgauuuuuaaguuaacuuaucaaaacaaaguagucaaaguacagagaccuacuccgacagguaccgucauggauaucauaucaagaaaggaucaaagagguucgggacaaguagguacuuauggacuaaauacauuuaccaacauggaagcucaauugauuaggcaaauggaaggcgaaggaguucuaaguaaggcagaccuugaaaacccgcacuuaccagagaagaaaauaacucaguggcuagaaacuaaaggaguugaaagacugaaaagaauggcaaucaguggugacgauugugucguaaaaccaauugaugauagauuugcuaaugcccuacuggcgcucaacgauauggggaaaguccgaaaagauauaccccaauggcaaccuagcaaaggauggcacgauuggcagcagguuccauucugcagccaucauuuucaugaacuaauaaugaaagacggaaggaaauugguaguacccugccgaccacaagaugaguuaauaggacgugcaagaaucucucaaggugcaggguggucccuuagagaaacggcgugucuaggaaaagccuacgcucaaauguggagccuuauguauuuucaccgucgagaucugagauuggcuaguaaugcaauauguagcgccguacccguacacugggucccaacaucucgaacaacuuggucuauucacgcucaucaucaauggaugacgacggaagacaugcuaacuguuuggaaccguguuuggauagaggacaauccauggauggaggauaaaacaccaguuacaacaugggaaaauguaccauauuuagguaaacgagaagaucaaugguguggaucacucauaggucucacuucaagagccacgugggcccaaaacauuccaacggccauccaacaagucagaucguuaauugguaacgaagaauuuuuagauuauaugccaucuaugaagagguuucguaaagaagaagaaagugagggugcaauaugguaa

SEQ ID NO: 23152 - RNA, 9873 nt, Artificial Sequence
  derived and/or modified CDS sequence (opt6) from DENV-3__GQ199887__SS-prME
accucauuaugcuuaaugaugauacuaccagcagcacuagcuuuucauuugacuuccagagauggagaaccacguaugauagugggcaaaaaugaaagaggaaaaucauugcuuuucaaaacugcaucuggaauuaauaugugcacguugauagcaauggaucuaggagaaaugugugaugacacuguaacguacaaaugcccgcacauuacagaaguagaaccggaagacauagauugcuggugcaacuuaacuucuacaugggucacuuauggaacaugcaaucaagcgggagaacaucgacgggacaaacggagcguagcccuugcaccccacguagggaugggucuggacacgagaacucaaacguggaugucagcagaaggugcguggagacaaguagaaaaaguggaaacaugggcguuaagacauccuggguucaccauauuagcgcuuuucuuagcucauuauaucggaacuucccuaacccaaaaaguaguuaucuucauccuauuaauguuagucacacccagcaugacaaugaggugcgucgggguuggaaaucgugauuucguagaaggauuaagcggugcgaccuggguagauguaguacuagaacaugguggauguguaacuacaauggccaaaaauaaaccaacucuggacauagaauuacagaaaaccgaagcaacacaauuggcgacgcuuagaaaauuauguauagaaggaaaaauaaccaacauuacuacugacucacgauguccaacgcaaggugaagcaguacucccagaggaacaagaccaaaauuauguauguaaacauaccuacguggaucgagguugggguaauggauguggucuauucgguaaaggaucauugguuacaugugcuaaauuucaaugccuugaaucaauagaaggaaaagucguucaauaugaaaacuugaaauacacaguaauuaucacaguacacacgggagaucagcaccaaguagguaaugagacacaaggaguuacagcugaaauuacaccgcaagcaaguacaacugaagcaauuuuaccugaauaugguacucucgguuuagaauguaguccccguacaggacuagacuucaacgagaugauucuguugaccaugaaaaauaaggcuuggaugguccauagacagugguucuuugaucuuccgcuuccuuggacaucaggugcaacuaccgaaaccccuacauggaaucgaaaagaauuacuggucaccuucaaaaacgcacacgcuaagaaacaagaaguuguggugcuaggaucccaagaaggggcuaugcauacggcuuuaacaggggcgacagaaauucaaaacaguggagguaccucaauuuucgcaggucauuuaaaaugucgacugaaaauggacaaauuggaauugaaaggaaugucuuaugcgauguguacaaacacuuuuguguuaaagaaagaaguaagugaaacacaacacgggacuauccuaguaaaaguagaguauaaaggugaagacgcuccauguaaaauaccauuuuccacugaggacggacagggaaaagcccauaauggccgacuuauuacggcuaauccuguuguuacaaagaaagaagaacccguuaacauugaagcagaaccaccguuuggagagucuaauaucgucauaggcauuggcgacaacgcauuaaaaaucaacugguauaagaaaggcaguucaauagguaaaauguucgaagcgacggcacgaggagccagaagaauggccauuuuaggugauacagcgugggacuucgguucggugggaggaguauuaaauucauugggaaaaaugguacaucagauauuugguagugcuuauacugcucuauuuagugggguaaguuggguaaugaaaauaggaaucggagugcuacuaaccuggaucggucuaaauucgaaaaauacaaguaugucauuuucauguauugcuaucggcaucauaacucuauauuuaggugcggucguacaggcugacaugggcugcguaauaaacuggaaaggcaaagaacuuaaauguggcagcggaauuuuugucaccaacgaaguccacacguggacagaacaauacaaauuucaagcggauucaccaaaaagauuggcaacagccauagcaggcgcuugggagaauggcgucugcgggauucguagcaccacuaggauggaaaaucugcuuuggaaacaaauagcaaaugaguuaaacuauauccuaugggaaaauaacauaaaauuaacaguggugguaggggacaccaucggagugcuggaacaagggaaacguacacuaacaccacaaccaauggagcuuaaauacucuuggaaaacuuggggaaaagcaaaaauagugaccgccgaaauacagaacuccucauucaucauagacggaccaaauacaccagaguguccaucugcuaguagagcauggaacguuugggaaguagaagacuauggguucgguguauuuacgacuaauauuuggcuaaaauuaagagaggucuauacccagcucugugaucauagauugaugagcgcagcaguaaaagacgaaagagccgugcaugcagauaugggauacuggauagagagucagaaaaauggaucauggaaacuugagaaagcaucauucauagagguuaaaacauguacguggccuaaaucacauacccuauggucuaauggcguuuuggaaucugauaugauaauuccaaaaucacuggcggguccaauaucacaacauaacuaucgcccagguuaucacacucagacagcgggaccguggcauuuaggcaaacucgaauuagauuuuaauuacugugaaggcaccacuguuguaauaacugaaaauuguggaacacgcgguccaucccuuagaacaacuacugugagcgggaaacuuauucaugaaugguguugccguucuuguacucuaccaccauugcgauauaugggagaggacggauguugguauggcauggagauuagaccuauaucugaaaaagaagaaaacaugguuaaaucguuagcaucagcagggagcggaaaagucgauaauuuuaccaugggcguacuauguuuagcaauuuuguucgaagaaguuaugagaggaaaauuuggcaagaaacacaugauagcaggaguguucuucacauucguauuacugcuaucgggacaaaucaccuggcgugacauggcucauacucuuauuaugauuggcagcaaugcauccgaccgaaugggcauggggguaacguaccucgcacucauagcaacauuuaaaauacaaccuuuucucgcgcucggauuuuuccugcguaagcugacuucacgggaaaaucuacuauugggagucgguuuagcuauggcgaccacacuccaacuaccagaagacauagaacaaauggcaaauggaauagcacuaggccucauggcucugaaauuaaucacacaguuugaaacguaucaacuuuggacagcauuagugagccugacauguuccaauacaauguuuaccuuaacuguugccuggaggacagcaacuuuaauauuagcgggaguaucauuauuacccguaugucagaguaguucaaugaggaagaccgauuggcugccuaugacgguagccgcaaugggcguaccaccacugccauuauuuauuuucagccuaaaggauacgcuaaagaggcguucauggccccuaaacgagggaguuauggcgguaggauuaguaagcauuuuggccucaucacucuuacggaaugacguaccuauggcuggacccuuagucgcggguggauuacuaaucgcgugcuauguaauaacaggcacaagugcagaucuaacagucgaaaaagcugccgauguuacaugggaagaagaagcugaacagacggguguaucgcauaauuugaugauaacgguugaugaugacggaacuaugagaauaaaagaugacgagacagaaaauaucuuaaccguauuauugaaaacagcucuauugaucguaagcgggauauucccauacucaauaccagcgacacucuuaguauggcauacauggcaaaaacagacacagcgaagcgggguccuuugggacgugccuucacccccggagacacaaaaggcagaacuagaagagggcguuuaccgaauaaaacagcaagguaucuuaggaaagacacaggucggugucggagugcaaaaagaaggaguguuucacacaauguggcaugugacacgcggagcgguauuaacgcauaaugggaaaagauuagaaccaaauugggccagcgucaagaaagacuugauaucauacggcgguggauggagacuaucugcacaauggcaaaaaggagaggaaguucagguaaucgcagucgaacccggcaaaaaucccaaaaauuuucaaacuaugccagguacauuccaaacaacaacuggugaaauuggagcgauugcucuagauuuuaaaccgggcacgucagggagcccaauuaucaacagagagggaaaaguggucggacuuuacggcaauggaguaguaacgaaaaacgggggauaugugagcgguauugcacaaacaaaugcagaaccugacggucccacaccagagcuugaagaggaaauguuucgcaagagaaaucuuacgauaauggacuuacauccugggucgggcaagacgagaaaguaucuccccgcuauaguuagagaagcuaucaagagaaggcuacggacucuuaucuuagcaccuacacgaguaguggcagcggaaauggaagaagcauugaaaggcuuaccgauaagauaccagacaaccgcgacaaaaucggagcauaccggaagggagaucguagaucuaaugugccaugcuacauuuacaaugagauuguugucuccugugcgggugccaaauuauaaccucauaauaauggaugaagcucauuucacagauccugccaguauugcagcaagaggcuacauuucaacgcgagucgguaugggagaggcggcugcuauuuucaugacagcaacaccaccaggaacggcagaugcguuuccucaaaguaaugcuccaauccaagacgaagagagagauauuccugaaagaagcuggaacuccggcaaugaauggauuacagauuuugccgguaaaacgguaugguuugugcccaguaucaaagcggggaacgacauugcuaauugccuacguaagaaugguaagaaagucauucaacuaucacgaaaaacauuugacaccgaauaucagaagacaaaacuuaaugauugggauuucguagucacuacagacaucagugaaaugggcgcaaacuuuaaagcagauaggguuauugauccccgaagaugcuuaaaaccgguuauauugaccgaugguccugaacgaguaauacuagcaggcccuaugccagucacagcggcaagugcugcacagcgacgagggagaguagguagaaacccucaaaaagagaaugaccaauauauauuuacaggacaaccguugaauaacgaugaagaccaugcacacuggacggaagcaaaaaugcucuuagacaacauaaacaccccagaaggcauuaucccugcucuauuugaacccgaacgcgagaaaagugcugccauagauggugaauaccgucuuaaaggugagagucggaaaacauuuguugagcuuaugagacgaggggacuugcccguauggcuagcgcauaaaguagcaucagaagggaucaaguacaccgaccggaagugguguuuugauggccaaagaaauaaucaaauacucgaagaaaauauggauguagaaauauggacgaaagagggagagaagaagaaauuaagaccaagauggcuggacgcacgaacuuauagcgacccuuuagcguuaaaagaauuuaaagacuucgcggcuggcagaaaaucgaucgcauuggacuuaguaacagagauaggacgagucccaucacaucuggcacaucgaacgagaaaugcguuggauaaucuuguaauguuacauaccucagaacauggugggagagcauauagacaugcuguggaagaacucccugaaacaauggagacacuccuucuuuuaggauuaaugauccuauuaaccgggggaguaauguuauuuuuaaucucaggaaagggaauuggaaagacgucaauuggauuaauauguguaaucgcgaguagcggcaugcuuuggauggccgacgucccccuucaauggaucgcaucagcuauagugcuagaguucuuuaugaugguucugcuaauuccggaaccggaaaagcaaagaacgccgcaggacaaccagcuggcauacguagucauagguauacucacacuugcggcgauuaucgcagcgaaugaaaugggucuccucgagacaaccaagagggaucuuggcaugaguaaagaaccgggaguaguaucaccgacaaguuaucuugauguggaucuccauccagcaucagcauggacauuauacgcaguggcaacaacaguuauaacacccaugcuucgccacacaauagaaaacucaacugcgaacguaucauuagcugcuauugcuaaucaggcaguuguucugauggguuuagauaaaggcuggccgauaagcaagauggauuuaggcgucccgcuuuuagcgcugggguguuauucacaaguuaacccuuuaacucucaccgcggcaguccuauuauuaauuacacacuacgccaucauaggcccuggacuccaggcaaaggcuaccagggaagcgcaaaaacgaaccgcagcagguauuaugaaaaauccaacgguugauggcauaaugacaauugacuuagaccccgugaucuaugacucaaaauucgaaaaacaauuaggacaagucaugcuucugguauugugcgcuguucaauuacuguuaaugcgaacaucaugggcacuaugcgaagcgcuaacucuugcgacaggaccaauaaccacauugugggaggguucaccagguaaguucuggaauaccaccauagcuguuuccauggcaaauaucuuucgcggaucauaucuggcaggggccggccuagcauucucuauaaugaagucggucggaaccgggaaacgaggcacagggagccagggggaaacauugggcgaaaaguggaaaaagaaguugaaucaguuaucgaggaaagaauuugaccuguacaagaaaucuggaauaaccgaaguugaucgaaccgaggcaaaagaaggccuaaaaaggggcgaaacuacucaccaugcuguuucccguggaucagccaaacuacaaugguucguagaaagaaacaugguuaucccggaagguaggguuaucgaccuggggugcggaagaggcggauggagcuacuacugugcuggguugaagaaagugacagaggucagaggauacacaaaagguggaccuggacaugaggaaccaguaccaaugaguacauacggguggaauauuguaaagcugauguccggaaaggauguauucuacuugccuccggaaaaaugugauacacuauuaugugauaucggagaaaguucaccgagcccuacaguugaagaaucacggacaauccgaguauugaaaaugguugaaccuugguugaaaaauaaucaauuuugcaucaaaguacuaaauccguauaugccuacagucaucgagcaccucgaaagacuucaaagaaaacacggggguaugcuagugcgaaacccuuuaucgagaaacucgacacacgaaauguacuggauaucgaacgguaccgguaauaucguuuccucugugaauaugguuucccgucuuuuauuaaauagguucacgaugacucauagaagacccacuauagaaagagacguagauuuaggugccggaacgaggcaugugaacgcugaacccgagauccccaauauggauguaaucggagaacgaauaaaaagaauaaaagaagaacauaauaguaccuggcacuaugacgaugaaaauccauacaaaaccugggcauaccauggguccuacgaaguaaaagcaaccggcagugcaucaaguaugauaaacggaguaguaaaacuccuaacaaaaccaugggauguggugcccaugguaacacaaauggcaaugaccgacacgacuccauucggucaacaaagaguauuuaaggagaaaguugauacuagaacuccucggcccaugccagggacaagaaaaguaauggaaauaacugcugaauggcuauggcguacguuagggcgcaacaagcgcccuagguuaugcacaagagaagaguuuacaaagaaaguucgcacaaacgccgcgaugggugccguauuuacggaagagaaucaaugggacucggccaaagccgcuguagaagacgaagaguucuggaaguuaguagauagggagcgggagcugcauaaacugggcaaaugugguucuugcguauacaauaugaugggaaaaagagagaagaaauuaggagaauuuggcaaagcaaaaggcucacgagcgauuugguauauguggcuaggugcucgauacuuagaauuugaagcauuaggguuuuuaaaugaggaccauugguucucucgugaaaacucguauagcggaguagaaggagaaggauugcacaaguuagguuacauuuuacgggauauuaguaaaauaccaggcggagcgauguacgcggacgauacugcagguugggauacaagaauaacggaagaugauuuacauaacgaagagaaaauuacacaacaaauggaucccgaacacaggcaacuagcuaaugcaaucuucaaauugacauaccaaaacaaaguuguuaagguucagaggcccacaccuacaggcacugugauggauaucauaagcagaaaagaccagcgugguagcggucagguugggaccuacggauuaaacacuuuuacgaauauggaagcacaacuggucagacaaauggaaggagaaggaguguuaucaaaagccgacuuagaaaacccacaccuuuuggagaagaaaauaacacaaugguuagaaacuaaaggaguagaacgauuaaagcggauggcaauaucgggagacgauugcguugugaagccaauugaugaucgauucgccaaugcccuccuagcauuaaaugauaugggaaaaguccgaaaagauauuccgcaauggcaaccgagcaaaggauggcacgacuggcaacagguaccauuuugcucgcaucauuuucaugaauuaauuaugaaagacgggagaaaauuagugguucccugucgaccccaagacgaacuuauagguagggcucguauaucucaaggagcaggcuggucccuccgagaaacggcuuguuuaggcaaggcuuaugcucagauguggagucuuauguauuuccacagaagagaucuacgacuagcaucaaaugcgaucugcucagcaguaccaguccacugggucccgacuucgcggacgacauggucaauacaugcccaccaucaauggaugacaacagaagacaugcucacggucuggaacaggguuuggauagaagauaauccauggauggaggacaaaacaccagugacuacaugggaaaacgugccuuacuugggcaaaagagaagaccaauggugcgguucguugauuggcuuaaccucacgagcgacaugggcacaaaacauucccacagcaauccagcaaguacgaucauuaaucggaaacgaggaauuucuagacuauaugcccaguaugaaaagauuccgaaaagaggaggaaagugaaggagcuaucugguag

SEQ ID NO: 23153 - RNA, 9873 nt, Artificial Sequence
  derived and/or modified CDS sequence (opt6) from DENV-3__GQ199888__SS-prME
accagccuuugccugaugaugauuuugcccgcagcacuagccuuucauuugacgaguagagauggagaaccacguaugaucguggguaaaaaugaaagaggcaaaucacucuuauuuaaaacggcuucaggaauuaauauguguacacuaauagcgauggaucucggugaaaugugcgaugacaccgugacuuacaaaugcccccacauaacugaagucgaaccggaagauaucgauuguugguguaaccucacuucaaccuggguaacuuauggaacuuguaaucaagcaggagaacauagaagagauaaaagaaguguagcccuagcuccacacguuggcaugggguuagauaccagaacgcaaacauggaugagcgcagagggggcuuggagacaaguugagaaaguugaaacuugggcgcuucgacaucccggauucacuauacuugcacuauuucuugcucacuauaucggaacaucccuaacucaaaaaguugugauauuuauacuguuaauguuaguaacuccgaguaugacgaugcguugcguagggguugggaauagggacuucguugaaggacuaaguggcgcaaccuggguagacgucguauuagaacacggagguugcgucacuacaauggccaaaaauaaacccacccuugauauugaauugcagaaaaccgaagccacacaacuugcaacucuccgcaaacucuguauagaagggaaaauaacgaauauaacgacagacucuagaugucccacccaaggagaagccguauugccggaagaacaagaucaaaacuacguauguaaacauacguaugucgacagaggauggggaaaugguuguggcuuguuuggcaaagguucacucguuacaugugcgaaauuucagugcuuagaaucaauugaagggaaagugguucaauacgaaaaccugaaauauacagugauaaucacagugcauacuggagaccaacaccaagugggaaacgagacacagggcguaaccgcugagauuacaccacaggcaucaacuacagaagcgauccuccccgaauaugggacgcuuggacuggaauguuccccacguaccggauuagauuucaacgagaugauacuuuuaaccaugaaaaacaaagcauggaugguacaucgacagugguucuucgauuugccuuugcccuggacaaguggggcuacaacagaaacuccaacguggaaccgaaaagaacuauuaguuacuuuuaagaaugcacaugcuaaaaagcaggaggucgucguuuuaggcucgcaagaaggggccaugcauacugccuuaacuggagcuacagaaauccagaauaguggaggcacaaguauauuugcuggacacuugaaaugccgacuuaaaauggauaaauuagaauuaaaagguaugucauaugcuaugugcacaaacacguucgugcuaaagaaagaggucagugaaacucaacacggcacaauuuuagucaaggucgaauauaaaggagaagacgcacccugcaaaauuccguuuaguacugaagauggucagggaaaagcacauaacggcaggcuaauaacagcaaauccuguugucacuaagaaagaagaaccagucaauauagaagcagagccaccauuuggcgaaucuaauaucguaauuggaacgggggacaaugcacugaagauaaauugguauaaaaagggcuccucuauuggcaaaauguucgaagcaacagcacguggagcucgcagaauggcuauuuuaggcgauacugcuugggacuucgggagcguuggagggguccuaaauucccuuggcaaaaugguccaccagauuuuugggagcgccuacacugcuuuguuuagcggcgucagcuggguaaugaaaauagggauugguguccuacuaacguggaucggucugaacagcaaaaauacauccaugucauucucauguauagcgauugggauuauaacauuauacuuaggugccgucguacaagcggauauggguuguguuauaaacuggaaggggaaagaacuuaaaugugguagcgggauauuuguaacuaaugagguccauaccuggacugagcaauauaaguuucaagcagacaguccaaaaaggcuugcaaccgcaauagcuggugcaugggaaaacgggguaugcggcauucguaguaccacucguauggaaaaucuacucuggaaacaaaucgcuaacgaacuuaauuauauccucugggaaaacaauauuaaguuaacaguggucgucggagauacaauaggaguacuagagcaagguaaaagaacauuaaccccacagccgauggaacucaaguacucauggaagacaugggggaaagcaaagaucgugacagcggagauacagaauagcuccuucauaaucgaugggccaaauacccccgaauguccuagcgcaagcagggcauggaauguaugggaaguagaagacuacgguuuuggaguauucacaacuaacauaugguugaaacuuagagaaguauacacucaauugugcgaccaucgguuaaugagugccgcugugaaagaugagagagccguacaugcagacaugggauauuggauugagucacagaaaaacggcaguuggaaguuggagaaagccagcuuuauagaaguaaaaacauguacuuggccaaagagucauacauugugguccaacgguguauuagaaucugauaugaucauccccaagucgcuagcuggaccuaucucccaacauaauuaucgcccaggcuaucacacgcaaacagcuggaccuuggcauuuagggaaacuagaguuagacuucaauuauugcgaagggacaacagugguaaucacggaaaauuguggcaccagagggccguccuuaagaacuacaacgguaucaggcaaauuaauacacgagugguguugccgaaguugcacacuuccuccacuacgauacaugggugaagacggcugcugguauggaauggaaaucagaccaauaagugagaaagaagaaaacaugguaaaaucuuuggcaagugcuggcucugggaaagucgauaauuuuacgaugggaguacuauguuuagcaauuuuguuugaggaaguaaugagaggaaaauuuggaaagaaacacaugauugccggaguauucuuuacauucguuuuguugcugucgggacaaauaacauggcgagacauggcucacacccuaauaaugauagggucaaacgcuucagaccgaaugggcaugggggucacauacuuagcacuuauugcuacguucaagauucaaccauuccucgcucucgguuucuuucuaagaaaacugacaucacgugaaaaccuauuacuaggcgucggacuggcuauggcgacuacauuacaacuaccggaagacauagaacagauggcaaaugggaucgcacucggguuaauggcccuaaaauuaaucacacaguucgaaaccuaccaacuguggacagcgcuuguaucacucacaugcagcaauacaauguuuacucucacgguagcuuggaggaccgcaacacucauuuuagcuggaguaucauuauugccgguuugucagaguucuucgaugaggaaaacggacuggcuuccuaugacaguggcagccauggguguacccccauuaccguuguucauauuuaguuuaaaagacacgcuuaagagacgaucguggccuuuaaaugaaggugugauggccgucggacucguaagcauucuagcuagcagucuacuuagaaaugacgucccaauggcugggccucuaguagcuggcggacucuuaaucgcuuguuaugugauuacuggaacauccgcugaccucacgguagagaaagcugcagacgucacaugggaggaagaggcagaacaaacugggguuagccacaaucuuaugauuaccguagaugaugacggaaccaugcguauaaaagaugacgagacagaaaacauacuaacaguguuacuaaaaacggcguuauugaucgugaguggaauauuuccauauaguauuccagcuacacuccugguauggcacacuuggcagaaacaaacucaaaggagcgggguccuaugggacgucccaucuccaccagaaacacaaaaagcggagcuugaagaaggaguuuauagaauaaagcaacaaggcauauuagggaaaacacagguuggggugggcguacaaaaagaaggaguauuucacaccauguggcaugucacaaggggugcggucuuaacccacaauggaaaaagacuagaaccaaauugggcaagcguuaagaaagaucuaauaucauauggaggagguuggcgacuuuccgcacaauggcagaagggcgaagagguucagguaauagcaguggaaccagguaaaaaucccaaaaauuuccaaaccaugccgggcacuuuucagacuacgacaggggaaauaggagcaauagcucucgacuucaaaccagguacaagugguucucccauaaucaaccgagaggguaaaguaguaggauuguauggcaacggagucguaaccaaaaacggaggauauguuucgggcauagcucaaacaaaugcggaacccgauggcccgacaccagagcuagaagaagaaauguuucguaagcgaaaucucacaauaauggaucuucacccaggaucugguaaaacgagaaaauauuugccagcaauuguaagagaagcuaucaaacgacguuuaagaacauuaauacucgcaccaaccagaguuguugcagccgaaauggaggaagcacuuaagggucugccaauacguuaucagacgacagcaacaaagucagaacauaccgggagagaaaucgucgaucuaaugugccaugccacauucaccaugaggcuguuaagcccagugcgugucccgaacuauaacuuaauaauuauggacgaagcccauuuuacugauccugccaguauagcagcaagaggauacauuucaacgaggguuggaaugggagaggcagcagcaauauuuaugacggcuaccccaccaggaacagcagaugcauuuccgcaaucuaacgccccuauacaagacgaagaacgcgauaucccagaaagaucauggaacucuggaaacgaauggauaaccgacuuugcagguaaaacgguuugguuugugcccagcaucaaagcaggcaaugacaucgccaacugcuuaaggaaaaacgggaagaaagugauacaauuaucuaggaagacauuugacacggaauaccaaaagaccaaguuaaacgauugggauuuuguagugaccacagauauaagugaaaugggcgcaaauuucaaagcugacagaguuaucgauccaagacgcuguuuaaaaccgguaauucuuacugacggaccagaacgggucauacuagcagguccuaugccgguuacagccgcauccgcagcacaaagaagaggcagaguuggcaggaacccucagaaggaaaaugaucaauauauauucacaggucaaccauugaauaaugaugaagaucaugcucauuggacagaggcaaaaauguuacuagauaacauaaacacuccagaagggauaauccccgcucucuuugaaccagaaagagaaaagagcgccgcaaucgacggagaguauagacuaaagggcgaaaguaggaaaaccuucguugaguuaaugcguaggggagaccuaccaguauggcuagcacauaaaguagcaagcgaaggaauaaaguacacugaucgcaaauggugcuuugauggucaacgcaacaaccaaauacuagaagaaaauauggacguugaaauauggacuaaggaaggcgagaaaaagaaacugcgaccacgaugguuggaugcaagaacauacagugauccacucgcucugaaagaauuuaaagauuucgcagcuggccgaaaaaguauagcccuugauuuaguuacggaaaucggaagaguaccaagucaccuggcucacaggacgcgaaaugcccuugacaacuuaguaauguugcacacaagugagcauggagguagagcauauagacaugcaguugaagaauuaccugagaccauggaaacgcugcugcuguuaggcuuaaugauacuauugacuggcggcgcaauguuguuccucauuagugggaaggggauaggcaaaaccucgauaggcuuaauuuguguaauagccucaucagggauguuauggauggcagauguaccguugcaguggauagcuagcgcgauagucuuggaguucuucaugaugguauuacuaauaccugaacccgaaaaacaacggacaccucaagacaaucaacucgcuuacguaguuauagggauucucacacuugcugcuauaaucgcggcuaaugagaugggucuacuugagaccaccaaaagagaccuaggaaugaguaaagaaccaggugugguaucuccgacuuccuauuuagauguugacuuacacccagcaagugcuuggacauuauacgcuguugcgacgacuguuauaacaccaaugcuacgccacacaauagaaaacucgacugcuaacguaucgcuagcagccaucgcaaaucaagcaguagucuuaaugggacuagauaagggcuggcccauuucgaaaauggaccuaggggucccuuuacuagcuuuaggaugcuacagucagguuaauccacugacccuuacagcagcugugcuauuacuaaucacacacuaugcaauaaucgggccgggauugcaagccaaagcuacacgugaggcacagaaaaggacugcagccgguauaaugaaaaauccuaccguugacggcauaaugacaaucgacuuagaucccguaaucuacgacucuaaauuugaaaaacaauuagggcaaguuaugcuauuaguacuuugcgccguacaacuccuguugaugagaacaagcugggcuuuaugcgaagcucuuacauuggcuacagggcccauuacaacguuaugggaagggaguccugggaaauuuuggaauacaacaauagcaguaucuauggcuaacaucuuucgaggaucuuaucuggcgggagcgggacuagcauucuccaucaugaaauccgucggaacagggaaacgcggcaccggaucucaaggcgaaacguuaggagaaaaguggaagaagaaauuaaaucaacuaucacgaaaagaauuugaccucuacaagaaaaguggaauuacagaaguggacagaaccgaagcaaaagaaggauuaaaaagaggugagacuacgcaucacgcgguguccagaggaucagcaaaauuacaaugguuuguagagcguaauauggugauaccugaaggacgcguuauagaucuagggugcgguagagggggcuggaguuacuauugcgcuggauugaagaaaguaacggaaguaagaggguauacaaaaggaggcccaggccacgaagaaccuguaccgaugaguaccuauggauggaacauaguuaaauuaaugucugggaaagauguauucuauuuaccaccagaaaaaugcgacacacuucuaugcgacaucggugaaaguucuccauccccgaccgucgaggaaagcagaacuauaagagucuugaaaaugguagagccauggcuaaagaauaaccaauuuuguauuaaaguauuaaaccccuauaugccaaccgugauugaacaucuagaacgauugcagcguaagcacgggggaaugcuaguucgaaacccacucaguagaaauucaacgcacgaaauguauuggauaucgaacggcacuggaaacauaguuagcagcgugaauaugguaucgcgacuauugcucaaucgauuuacgaugacacauagaaggccgacgauagaaagagauguggaucuaggcgcaggaacacgucauguaaaugcagaaccugagauccccaauauggacguaauaggugaaaggauuaaaagaauaaaagaagaacacaauucaacuuggcauuaugacgaugaaaaccccuacaagaccugggcauaucacgguaguuaugagguaaaagcaacaggauccgcguccagcaugauaaacggagugguaaaacuuuuaacuaaaccuugggauguuguucccaugguaacacaaauggcuaugacagacacaacaccguucggacaacaacgcguuuuuaaagaaaagguggauaccagaacgccgaggccgaugccaggaacgaggaagguaauggagauaacagcugaauggcuauggaggacuuuaggaagaaacaagcgaccacgauuauguacgagagaagaauuuacgaagaaagugagaacaaaugcagcaaugggcgcaguguuuacggaagagaaccagugggauuccgcaaaagcagccguagaggaugaggaguucuggaaacuuguugauagggagcgagaauuacauaaacuggggaaauguggaagcugcguuuauaauaugaugggaaaaagggagaaaaaguuaggugaauuugguaaagccaaaggguccagagcaauaugguauauguggcuaggagcccguuacuuagaguucgaagcgcuaggguuucuaaacgaagaucacugguuuaguagagaaaauaguuauagugguguugaaggggaaggucuacauaaacuggguuauauauuaagggacauaagcaaaauuccagggggagccauguaugcagaugauacugcuggaugggauacccgaauaaccgaagaugaccuacauaacgaagaaaagauaacacaacaaauggauccugaacaucgacaauuggcaaaugcaauauuuaaauugaccuaucagaacaaaguagucaaaguacaaagaccaacgccaacugguacuguaauggacauuauaucucggaaagaucaaagaggcuccggccagguaggaaccuauggacuaaauacuuuuacuaacauggaagcacaauuagucaggcagauggagggcgaagauguauuaagcaaggccgaucuggagaauccgcaucuacuugagaagaaaauaacacaaugguuagaaacaaaaggaguagagagauuaaagaggauggcgauaucuggcgacgacuguguggucaaaccuauagaugaucguuucgcgaacgcacuuuuagcucugaaugauaugggcaaagucagaaaagauauaccccaauggcaaccaucaaaaggcuggcaugauuggcaacaagugccuuuuugcucucaucauuuccaugaauugauuaugaaggaugguaggaaguuaguagucccaugcagaccgcaagacgaacugauagguagagcacgaauuagucagggagccggauggucacuccgugagaccgccugcuuggggaaagcauaugcacaaauguggucuuuaauguauuuccaccgucgcgacuuacguuuagcaucuaaugccaucugcucagccguaccuguucacugggucccgacuucgcgaacgacauggucuauccacgcccaccaccaauggaugacgacggaagauauguuaacuguauggaaccgaguauggauagaagauaacccauggauggaagauaagacuccaguuacuacaugggaaaacguacccuaucugggaaaaagagaagaucaaugguguggaucauuaauaggauuaacaucacgggccacaugggcucagaacaucccaacugcaauccaacaaguuagaaguuugauugggaacgaagaguuccuagauuauaugcccucaaugaaaagauucagaaaggaagaggaauccgaaggggcgauaugguaa

SEQ ID NO: 23154 - RNA, 9873 nt, Artificial Sequence
  derived and/or modified CDS sequence (opt6) from DENV-3__GQ252674__SS-prME
acaaguuuaugcuuaaugaugaucuuaccugcagcauuagcauuucauuuaacuucaagggacggagaaccuaggaugauuguagggaaaaaugaaagagggaaaucacugcuguuuaaaaccgcuaguggaauaaacaugugcacucuuauagccauggacuuaggagaaaugugugacgacaccgugacauauaaaugcccgcauaucacagaaguggaaccagaagacauagauugcuggugcaauuuaacguccacauggguaaccuauggaaccuguaaucaagccggugaacaucggagagauaaacgaagcguagcacucgcaccucaugugggaaugggucuagacacaagaacccaaacauggaugagcgcugaaggcgcguggagacaaguagaaaaaguagaaacaugggcacugaggcauccaggauuuacgauacuggcacuguuuuuggcgcauuacauuggaaccaguuuaacucaaaaaguggucaucuuuauauuauugauguuaguaacuccgucgaugacaaugagaugugugggaaucgguaauagagacuucguugaaggccucuccggggccaccuggguggauguaguccuugaacacggcggauguguaacaacuauggcuaaaaauaaaccaacccuugauauagaacuccagaaaacagaagcaacacaacuugcuacgcugcgcaaacuauguaucgaagggaaaauaacaaacauuacuacugacaguagauguccuacacaaggagaagcaguacuaccggaagaacaagaucaaaauuauguauguaaacauaccuaugucgacagagguugggguaaugguuguggcuuauucggaaaaggaagccucguaacaugcgcuaaauuucaauguuuagaaccaauagaaggaaaaguaguacaauaugaaaaucugaaauauacggucauaauaacagugcacacaggugaucaacaccaaguagggaacgaaacacaaggaguuacugcagaaauaacgccucaagcuaguaccaccgaagcaauccucccagaauacggaacuuuagguuuagaauguucaccaagaacagguuuagacuuuaaugaaaugauuuuacugacgaugaaaaacaaagccuggaugguccauagacaaugguucuuugaccucccauuaccauggacgucaggagcuacuacagaaacgccgacuuggaauagaaaagaacuuuuggucacguuuaaaaacgcucacgccaagaagcaagaaguagugguucuagggagccaggaaggagcuaugcauacggcauugacuggagccacggaaauccaaaauucugggggcacgucgauauuugcuggacauuuaaaguguagacugaaaauggauaagcuagaacuaaaagguaugucguaugcuaugugcacgaacacauuuguucuuaagaaagaaguaucugaaacccaacauggcacaaucuuaaucaaaguagaauacaagggagaagacgcuccauguaagauuccuuuuagcaccgaagauggucagggaaaagcccauaauggcagauuaaucacagcuaauccaguagugacgaagaaagaagaaccaguuaauauugaagccgaacccccauucggugaaagcaauauagucaucggaauaggugacaaugcauugaagauaaacugguacaagaaaggaaguucaaucgguaagauguuugaggcaaccgcacguggggcaaggcguauggcuauacuaggcgauacagccugggacuuuggauccguaggugggguacuaaauagccuagguaagaugguccaccagauuuucggaagcgcuuacacggccuuauuuucaggaguaaguugggucaugaagaucggaauuggcguacuacuaaccuggauagggcuaaauucuaaaaauacaucuaugucauuuucaugcauagccauaggcauaaucacuuuguauuuaggggcgguuguccaagccgauaugggauguguuauaaacuggaaagggaaggagcuaaaauguggaaguggaauauuugugaccaaugaaguacauacguggacagagcaauacaaauuucaagcugauaguccgaagagguuggcaaccgcgaucgcaggggccugggaaaacggaguaugcgguauacguuccacuacuagaauggaaaaccuacuuuggaaacagauugcuaacgagcuaaauuacauacugugggaaaacaauauaaaacuaacggucguagugggggauacaauagggguuuuagaacaagggaagagaacuuuaacgccacaaccaauggaacucaaauacaguuggaagaccuggggaaaagcaaagauuguaacggccgaaacacaaaacuccuccuuuauaauagauggccccaacacucccgagugucccucagcuucaagagcguggaaugugugggaaguggaagacuauggguuuggaguuuucacgacaaacauuuggcuuaaauuaagagacgucuacacgcaacuuugcgaucaccguuuaaugucugcagcugucaaagacgaaagagcaguacaugcagacaugggauacuggauagaaucucaaaagaauggcuccuggaaauuggaaaaagcgagucucaucgaagugaaaacauguacguggccgaaaagucacacauuauggucaaacggcgucuuagagucagauaugauaauuccuaaaucacuugcuggaccaauaucucaacacaauuauaggccugguuaucauacucagacggccgggccuuggcaucuuggaaaauuagaacucgauuuuaauuauugugaagguacaacggucguaaucacagaaaauugcggaacaagaggaccaucgcuuaggacgaccacaguuucuggaaaguuaauacaugaaugguguuguagauccuguacacuaccucccuuaagguauaugggggaagauggcuguugguacggcauggaaauaaggcccauuucagaaaaagaagaaaauaugguaaagagcuuaguuuccgcgggcagcggaaaggucgauaauuucaccauggguguacucuguuuggcgauuuuauuugaagagguaaugagaggaaaauucgguaagaaacauaugauagcgggaguacuguuuacauucguauuacuccuuucagggcaaauaaccuggcgagauauggcucauacacuaauaaugaucgggagcaacgcuagcgauagaaugggaaugggaguaacuuauuuagcucuuauagcaacuuucaagauucagcccuucuuagcauuaggauuuuucuuaagaaaauuaacaucaagggaaaaccuccugcuuggaguaggauuggcaauggcaacgacacuacaacucccggaagauaucgaacaaauggcaaacggaauagcucuaggauugauggcccuaaaauuaauaacacaauucgagacauaccaacuguggacugcacucguuagucuuaccuguucuaacacuauucucacuuugaccguggcauggcgaacggcaacccugauucuagccggugucucguugcuuccaguuugucaaucaucuucgaugagaaaaacagauuggcuuccuaugaccguagcugcaaugggcguaccgccgcuaccguuauucauauucucuuugaaagacacucuaaaacgcagaucuuggccacucaacgagggagucauggccguaggacucguaucaauauuagcaucuagcuuauugcgaaaugacguuccuauggccgguccccuaguagccggaggacuauuaauagcaugcuauguuauuacagggaccagugccgaccuuacaguagaaaaugcugcggacguuacaugggaggaagaagcugaacagacgggagugucucacaauuuaaugaucacuguagaugacgauggaacaaugagaauaaaagacgaugaaacugagaacauccucacuguauuauuaaaaacugcauuacuuauuguaucugguauuuuucccuauucuauuccugccacuuugcugguuuggcauacuuggcagaaacaaacucaaaggagcgggguacuuugggacguuccuagcccuccugagacacaaaaggccgaacuagaagagggcgucuauagaauaaaacaacaagguauuuuuggcaaaacacaaguaggugucggaguacaaaaagaagguguuuuucauaccauguggcacgugaccagaggggcuguuuuaacgcauaaugggaaaagacuugagccuaauugggcaagugugaagaaagauuuaauuucuuauggagggggauggagauugucugcacaauggcaacgaggugaagagguacagguuauagccgucgagccagguaaaaaucccaaaaacuuucagaccaugccugggacauuccaaacaacaacaggagaaaucggagcuauagcacuugacuuuaaaccggguacuagcggaagcccgauaauaaaccgggaagggaaaguuguaggccucuauggcaacgggguaguaacuaaaaacggcggcuauguaaguggaauagcucaaacgaacgcugagccagauggacccacaccagaacucgaagaggagauguucaaaaagcguaaccucacaauaauggacuuacacccagguucaggcaaaacacguaaguaucuuccggcaaucgugcgagaagcaauuaaacgaaggcuccguacacuuauccuugcaccaacuaggguaguagcugcggaaauggaagaagcucugaagggauuaccaauacgauaccaaaccacagcaaccaagagugaacauacugggagagagauaguggaccugaugugucaugcuaccuucacaaugcguuuauuaucuccaguacgugucccuaauuauaaccuaauaauaauggacgaagcacauuucacggauccggccagcauugcggcuagagguuauaucucuacaaggguaggaaugggagaagcggccgcaauuuuuaugacggcaacaccgccuggaaccgccgacgccuucccacagucgaacgccccuauucaagacgaagagagggacauacccgagcggagcuggaacucaggaaacgaguggauaacggauuuugcuggaaaaacuguaugguuuguacccuccauaaaggcagguaaugauaucgcgaauugccuacgaaagaaugguaaaaagguuauacaacuuucccgcaaaacuuucgacacagaauaucagaaaacaaaauuaaacgacugggauuucgucgugacaacugauauuagugaaaugggggcaaauuuuaaagcggaucguguaauagacccucgaagguguuuaaaaccagucauacuaacagaugggccagaacgcgucauccuugcuggaccaaucccaguaacagcagcaagugcugcccaaagaagaggaaggguaggaagaaacccacaaaaggaaaacgaccaauacauuuucacaggacaaccauuaaauaacgacgaagaucaugcgcacuggaccgaagcaaaaaugcuccuugacaauauaaauacucccgaagguaucauaccugccuuguucgaacccgaaagggagaaauccgcagcuauagauggugaauaccgauugaaaggugaaaguagaaaaaccuucguugagcucaugagaaggggugauuuaccaguaugguuagcccacaagguagcaucagagggaaucaaguacacugaucgcaaauggugcuuugauggacaacguaacaaucaaaucuuagaggaaaauauggauguagaaaucuggacgaaggagggcgagaagaagaaacuucguccuagguggcuagacgcgcgaacauacagugacccacuagcacuuaaagaguucaaagacuuugccgcaggacgaaaaucaauagcauuggaccuagucaccgaaauagggagagugccgucccauuuagcacauagaaccagaaacgcccuugauaaucuagugaugcuccauacaagugagcacggaggccgagccuauagacaugcaguugaagaauugccagaaacgauggaaacauuauuacuacuuggucuaaugauucugcuaacaggcggcgcaaugcuuuuucuaauuagcggaaaaggcauugggaaaacaucaaucgggcuaaucugugugauagccucuucaggaaugcucuggauggcagaaauccccuuacaauggaucgcuucugccaucgucuuagaauuuuucaugaugguguuauugaucccugaaccggaaaaacaacgaacaccacaagauaaucaacuagcauauguaguuauagguauacuuacauuggcagccauaauugcggcuaaugaaaugggauuacuagaaacaacgaaaagggacuuagggaugucuaaagaaccgggaguaguaucaccuaccaguuaucuagauguagaucuucauccagcgucugccuggacauuauaugcaguagcaacaacgguuaucacaccaaugcuaagacauacuauagagaauaguacugcaaacguaagccuagcagcgauugccaaccaagcugugguuuugaugggccuagauaaagguuggccaauaagcaaaauggaucuagguguaccauuacucgcucuuggauguuacagucaagucaauccccugacauugacagcugcaguacuacuacuaauuacacacuacgccauaauaggucccggccuccaggcaaaagccacgagggaggcccaaaagaggacagcggccggaaucaugaagaacccaacagucgauggcauaaugacgauagacuuagauccaguaauauacgacucuaaauuugaaaaacagcugggucaaguaauguuauugguccucugcgcgguccaauuacuccugaugcgaacauccugggccuuaugcgaggcuuuaacuuuagcgacaggccccauaacaaccuugugggaaggaagcccaggcaaauuuuggaauacgacuauagcaguaucgauggcaaauaucuuuagaggaaguuaccucgcaggagcggggcucgccuucaguauuaugaagaguguagguacaggaaaacgggggacuggcucccagggagagacacucggcgaaaaguggaagaagaaauuaaaucagcuuagcagaaaagaguucgauuuauauaagaaaucagguauaacagaaguugaccgaacggaagccaaagaggggcucaagcgcggagagauaacccaucacgcagucucacggggguccgcuaaauuacaaugguucguagaaagaaauaugguaauuccugaagggcgcguaaucgaccuaggcugugguagaggaggauggaguuauuauugugccggucucaagaaagucacagagguaagagguuacacuaaaggaggcccaggacacgaagaacccgucccuaugagcaccuacggauggaauauaguaaaguuaaugucuggcaaagauguuuucuaucuaccuccagaaaaaugugauaccuuguuaugugauaucggugaauccucuccaagucccaccguagaggaaagcagaacgauacguguacuaaaaaugguugagccauggcuuaagaacaaucaauucugcaucaaaguucucaauccuuauaugccaacaguuauugaacacuuagaaagacugcaaagaaagcaugguggaauguugguaaggaauccgcuuagucguaauucuacgcaugaaauguacuggauaucuaaugggaccgguaauauuguaaguucaguaaacaugguuaguagauuauuguuaaauagguuuacuaugacacaucgacgacccacaauugaaaaagacguggacuuaggagcagguacacgacaugucaaugcugagccugagacaccuaacauggacguaauuggugagcggauaaaacguauaaaagaagaacauaauucaacguggcauuacgacgaugaaaacccuuacaagacgugggcguaucauggaagcuaugaaguaaaagcaacagguagugcgucaucaaugaucaaugguguaguaaaacuacuaacaaaaccgugggauguuguuccaauggucacucaaauggcaaugacggauaccacaccuuuuggucaacagcggguauucaaagaaaagguggacacaagaaccccucgaagcaugcccgguacuagaaaaguuaugggcauaacagccgaauggcuuuggcgaacacucggucgaaauaaacgaccacguuugugcacacgugaggaguucaccaagaaaguaagaacuaaugcagcgaugggagcaguuuuuacugaagaaaaccaaugggauagugcaaaagcagcagucgaagaugaagaauuuuggaagcuaguagacagagagagagaauuacauaaacuagguaaaugugguaguugcguauacaauaugaugggcaagagagaaaagaaauugggggaguucgguaaggcuaaggguagcagagcuauuugguacauguggcucggagcaagguauuuggaguucgaagcccuaggauuuuugaaugaagaccauugguucagccgcgauaauagcuacucagguguagaaggcgaaggauuacauaaacuuggguacauucuaagagauaucucaaagauccccggaggagccauguacgcagaugacaccgcugguugggauacaagaaucacugaagaugaucuacacaacgaggagaaaauaacucaacagauggaccccgagcacagacagcuugcaaacgcaauuuuuaagcuaacuuaucaaaauaaaguagucaagguccagcguccaacaccuacuggaacuguuauggauauaauuucaaggaaggaucagcgaggaucaggccaaguagguacuuauggacuaaauacauuuaccaauauggaagugcagcuugugagacaaauggagggcgaagguguauugucuaaagcagauuuagaaaauccgcaccuucccgagaagaaaauaacucaaugguuagagaccaaaggaguggaaagacuuaagcgaauggccauuucaggugaugauuguguaguaaaaccuauugacgauagauuugcaaaugcauugcucgcguugaaugauaugggaaagguaagaaaggacauuccacaguggcaaccuuccaaaggauggcaugauuggcaacaagucccguuuugcucccaccauuuccacgaauuaauaaugaaagauggacgcaaacucguugucccaugcagaccucaagaugaacugauagguagagcuagaauaucacaaggggcuggauggucauuacgagagacugcaugucuaggcaaagcauaugcacaaauguggaguuuaauguauuuucauagaagggaccuuagacuugcuuccaacgcuauuuguagugcaguacccguccauugggugccaacaaguagaacaacuugguccauacacgcccaucaccaauggaugacgacugaggacaugcuaaccguguggaauagaguuuggaucgaagauaauccguggauggagaacaaaacucccguuaccacaugggaaaaugucccauauuugggcaagagagaagaucaauggugcgguucgcugauaggacuaacgagccgugcuacaugggcgcaaaacauaccgaccgcaauacaacagguaagaagccuaauuggcaaugaggaauuucuagauuauaugccuucaaugaaacgauuucgaaaagaagaagaaucagaaggggcaaucugguaa

SEQ ID NO: 23155 - RNA, 9873 nt, Artificial Sequence
  derived and/or modified CDS sequence (opt6) from DENV-3__GQ199889__SS-prME
acaagccuaugucugaugaugauucuuccggcagcucucgccuuccauuuaaccagcagagauggcgaaccgagaaugauaguaggcaaaaacgaaagggguaaaucucuuuuguucaaaacugccaguggcaucaauaugugcacucuaauugcuauggauuuaggagaaaugugcgacgacaccguaacauauaaauguccccacaucacugaaguagaacccgaagauauagauuguuggugcaacuuaaccaguacauggguaacuuauggaacauguaaucaagcaggggaacaucgucgagauaaaagaucuguagcuuuagcaccccauguggguaugggccuagauacacgaacccaaacguggauguccgcggaaggugcguggcgacaagucgaaaaaguugaaacuugggcacuaagacacccaggauucaccauuuuggcuuuguuccuagcccacuauauagggacuucauuaacgcagaaaguggucauauuuauauugcuaauauuagugacaccaucgauggcaaugagauguguagggguaggcaaucgagacuucguugaagguuuaagcggugcuacauggguugauguuguacuagaacacggcgguuguguuacaaccauggcuaaaaacaaaccuacucuugauauagaacuucagaaaacagaagcuacacaauuagccacguugcguaaacuuuguauagaagguaaaauuacaaauauaaccacagauucuaggugcccgacacaaggagaagcgauacucccugaagaacaagaucagaauuaugucuguaaacauacauauguagaccgagguugggguaacgggugcggcuuauuuggcaaagguaguuuagucacaugugcuaaauuucaaugucucgaaucuauagagggcaaaguagugcaauaugaaaauuuaaaauauaccguaauaaucacaguccauacaggagaccaacaccaaguuggaaaugaaacacaaggcguaacagcugagauaaccccucaagcaucaacaaccgaagccauucuaccggaauaugguaccuuggguuuggaauguucuccaagaacuggacuagauuucaacgaaaugauuuuguugacuaugaaaaacaaggccuggauggugcauagacaaugguucuuugacuuaccgcuaccuuggacuucaggcgcaacuacggaaacaccaacuuggaaucgaaaagaacuauuaguuacauuuaaaaaugcacaugcaaagaaacaagagguagugguucuaggcagucaagagggagccaugcauacagcguuaacaggagcuaccgagauucaaaacucaggagggacaaguauuuuugcuggucacuuaaaaugcagauugaaaauggauaaauuagagcugaaaggaaugucauaugcaaugugcacaaauaccuucguucuaaagaaagaaguaagugagacgcagcauggcacaauuuuaauaaaagucgaguauaaaggagaagacgcuccguguaagauaccauuuaguacagaggauggacagggaaaagcacacaauggaagguuaauaacggcgaaccccgugguaacaaagaaagaggaaccgguuaauauagaagcugaaccucccuuuggggagucuaacauaguaauaggaauuggagauaaugcuuugaaaauuaacugguauaagaaaggaucuucaauuggaaaaauguuugaagcgacagcuaggggugcacgacguauggccauauuaggugacacggcuugggauuucggaaguguuggugguguauugaacucguuaggaaaaaugguccaccaaauauuugguucagcauauacagcucucuucucuggcguaagcuggguaaugaaaauuggcauaggaguauuauugacauggaucggucuaaauagcaaaaauacaaguaugaguuuuagcuguauugccauuggaauaaucacacucuaccuaggagcugucguacaagccgacacagguuguguaaucaacuggaaaggaaaagaacuaaaaugugguaguggaauuuuugucacaaacgaagugcacacauggacagagcaauauaaauuccaggcagacaguccaaaacgccuagcaacggcaaucgcaggagcuugggaaaacgguguaugcggaauaagaucaacuacgcgcauggaaaaucuauuauggaaacaaauugcuaacgaguugaauuacauucuaugggaaaauaauaucaagcucacaguggugguaggugacacgauuggcguucuagaacaagguaaaagaacccuuacuccgcaaccaauggaauuaaaauauuccuggaaaacauggggaaaagccaaaauagucacugccgaaauccagaacucauccuucauaauagacgggccaaauacgccugaauguccaucugcuuccagggcuuggaaugucugggagguagaagauuauggguucggcguuuuuacuacaaacauuuggcuuaaacuaagagaaguguacacucaacuaugcgaccaccgauugaugucagcugcuguaaaggaugagagagccguccacgcggauaugggcuauuggaucgaaucgcagaaaaauggaagcuggaaauuagaaaaagccucguuuaucgaaguaaaaaccuguacuuggccuaaaucgcauacgcuuuggucuaauggcgucuuagaauccgauaugauuauacccaaaagccuggcuggaccaauuucacaacauaauuacagaccagguuaucacacacagaccgcggggccguggcaucuaggaaaacuagaacuagauuuuaauuacugcgaagggacaacagugguaaucacugaaaauugcgguacuaggggaccaucucucagaacaaccacaguauccggcaaauuaauccacgaauggugcugccguaguuguacguuacccccauugcguuauaugggagaagaugguugcugguacgggauggaaaucagaccaauuagugaaaaagaagaaaauaugguuaaaaguuuagcaucggcagguucaggcaagguugacaacuucacaaugggagugcuuugccuagcaauuuuauuugaagaaguaaugagagguaaauuugggaaaaagcauaugauugcaggagucuucuuuacguucguucuuuuacuaucaggucaaaucacauggagagauauggcucacacccuaaucaugauugguucaaacgcaucugaccgcaugggcaugggaguaacauaccucgccuuaauagcaacguuuaaaauucagccguuucuagccuuaggcuucuuuuugagaaaguuaaccucacgagaaaaccuguuguuaggagugggucuagcuauggcuacuacacuucaacuuccagaagacauugaacaaauggccaacgguauugcucugggucuaauggcauugaaguugauuacacaauuugaaacauaccagcuguggacagcauuaauuagucugacaugcucaaacacuauguuuacacuuacuguagcuuggagaaccgcaacacugauauuagcaggaguguccuuacuucccguaugucagagcucgucaaugagaaaaacugauuggcuacccaugacaguagcggcaauggguguuccacccuugccauuauuuauauuuagucuaaaagacacacuaaaacgaagaucauggccauuaaaugaaggcgucauggcaguggggcugguauccauauuggcaucaucguuguuaagaaacgacguaccaauggcugguccauugguggcuggagggaugcucaucgcauguuauguaauaacaggcaccucagcggaucucacaguagaaaaagcagcggacguaacuugggaagaagaagcggaacagacaggagucucucauaaucuuaugaucacgguugaugacgacgggaccaugagaauuaaagacgaugaaacagaaaauauccugaccguccuacucaagacagcacuacucauagucucuggaaucuucccauacagcauuccugcuacacucuuagucuggcauacauggcaaaaacagacgcaacgaagugguguucuuugggaugucccuaguccaccagaaacacagaaagcagaacuggaagagggcguauaucgaaucaaacaacaggggauauuggggaaaacacaagugggaguuggcguacaaaaggaggggguauuucacacgauguggcacgucaccagaggagcugugcugacacauaacgguaaaaggcuugaaccaaauugggcauccgucaagaaggacuuaaucucauaugggggaggauggagauuaucagcucaauggcagaaaggagaagagguccaaguuauagcaguagaaccagggaaaaauccgaagaauuuccaaaccaugccaggcacauuccagacgacaaccggggaaauaggugcaauagcacuggauuuuaagccaggaacauccggaaguccaaucauaaaucgugaagguaagguuguuggacuauaugggaauggaguaguuacgaaaaacgguggauauguaucagguauugcacaaacuucugcugagccagacgggccuacuccugaauuagaggaagaaauguucagaaagaggaauuugacuauaauggacuugcauccaggaagugguaaaacuaggaaauauuuacccgcuauugucagagaagcgaucaagcgacgacuccguacacuuauccuugcacccacccgggucguggcugcugagauggaagaagcucuuaaaggacugccaauaagauaccagacuacagcgacaaaaucugaacauacuggccgagagauuguggaccuuaugugucacgccacguucacaaugcgacugcuaucgcccgucagagucccaaauuauaaucuaauaauuauggacgaagcacauuuuaccgauccugcaucaauagcugcaagaggguacaucucuacuagaguagggaugggagaagcugcagcaaucuuuaugacagcaacgccaccgggaacggcugacgcauuuccacaaaguaaugccccaauucaggacgaagaaagagacauaccugaaaggaguuggaacucaggaaaugaauggauaacggacuuugcgggaaaaaccguaugguucguacccucaauaaaagcagguaacgacauugcaaauuguuuacgcaagaacggcaagaaaguuauucaauuaucaagaaagaccuuugacacagaguaccaaaagaccaaacuaaacgacugggacuuuguuguuacuacagacauuucagagaugggcgcaaauuuuaaagcagaccgaguuauagaucccagaagaugccuaaaaccggucaucuuaacggaugggccagaaagaguuauuuuggcaggaccuaugccgguaacugcagcaucagcggcacaaagacguggucgagucggaagaaauccgcaaaaggagaacgaccaauacauuuucaccggacaacccuuaaauaacgaugaagaucaugcucacuggaccgaggcaaaaaugcuuuuagauaacauuaauaccccagaagguaucauacccgccuuguuugaacccgaaagggaaaaaucggcagcgauugacggagaauacagacugaaaggagaaucuaggaaaacuuuuguugaacucaugcgccgaggggauuuacccguaugguuggcgcacaaaguugccucagaaggaauuaaauacacagacagaaaauggugcuucgauggacaaagaaacaaucaaauacuagaagaaaauauggauguugaaauauggacgaaagaaggugagaagaagaaauuaaggccaagaugguuagacgccagaacauacagcgauccguuagcacuuaaggaauuuaaagauuucgcugccgguagaaaauccauagccuuagauuuggugacugaaauagguagagugccuucucaccucgcucauagaacccguaaugcgcuugacaauuuaguaaugcuucacacaagcgaacacgguggacgugcauauaggcaugcuguggaagaguuacccgaaacuauggaaaccuuacuucuacuuggcuuaaugauauuauugacugggggagcaaugcuauucuuaauaucagguaaaggaauagggaaaacgagcauuggauuaauauguguaaucgccaguaguggaauguuauggauggcugacgugccacuucaauggauagcuucagcaaucguucuagaauuuuucaugaugguuuugcuaauuccagaaccggaaaaacaacgaaccccucaagauaaucaacuugcguauguuguaaucgguauauuaacucucgcagcuauuaucgcagcuaacgaaaugggauuauuagaaaccacaaaaagggaucuagguaugucaaaggaaccaggcguaguaagucccacgucuuaccuggacguagaccuacauccagcuucagcauggacauuauaugcgguagcuacaacagugauaacacccaugcuccgucacaccauagaaaacaguacggccaaugugucacucgcagcaauagcgaaucaagcaguaguauuaauggggcuagacaaaggguggccuauuucaaagauggauuuaggagucccucuauuagcgcuaggguguuacagucagguuaacccauuaacacuuacagcugcaguacuuuuacucauaacacacuaugcaauaauaggcccuggguuacaagcgaaggcgacacgcgaagcucagaaaagaaccgcugcugguauaaugaaaaauccgacgguggaugggauaaugacuauagauuuagaccccguaauuuacgauaguaaauuugaaaaacaauuaggacaaguaauguugcucguucugugcgcaguccagcuauugcuaaugcgcacaucuugggcacucugugaggcauuaacguuagcaaccggaccuauuacuacccucugggaagguagcccggguaaauuuuggaacaccacuauagcaguaaguauggcuaauauauucagagggucauacuuagccggggccggcuuagcguuuaguauaaugaaaaguguggguaccggaaaaagagguacgggcucacaaggagagacucuuggggagaaauggaagaagaaacuaaaucaacuuucacguaaggaguucgaccucuauaagaaaucugggaucaccgaaguagaucgaacagaagcgaaagaagguuuaaaaaggggagagacgacacgacaugcaguuaguagagguagugcaaaacuacagugguuuguugaaagaaauaugguuauuccagagggccgugucauagaucuaggcuguggacgaggaggauggaguuauuauugcgcaggacuuaaaaaggugacugaaguacgcggauauacaaaaggaggaccgggacaugaagaaccaguuccgaugagcacauauggauggaacauugucaaacuaaugucaggcaaggauguauuuuacuuaccgccagagaaaugugauaccuuacugugcgauauaggagaaucaucaccgucuccgacaguagaagaaucaaggacaauaagaguacugaaaaugguagaacccuggcuuaagaauaaucaauuuuguauuaaaguacucaacccuuauaugccaaccgugauagaacaucuagaaaggcuacaaagaaagcacggaggaaugcugguacguaacccacuaucaagaaacucuacucacgaaauguauuggauaucaaacggcacagguaacauuguaucuagcguuaauaugguaagccguuuauuacucaacagauucaccaugacacauagacgaccuacgauugagcgugauguagaccuuggagcugguacgagacauguuaaugcggagccugagauuccgaacauggacguaauuggggaaagaaucaaaaggaucaaagaagaacauaacagcacuuggcacuacgacgaugagaacccuuacaaaacuugggcuuaucauggaagcuacgaaguuaaggccaccgggucagcaucaaguaugauuaacgguguaguuaaauuacuuacaaaacccugggauguuguuccaauggugacccaaauggcuaugacagauacaacaccuuucggccaacaacggguauuuaaagaaaagguagauacaaggacuccacgaccaaugccggggacacgaaagguaauggagauuaccgcugaauggcucuggcggacgcuaggaagaaacaaacguccgagacugugcacacgugaggaguucacgaaaaagguacggacaaaugcggcaaugggggcugucuucacggaagaaaaucagugggauagugcaaaagcugccguagaagaugaagaguucuggaaguugguugacagagaacgagagcuccacaaacuuggaaaaugcgggaguuguguauauaacaugauggggaaaagagagaagaaacuuggagaguucggaaaagcuaaaggaagucgagcaauaugguacaugugguuaggggcuagauaucuagaguuugaagcucuugguuuccugaacgaagaucauugguucagucgugaaaacucguauaguggcgucgaaggugaggguuuacauaaacuaggauacauacuucgcgauauaagcaaaaucccagggggagcaauguaugcggacgacacagcagguugggauacgcgcaucacugaagacgaucugcauaacgaggagaaaaucacacaacaaauggauccagaacaucggcaguuagcuaaugcaauauuuaaacuaacguaucagaauaaagucgucaaaguucaacguccuacuccaacgggaacagugauggauauaaucucuagaaaagaucaacgaggaucugggcagguaggaacauauggucuuaauacguuuacgaacauggaggcgcaacugguacgucaaauggaaggggaagguguacuuucaaaagccgaucuagaaaauccacaccuucucgagaagaaaauaacgcaaugguuagaaaccaaaggcguagagcgacuaaaacgaauggcgauuucaggugaugacugugucguuaagccaauugacgacagguuugcaaacgcccuacucgcgcuuaaugauaugggaaagguaaggaaagauauaccucaauggcaaccgucaaaaggauggcacgauuggcaacagguaccauuuugcagucaucauuuccacgagcuaauaaugaaagacgggagaaagcuaguuguaccgugcaggccccaagaugaacuaauaggucgagcacggauuucucaaggagcuggcuggucacuucgagaaacagcauguuuaggaaaggccuacgcucagauguggucucuuauguauuuucauagaagagacuugagauuagcuucgaacgcuauuuguucagcuguaccaguacauugggucccuacaaguaggacuacuuggucaauacaugcucaucaucaauggaugacaacagaagauaugcuuacaguauggaaucgaguauggauagaagauaauccauggauggaagauaaaacaccaguuaccacuugggaaaacguuccuuauuugggaaaaagagaagaucaauggugugggucacuaauugggcuuacaucucgugcuacaugggcucaaaauauaccaacugcaauccaacaaguccggagucuaauagguaacgaagaguuuuuagacuauaugccaucaaugaagagauuuaggaaggaagaagaaucagagggagcgauaugguga

SEQ ID NO: 23156 - RNA, 9873 nt, Artificial Sequence
  derived and/or modified CDS sequence (opt6) from DENV-3__FJ882571__SS-prME
accagcuuaugucuaaugaugauacuuccugcagccuuagcauuccaucuuacaucacgcgauggagaaccacgcaugauugucggcaaaaaugaaaggggaaaaucacuuuuauucaaaacugcaaguggaaucaauaugugcacucuaaucgccauggaccuaggagaaaugugcgaugacacagucaccuacaaauguccgcauauuacggaagucgaaccagaagacauagacuguugguguaaucugacaaguaccuggguuaccuacgguacauguaaucaagccggagaacaccgaagagauaaaagaucugucgcuuuggcaccccauguggggauggggcuagacaccagaacacaaaccuggaugucagcggaaggcgcguggcgacaaguggaaaaaguagaaacuugggcauuaagacauccagguuuuacuauauuagcgcuauuucuagcucacuacauaggcaccucauuaacccaaaaaguuguuauuuuuauauugcuuaugcucguuacacccuccaugacuaugcguuguguuggaguagggaaucgagacuucguagaaggacuaucaggagcuaccuggguagauguagugcuugaacacggagggugcgucacuacaauggccaaaaauaaaccaacuuuagacaucgaacuccagaaaacugaagcaacucaacuugcaacacuacgaaaauuauguauugaaggaaaaauaacuaacauuacaacugauucaagaugucccacacaaggagaagcaguuuugccugaagaacaagaccaaaauuauguguguaaacacacguacguagacagggggugggguaauggguguggucuauuuggaaaagguagucuagucacaugugcgaaauuccaaugucuugaacccauagaagguaaaguaguacaauacgaaaauuuaaaauacacaguuauaauaacaguacacacuggagaccaacaucaagucgggaaugaaacccaaggaguuaccgcagaaauaacuccacaagcaucuaccacugaagccauacuaccggaauauggcacacuaggguuagaauguuccccgcguacuggguuagauuuuaaugagaugauacuucuaacaaugaaaaacaaggcuuggaugguccauagacaaugguucuucgaucuuccucuaccguggacaaguggggcaacaaccgagacucccacguggaacagaaaagaauuguuaguaacauucaaaaaugcacacgcgaagaaacaagaagugguaguucuagggucgcaagaaggagcaaugcacaccgcacuaacaggcgccacagaaauacaaaauaguggcgggacgucgauuuuugcaggacauuuaaaauguagauuaaaaauggauaaauuagaacugaaagggaugucauaugcaaugugcacuaauaccuucgucuuaaagaaagaaguaagugaaacucaacauggcacaaucuuaaucaaaguugaauauaaaggagaagaugcaccguguaaaauaccuuucaguacugaagacggacaaggaaaagcucacaauggucgacuuauaacggcaaaucccgucgugacaaagaaagaggaaccaguaaauauagaagcagagccacccuuuggcgagucuaauauaguuauuggaauuggggauaaugcacucaaaaucaacugguauaagaaagggucaucaauuggaaaaauguuugaagcuacagccagaggagcacgcagaauggcgauauuaggcgacacugcaugggacuuuggcagcguaggggguguucuaaauucacuagggaaaaugguccaccaaaucuucggaucagcauacacggccuuguucucgggaguuaguuggguaaugaagauuggaauugguguauuguuaacuuggauuggacuuaauagcaaaaauacaucuaugagcuuuuccuguaucgcuauuggaauuaucacgcuauacuuaggcgcaguugugcaagcggauauggguugcguaauaaacuggaaaggcaaagaacuaaaaugugguucugggauuuucguaacgaacgagguacauacguggacugaacaauacaaauuccaagcugauagcccuaaacgccucgcgacagccaucgcgggugcuugggagaacggaguuuguggcauaaggaguaccacuagaauggaaaacuuacuuuggaaacaaauagcaaacgagcuuaauuacauucuaugggaaaauaacaucaaacuaacuguaguugucggagauacgauuggaguacucgaacaagguaaaagaacucuaacaccacagccgauggagcuaaaauauucguggaaaacguggggaaaggcuaagauugucaccgccgaaacgcaaaauaguucguucaucauagauggcccaaauacuccggaguguccaagugccaguagagcguggaacguaugggagguugaagacuauggauuuggaguauuuacaacuaauauauggcuaaaacuacgugauguuuacacacaacugugcgaccaucgcuuaaugucggcagccguaaaagaugaaagggcuguucaugcugacauggguuauuggauagagucucagaaaaacgguuccuggaaacuagaaaaggcaaguuuaaucgaagugaaaacuugcacguggccaaaaucgcauacauuauggaguaacggagugcuagaaagugauaugauuauuccaaaaucucuagcaggaccaauaagucaacacaacuauagaccaggauaccacacgcagaccgcugguccauggcaccucggcaaacuagaacuugauuucaauuauugcgaaggaacuacuguaguuauaacagagaacugugggaccagagguccgucguugagaacgacaacgguaucagguaaacuaauccaugaaugguguugucgaagcuguacgcuuccaccgcucagguacaugggggaagauggaugcugguauggaauggaaauacgaccaauaucagaaaaggaggagaauauggucaagagucuagugucagcaggaucugggaagguagauaauuuuacgauggguguauuaugcuuagcuauacuauucgaagaaguuaugcguggcaaauucgggaaaaagcacaugauagcaggaguauuguuuaccuuuguucuauuacucucaggucaaauaacauggagagauauggcccauacguuaauuaugauagguucaaacgcaucugaucgaaugggcaugggaguuacauauuuagcucucauagcuaccuuuaaaauccaacccuuucuagcucuaggauucuuucuccgaaaauuaacguccagagaaaacuuauugcuaggcguuggacucgcuauggcuacaaccuuacaauugccggaagauauagaacagauggcgaaugggauagcccucggacucauggcccucaaacuaauaacacaauuugaaacuuaucaacuauggacagcucugguuaguuuaaccuguagcaauaccauacuaacacugacaguugcauggagaacagcaacguuaauccuagcuggcguaucguuguugccgguaugucagucaucaagcaugcgaaagacggacuggcuaccaaugacgguugcagcuaugggugugccgccacucccccuauuuauauuuagccuuaaggacacgcuaaaacgccgcucuuggccgcuaaacgaaggagucauggcuguagguuugguaagcauauuagcuuccucuuuguuacgcaacgauguuccaauggccggaccucuaguagcgggcgggcugcuaauugcguguuauguaauuacuggaacaucggcugaucuuauaguugagaaagcagccgaugugacaugggaagaggaagcggaacagacagguguuucucacaacuugaugauaacaguagacgaugauggaaccaugcguauaaaggacgacgaaacugaaaauaucuugaccguucuacuaaaaacggcuuuacuuauugugaguggcauauuuccauacuccauuccugcaacguuacuuguuuggcacacauggcaaaaacagacccaacgaucaggcguccugugggacguuccuucaccucccgaaacccagaaggcggaacucgaagaaggaguguaccggauuaaacagcaagggauccuaggcaagacacaaguggguguaggagugcaaaaagagggagucuuucauacaauguggcacguaacccggggagcaguauuaacccauaacggaaagagacuggaacccaauugggcaucagucaaaaaggauuuaauaaguuauggaggaggauggcgauuauccgcacaguggcaaaaaggggaagagguacaagucauagcaguagaaccaggcaaaaaucccaaaaauuuucaaacaaugccaggcacuuuccagacgacgaccggcgaaauuggugcaaucgcgcucgacuuuaaacccggcaccucaggaaguccaauaauaaacagggaaggaaaaguuguuggauuguauggaaauggaguugucaccaaaaauggaggguauguuagugguaucgcacaaaccaacgcagaaccagauggacccacuccagaacuagaggaagaaauguuuaaaaagaggaaucuaacaauaauggaccuccacccagguucagguaaaacacggaaguaucuaccugccauaguaagagaagcaauuaaacgucggcuacgaacacucauauuggcgccuacaagaguagucgcagcggaaauggaagaggcuuuaaagggauuacccauucgcuaccaaacuacugcaaccaagucggaacauacaggcagagaaauagucgaucuuaugugucaugcaacauucacuaugcggcuacuaucuccgguuagagugccgaacuauaacuuaauaauaauggaugaagcucacuuuacagacccugcaagcauugcagccaggggauauauuucaacaagaguuggaaugggagaggcagcugcaauuuuuaugacugcaaccccgccggggacggccgaugcauuuccacagaguaacgcaccaauucaagacgaggaaagagauauccccgaacguucuuggaacuccggaaaugaguggauuacagauuuugcaggaaaaacaguaugguucguuccuucaauuaaagcuggaaacgacauugcaaauugucugagaaagaauggaaagaaagucauacagcuauccagaaaaacuuuugacacagaguaucagaaaacgaaauuaaaugauugggacuuugugguuacuacugauauaucggaaaugggugcgaauuucaaagcagacagaguaaucgauccaagaagguguuuaaaaccuguaauauugacggaugggccagaaagaguuauacuagcaggaccaaugccugucacagcggcaagugcagcucagcggcgugguaggguugguagaaacccacagaaggaaaaugaccaauacauauuuacaggacaaccccuaaacaaugaugaggaucacgcacacuggacagaagcuaagaugcuauuagauaauauuaacacgccagagggcauuauaccugcccuguuugaaccugaacgcgaaaaaucagcugcgaucgauggcgaauauagacuuaagggggagagucggaagacuuucguugagcugaugagaagaggagauuuaccuguauggcuugcccacaaaguugcgucggagggaauaaaauacacggaucguaaauggugcuucgauggccaacguaauaaccaaauucucgaggaaaauauggacgucgagauauggacaaaggaaggcgagaagaagaaauuaagaccucgcugguuagaugcgagaacguauuccgauccauuggcacuaaaggaauuuaaggacuucgcagcaggcagaaaaagcauugcauuagauuuaguaacugagauuggaagaguccccucgcauuuggcucauagaacaaggaaugcacuugauaacuuaguaauguuacauacaagugaacacggaggucgagccuaccgccacgcaguugaagaacuuccugaaacaauggagacccuacugcuccuuggauuaaugauuuuauuaacaggaggagcaaugcuguuucuuauauccgggaaaggaauagguaaaacuucaauagguuuaauaugcguuauugcaucaucuggaauguuguggauggcugaaauaccuuuacaguggauagccucagcgauaguucuugaguucuuuaugaugguauuauuaauacccgaaccugaaaaacaacgaacuccacaggauaaucagcuugcauacguuguuauugggauccucacauuggcagcaauuauugccgcuaacgaaaugggacuguuggaaacaacuaagagagaucuggguauguccaaggaaccaggugugguaaguccaacaagcuauuuagacguagaccuacacccagcuucagcuuggacacuuuaugcaguggccacaacggucaucacgccuaugcuucgacauacaauugaaaauuccacugccaauguuucgcuagccgcuauugcaaaucaagcuguaguauuaauggggcuagauaagggcuggccgauaucaaagauggaccuagguguaccguuacucgcguuaggaugcuacagucaaguuaacccccuuacucuaacugcagcgguccucuuguugauaacacacuacgccauuaucggacccgguuuacaagcaaaggcgacacgugaggcucaaaagcggacagcugcgggcauuaugaaaaauccaacugucgauggcaucaugaccauagacuuagauccugucaucuaugacuccaaauucgagaagcaauuaggucagguaaugcuccugguauuaugugccguucaauugcugcuaaugcgaaccucaugggcgcuuugcgaagcacuaacccuagcgacuggacccauaacaacacuaugggagggaucaccgggcaaauucuggaauacaacaaucgcgguaaguauggcaaacaucuuucgcgguucauaucuagcuggagcaggucuagcuuuuuccauaaugaaaagcguuggcacgggaaaaagagggacagggucccagggagaaacauuaggagaaaaauggaagaagaaauugaaccaacuaaguagaaaagaguuugaucuauacaaaaagucuggaauaacagaaguggaccgaaccgaggcuaaagagggacugaaacgcggagaaauaacccaucaugcgguuucaagagguagcgcuaaauuacaaugguuuguagaaagaaauauggugauaccagaaggccgaguaauagauuuagguuguggacguggugguuggagcuauuauugcgcgggacucaagaaagugacugaaguacgugguuauacaaaaggugggccaggucaugaagaacccguuccuaugucaacuuacgguuggaauauuguuaaauugaugaguggaaaagaugucuucuaccugccaccagaaaaaugugauacucucuugugugauauuggcgaaaguaguccuucuccaacgguugaggaaucgagaaccauacggguucuaaaaauggucgaaccaugguuaaagaacaaucaauucuguauaaagguacuaaacccuuauaugcccacagugauagaacauuuggaacggcuucaacgcaaacauggaggaauguuaguacguaauccauuaagucgaaauagcacacaugaaauguauuggauaucgaacggaacaggaaauauaguaagcagcgugaauaugguuucacggcuccuacuaaaccguuucacgaugacacacagaaggccgacaauugaaaaggacguagauuuaggagcaggcacacgacauguuaaugcagaaccagaaacaccuaacauggauguaauaggugaacgaauaaagcgcauaaaagaagaacauaacucuacguggcauuaugaugacgaaaauccuuacaaaaccugggcuuaccauggaagcuaugaagucaaggccacaggaucggcgaguagcaugauaaauggugucgucaaauuacuaacaaaaccuugggaugucguuccaauggugacacaaauggcaaugacagauacuacacccuucggacaacagaggguuuuuaaggaaaaggucgauacgcgcacacccagaccaaugccuggaacacgaaaagugauggggauaacagcagagugguuauggagaacuuuaggacguaacaaaagaccaagguuauguacacgagaggaguucacuaagaaaguaagaacaaaugcagcaaugggcgcuguuuucaccgaggaaaaccaaugggauucagcuaaagcagcgguagaggacgaagaauuuuggaaauugguggacagagaaagagagcuacauaaacuuggaaagugugggagcugcguuuacaauaugaugggaaagcgagagaagaaacuaggagaauuuggcaaagcuaaagguucucgugcgauaugguacauguggcuuggggcacgcuaucucgaguucgaagcacuaggauuccuaaacgaagaucauugguucagucgggauaauucguauagcggcguagaaggcgaaggacuccacaaacugggauauauauuaagagacauuaguaaaauaccaggaggugcgauguaugcggacgacacagcugguugggacacaagaaucacagaggacgaucuucauaacgaagagaaaauaacacaacaaauggauccugaacacaggcaauuagcaaacgcaauauuuaaacuuacuuaucaaaauaaagugguuaaaguacaaagacccaccccuaccggaacaguuauggacaucauuucuaggaaagaucagagaggaaguggacaaguagguacuuauggacuuaauacauuuacgaacauggaaguucaacuggugagacagauggagggagagggugucuuaucuaaagcugaucucgaaaacccacacuugccugaaaagaaaauaacucaaugguuagaaacaaagggaguugaaaggcucaaacgaauggcuauaagcggagaugauugcguaguaaagccaauagaugacagauuugccaaugcccucuuagcacuuaaugacaugggcaaaguuagaaaagauauuccgcaguggcaaccaaguaagggaaugcacgauuggcaacaaguaccuuucugcucacaccauuuucaugaauuaauaaugaaagaugguaggaaauuaguaguuccuugucgaccacaagacgagcuuauugggcgagccaggauaucucaaggugcagguugguccuuaagggaaacagcaugcuuagggaaggcuuaugcacaaauguggagucuaauguacuuucauagaagggaucuuagacucgcaucaaaugccauuuguucggcgguccccguccauuggguaccuaccucccgaacuacauggucgauacaugcacaccaucaauggaugacuacugaggauaugcuagcuguuuggaacagaguuuggauagaggacaauccuuggauggaggacaaaacaccaguaacaacuugggaggauguucccuacuuagguaagagggaagaucaguggugcggcaguuugauaggacucacaagcagagcaacuugggcucaaaacauucugacugcgauucaacagguucguucccuuaucggaaacgaagaauuucuagauuauaugcccucaaugaaaagauuucgaaaagaggaagagagcgaaggagcaaucugguaa

SEQ ID NO: 23157 - RNA, 9873 nt, Artificial Sequence
  derived and/or modified CDS sequence (opt6) from DENV-3__FJ882572__SS-prME
acuucauuaugucuuaugaugauccuuccagcagcauuggcguuccauuugacuucuagagacggagaaccccggaugauuguuggcaaaaaugaacgaggaaaaucucuacucuuuaaaacagcuuccggcaucaauauguguacacuaauugccauggacuuaggcgaaaugugugacgacacagugaccuauaaauguccgcauauuacugaaguugagccagaggauauugauuguugguguaauuuaacguccaccuggguaacguacgguacuuguaaucaagcuggcgaacaucggcgagacaaacgauccguagcccucgcaccacacgucggaaugggucuugacaccagaacacaaacauggaugagugcagaaggagcauggcgacaaguugaaaaaguugagacgugggcucuaagacacccaggcuucaccauauuagcuuuauuuuuggcacauuacaucgggaccaguuuaacacagaaagugguuauauucauacuauugauguugguaacaccaucgaugaccaugagaugcguagggguuggcaauagggauuuugucgaggguuuaucuggagcaacaugggucgauguaguacuugagcacggagguuguguaacaacaauggcuaaaaauaaaccgacacuagacaucgaauuacaaaagaccgaggcaacacaauuggcaacacuaaggaaacuuuguaucgaggguaaaauaacuaauauaacgacagauagcagaugcccaacacagggggaagcuguguuacccgaggaacaagaucaaaacuauguuugcaaacacacguacgucgacagagguuggggaaacgguuguggguuauuuggaaaagguaguuugguaaccugcgcaaaguuccagugccuggagucgauagagggaaaagugguacaauaugagaacuuaaaauacacaguaauaauaacaguacacacuggugaccaacaucaggucggaaaugaaacccaggguguuaccgcagagauuacaccccaagcaucuacaacggaagcgaucuugcccgaauauggaacccugggauuggaaugcaguccccgcacaggacucgacuuuaacgaaaugauauuacuaacuaugaaaaacaaagcauggauggugcauagacagugguucuuugaucuaccauugcccuggacuagcggagcuacaacagaaacuccuaccuggaauagaaaagagcuuuuaguuaccuuuaaaaaugcucaugccaagaaacaggaaguaguaguauugggcucucaagagggggcuaugcacaccgcucuuacaggagcgacugaaauucaaaauucuggcggaacauccauauuugcaggacauuuaaaaugcagauuaaaaauggacaaauuagaauugaaaggaaugucguaugcgaugugcacuaacacguuuguccuaaagaaagaagugucugaaacccagcacggaaccauauugauaaaaguagaauacaaaggagaagaugcaccguguaaaaucccauucucaacagaagaugggcaagguaaagcgcacaaugguagguugauaacugcuaacccuguggucaccaagaaagaagaaccuguaaauauagaagcugagccaccuuucggugagaguaacauagugauagguauaggggacaacgcacucaagauaaauugguauaagaaaggaucaaguaucggaaaaauguucgaagcgacugccagaggggcacgaagaauggcgauucucggagauacagcgugggauuuuggaaguguaggugggguacuaaauucauuaggcaaaaugguacaccaaauauuuggaucggcuuacacagcacuauuuagugguguaucgugggugaugaaaauaggaauaggaguucuauuaacauggauuggucuaaacuccaaaaacacuucgaugaguuuuucauguauagcuauaggaaucaucacucucuaccuuggagccguagugcaagcggauaccggauguguuauaaauuggaaagguaaagaacucaaaugugguuccggcauuuuuguuacaaaugagguacauacauggacggagcaauacaaguuucaagcagauucaccaaaaagacuugcaacugcuauagcgggagcgugggaaaacgguguauguggaauaagaucuacuaccagaauggaaaauuuacuuuggaaacaaaucgcuaacgaacuuaauuacauccuaugggaaaauaacauuaaauuaacaguugugguaggggacacuauuggaguauuggaacaaggaaagagaacucugacaccacaaccgauggaguuaaaguauagcuggaaaaccuggggaaaagcgaaaauaguaacagcugagauccaaaauagcaguuuuaucauagauggacccaacacaccagaauguccgucagcuucucgugccuggaacguaugggaaguagaagauuauggauuuggcguauuuacaaccaacauauggcuuaaauuaagagaaguauauacacagcucugcgaucacagacucaugagcgcagcaguuaaagacgaacgagcuguccacgccgauaugggcuauuggauagagucccaaaagaaugguucuuggaaacuugagaaagccagcuuuauagaagucaaaacaugcacauggccaaaaucacauacacuuuggaguaauggcguuuuagaaagugacaugaucauuccuaaaagucuugcugggccgauuucacaacacaacuacagacccggauaccauacgcagacagcagguccauggcaucuagguaaacucgaauuggauuucaauuauugcgaagguacgacaguuguuauuacagaaaacuguggaacccgaggaccaucacucagaacaaccacaguaucuggaaaauuaauacacgaguggugcugcaggucguguacucuaccaccccuucgauauaugggugaagaugguugcugguacggaauggaaauucguccaauaagugaaaaagaggagaacaugguaaaaucuuuggcaucggcugguucggggaagguggacaacuucacuauggguguacuauguuuggcaaucuuguuugaagagguaaugcguggcaaauuugguaagaaacacaugauugcaggaguguucuuuacauuuguguuauuauuauccggucagauuacuuggagagauauggcgcacacccucauaaugaucgguuccaacgcaucugacagaauggggaugggcguuaccuaccuugcacucauagcuacauuuaaaauacaaccguuucuugcauuagguuucuuucuuagaaagcuaacuagcagagaaaauuuauuacucggcguuggacuagcaauggcuaccacacuccaacuacccgaggauaucgaacagauggccaauggcauagcacucggauugauggccuuaaaauuaaucacacaauuugagaccuaccaacucuggaccgcgcuuaucucuuuaacauguaguaacaccauguucacacuaacuguagccuggagaacagcuacauugauucuggcugguguaucacuucugccuguaugucaaagcagcucgaugagaaaaacggauuggcugccaaugacuguugccgcuaugggggucccuccauugccacuauucauauucaguuuaaaggacacacugaaaagacgaaguuggccauugaacgaaggugucauggccgucggcuuaguuagcauacuagcuucaucauuauuaagaaaugacguuccaauggccggcccucuagucgcaggaggaaugcuuauagccugcuauguaauuacagguacaucugcagacuuaacgguagaaaaagcagcugaugucacaugggaagaagaggcugaacaaacuggcgugucucacaauuuaaugauaacuguggaugaugaugguacgaugcgcauaaaggaugaugagaccgaaaacaucuuaacaguguuacuaaagacagcuuuacuaaucgugaguggaaucuuuccauauucuauaccugcaacucucuuagucuggcauaccuggcaaaaacaaacgcaacgaucaggcgucuuaugggauguacccucgccgccggaaacacagaaagcugagcuggaagaagggguauauagaauuaagcagcaaggaauacuaggaaaaacgcaagugggcguaggaguacagaaggaaggcgucuuccauacaauguggcacgugaccagaggggcaguauugacacauaacgguaagcgccucgagccaaauugggcuagcgugaaaaaggaucugauauccuaugguggaggauggcgacuuucagcacaguggcagaaaggugaagaagugcaaguuauugcuguagaaccuggcaaaaauccuaaaaauuuucaaacgaugcccgguacuuuccagacaacaacuggagaaauaggugcuauugcauuagacuucaaaccggguaccagugggucuccaaucauaaauagggaggggaaagugguaggccuauacggaaauggaguaguaacuaaaaacgguggauauguaucaggaauagcacaaacauccgcagagccagauggaccuacaccggaacuugaagaagagauguuucguaaacguaauuuaacaaucauggaccuucacccuggauccgggaaaaccaggaaauaccucccagcgauuguccgggaagccauaaaaagaagacuaagaacacuaauacuagcacccacuagggucguagcagcagaaauggaagaagcccucaaaggauugccgauuagguaccaaacgacugcuacaaaaucagagcauacugguagggaaaucgucgacuuaaugugucacgcaaccuuuaccaugcgguuacuuucgccuguccguguuccaaauuauaaucugauuauaauggacgaagcacacuucacugauccagcaucaauugcugcccgaggguacauuucuacuagggucggaaugggagaagcagccgcgauauuuaugaccgcaaccccgccagggacugcagaugccuuuccacaaaguaaugcuccaauucaagacgaagaaagggacauaccugaaaggucuuggaauagcggaaacgaauggauaacagauuuugcagggaagacaguuugguuuguaccaagcauaaaagccggaaaugauauagcaaacugucucaggaaaaacgguaaaaaggugauacaacuaucacgaaaaacguuugauacggaauaucagaagaccaaacuaaacgauugggauuuuguagucacgacugauauaagugaaaugggugcaaauuucaaagccgacagaguaauugauccuagacgguguuugaaacccgugauauuaacugaugggcccgaaagagucauucuagcaggaccaaugccaguaacggcagcauccgcugcucaaagaagaggacgcguaggucgcaacccucaaaaagaaaaugaccaguacauauuuacagggcagccgcuaaauaaugacgaagaucaugcucacuggacagaggcaaaaaugcuauuagauaacaucaauacaccagaagggauaauaccggcgcuuuucgagccagagagagaaaaaucugcggcaaucgacggagaauaccgacuaaagggugaaucacgaaaaaccuuuguagaacuuaugcguagaggugaccuaccaguguggcuagcacauaaaguagcaucugaaggaauaaaauacacagaccgaaagugguguuucgaugggcaaaggaauaaccaaauucuugaggaaaauauggacguagagauuuggacaaaagaaggagaaaagaagaaauuaaggcccagauggcuagaugcaagaacuuauucugauccacuggcuuuaaaagaauuuaaagauuucgccgcaggcagaaaaaguauagcccuagaccugguuacggaaauuggccgcguccccagccaccuagcucaccgaacaaggaacgcauuagauaaucuaguuaugcuucauacaagugaacacggcgggcgggcauacaggcaugcuguugaggaacuaccagaaacaauggaaacccuacuacucuuagguuuaaugaucuuauugacagguggugcuauguuguuccuaauuuccgggaaagggauugguaaaacgucaauagguuuaauuugcgugaucgcaaguucaggaauguuauggauggcggaugugccauuacaauggauugccagugcaauuguauuagaguucuuuaugauggucuuguuaauuccggaacccgaaaaacaacguacaccgcaggauaaucaacuugcuuacgucguuaucggaauacuaacuuuagcugcaauaauugcagcgaacgaaaugggacuacuagagacgaccaagagagaccuagguaugagcaaagagccgggcguaguaagcccuacaaguuauuuggauguugacuuacauccggcuucagcauggacuuuauaugcuguagcaacuacaguaauuacaccuauguuacgacauacuauagaaaacucaaccgcgaacguauccuuagcggcaauagcaaaccaagcuguugucuugaugggucuagauaaaggguggccuauaaguaagauggaucucggagugccauugcucgcacuagguuguuauucucaagugaauccguugacacugacagcugcaguauuacuccuaauaacgcacuaugcaauaaucggaccaggucugcaagcuaaagccacucgagaagcccagaagcgaacugcagcggguauaaugaaaaacccaacgguagauggcauaaugacaauugaccucgacccugugauuuacgauucuaaauucgaaaaacaacugggacaagucaugcuauuaguguuaugugcaguccaacucuuauuaaugagaaccucaugggcauuaugcgaagcacucacauuagcaaccgguccuauaacaacuuuaugggaaggaucaccagggaaauucuggaacacgacgauugcaguguccauggcaaacauauuucgcggaucauaccuagcaggagcugguuuagcguuuaguauaaugaaaagugucgguacaggaaagcgugguacggggucgcaaggagagacauuaggggagaaauggaaaaagaaguuaaaucaacuaucacguaaggaguucgauuuauacaaaaagagcgggaucacagaggucgacagaacagaggcuaaagaggggcuaaagagaggugaaacaacccaccaugccguaucucgagggagugcaaaacuccaaugguuuguagaaaggaauaugguuauacccgaagguagagucaucgacuugggauguggaagagggggauggaguuauuauugcgccggauugaagaaaguaacugaaguucgggguuauacaaaagggggucccggacaugaagaaccuguaccgaugucaacuuacggcuggaacauaguaaaauugaugagcgggaaagacguauucuaucucccucccgagaaaugugacacccugcuuugugauauuggugagucgaguccgucaccaacaguugaggaaaguagaacaauacgaguacugaaaaugguagaaccguggcuaaagaauaaucaauuuuguauaaaagucuuaaauccguacaugccuacaguaauagagcaccucgaaagacuccaacgaaaacauggugguaugcuugugaggaaccccuuaucgagaaauucaacacaugaaauguauuggauuaguaauggcaccggaaauauagucucaaguguaaauauggucagcagguuauuauuaaacagauucacgaugacacaucgacguccaacgauugagagagacgucgaccuaggcgccgguacuaggcauguaaaugcagagccugagauuccgaauauggauguaauaggcgaacguauaaagaggauaaaagaagaacauaacucgaccuggcauuaugacgaugaaaacccuuauaaaacgugggcuuaucacgguuccuacgagguuaaagcgacggguagugcuuccuccaugauaaauggugucguaaaguuauuaacaaaaccaugggauguugugccaaugguuacacaaauggcuaugaccgacacgaccccauuuggacaacaacgaguuuucaaagagaaagucgauacacguacccccagaccuaugccaggaacaagaaaggucauggaaauuacggcagaauggcuguggcgaacguugggaagaaacaagcguccaagacugugcacaagggaagaauuuacgaagaaaguucgcaccaaugcugcgaugggcgcuguguuuacagaagaaaaccagugggacagcgcaaaagcugcuguagaagaugaagaauuuuggaaauuagucgauagagaaagagaacuacacaaacuagguaagugugguucaugugucuacaauaugaugggaaaacgagagaagaaacugggagaguucggaaaagcgaagggcucacgugcaauuugguauauguggcuuggcgcaagauaucuagaauuugaagcguuaggcuuuuuaaaugaagaucauugguuuucaagagagaacuccuauucuggcgucgaaggagaaggacuucauaagcuaggcuauauccuacgcgacauaucaaaaauucccgguggugccauguaugcagacgauaccgcgggcugggauacaaggauuaccgaggacgauuuacauaacgaagagaaaauuacucaacaaauggaccccgaacacagacaacuagccaacgcaauauucaaauugacauaucaaaauaaggucgugaaaguccaaaggcccacccccacgggaacgguaauggauaucauuuccagaaaagaucaaagggguucgggucaagucggcaccuauggcuuaaauaccuuuacaaauauggaagcucaguuaguucgucagauggaaggugaagggguucucucuaaagcugauuuagaaaauccacacuuauuggagaagaaaauaacacagugguuggagacaaagggaguagagcguuugaaaagaauggcgauaucuggagaugacugugugguuaaaccaaucgacgauagauucgcuaaugcacugcuggcucucaacgauauggguaagguucgcaaagauauaccacaauggcaaccaucaaaaggauggcacgauuggcaacaaguccccuucuguucgcaucacuuucacgaauugauuaugaaagauggccggaaauuaguagucccgugccgcccacaagaugaacuaauagguagagcuaggauaagccaaggggcaggguggucucuacgggagaccgccugccuaggaaaagccuaugcgcaaauguggagucugauguauuuucauagaagagaucugagacuugcgaguaacgcgauauguagcgcaguaccuguacauugggucccaacuucaagaacuacaugguccauacacgcucaucaccaguggaugacgaccgaagauauguuaacugucuggaauaggguauggauugaagacaacccauggauggaggacaaaacgccagugacuaccugggaaaaugucccauaucuaggaaaacgggaagaucaauggugugguucucuaauaggcuuaaccaguagagcuacuugggcucaaaauaucccuacagcaauacaacaaguuagaucacuuaucggaaaugaagaauuuuuggacuauaugcccaguaugaaacgcuuucgaaaagaagaagaaagugagggggcuauaugguag

SEQ ID NO: 23158 - RNA, 9873 nt, Artificial Sequence
  derived and/or modified CDS sequence (opt6) from DENV-3__FJ882573__SS-prME
acgucacuuugccuaaugaugauauuaccagcugcacuugcauuucaucuuacaucaagggauggugaaccacgcaugauaguuggcaaaaaugaaaggggaaaaaguuuacuauuuaaaaccgcgucagggauaaauauguguacauuaauagcaauggacuugggugaaaugugcgaugacacagucacguacaaauguccacauauaacagaaguagaaccggaggauauagacugcugguguaaucuaacaaguacaugggugacuuauggcacguguaaucaagcaggagagcauagacgggauaaaaggaguguugcauuagcaccucauguaggaaugggucuagacacaaggacacaaaccuggaugucggcugagggagcguggaggcaagucgaaaaaguugaaaccugggcacuuagacacccaggcuucacaauauuagcauuauuucuugcgcauuacauaggaacuucucucacacaaaaaguuguuauuuuuaucuuauugauguuaguuacaccaaguaugacaaugcgauguguggggguuggaaaccgggauuuuguugaaggauuaucuggagcaacauggguugaugucgugcuugaacauggcggcuguguuacaacuauggccaaaaacaaaccaacucuagauauugagcuccagaaaacugaagcaacucaauuggcaacguugagaaaacuaugcauagaaggaaaaaucacaaauauaacaacagauucucgaugccccacucaaggugaagcuguacucccagaagaacaagaucaaaauuacguuugcaaacauacuuauguugauagaggaugggggaaugguuguggccuuuuuggaaaggguucucuaguaacaugcgccaaauuucaaugucuugaaccuauugaagguaaagugguacaguacgagaaccucaaauacacggucauuauaacugugcauacaggagaucaacaccaaguaggaaaugaaacacaaggaguuacggccgagaucacaccccaggcuuccacaacagaagccauacuacccgaauauggaacucugggacuggaauguucuccucggacaggauuagacuuuaacgagaugauacuauuaacaaugaaaaauaaagcauggaugguucauaggcaaugguucuuugauuuacccuuaccuugggcaucuggggcaacaacugagacuccaacauggaacaggaaagaacuguuaguuacauuuaaaaaugcacaugcuaagaaacaagaaguaguuguauuagguagucaggaaggggccaugcauacggcgcucacgggagcgaccgagauacaaaauucuggaggcacgucaaucuucgcgggccaucugaagugcagacucaaaauggacaaauuagaauuaaaagguaugagcuaugcaauguguaccaauacauuugugcugaagaaggaaguuagcgaaacacagcauggcacaauauuaauuaaagucgaguauaaaggagaagaugcaccauguaaaauacccuucaguacggaagacggacaagggaaagcacauaacgguagauuaauaacggcuaauccgguaguaaccaagaaagaggaaccggugaauauugaagcagaaccuccauuuggugagaguaauauagugauaggcauuggggacaacgccuuaaaaauaaauugguauaagaaaggcaguuccauuggcaaaauguucgaagcuacagcgaggggugccagaagaauggcuauuuuaggagacacugcaugggacuuuggaucggucggaggaguuuuaaauucacuggggaaaaugguacaucaaaucuuuggaucagccuacaccgcauuguucaguggcgucucguggguuaugaaaaucggcauaggagugcuacugacguggauuggacuaaacucuaaaaacacaccuaugucauuuaguuguauugcaauuggaauaauaacucuauacuugggagccguuguucaggcagacauggguugugucauuaacuggaaagguaaagaauugaaaugcgggucagguauuuucguaacaaaugaggugcauacuuggacagaacaguauaaauuccaagccgacuccccaaaaagauuagcuacagcuaucgcuggagcaugggaaaaugguguuugcgggauaagaagcacaacucgaauggaaaaccuauuguggaagcaaaucgcaaaugaacuaaacuacauucugugggaaaauaacauaaaacucaccguaguagugggagauacaacuggaguacuagaacaaggaaaacguacacuaacgccucaaccaauggagcuuaaguauaguuggaaaacuuggggaaaagcuaaaauaguaaccgcugagacccaaaauucuucauucauuaucgauggacccaauacuccggaaugcccuagcgccucaagagcuuggaacguuugggaagucgaagacuacggguucggaguguucacaacuaacaucugguuaaaacuucgagaaguuuauacucaauugugcgaccauagauuaaugucugccgcuguuaaggacgaaagagccguccacgccgauaugggcuacuggauagaaucacagaaaaauggaaguuggaaacuggaaaaagccucgcuaaucgaaguuaagaccugcacguggcccaagucucacacccuuuggagcaaugggguacuagaaagcgauaugaucauaccgaaaagccuggcugguccuaucagucagcauaauuauagacccggcuaucauacucagacugcuggucccuggcaccuagguaaguuagaguuagauuucaauuauugcgaaggcacaacggugguaauaacagagaauugcggaacccggggacccucguuaaggacaacaaccguaucgggcaaauugauccacgaaugguguuguagguccuguacucucccaccauugcgguauaugggagaagaugguugcugguacggcauggaaauacggcccauaucugaaaaagaagaaaauauggugaaaucauuggugucggccgguaguggaaaaguagauaauuucacuaugggaguccucugucuugcgauacuguuugaagaagucaugagaggcaaauuugguaagaagcacaugaucgcaggaguauucuuuacauuuguucuacuuuuaagcggacaaauaacguggagagauauggcgcauacauuaaucaugauaggaucuaaugcgucggaucguauggguaugggaguaacguaucucgcccucauagcaaccuucaaaauacagcccuucuuagcccuuggauucuuucucagaaaacuaacgucucgggaaaaccuucuacuagguguaggauuagcaauggcaacuacucuacagcugccggaagacauagaacaaauggcgaacggaauagcacuuggccuaauggcguuaaaauuaauaacacaguucgaaacguaucagcuguggacugcauuaguaagccuaacuuguuccaauacaauauuuacacucaccguagccuggagaacagcaacacuaauauuggccggcgugagccuguuaccagugugucaaucaucgagcaugagaaaaacggacugguuaccuaugacgguugcagcaauggggguaccaccccuaccuuuauuuauauuuagccugaaagauacuuuaaagcgacgaucguggccccuaaaugaaggugugauggcuguuggacucguaagcauuuuagccucgagccuccuucgcaaugaugucccgauggcggggcccuuaguggcggguggguuacuuaucgcgugcuauguaaucacagguacaucugccgaucuuacgguagagaaagcagcugaugucacaugggaagaagaagcggaacaaacugggguuagccacaaccuuaugauuaccgucgacgaugauggcacuaugagaauaaaagacgacgagacugaaaacauacuaacuguuuugcuuaaaaccgcguugcucauagucucuggaauauucccauacagcaucccagcgacucucuuaguauggcauacguggcagaaacaaacucagagaaguggaguauuaugggauguacccucaccaccggaaacacaaaaagcugaauuagaggaaggcguauaucgcauaaaacagcaaggcauucuagguaaaacgcaagucggaguuggaguccaaaaagaaggaguauuccauaccauguggcacguaacgagaggagcaguacuuacacacaacgguaaaagacuagaaccuaauugggccaguguuaaaaaggauuuaaucucuuauggaggcgguuggagauuaucggcacaauggcagaaaggagaagaaguacaagucauugcgguugagccuggcaaaaaucccaaaaacuuccaaacaaugccugguacuuuccagaccacgacuggcgaaauaggagcgaucgcucuugauuuuaagccugguacgucaggcucaccuauaauaaauagagaagggaagguugucgggcuauaugggaauggcguaguuacuaaaaacggaggauacguaucugggauagcacaaacaaacgcggaaccagacggaccaacucccgaacuagaagaagagauguuuaagaaaaggaaucucacaauaauggaucuccaccccgggucaggaaaaacucgaaaauaccucccugcgauugugagagaagcgaucaagagaagguuacgaacauuaaucuuggcuccaacgagaguagucgcugcagaaauggaagaagcucuuaaaggauuaccgauuagauaucaaacuacagcaaccaaaucagaacacacuggcagagagauuguagacuugaugugucacgccacuuuuacaaugagauuauugagcccaguacgcguaccaaauuacaaucucaucauaauggaugaagcucauuucacagaccccgcgucuauagcugcgaggggauacauuucaacucgagugggcaugggggaagccgcugcaauauuuaugacagcaacaccaccagguacggcggaugccuucccccaaucaaaugcaccaauacaggaugaagaaagggauauacccgagaggucauggaacucggggaacgaauggauaacggauuuugccggcaaaacuguaugguuugucccgaguauaaaagcagguaacgacauagcaaacugccugcggaagaaugguaagaaaguaauucaauuaucaagaaagacauuugauacagaauaccagaaaacuaaacuaaacgauugggauuuuguugugaccacagacauaagcgaaaugggagcuaauuucaaggccgaccggguuauagacccucgucgaugccucaagccugugauacuaacagaugggccggaacguguuauacuagcaggcccaaugccaguuacagccgcauccgcggcacaacgacgugggcguguaggacguaacccgcaaaaagaaaaugaccaauacauauuuacuggucaaccacugaauaaugacgaagaccaugcacauuggacugaagcuaaaaugcuacucgacaauaucaacacgccugagggaaucauaccagcgcuauucgaacccgaacgugagaaaucugcggcaauagacggugaguauagacuuaaaggcgaaagcagaaaaacuuucguugagcuaaugaggcggggagaucuaccaguuugguuagcccacaagguggcaucagaagggauaaaauauacagaccgaaaaugguguuuugacggacaaagaaauaaucagauauuggaagagaauauggaugucgagauuuggacaaaagagggagaaaagaagaaauuacgaccccgcuggcuagaugcuaggacuuauucagacccccuagcauugaaagaguuuaaagacuuugccgccggaaggaaaucuauagcuuuggaucucguuacagaaauaggaagaguaccuagccacuuggcgcacagaacccggaaugcacucgauaacuuaguaauguugcauacaagugaacacggugggagagcauaucgccacgcgguagaagaguuaccagaaacuauggaaacuuuauuacuucuaggccuuaugauauuacucacuggcggagccauguuauuccuaaucagugggaaagguauagggaagacaagcauaggguuaauuuguguuauugcaucgagcgguaugcucuggauggcugaaguacccuugcaauggauugcuucggcuaucguacuagaauuuuucaugaugguacuacucauacccgaaccggagaaacaaaggacaccucaggauaaucaauuagcuuaugugguaauuggaauacugacauuagcggcaaugauagcagcaaaugaaaugggacuauuagagacaacaaaaagagaucuaggcauguccaaagaaccgggcguugucucaccgacaucauaucuugauguagaucugcauccugcgucagccuggacucuuuaugcagucgcaacaacaguaauaacaccgaugcuucgacauacgauagaaaauagcacagccaauguuagucuugcugcaauugcaaaucaagcuguuguauuaaugggucuggacaaggguuggccaauaucgaaaauggauuuaggaguuccauugcucgcauuaggauguuauagccaaguaaauccucuaacauuaacugcugcaguuuuacuuuuaaucacacauuaugcgaucauuggucccgggcugcaagcaaaagcgacucgagaagcgcaaaaacggaccgcugcugggauuaugaaaaauccgacaguagacggaaucaugacaauugaucucgauccggucaucuacgauaguaaauuugaaaaacagcuuggacagguaauguuacuuguacugugugcaguucaauuauugcuaaugaggacgucuugggcccuaugugaagcacuaacucuagcgacugggccaauaacuacacuuugggaagggucuccaggaaaauuuuggaacacuacaauagcuguaaguauggcaaacaucuuucguggcucauaccuagccggugcgggauuagcauucagcauaaugaaaagcguagguacaggaaaaagggguacaggcucccagggggaaacuuugggugagaaauggaagaagaaacucaaucaacuauccagaaaggaauuugaccuuuacaaaaagagcgggauuacugaaguagacagaacagaagcuaaagaagguuugaagcguggagagaucacccaccaugcagugucucgagggagcgcgaaauuacaaugguuuguagaacgcaauaugguagucccggaagggcgaguaaucgaucuuggauguggacguggggguuggaguuacuacugcgcagggcuaaagaaaguaacugaaguacguggauauacaaaaggagggccaggucaugaagaaccaguucccauguccaccuacggauggaauaucguuaaacucaugucuggaaaagauguuuucuacuuaccuccagaaaaaugugacacacuacuaugugauauaggggaauccaguccuucuccgacaguggaagaaucaagaacaauaagaguacugaagaugguugaaccuugguugaaaaauaaccaauucugcauaaagguccuaaacccuuauaugccaacaguaauugaacaccuagaaagacuacaaagaaagcauggagguauguuggugagaaacccuuuaagcagaaauucaacacacgaaauguauuggauuaguaauggaacgggaaauauaguaaguaguguuaacaugguaagcagauuguuauuaaacagauucacaaugacucaucggagaccuacgauagagaaagacguagacuugggugccgguacacgucacguaaacgccgagcccgaaacucccaacauggacgugauuggcgaacgugugaaacguauuaaggaagaacacaauaguacguggcacuaugacgacgaaaauccauacaaaacaugggcauaucacggcucauacgaaguuaaggcaacaggcagcgcuucuucuaugauuaaugguguugucaaauuacuuacgaaaccuugggauguagucccgaugguuacacagauggcuaugacagauacgacgcccuuugggcaacaacgaguguuuaaagaaaaaguagauacucgaacaccaagaccaaugcccggcacgagaaagguaauggaaauaacggcggaguggcuauggcggacgcugggacgcaauaaaagaccgcgacuauguacuagggaggaauuuaccaaaaagguuaggacaaaugcagcgaugggagcgguauuuacagaagaaaaucagugggauagugcuaaggcugcuguugaggaugaggaauuuuggaaauugguugauagagaaagagaauuacacaaacuuggaaaauguggcaguugcgucuacaauaugauggguaaaagggagaagaaacuaggugaauuuggaaaagcaaaagguucucgagcgauaugguauauguggcugggcgcgagauaccucgaauuugaagcauuaggguuccuaaacgaagaccacugguucucaagagagaauaguuauucagguguagaaggagaaggccuacauaaauugggcuauauacuucgggauaucaguaagauaccugggggagcaauguacgcggaugacacagcugguugggauacaagaauaacugaagaugaccuacauaaugaagagaaaaucauucagcagauggacccggaacauagacaacuagcaaacgcgauauucaaauuaacauaccaaaauaaagucgucaagguccagagacccaccccaacaggcacuguuauggacauuauaucccguaaggaccaaagaggaaguggacaggugggcacauaugggcuuaauacuuuuacuaacauggaggcucaguugguccgucaaauggaaggcgaaggaguacuaaccaaagccgaccuugagaauccucacuuauuagaaaagaaaauuacacaaugguuagaagcaaagggaguggaaagacuuaaaagaauggcgauaucaggagaugacugugucguuaagccuaucgaugaccgauuugcgaaugccuuauuggcucucaaugauauggguaaaguaaggaaagauauuccgcaauggcaaccaaguaaaggauggcaugacuggcaacaagugcccuucuguucacaccacuuucacgaguugauaaugaaagacgguagaaagcugguagucccguguagaccacaggacgaacuuaucggcagggcuagaauuucccaaggagcaggauggucuuuaagagagacagcuugucuaggcaaggcauacgcacagauguggagucugauguauuuucauagacgagaucuuagacuagcaucaaaugcaaucugcucagccguacccguucauugggugccaacguccagaaccacguggaguauacaugcacaccaucaguggaugacaacggaggauauguuaacuguauggaauagaguauggauagaagaaaauccauggauggaagauaaaaccccggucacgacgugggaaaauguaccuuaucuaggcaaaagggaagaccaaugguguggaagucuaauaggucuaacuagcagagcaacaugggcacaaaauauuccaacugcaauccaacagguacggagucugauugggaaugaagaguuucuagauuacaugccuagcaugaagagauuccgaaaggaggaggagucagagggagccaucugguga

SEQ ID NO: 23159 - RNA, 9873 nt, Artificial Sequence
  derived and/or modified CDS sequence (opt6) from DENV-3__FJ898440__SS-prME
acaucauugugccugaugaugauauuaccagcagcacuagcuuuucaccuaacaucucgggauggagaaccuaggaugauuguagguaaaaacgaaagagguaaaucguuacuuuuuaaaaccgcauccgggauuaauaugugcacacugauugcuauggauuugggugaaaugugugacgacacuguaacauacaaauguccacauauaacggaaguugagccagaagauauagauugcugguguaauuuaacuucgaccuggguaacuuauggaacuuguaaccaagcaggagagcauagacgugacaaacgcucuguagcacuggcaccacauguuggcaugggauuggacacccguacacaaacauggaugucugcagaaggugccuggcgacaaguugagaaaguggaaaccugggcucuuagacauccuggcuucacgauuuuggcgcuauuccuugcgcauuauauaggcacaucauugacccaaaaaguaguaauauucauuuuauugaugcuugugacuccaucaaugaccaugagaugugucggcguugggaauagagauuuuguggaaggccugucuggugcuacauggguagauguaguauuggaacacggaggaugcgucacaacuauggccaaaaauaaaccgacacuagacauugaguugcagaaaacagaagcaacacaauuagcaacuuuacgaaaacuaugcauugagggaaaaauaacuaauauuacgacagacucucgcuguccaacacaaggcgaagcagugcugcccgaggaacaagaucaaaauuacguaugcaaacacacguauguagaucguggguggggaaaugguuguggccuuuuuggaaaaggaucgcuaguaacaugcgcuaaauuucaaugucuagaaccaauugaaggaaaagugguucaauaugagaaucuaaaauacacuguuauaauaacaguacacaccggagaccaacaucaaguuggaaaugaaacucaggguguuacagcugaaauaacgccacaagcaucaauaacagaagccauuuugccagaauacgguacgcuagguuuagaauguaguccacgaacuggauuagauuucaaugaaaugguacuacucacaaugaaaaauaaggcuuggaugguacacagacaaugguucuuugaccuuccucugccguggaccaguggggcaacuacugaaacaccgauauggaauagaaaagaacuauuagucacguuuaaaaaugcacacgccaagaaacaagaaguaguuguauugggaagucaagaaggugcuaugcauacagcacuaacuggugccacggaaauacaaaacuccggcgguacaaguauauuugcuggucaucugaaauguagacuaaaaauggacaaacuagaacucaagggaaugagcuaugcuauguguacaaauaccuuuguucucaagaaagaaguaagcgaaacacagcauggcacaaucuuaauuaaagucgaauacaaaggagaagaugcgccguguaaaauacccuucucaacggaagacggccaagguaaagcgcauaacgggagauuaauuacagcaaauccaguagucacgaagaaagaagaaccgguaaauauagaagcagaaccuccuuuuggggaaucgaauauagugauagggauuggugauaacgcuuuaaaaauaaauugguauaaaaagggauccagcauaggaaaaauguucgaagcaacggcuagaggagcaaggcggauggcaauauuaggagacaccgcaugggacuucgggucuguuggcggugugcuuaacucauugggaaagaugguccaccaaauauuuggcagcgcguacacagcacuauuuuccggaguaucuuggguaaugaaaauaggaauaggaguacuucuuacguggauaggauuaaauagcaaaaacacuagcaugucuuuuucuuguauagccauuggaauaauaacucucuauuuaggagcaguuguucaagcggauacuggaugcgucaucaauuggaaaggaaaagaauuaaaauguggaaguggcauauucguuacaaacgaaguacacaccuggacggagcaguacaaguuucaagcugacucaccuaagcgacuagcuacugcuauugcaggagcaugggaaaacggaguuuguggcauaagaucaaccacuaggauggaaaaucuuuuauggaaacaaauagccaacgagcucaauuauauccugugggaaaauaauauaaaauuaaccguaguagugggugauaucaucgggguauuagagcaagguaaaagaacucucacuccacaaccaauggaacuaaaauauucguggaaaacgugggggaaagcgaagauugugacugcagaaacacagaacuccucauuuauaaucgaugguccaaacacccccgaauguccgucagcaucacgggcguggaaugucugggaaguagaagacuauggguuuggagucuuuacgacaaauauauggcuuaaacuaagagagguauauacucaacuaugugaucaucgcuuaaugagcgcagcggugaaagaugaacgagcuguacacgcugacaugggcuauuggauagagagccagaaaaacggaucguggaaauuggaaaaagccucacugauugaggucaaaacauguacauggccaaaaucacauacuuuguggucuaacggaguccuagaaagugacaugauaauccccaaaaguuuagccggaccaaucagucagcauaacuaucgcccugguuaucauacacagacagccggacccuggcauuuaggcaaauuagaguuagacuuuaauuauugugaagggacgacaguagugauaacagaaaacugcggaacuagagggccaucuuuacgaaccacgacgguaaguggcaagcuaauacaugagugguguugucgaucauguacacuacccccacuuagauauaugggugaagaugguugcugguaugggauggagauaagaccaauuucagaaaaggaggaaaauaugguaaaaucauuaguuucagcugguucugguaaaguagacaauuucacuaugggaguccuauguuuagccauucuuuucgaagaaguaaugagagggaaauuuggcaagaaacauaugauugcuggaguauuuuucacauuuguguuguuacuuucagggcaaauaaccuggagggacauggcccacacacucaucaugauaggaaguaaugccagcgaccgaaugggcaugggcgucacauaucuggcacuaaucgcuacuuuuaaaauacagccauucuuagccuuagguuucuucuuaagaaaacuaacgaguagagaaaauuugcuauugggggucggccuggcaauggcaacuacguuacaauuaccagaggacauagaacaaauggcaaacggaaucgcccuuggguuaauggcucuaaaguuaauuacgcaguuugaaacauaucaauuauggacugcacuuaucucauuaacguguucgaauacgaucuuuacacuaacggucgcguggcguacagcuacacucauauuagcggguguaaguuuguuaccaguaugucagagcucaucgaugcguaaaacagacuggcugccaaugacaguagcagcuaugggagugcaaccccugccacucuuuauauucucuuuaaaggacacguuaaaacgacgaucguggccuuugaacgaaggugugauggcggugggauuagugagcauuuuagcauccaguuuauuaagaaaugauguaccaauggcugggccgcuagucgcgggaggccuucuaauagccugcuacguaauaacugggaccucugcugaucuaacagucgagaaagcagcagacguaaccugggaagaagaagcagagcaaacaggggucucucacaacuuaaugauaacuguagaugaugaugguaccaugcguauaaaggacgaugaaacugaaaauauacugacuguauuauuaaagacugcccuacucauagucagcggcauauucccauauucuauuccagcgacgcuuuuaguguggcauaccuggcaaaaacaaacacagcgaucuggugucuuaugggacguaccaagcccuccugaaacacaaaaagcagaguuagaagagggaguauauagaauaaaacaacaaggcauuuuugguaaaacacaagugggaguagguguucagaaagaagguguauuucacacaauguggcauguaacaagaggagccguacugacuuauaacggaaagagacuagaaccaaauugggcgagugucaaaaaggauuugauuagcuaugggggaggauggagacugucagcucaauggcaaaaaggagaagaaguacagguuaucgcaguugaaccuggcaagaauccgaaaaacuuucaaacuaugccaggaacuuuucaaacgacuacuggagaaauuggagcgauagcacuagauuucaaaccaggaaccagcgguagcccuaucauaaacagagaaggcaaaguaguugggcuauaugggaauggaguuguaaccaagaauggaggauaugucagugguauagcucaaacuaaugcagagccugacggaccaacaccggaacuagaggaagaaauguucaagaaaagaaauuuaacaauaauggaucuccacccugggucaggcaagacucgcaaguacuuaccagcuauaguaagagaagcaauuaaaagaagauuaagaacucuaauuuuagcccccacgcgaguaguagcggcagaaauggaggaggcauuaaaaggauuaccgauccgauaucaaacuacagcgacgaagucagaacauacuggccgcgaaauagucgauuuaaugugucacgcgacauucaccaugcgauuacuauccccaguaagaguaccaaauuauaaucucauuaucauggaugaagcccauuucaccgauccagcaagcauugcggcacgaggauacauuuccacccgcgugggcaugggagaagcagcagcuauauucaugacugcaacaccuccgggaacagcagaugcauuuccacaaucaaacgcaccgauacaagaugaggaacgugacauaccagaacgcucuuggaacagcgguaacgaguggauuacggauuuugcugguaaaacaguaugguuuguaccauccauaaaagcagguaaugacauugccaauugccuaaggaaaaauggcaagaaaguaauucaauugucaaggaaaacuuucgauacugaguaucagaaaacaaaacuaaaugauugggauuuuguaguuaccacagacaucucagagaugggcgcaaauuucaaagccgaucguguaauagaucccagacguugucuuaagccugugauuuuaacggacggaccugagcgaguaaucuuagccggaccaaugccgguaacggcagcaagugcagcucaaagaagagggcgaguaggaaggaauccgcaaaaagaaaaugaccaauacaucuucacgggacagccacuaaauaacgaugaggaccaugcucauuggacagaagcuaaaaugcuuuuagacaauauaaacacuccggagggaauuauucccgcgcuauuugaacccgagagagaaaaaucugcugcaaucgauggagaauauagauuaaagggagagucccggaagacuuuuguagagcuaaugagaagaggugaucuaccuguauggcuugcgcauaaaguagcuucagaaggcauuaaauauacugaucgaaaaugguguuucgauggacagcguaauaaccaaauuuuagaagaaaacauggauguagaaauuuggacuaaagaaggggagaagaagaaacuccgcccccgauggcuagaugcuagaacauauucagacccacuagcuuuaaaagaauuuaaagacuucgccgcuggccgaaaaagcauugcucuagaucugguaacagaaauuggacgugugccuagucacuuagcacauagaacgagaaaugcauuagauaaucuagucaugcuacauacuagcgaacacggcgggagagcuuaccgucacgcaguagaagaacuuccugaaacuauggaaacucuguuacuauuagguuugaugauuuuacuaacuggaggagcgauguuauucuuaaucagugguaaaggaauagggaaaacgagcauaggauuaauuuguguaauagccaguagcggcaugcuauggauggccgaaauuccgcuucaauggauugcuagcgcaauuguacuagaguucuuuaugaugguauuguuaauaccggaaccagaaaaacaacguacgccccaagauaaccaguuagcguauguagucauaggaauacuaacauuagcugcaauuauagcagcgaaugaaauggggcuacuagagaccaccaagaaagauuuagggaugaguaaagaacccggugucguaaguccuacaucguauuuagaugucgacuuacacccagcaagcgccuggacccuauaugcaguagccacaaccgugauaacuccaauguugaggcauacaaucgagaacucuaccgcaaacgucagccuggccgcaauugcuaaucaggcuguagugcuuaugggauuagauaaaggauggccaauuucgaaaauggauuuaggugugccucugcuugcucugggauguuacagucaaguaaauccguuaacauugacggcugccgugcuacuccucauuacacauuacgcuaucauaggcccgggacuacaagcuaaggcaacaagagaagcucaaaaacgcaccgccgcugguauuaugaaaaaucccacuguagauggaaucaugacaauagaucuagacccugucauauacgauucaaaguucgaaaaacaguuagggcagguaauguuacucguguuaugcgccguacaguuacuacuaaugaggaccucuugggcauuaugugaagcacuaacucuggcuacagguccgauaacgacuuuaugggaagguucuccuggcaaauuuuggaauacaacaauugccguauccauggcuaauaucuuucgagguucauauuuggcaggagcgggcuuagccuucaguaucaugaaaaguguaggcacuggaaaaagaggcacagggucacagggcgaaacacuaggugaaaaauggaagaagaaauuaaaucaacuaucuagaaaggaauuugaucuauacaagaaauccggaaucacugaaguagaccgaacagaagcaaaagaaggguugaagagaggggagauaacgcaucacgcggugaguagaggaagcgcaaaacugcagugguucguugaacguaacaugguaauaccggaaggcaggguaauugaucugggauguggacgaggaggcuggucauacuauugcgcaggauugaagaagguaacagaaguaagaggguacacuaaaggggguccugggcaugaggaaccggucccgaugaguacguauggcuggaauauuguaaaacugaugucaggaaaagauguguucuacuuaccaccagagaagugugauacacucuugugcgauauaggagaauccucaccuucaccaacuguggaggaaagucguacuauaagaguccucaagauggucgagccauggcucaaaaacaaucaauucugcauaaaaguacuaaacccauacaugccgacagucauugaacaucuugaacgucuucaacgaaagcauggggguauguuaguaaggaaucccuuaagucggaacaguacccacgaaauguauuggauuuccaacgguacaggaaacauuguagcaucaguaaauauggugagccgucuacuacuuaaucgcuuuaccaugacgcacagaagaccaacuauugaaaaagacgucgacuuaggagcugggacacgccacguaaaugcggaaccugaaaccccaaacauggauguaauaggagagagaaucaaacgaauaaaagaagaacauaacuccacuuggcacuacgacgacgaaaauccauacaaaacaugggcauaucauggaaguuacgaaguaaaagccacgggauccgcgaguagcaugauaaacggaguuguuaaguuauuaacuaaaccaugggaugucgucccaaugguaacacagauggcaaugacagacacaaccccguucggccaacagcgcguauuuaaggagaaaguggacacacgaacuccuagaaguaugccgggcacaagacguguuaugggaauaacugccgagugguuauggcguacauugggucggaacaagaaaccacgacuauguacucgugaagaauuuacuaagaaaguuagaacaaaugcagcaaugggagccgucuuuacagaagaaaaccaaugggacucagcuaaggcagcuguugaagaugaggauuuuuggaaacugguggacagagaacgagaguuacauaaacuuggaaagugugguucguguguuuauaacaugaugggaaaacgcgaaaagaaguuaggugaguuugguaaagcuaaaggaagccgcgcaaucugguauaugugguuaggggcuagguaccuagaauuugaggcauuaggguucuuaaaugaagaucacugguuuucucgagaaaacucuuauuccggcguagagggagaaggucuacauaaauuaggauauauuuuacgugacaucagcaagauccccgguggugcaauguacgcugaugacacggccgggugggacacucguauaaccgaagacgauuuacacaaugaggagaaaauuacucaacaaaugaauccagaacaucgacaacuggccaaugccauauuuaaguugacauaccaaaacaaagugguuaaaguccaaaggccaacccccacuggcacagucauggauauuauuaguaggaaggaucaacgaggauccgggcaaguaggaacuuacggacugaauaccuucacgaacauggaagcacaacuaauacgacagauggagggcgaaggcguguuaucgaaagcagauuuggagaacccacaccuuccugagaagaaaaucacucaauggcuugaaacuaaaggcguagaacgcuugaagcgaauggcaauaucgggcgacgauugcguagugaaaccuauagaugaccgauuugcuaaugcacuacuagcacuuaaugacauggggaaagugagaaaagauauuccacaauggcaaccgagcaaagguuggcaugauuggcaacaaguuccauucugcucacaucauuuccaugaauuaauuaugaaagacgguagaaaacuuguuguaccguguagaccacaagaugaacuaauaggacgagcgcggauuucccaaggagccggcuggucucucagggaaacugcuugcuuggguaaggcauacgcacaaauguggagucugauguacuuucaucgaagagauuugagauuagccucaaacgcuauuuguucugccguaccugugcacugggucccaaccucccggacuacuuggucgauacacgcacaccaucaauggaugaccacagaagauauguuaaccguuuggaauaggguguggauagaagauaauccauggauggaagacaaaacgcccgucacaacaugggaaaaugugccuuaccuaggaaaacgagaagaucaauggugcgguucucuuauuggucuaaccucucgggcaaccugggcacaaaacauccccacagcaauacaacaaguacgcaguuuaauaggcaaugaagaguuccuugacuauaugccuucaaugaaacgguuuaggaaggaggaagagucagaaggggcaauaugguag

SEQ ID NO: 23160 - RNA, 9873 nt, Artificial Sequence
  derived and/or modified CDS sequence (opt6) from DENV-3__FJ898441__SS-prME
acgucacugugucuaaugaugauacuuccagcagcucuagcguuccauuuaaccucacgcgacggagagccucgaaugaucguuggcaaaaaugaaagaggaaaaucacuacuguucaaaacagcuucaggaaucaauauguguacauuaauagcgauggacuuaggugaaaugugugaugacacagucacuuauaaaugcccucauauaacagaaguggaacccgaagacauagauugcuggugcaauuuaacaaguacguggguaacguauggaacuugcaaucaagcaggagaacaucgacgugauaaaaggucgguagcucuugcuccacacgugggaauggggcuagacacuaggacacaaacuuggaugagugcagaaggggcuuggagacaagucgaaaaagucgaaacaugggcacuacgccaucccggauuuacuauucucgccuuauucuuagcacauuauauaggaacaaguuuaacacaaaaagucguaaucuuuauacuacuuauguuaguuacuccuucaaugacuaugagguguguaggaguaggaaaccgggauuuugucgaaggguuaagcggagcuacauggguagauguaguauuagaacacggugguugugucacaacuauggcuaaaaacaaaccgacauuggacauagagcuccagaaaacagaagcgacucaacuagcgacacugagaaaauuaugcauagaaggaaaaauaacaaauauuacuacagauucaagaugcccaacacaaggggaagcaguauuacccgaagaacaagaucaaaauuauguauguaaacauacauacgucgacagaggcugggggaaugguuguggauuauucgggaaagguuccuuaguaaccugcgcuaaauuccaaugcuuagagccaaucgaagggaaaaugguucaauaugagaaucucaaauauacggucaucauuaccguacacacuggcgaucaacaccaaguagggaacgaaacucaaggagugacagccgagaucacuccacaagcaucuauuacggaagcaauacuaccugaauauggaacucuaggguuagaauguucuccccgcacaggguuagauuucaaugaaaugauuuuguuaacaaugaaaaauaaagcauggaugguacauagacaaugguucuucgaucuaccauuaccauggacgucaggggcuaccacggaaacacccacauggaaccgaaaagaguuauuaguuacuuuuaaaaaugcacacgccaaaaagcaggaaguuguuguauugggaagucaagaaggagcaaugcauacagcucucacgggugccacggaaauacaaaauaguggagguacaacuauauucgcuggccaccuuaagugucgauuaaaaauggauaaacuugaacuaaagggaauguccuaugcgaugugcaccaacacauuuguauuaaagaaagaagugagcgagacacaacauggcacgauauugauuaaaguagaguacaaaggugaagacgcgccaugcaaaauuccauuuagcacggaagauggucagggaaaggcccauaacggaagauuaaucacagcaaaccccguagucacuaagaaagaagaaccaguaaacauagaagcagaaccgccuuucggagagagcaacauaguuauaggcauuggagauaaugcgcuaaaaauaaauugguauaagaaagggucaagcaucggcaaaauguucgaagccacggccagaggagcuaggagaauggcaauucuaggugauacagcuugggauuuuggcucaguuggaggagugcugaacucuuuagggaagaugguccaucaggucuucgguagugcauauacugcacuauucucaggagucucauggguaaugaaaauaggaauaggaguguuacuuacuuggauuggauuaaacagcaaaaauacaagcauguccuucucuuguauagcuauuggaauaauuacccuuuaucuuggagcagugguccaagcagauacaggaugcguuauaaacuggaaaggaaaggaauuaaaauguggcagugguaucuuugugacuaacgaaguucacacuuggacagaacaguacaaauuccaagcggauagcccaaaacguuuggcgacggcaauugcuggggcaugggaaaacgggguuugugguauacggagcacuacaaggauggaaaauuuacuauggaaacagauugcuaaugaacugaauuauauuuuaugggagaauaacaucaaacuaacuguggucguaggugacaucauugggguacuggaacaagguaaaagaacuuugacaccacaaccgauggaauugaaguacucauggaagacuuggggcaaagcaaagauaguaacagcggagacacaaaacagcaguuuuauuaucgaugguccaaacacucccgaguguccgucagcaucacgggccuggaacguaugggaaguagaagacuacggauuuggaguuuucacuacaaacauuugguugaaacucagagaaguguacacgcaguuaugugaccauagguuaaugagugcagcaguaaaggaugagagagcaguacaugcggacaugggauauuggauagaaucccagaaaaacgggucuuggaaacuagaaaaagcaagucugaucgagguaaagacaugcacguggccaaaaucgcauacucuauggucaaacggcguccuggagagcgauaugauuaucccaaagucacuagcaggaccaauuagucaacacaacuauaggccuggauaucacacucagacagcagguccguggcauuuagguaaacuagaauuagacuuuaauuacugcgaggguacaacagucgucauuaccgaaaauugugggaccagaggcccaucuuugagaacgacgacuguuuccgggaaacucauccaugaauggugcugucguaguugcacauuaccuccuuuaagguacaugggcgaagacggcugcugguaugguauggaaauacgaccgauaucggaaaaggaagagaauauggugaagagucucgugagugcagguagcggaaaaguggacaauuucacaaugggcguccuuugucuagcaauauuguucgaagaagucaugcgcggcaaauuugguaagaaacacaugauaguaggaguauucuuuacguucguacuacucuugucaggccaaauaacuuggcgcgacauggcucauacauuaauaaugauuggcuccaaugcaagugaucgaaugggaaugggaguuacauauuuagcauuaaucgccacguucaaaauacagccauucuuagcacuugguuucuuccuucguaaauugacaucucgggagaaccuacuuuugggcguugguuuggcaauggcaacuacccuucaacuaccagcggauaucgagcaaauggcaaauggcauagcguuaggauuaauggcuuuaaaacucauaacacaauucgaaacauaccaauuauggacagcccuuauuagccuaacauguaguaacacaauauuuacacugacuguugccuggagaacugcuacacuaauacuagcgggcguaucacuacuuccagucugccagaguaguaguaugcguaaaacagacuggcuccccaugaccguugcagccaugggcgugcaaccucugccuuuauuuauuuucucauugaaagacacacuaaagcgacgaaguuggccuuuaaaugagggagucauggcugugggccuaguaaguauucuugcauccagucuacuuagaaaugacguuccgauggcuggaccauuaguggcgggcggacuccuaaucgcguguuauguuaucaccgguacaucagccgacuuaacaguugaaaaagcagcagauguaacaugggaagaagaagcagagcaaacaggaguaucacauaacuuaaugauaacaguugacgaugaugggacaaugaggauaaaagacgaugaaacagaaaauauauuaacugucuuacuaaaaacagcacuauugaucguguccggcauuuuccccuacucaauacccgcuacacuauuagucuggcacacauggcagaaacaaacacaaaggagugguguauugugggaugucccaucgcccccggaaacacaaaaagcggaauuggaagaagggguuuauaggauaaaacaacaagggauauuuggaaaaacacaaguaggaguuggcguacagaaagaggggguuuuucauacuauguggcauguaaccagaggagccguauuaaccuauaacggcaaacgccuagaacccaacugggccagcguuaaaaaggauuuaaucagcuauggaggaggcuggcguuuaagcgcacaauggcaaaagggugaggagguacagguaauagcgguggaaccuggcaaaaacccuaaaaacuuucaaacgaugcccggaacuuuccaaacgacuacaggugagauaggagcaauugcauuggauuuuaagccgggaaccaguggaagcccuauaauaaaucgggaaggaaagguaguuggucuauaugggaacggcguagucaccaaaaaugggggauauguuucagggauugcacaaaccaacgcagaaccggacggcccuacaccggagcuagaagaagagauguuuaagaagagaaaccugacgauuauggaucuacacccaggaaguggaaaaacaagaaaauaucuaccugcgauuguucgcgaggcuaucaagcggagauuacgcacgcuuauauuagcaccuacgcgcgucguugcagcggagauggaagaagcacuuaaaggacuaccgauuagguaucaaaccacagcaacgaagucggaacacacaggacgcgaaauagucgauuuaaugugucacgcaacauuuacaaugagacuauuaucgccuguaagaguuccuaauuauaauuuaauaaucauggaugaagcgcauuuuacggauccggcaucaaucgcagcacgaggauacauaucaacgagagucggaaugggagaagcggcggcuauauuuaugacugccacacccccagguacugcugaugcuuuuccacaaucaaaugccccgauacaagaugaagaacgagauauaccggaaagaucguggaacucuggaaacgaguggauuacagauuuugcuggcaagaccguaugguuuguuccaucuauuaaagccgggaaugacaucgcgaauuguuuaaggaaaaaugguaagaaaguaauccaauuaucaagaaaaacuuuugacacagaauaucagaaaaccaaauuaaaugauugggauuucguaguaaccacagacaucucggaaaugggugcuaauuucaaagccgauagaguuauugaucccagaagaugucuaaaaccagucaucuuaacugacggcccagaacgcgucauacuugcugguccuaugccuguaacggcagcgagugcagcacagcgucguggaaggguaggacgaaacccacaaaaagaaaacgaucaguauaucuucacuggccaaccacuaaauaaugacgaggaccaugcacauuggacggaagcaaaaaugcuccucgacaauaucaacacaccagaagguauaauucccgcauuauucgaaccagagcgagagaaaagugcugcuauugauggggaauaccgacuaaagggugaauccagaaagacuuuugucgaauuaaugaggcgcggagaucuaccuguauggcuagcgcauaaaguagcuucagagggaauaaaauauacagaucgcaaauggugcuucgauggacaacgaaauaaccaaauacuagaagagaauauggacguagagaucuggacaaaagagggcgagaaaaagaaacugcggccucguuggcuagacgcucgaacauauagcgacccguuggcacuaaaagaauuuaaagauuuugcugcaggacgaaaauccaucgcauuggauuuggucacugagaucggaagaguacccagucaucuggcucaucgcacacguaacgcucuggacaaucucgugaugcuccacacuucugagcaugguggccgugcauaucgucacgcuguagaagaacuaccagagacuauggaaacccuuuuguuacuagguuugaugauacuuuuaacagggggcgccaugcuguuucuaauuucagggaaaggaauuggcaaaacaaguauaggccucaucuguguuauagcaaguagugguaugcuauggauggcagaaaucccccuccaauggauagcuucugcgaucguucucgaguucuuuaugaugguuuuacuaauaccggaaccagaaaaacaacgaaccccacaagacaaucaacucgccuaugucguaauaggcauauugaccuuagcagccauaauagcggcgaaugaaauggguuuguuggagaccacuaagaaagacuuagggaugucuaaagaaccggguguagucucgaguacgagcuaucuugauguugaucuacaucccgccucagcuuggacguuauaugcggucgcuacuacugucauaacacccaugcuacgccauacaauagaaaacagcaccgccaacgugucacuagcagcgauugccaaccaagcggugguacuaaugggacuugauaaagguuggccuauuucaaaaauggaccuuggggucccccugcuugcauuaggcugcuauucacaaguaaaucccuuaacacugacggcagcuguccuacucuuaauuacccauuaugcaauuauuggcccuggauuacaggccaaagccacgagggaagcacagaaaagaacagcugccggaaucaugaaaaauccaacaguagacgguauaaugaccauugaccuagauccaguaauauaugauagcaaauuugagaaacaauuaggacaaguaauguuacugguuuuaugcgcaguacaauuacucuuaaugcgaacauccugggcacuaugugaggcccuaacucuagccacugguccgauuaccacacuaugggaagggucucccggcaaauuuuggaacacuacaauagcuguaaguauggcuaauauuuuucgugguucuuaucuagccggggcgggucuggcauuuucuaucaugaaaagugugggcacuggaaaaagaggaaccgguucccaaggcgaaacucugggcgaaaaauggaagaagaaacuaaaucaauuaucgcgaaaagaauuugauuuauacaaaaagucaggaauuaccgaaguugaucgaacagaggccaaagaaggacuuaaaagaggggaaauaacacaccaugccguaagcagagguagcgcaaaauuacaaugguucgucgagaggaauauggucaucccagaaggacgcguaauagauuuagguuguggccgcgguggguggucuuacuacugugcgggucuaaagaaagugacagaaguccgaggauacacuaaaggaggaccaggacacgaagaaccgguuccuaugaguacuuaugguuggaauauugugaaguuaaugacugggaaagacgucuuuuauuuacccccggaaaaaugcgacacccuacuuugcgauauuggagaaucaucaccgucaccuacgguugaggaaucucgaacgauuagaguuuuaaaaaugguugagccuuggcucaaaaacaaucaauucuguauaaaaguucucaacccauacaugcccacaguuauagaacacuuagagcgguuacagaggaaacaugggggaaugcucguacgcaacccguuaucacgcaacucaacucaugaaauguauuggauaucaaauggcacaggaaacaucguugcaucaguuaauaugguaucacgccugcuauuaaauagguucacaaugacgcauagaagaccaacgaucgaacgagacguagaccuaggagcaggaaccagacauguaaacgcugaaccagaaacucccaauauggacguuauaggugaacguauaaaaagaauaaaagaggaacauaacaguacauggcauuacgaugaugaaaaucccuacaaaacgugggcauaccacgguucauacgaaguaaaagccacugguuccgcuagcucaaugauuaauggagugguuaaacuucuuacuaagcccugggacgugguaccgaugguaacacaaauggcgaugaccgauacuaccccauuuggucagcaaagaguauucaaggaaaaaguagacacaaggacuccgagaaguaugccuggcacccgaaagguaaugggaauuaccgcugaguggcucuggaggacucuaggaaggaauaagaaacccagguugugcacccgagaagaauuuacuaagaaagugagaacaaaugcugcgaugggggcagucuuuacagaagagaaccagugggauucggcuaaagccgcugucgaggacgaggacuuuuggaaauugguugaccgugaacgagaacuucauaagcuagguaaauguggauccugcguguacaacaugauggggaagagagagaagaaacuaggagaauuuggaaaggcuaaaggaagccgugcuauuugguauaugugguugggugcgagguauuuagaguuugaagcacuaggauuccuaaaugaagaucacugguucucuagagaaaauucuuauucaggaguggaaggugaaggauugcacaaauuaggauacauauuaagagauauaaguacaaucccggguggagcgauguacgcugaugauacagcgggcugggauacucggauaacagaagaugaucuacacaaugaagagaagauuacucagcaaauggacccugaacacagacaacuugccaacgcuauauucaaacucaccuaucagaauaaaguagucaaaguccaacguccaacuccaacggguacuguuauggacauaaucucacguaaagaucaacgugguaguggacaggugggaacauauggccuuaauacauucacaaauauggaagcacaacugauucggcagauggaaggugagggagucuugucaaaagcugaccuagaaaauccacaucuacccgagaagaaaauaacccaauggcuugaaacuaaaggugucgaacgucuaaaaaggauggcaaucucuggugaugacugcgucguaaaacccauagaugaucguuuugcgaaugcgcuauuagccuuaaaugacaugggcaaaguaaggaaggauauaccacaguggcaaccuucuaaaggauggcacgauuggcaacaaguaccuuucugcucccaucacuuucacgaauugauuaugaaagauggaagaaaauugguggucccaugccguccucaagaugagcucauaggaagggccagaauuagccaaggagcuggcuggaguuuacgugagacggcuugcuugggaaaggcuuaugcacagauguggucccuaauguauuuccacagacgagauuuacgauuggccucgaaugcgauauguucggcgguaccggugcauuggguacccacaaguagaacuacauggaguauacacgcacaucaucaguggaugaccacugaagauaugcuaacuguuuggaacagaguauggaucgaagauaacccuuggauggaagauaaaacccccguuaccacuugggaaaaugugcccuacuuagguaaaagagaagaucaaugguguggaaguuuaauuggauuaaccucuagagcuacgugggcccaaaacauaccgacugccauucaacaaguccgaaguuuaauagguaaugaagaauuucuagauuauaugcccagcaugaaacgguuuagaaaagaggaagaaucugaaggggccauaugguaa

SEQ ID NO: 23161 - RNA, 9873 nt, Artificial Sequence
  derived and/or modified CDS sequence (opt6) from DENV-3__FJ898442__SS-prME
acaucccuuugcuuaaugaugauuuuaccagcggcacuggcauuccacuuaacaagucgcgauggggaaccacgcaugauuguugguaaaaaugaaaggggaaaaaguuuauuauucaaaacagcgucuggaauaaauauguguacauuaauagcuauggauuuaggagaaaugugugacgauacaguaacauauaaaugcccacauauaacagaaguagaaccagaagauauagacugcuggugcaacuuaacaucaacuuggguaacauacggaaccuguaaucaagccggugaacaccgacgggauaaaagaucaguagcacucgcuccucauguuggaauggguuuggacacacguacacaaacuuggaugucugcagaaggagcauggcgacaagucgaaaaaguagaaacaugggcacuucgucauccaggauucacaaucuuagcauuauuuuuagcgcacuauaucggaacuucgcuuacccaaaaagucgucauauuuauucuacucauguuggucacgccaagcaugaccaugagaugcguagggguuggaaaccgcgauuucgucgaaggacuuucaggugcuacguggguugauguuguacucgaacauggaggauguguaacaaccauggccaaaaauaaaccgacgcucgacaucgaauuacagaaaacagaagccacccaacuggcuacacugagaaaacuaugcaucgagggcaaaaucacaaacauaacaacagauaguagguguccuacacaaggagaagcaguucuuccugaagaacaagaccaaaauuauguuuguaaacacacguauguagacagaggauggggcaauggaugcggcuuguuuggcaaagggagucuggucacgugcgcaaaauuccaaugccuagaaccuauagaagggaaaaugguacaauaugaaaacuugaaauauaccgucauaauaacuguccauaccggagaucagcaucaaguugggaacgaaacacaagggguuacagcggagauaacaccucaagcaaguauuacagaagcaauccucccagaauacgguaccuuaggauuagaauguucaccgagaacaggacuagauuuuaaugagaugaucuuauugacaaugaaaaacaaggcuuggaugguacaccggcaaugguuuuucgacuuacccuuacccuggaccaguggagcuacgacugaaaccccuacguggaaucggaaagaacuuuuagugacuuucaaaaaugcacaugccaagaaacaagaagucgugguacuuggcucccaggaaggggcuaugcacacggcucugacaggugcaacugaaauacaaaauucuggugggaccacaauauuugcuggacacuuaaaaugucgacuaaaaauggauaaacuggaacuuaaaggaauguccuacgcaaugugcaccaacacguuuguacuuaagaaagaaguuagcgaaacucaacacggaaccaucuuaauaaaagucgaauacaaaggggaagaugccccuuguaaaauuccauuuagcacggaagaugggcaaggaaaagcccauaauggaagguuaaucaccgccaacccggucguuacaaagaaagaggaaccuguaaauaucgaagcggagccgccauuuggagagucuaauauagucauugguaucggagauaacgcuuugaaaauaaacugguauaagaaagguucaaguauaggaaaaauguucgaagcuacagcaagaggggcacgccgaauggcaauacuaggugauacagcaugggacuucggcucuguaggugguguacuaaacagccuaggaaaaaugguacaucaagucuuugggagcgccuacacggcgcuuuucucaggcgugucuugggucaugaaaauagggaucggcguacuauugaccuggauaggguuaaacucuaaaaauacaucuaugaguuuuucguguauugcgauaggaauaaucaccuuguaccuaggagcaguugugcaagcggauacuggcuguguaauaaacuggaaagguaaagagcugaaaugugggucugggauauucgucacaaaugaaguacauacuuggacagaacaauauaaauuucaggccgauucacccaaaaggcuagcaaccgcuauugcuggcgcuugggaaaacgguguuuguggaauaaggagcacuacaagaauggaaaaucuacuauggaaacagauagcgaaugaguuaaacuacauacugugggagaacaauauaaaauuaacuguaguaguuggcgacauaauaggaguucuugaacaaggaaagaggacccucacuccacaaccaauggaacuaaaauauucauggaaaacaugggguaaagcaaaaauuguuacugcggaaacacaaaacuccaguuucaucauagacggacccaacaccccagagugcccuagugcaagcagagcguggaaugucugggaaguagaggauuauggauucggaguuuuuacaacaaauauauggcuaaaauuaagagaaguauacacccaacuuugugaucacaggcuuaugucugcugcaguuaaagacgaacgggcuguacacgcggauaugggcuauuggauagaaucccagaaaaaugggaguuggaaauuggaaaaggcuucacuuauagaaguaaaaaccuguacauggccaaaaagucauacacuauggucaaauggcguucuugagucagacaugaucauuccaagaucguuagcaggacccauaagucaacauaauuacagaccaggauaucauacucaaacugcugguccauggcaucuugguaaguuggaauuagacuucaauuauugugaggguacaacgguugugauaacagaaaacugugguacacgcgguccuucucuccguacaacaacagugaguggaaaacugauacacgaaugguguugccgauccuguacuuuaccaccucuucgauacaugggagaagaugguuguugguauggcauggagauaagaccaauuagugaaaaggaagagaacaugguaaaaagucugguaagugccgggucagggaaaguagacaauuucacuauggguguacuuugucuggcaauacuguuugaagaaguaaugagaggaaaguucggcaagaaacacaugauagcgggaguauucuuuacguuuguguuacuauugaguggucaaauuaccuggagagacauggcgcauaccuuaauuaugauagguucaaaugcuagugaucgaauggggauggguguaacuuaucuagcgcugauugcaacuuucaaaauccagccguuucuagcauuaggauuuuuccuaagaaaacugacuucacgagaaaaucuauuauugggaguuggccuggcaauggccacuacacugcaacuucccgcagacaucgagcagauggcaaacggcauagcacuugggcuaauggcauuaaaguuaauuacacaauucgaaacauaucaauuguggaccgcauuaauaagucuaacauguagcaacacaauauuuacuuuaacuguggccuggagaaccgcaacuuuaauauuagccggcgucagucuucuaccagucugucaaagcucgucuaugcguaaaacugauuggcuuccaaugacaguugcugcuaugggagugcagccucuaccccuguucauuuucaguuugaaagauacauuaaaaaggagaucuuggcccuuaaaugaagguguaauggcuguugguuugguuaguauccuagcaaguucuuuacugcgcaacgauguacccauggccgguccucuaguagcaggagguuuacucauugcaugcuacguaauaacgggaacaucagccgaucucacaguggagaaggcagcagauguaaccugggaggaggaagcagaacagacgggaguaucccacaaccucaugauaacuguggacgaugacgguacaaugaggauuaaagacgaugaaaccgaaaacauacuaacgguauugcuuaaaaccgccuuacucauugucucaggaauuuuucccuauaguauccccgcaacacuacucguauggcacaccuggcaaaaacaaacucaaaggucgggcguucucugggauguuccuucgccgccagaaacacaaaaagcugagcuugaagaaggaguguaccguauuaaacaacaagguauauuuggcaaaacacaggucggagucggagugcagaaagaagggguauuucacacuauguggcaugugacaagaggggcuguguuaaccuauaauggaaaacgucucgaaccaaauugggcaaguguaaagaaagauuuaauuucauaugguggaggauggagauugucugcacaauggcagaaaggcgaagagguacaaguuauagcgguugaaccaggcaaaaaucccaaaaauuuucaaacuaugccgggcacauuucaaaccaccacaggugagauaggagcaauagcacucgacuucaagcccggaaccagugguaguccaauuauaaauagagaaggaaaggugguaggacuauacggaaauggcguagugacuaagaauggugguuacguaucggguauagcacagaccaaugcugaaccugaugguccgacacccgaauuagaagaagaaauguuuaagaaaagaaacuuaacaauaauggaccuucacccagguucaggaaaaacaagaaaauacuuaccagcaaucguacgcgaggcgauaaagagacgccuuagaacccuuauauuagcuccuacacgaguagucgcagcggaaauggaagaagcccuuaaaggucuucccauaagauaucaaacuacagcgacuaaaucugaacauaccggucgugaaauugucgacuuaaugugucaugcgacauucacaaugaggcuacugucgccgguacgcguuccaaauuauaaucuaauuauuauggacgaagcacauuucacugauccugcaucaauagcggcgagagguuauauuaguacaagaguuggaaugggggaagcggcagcaauuuuuaugacagcaacaccgccaggaacagccgaugcauucccgcaaagcaaugcuccaauucaagaugaagaacgugauaucccagaacgaucguggaacucaggaaaugaguggauuacagauuucgcagggaagacaguuugguucguaccgaguauuaaagccgguaacgacauugcaaacugccuaaggaaaaaugguaagaaaguaauucaauugucaaggaagacuuuugauacugaguaucagaaaacaaagcuaaaugauugggacuuugucguuacgacggauauuagcgagaugggagcaaauuucaaggcggaccgcgucauugauccaagaagaugccuaaaaccagucauauuaaccgaugggccugaaagagucauacuugcgggcccuaugcccguaacagcagccagugccgcacaaaggcgaggacguguagguagaaacccacaaaaagagaaugaucaguacauauuuacaggacaaccgcuaaauaaugacgaagaucaugcgcauuggacggaggcgaaaaugcuccuagauaacaucaauacaccggaaggcauaauacccgcauuguuugaaccagaacgggagaaaagugcagcaauugauggagaguauagguugaaaggugagucacggaaaacauucguugaacuaaugcgucgaggugaucuaccaguaugguuggcacauaaaguugcaagugaaggcauaaaauauaccgacaggaaauggugcuuugauggacagagaaacaaucaaauauuggaggaaaauauggacguagaaaucuggacaaaggaaggagagaagaagaaacuucggccucgauggcucgaugcucgaacauacagugauccgcucgcauuaaaggaguuuaaagauuuugcugcgggcagaaaaagcauagcccuugauuuaguaacagagauugguagagugccuucacaucuagcacauagaacacggaaugcccuagacaauuugguaaugcugcacacguccgagcauggagggagagccuacagacacgcaguagaggaauugccagagacaauggagacccugcuacuuuugggcuuaaugauccuacuaacuggaggcgccauguuauuccuaauuagcggaaaaggcauugguaaaacgaguaucggucugauaugcgucaucgcgucaucaggcaugcuuuggauggcugagauuccacuucaauggauagcguccgcuauaguacuggaguuuuucaugaugguucuauuaaucccagaaccagaaaaacagagaacuccacaagacaaccaauuggcauauguaguaauugggauuuuaacucuagcagcaaucauagcagcuaacgaaaugggccuucuagaaacuacaaagaaagauuuaggaaugucaaaagaacccgguguuguaucuuccacaaguuauuuagauguagacuugcauccugccucggcauggacucuuuaugcgguugcaacaacagugauuacaccuaugcuucggcauacgaucgaaaauucgaccgccaauguaaguuuagcagcaauagcgaaucaagcggucguacucauggguuuagacaaaggguggccaauuucuaaaauggaucuggguguuccuuuguuggcgcuagguuguuauucacagguaaauccucuaacccuaacagccgcaguacuguuguuaauuacgcauuacgcaaucauaggaccuggacugcaagcuaaagcuacuagagaagcccagaagcgaaccgcagcagggauuaugaagaaccccacuguagauggcauuaugaccaucgacuuagauccuguuaucuacgacagcaaauucgaaaaacaacucgggcagguaauguuauuaguauuaugugcgguacaacucuugcuaaugagaaccucaugggccuuaugcgaagcacuaacccuggcaaccggacccauaacuacucuuugggaaggaucucccgguaaauuuuggaauacuacaaucgcaguuucuauggcuaacauauuccgaggauccuacuuggcaggagcaggacuagcauuuagcauaaugaagucuguagggacagguaagcguggaaccggcucccaaggugaaacauuaggugagaaguggaagaagaaacugaaccaauugucccgaaaggaauuugaucucuacaaaaagagugguaucacugaaguggauagaacagaggcaaaagagggguugaaaagaggggaaauuacacaucaugcggucucucguggaagugcaaaguugcagugguuuguagagcgaaauauggucauuccagaagggcgagucauagaucucggaugcggacgaggaggcuggaguuauuacugugcaggauuaaagaaaguaaccgaagugaggggauauacaaaaggugggccaggacacgaagaaccagugccgaugucuacauacggauggaauauaguaaaacuaaugacggguaaagauguauucuauuuaccuccagaaaaaugugauaccuuacuuugcgacauuggagaauccucucccuccccaacaguagaggagagucguacaauccgugugcuaaaaaugguggaaccgugguugaaaaacaaucaguucugcauaaaaguuuugaacccuuacaugccuacuguaauagagcaucucgaacgauuacaacgaaaacacggcgggauguuaguccgaaauccuuuauccagaaauucaacacaugagauguacuggaucagcaaugguacugguaauauaguugcaaguguaaacauggucucgagguuauugcuaaauagauucacaaugacccauagacgaccaacuauagaaagagacguugacuugggagccggaacacggcaugucaaugcugaacccgagaccccaaauauggacguuauuggagaaagaauaaagaggauuaaggaggagcacaauaguacguggcacuacgacgaugagaauccauauaaaacaugggccuaccacggaucuuacgaagugaaagcgacaggauccgcuucauccaugauaaacgguguuguuaaacucuugaccaaacccugggauguagucccaauggugacucagauggcuaugacagacacaacaccauuuggacaacaaagaguuuuuaaagaaaaaguggacacaaggaccccaagaucaaugccuggaacaagaaaaguuauggguaucaccgcagaguggcuauggcgaacacuaggucgaaacaaaaagccccgacuuugcaccagagaagaguucaccaagaaaguacguacuaacgcagcaaugggagcaguauucacagaagagaaccagugggauagugcaaaagcugcgguagaagaugaagaguucuggaaacugguagacagagaaagagaauuacauaaauugggaaaguguggaagcuguguuuauaauaugaugggcaaacgagagaagaaacuuggagaauuuggaaaagcaaaaggcucaagggcuauaugguacauguggcuuggugcccgguacuuggaauuugaagcauuaggguuucucaaugaagaucauugguucaguagagaaaauuccuauagcgguguagaaggugaaggcuuacauaaauuagguuauauacugcgggauauaucaacaauucccgguggagcgauguaugcagacgacacagcgggcugggauacccguauuacggaagacgauuuacacaacgaagagaaaauuacacaacaaauggauccggaacauaggcaacuagcaaaugcaauuuucaaauugaccuaucaaaacaagguaguaaagguucaaaggccuacgccaacuggaacaguuauggauauuauuagcaggaaagaucaaaggggaucgggacaagugggcacauauggauuaaauacauuuacaaauauggaggcgcaacuaauucggcagauggaaggggaggggguauuaaguaaggcggaccuggaaaacccacauuuaccagagaagaaaauuacucaauggcuugaaacaaaagguguggaaagacuaaaaagaauggcaauaucgggcgacgauuguguaguaaagccgaucgaugauagauuugcuaacgcacuccuugccuuaaaugauaugggcaaggugcguaaagauauaccccaauggcaacccuccaaagguuggcaugauuggcaacaaguacccuuuuguagucaucacuuccaugaacucauaaugaaggauggacguaagcuaguaguaccuuguagaccacaagaugaacuaauugguagagccagaauaagccaaggagccggguggucucuucgggaaaccgcuugucugggaaaggcuuacgcgcagauguggucucuaauguauuuucaccggagggauuuacgacucgcuuccaacgcaaucuguucagccguaccuguucacuggguacccacgucucgcacaacuuggucuauacaugcucaucaccaguggaugacaacagaaaacaugcuuacgguauggaaucguguuuggaucgaagauaaucccuggauggaagauaaaacuccaguuaccacgugggagaacgucccuuaucuuggaaaaagagaagaucaauggugcgguucucuuaucggcuuaacaagucgagcgaccugggcacaaaacauaccgaccgcuauacaacaggucaggaguuugauaggaaacgaggaauuucuugacuacaugcccagcaugaaaagauuucguaaggaggaagagagugagggggcaaucugguag

SEQ ID NO: 23162 - RNA, 9873 nt, Artificial Sequence
  derived and/or modified CDS sequence (opt6) from DENV-3__FJ882575__SS-prME
acuucguuaugucucaugaugauacucccagccacauuagcauuucacuugacuagucgagacggagaaccaaggaugauugugggaaaaaacgaacgaggaaaaucccuacuguucaaaacagcauccggaauuaauaugugcacgcuuauagcgauggacuuaggagaaaugugcgacgacacgguaaccuacaagugcccccauauuaccgaaguggaaccagaggacauugauugcugguguaauuuaaccaguacauggguaacguaugguacuuguaaucaagcaggagagcauagaagagacaaaagguccguagcacuugccccucauguaggaaugggcuuagacacgaggacacaaacguggaugagugcagaaggugcuuggagacaaguggaaaagguagaaacaugggcucuuaggcauccaggcuuuacuauacucgcguuguuucuugcucacuauauaggcacaucuuuaacgcagaaaguagugaucuuuauacuccuaaugcuagugacaccuagcaugacgaugaggugugucggcgucgggaaccgggauuuuguagaagggcucuccggagcuacaugggucgauguaguacucgaacauggagguuguguuacuacaauggcaaaaaauaagccaaccuuagauauagaguuacagaaaacagaagccacccaauuagcaacccugcguaaauuauguauagaaggaaaaauaaccaauauaacuacggacaguagaugucccacacagggagaagcaguauugccugaggaacaagaucaaaacuacguguguaaacauacuuacgucgacaggggaugggguaaugguugcggccuauuuggcaaaggcucacuagugacuugugccaaguuucaaugccucgaacccaucgaggggaaagugguucaauaugaaaaccugaaauacacaguaauuauaacaguacauacuggggaccaacaccaagucggaaaugaaacucaggguguaacagcagaaauaacuccgcaagcaagcaccaccgaagcaauccuacccgaguauggaaccuuaggauuagaauguucuccaagaacuggucuagauuucaaugagaugauauuacucacuaugaaaaauaaagcguggaugguacaucgccaaugguuuuucgacuuaccauugccuuggacuagcggcgcgacgacugaaacgccuacuuggaaccguaaggagcuucuuguaacuuuuaaaaacgcacaugccaaaaagcaggaaguaguaguauuggggucacaagaaggagcuaugcauacagcccuuaccggagccaccgaaauucaaaacucugggggaacaucaauauuugcuggacacuuaaaauguaggcucaagauggauaaacuagaauuaaaaggcaugagcuacgcaauguguacaaauacguuuguauugaaaaaggaaguaucagagacacaacaugguaccauacuaauuaaaguggaguacaaaggcgaagacgcuccauguaaaauuccuuucucaacugaggauggccaaggcaaagcacauaauggucgguuaaucacugcgaauccagucgucacaaaaaaggaagaacccgugaauauagaagccgaaccaccguucggggagucuaacaucguaauaggcauaggggacaaugcgcuuaaaauaaauugguauaaaaaaggaucuaguaucgguaaaauguuugaagcaacagcuagaggugcgaggcguauggcaauuuuaggagacacagcuugggauuucggguccguaggaggaauacuaaacucauuagguaaaaugguccaccaaauuuucgggucagcguacaccgcauuauucaguggagugucauggguuaugaaaauagggauaggcgugcugcuuacguggauuggguuaaauucgaagaacaccaguaugaguuuuagcuguauagccauaggaauaauaacgcuauacuugggagccguaguccaagcagauaugggaugugugauaaauuggaaggguaaggaauugaaaugcggaucuggaauauuuguuaccaacgaaguucacacuuggacagaacaauacaaauuccaagcagacaguccaaagcgucuugcuacagcaaucgcaggggcuugggagaaugguguauguggcauaagaagcacaacucguauggagaauuuacuuuggaagcaaauagcuaaugaacuuaauuauaucuuaugggaaaauaauauuaaacuuacuguaguagucggagauaccauugguguccuagagcaaggcaaaagaacacuaacuccacagccaauggaacuaaaauauuccuggaagacuuggggaaaagcuaagaucguuacggcagaaacucaaaacucaaguuucauaauagacggaccaaacacacccgaaugucccagcgcaucaagggccuggaacguaugggaaguggaagacuauggcuucgggguuuuuacgacaaacaucuggcuaaaauugcgagagguuuauacccaauugugcgaucaccgauugaugagugcagccguuaaagaugagagagcaguccacgccgauaugggauacuggauugaaagucaaaaaaauggguccuggaaacuagaaaaagcuucccuaauagaggucaaaacaugcacauggccuaaaagccauacguuauggaguaacgggguacuugaaagugacaugaucauaccuaagucccucgcaggaccuauaagccaacauaacuacagaccagguuaccauacccaaaccgcuggucccuggcauuugggaaaacuagaacuugauuuuaauuacugugaggguacgacgguugugaucaccgagaacuguggaacucgaggaccaucacuacgaacuacgacggugucagguaaacuuauacaugaguggugcugcagaaguuguacgcuuccgccgcuaagauacaugggagaagauggcugcugguacggcauggaaauccguccaauaagugaaaaggaggaaaauaugguuaaaucguugguaucagcaggauccgggaaaguagacaacuucacuauggggguauuauguuuagcgauacucuuugaagagguaaugagaggaaaauucggaaagaagcauaugauagccgguguauucuucacuuucguauuauuacuaucaggacagauuaccuggagggauauggcgcauacacuaauaaugauuggcuccaacgcaagugauagaauggggaugggcguaacuuaccuugcucuaauagcaacuuuuaaaauucaaccauuuuuggcacuuggguucuuuuuacgaaagcuaacaucucgcgaaaauuuauuacuagguguaggacuagcaauggcaacgacuuuacagcuaccagaagauauagaacagauggcuaacggaauagcacuuggauugauggcauuaaaacuuaucacgcaguucgaaacuuaucaauuguggacggcacuaauaagccuaaccugcaguaacacuauuuucacuuuaacuguagcauggcgcacagccaccuuaauauuagcaggaguuaguuuacuuccugugugccaaucaucaucaaugaggaaaacugacugguugcccaugaccguugcagcuauggggguaccgccuuuaccguuauuuauauuuucccugaaagauaccuugaagaggagaaguuggccccugaaugaaggagucauggcaguuggacugguaagcauauuagcgucaucccuauugcgcaacgauguaccgauggcagggccuuuaguagcaggaggauuguuaauagcauguuacgucauuacgggaacuagugcagauuuaacaguagaaaaagcggcugauguuaccugggaagaagaagcagagcaaaccggcguaucgcauaacuuaaugauuacagucgaugacgauggaacuaugaggauuaaagaugacgaaacugaaaacauauuaacaguauuguuaaagacagcacuuuugauaguaaguggaauauucccuuacaguauaccagcaacauuacucguauggcacacuuggcaaaagcaaacccagaggagugggguacuuugggauguaccgucuccaccagaaacacagaaagccgaacuagaagaaggugucuaccgcauaaagcaacaaggaaucuuagggaagacucagguaggaguagguguccaaaaagaagggguuuuucauacaauguggcauguaacacgaggugcggucuuaacgcacaacggcaaaagguuggaaccaaacugggcgagcguuaaaaaggaucuaauuuccuauggagguggcuggcgcuuauccgcucaauggcagaaaggugaggaggugcaggugauugcaguggaaccuggaaaaaaucccaaaaacuuucaaacaaugcccgguacguuccaaacaacaacaggugaaauuggagcaauagcccuagauuucaagccagguacuuccggcaguccgauuaucaaucgagaaggcaaaguggucggccuguacgguaacggcguuguaacaaaaaaugggggauacguaagcggaauagcacaaacaaacgcggaaccugaugguccaacuccagagcuugaagaagaaauguuuaaaaaaagaaauuuaacgaucauggauuuacauccuggcucaggaaagacacgaaaauacuuaccagcgauaguuagagaagcgaucaagaggagauuaagaacccuaauucuugcuccuacaagaguaguagcugcggagauggaggaagcuuugaaaggccuuccaaucagauaucaaacuacagcaacuaaaagugaacauacaggacgugaaaucgucgauuuaaugugucaugcaacuuuuacgaugagauuauuaagccccguccgcguacccaacuacaaucuuauaauaauggaugaggcgcacuucaccgauccagcuucaaucgcugcuagggguuacauaaguaccaggguuggaaugggugaggcugcagcgauuuucaugaccgcaacaccacccggaaccgcggaugcuuuuccucaaagcaaugccccgauacaagaugaagaaagggacauaccagagagaucuuggaacagcgguaaugaguggauuacugauuucgcagguaaaacuguaugguucguuccuaguauaaaagcaggaaacgauaucgccaacugucugcgaaaaaacggaaagaaagucauccaacuuucccgaaaaaccuuugacacagaguaucaaaaaacuaaacuaaacgauugggacuucguaguuacuacagauauuuccgaaaugggagcuaauuucaaagcugacagaguaauagauccaagacgauguuugaaaccagugauauugacugauggcccagaaagggugaucuuggcuggcccaaugccuguuacagcugcaagugcggcacagagaagaggaagggugggacgaaauccacaaaaagaaaacgaccaauacauuuuuacaggccaaccccuuaauaaugaugaagaucacgcacauuggacagaagcaaaaauguuguuagauaauauaaauacucccgaagguauuauaccugcuuuauuugaaccagaacgugaaaaaagugcagcgaucgauggagaauacagacugaaaggugaaucaaggaagaccuucgucgaauuaaugcggagaggggacuuaccaguuugguuggcacauaaaguagcauccgaaggcaucaaauauacagacaggaaaugguguuucgauggccagcguaauaaucaaauuuuagaagaaaauauggacguagagauauggacgaaagaaggagaaaaaaaaaaauuaagaccccgcuggcuugacgcccguacauacucggacccccuugcacucaaggaauucaaagacuucgccgcagggcgcaaguccauagcacuggauuugguaacagaaauaggucgaguaccuucacaccuagcgcaccggaccagaaaugcacuugauaaucuaguaauguuacacacaagugagcauggagggcgggcauauagacaugcuguagaggaacugccugagacaauggaaacucuauuauuacucggauuaaugauacucuuaacgggaggagcaauguuguucuuaauuucaggaaaaggaauagggaaaacuucuauaggcuuaaucuguguaauagcaagcucaggcauguuauggauggcugaaauuccucuacaauggaucgcaucagcgaucguauuagaauucuucaugaugguacuauugauuccagaaccugaaaagcaaagaacaccucaggauaaucagcuugcauauguuguaauaggcauccucaccuuggcggccauuauagcugcaaaugagaugggacuccuagagaccacgaagagggacuuaggcaugaguaaagaaccugggguggucuccccuaccaguuacuuagacguagaucuccauccggcgagcgcguggacacucuaugcuguugcgacgacaguaauaaccccuaugcuuagacacacuauagaaaauaguacagcaaacguaucacuagcugcuauugcaaaucaagccguuguucuaaugggccuagauaaagguuggcccauaaguaagauggauuuggggguaccuuuacuggcguuagggugcuauucucaaguaaauccuuuaacauuaacagcugcuguuuuacucuuaauuacgcauuacgcaauaauaggcccaggauuacaagcaaaagcaacgagggaggcucaaaaaaggaccgccgcgggcauaaugaaaaacccaacagucgauggaauuaugacuauagauuuagaucccguuaucuaugauucaaaguuugagaaacaacuaggacaagucaugcugcuaguuuugugcgcuguccaauuguuacuuaugcgaacaucaugggcacuuugugaagcacuaacauuggcuacagggccaauuacgacucucugggagggaaguccuggaaaauucuggaauacaacaauugcgguaucaauggcuaacauuuuuagaggaucauacuuggcgggagcaggguuagcuuucucgauuaugaaaucgguagguacugguaaaaggggaacugggucacagggagaaacguuaggcgaaaaguggaaaaaaaaguugaaucaguuaaguagaaaggaguuugaucuuuauaagaaaucaggcaucacggaaguagauagaacagaagcaaaggaaggacugaaaagaggugaaauaacccaucacgccguuuccagagggucggcgaagcuacaaugguuuguagaaagaaacaugguuauccccgaaggaagagugauagauuuagguugcggacgagguggguggucuuauuauugugcggggcuaaagaaggucacagaaguaagagguuauacaaagggaggccccggacacgaagagcccguccccaugagcacauacgguuggaauauuguaaaauugaugucaggaaaagauguauuuuacuuaccuccagaaaagugugacacacuacuaugugacauaggagaguccagcccaucaccaacgguggaggagucgagaacgaucagaguacuaaaaaugguagaacccuggcucaaaaacaaucaguucuguauuaaaguucugaauccauacaugccgacggugaucgagcauuuagaacgccuacaacguaagcauggggguaugcucguuagaaauccacuauccagaaacagcacucacgaaauguauuggauaaguaauggaacaggaaacauaguaucgucaguuaauaugguaucaagauuauuauuaaauagauuuacgaugacgcacagaagacccaccauugaaaaggacguagauuuaggggcuggcacuagacauguggacgcugaaccagagacgccuaauauggauguaaucggagaaagaaucaaacguaucaaggaggaacauaauucgacguggcacuaugacgacgagaaucccuacaaaaccugggcguaucacggaucauaugaaguuaaagccacagggucagcaucuucgaugaucaauggugugguuaaacuuuugacaaagccuugggaugugguaccaaugguuacgcaaauggcaaugacggauacuacccccuucggacaacaacguguauuuaaggaaaaaguggauacacgaacgccgagaccuaugccggggacaaggaaagugauggguauaaccgcggagugguuauggaggacgcuugggagaaauaaacggccacgguuauguacaagagaggaauuuacuaaaaaagucaggaccaacgcugcgaugggggcuguauucacugaagaaaaucagugggacuccgcgaaagcagccguugaagaugaagaauuuuggaaauugguagacagagagcgcgaacugcauaaauuagguaaauguggaucaugugucuauaacaugaugggaaagcgagagaaaaagcucggggaauucgguaaagccaaagggucacgcgcuauuugguacaugugguuaggcgcuagauauuuggaauuugaagcccuugguuuucucaaugaagaccauugguucagucgagaaaauuccuacagcggggucgagggagaagguuugcauaaguuaggguauauauugagggacauuagcaaaauacccggcggagcuauguaugcugaugacacugcugguugggauacaagaauaacugaagacgauuuacauaacgaagaaaagauaacacaacaaauggauccugagcacagacaauuggccaacgccauuuucaaacuuacguaucaaaauaagguuguuaagguacaaagaccaaccccuacagguacagucauggauauaauuuccaggaaagaucagagagguuccggacaagucggaacauaugggcuaaauaccuucacuaauauggaggcacaacugguuagacagauggaaggagaaggaguacuaucaaaagcggaccuagaaaacccgcaucuuccagaaaagaaaauuacgcaauggcucgaaacaaaggggguggaaagauuaaaaagaauggcaauuaguggcgaugauuguguugugaagccgauagaugauagauucgcuaacgcuuuguuagcacucaacgauaugggcaaaguccguaaggacauuccucaauggcaaccaaguaaagguuggcacgauuggcaacaaguuccuuucuguucacaucauuuucaugagcucaucaugaaagacggcaggaaacuuguaguaccaugucgcccacaagacgaauuaauagggcgagccagaauaucgcaaggagccggauggagcuugcgggagacagccuguuuagggaaagcauacgcucaaauguggagccugauguauuuccacagaagagaucuuagauuagccucaaaugcgaucuguagugcagugccgguccauuggguacccacguccagaaccacauggaguauacacgcccaucaucaauggaugacuacugaggauauguuaacaguauggaauagggucuggaucgaggauaaccccuggauggaagauaaaacaccagugacuacaugggagaauguaccauacuuagggaaaagggaagaccagugguguggcucauuaauaggauuaacuucacgagccacuugggcucaaaacauaccaacagcgauacaacagguuagaagccuaauagggaaugaggaauuccuagacuacaugcccucuaugaaacgauuccgaaaggaggaagagucagagggugccauaugguga

SEQ ID NO: 23163 - RNA, 9873 nt, Artificial Sequence
  derived and/or modified CDS sequence (opt6) from DENV-3__GQ199886__SS-prME
accucucuuugucuaaugaugauccuaccagcagcgcuagcauuucacuugacaucucgagacggcgaaccgagaaugauaguagguaaaaacgaaagggggaaaucacuccuuuuuaaaacggcuaguggaaucaauaugugcaccuugauagcuauggaucuaggugaaaugugcgaugacaccguaacauauaaaugcccacauauaacagaagucgaaccagaagauauagauugcugguguaauuuaacaagcacgugggucacauauggcacguguaaccaagcaggggaacauaggagagauaaacggagcguagcacuagcaccucacguuggaauggguuuggacacacgcacccaaacguggaugagugcagaaggggcauggcggcaaguagaaaaaguagaaacaugggcauugagacauccuggauuuacuauuuuggcuuuauuuuuagcgcacuauauuggaacaucacuaacgcaaaaaguagucauuuuuauacuuuuaaugcucgugacgccaaguaugacuaugagaugugugggaguagggaacagagacuuuguagaaggccuaucaggugcaaccuggguggacguuguguuagaacauggaggcugcguuacaacaauggcuaaaaauaaaccaacacucgacauagaacuacagaaaaccgaagcuacgcaauuagcaacgcucagaaaauuaugcauagaaggaaaaauuacgaacauuacaaccgauucgcgauguccuacgcagggagaagccgugcucccagaagaacaagaccaaaauuaugucuguaaacauacauacgucgauagagguuggggaaaugggugcggauuauuugguaaagggucccuaguuaccugugcaaaauuucaauguuuagaaccuauugaagguaaagugguacaauacgaaaaucuaaaauacacgguuauaauuacgguucauaccggugaucaacaucaaguaggaaaugaaacucaaggaguaacggcagaaaucacaccacaagcaagcacuacggaagcaauacuaccggaauauggcacacuuggacucgaaugcagcccccguacaggucuggauuuuaaugaaaugauauuacuuacaaugaaaaacaaagcauggaugguucauaggcaaugguuuuucgacuuaccuuugccuuggaccucuggagccaccacagagacccccacauggaaucgaaaagaauuguugguuacauucaaaaacgcacaugccaagaaacaggaaguaguuguccuggguagccaagaaggagcaaugcauacggcacugaccggagcaacagaaauucaaaacaguggugggacuucaauauuugcuggacacuuaaaaugcagauuaaaaauggauaaauuagaacuuaaaggaaugucuuaugcuauguguacaaauacauuugucuuaaagaaagaagugucagaaacacaacacggaacaauauuaauaaaagucgaauauaaaggugaagauguacccugcaaaauaccguuuucuacggaagacggucaaggaaaagcucacaauggacgauuaauuacggcaaauccgguugugaccaagaaagaagaacccgugaauauagaggccgagccaccuuucggcgagaguaacauugucauuggcauaggcgauaaugcuuugaaaauuaacugguacaagaaaggaucuuccauuggcaaaauguuugaggcuacagcccguggcgcucgaagaauggcuauauugggugacaccgcaugggauuuuggaucaguaggaggcguacucaacuccuugggaaaaaugguacaucaaauauucgguucagcguacaccgcauuauuuuccggaguaaguuggguaaugaaaauaggcauaggagucuuacuuaccuggaugggucuaaacagcaaaaacacaucgaugagcuuuucguguauagccauuggaauaauaaccuuauaucucggcgcaguaguccaagcagauauggguuguguuauaaacuggaaaggaaaagaacuuaaauguggcucgggaauuuuuguaacaaaugaaguacacacauggacagaacaauacaaauuucaagcagacucaccaaaacguuuagcuacggccauugcuggugcuugggaaaauggaguaugcgguauacguaguacaacaagaauggaaaaucucuuauggaaacaaauagcaaacgaauuaaacuacauacugugggaaaauaacauuaaauuaacaguaguugucggcgauacaaucggcguguuagaacagggaaaaagaacauugacuccccaaccaauggaacuaaaguacucguggaaaacaugggggaaggcgaagauagucacagcugaaacacaaaacuccagcuucauaauagacggacccaacacaccagaauguccuagcgcaagcagggcauggaaugugugggagguagaagacuaugguuuuggcguauuuacuacuaacaucuggcugaaauugagggagguauacacgcaacugugugaucauagauuaaugucggccgcagucaaggacgaaagagcagugcaugcagacaugggguauuggauugaaagucagaaaaaugggaguuggaaguuagaaaaggcuucucuaauugagguuaaaacguguacuuggccaaaaagucacacgcucuggagcaauggaguauuggagucggacaugauuauuccaaagagccuugcgggaccaauaagucaacauaacuacagacccgguuaucauacccaaaccgcgggacccuggcauuugggcaaacuggaauuagauuucaauuacugugaaggaaccacagucguaaucaccgaaaacugugguacacgugggcccucuuuacgaacuacuaccguaucaggaaagcugauccacgaaugguguugccgaagcuguacgcuuccuccuuuaagauauaugggcgaagacggauguugguaugguauggaaauaaggccuauaucugaaaaagaagaaaacaugguaaagagcuuaguuucagcuggaucagggaaagucgauaauuucacaaugggcguauuauguuuagcgauauuguucgaagaaguaaugaggggaaaauucgguaagaaacacaugauagcaggaguauucuuuaccuuuguauuacuauugucuggucaaauaacauggagagauauggcucacacauugauuaugaucggauccaacgcuucagaucgaauggggaugggaguuacuuauuuggcguuaaucgcaacuuucaaaauacaaccuuuccuugcgcuagguuucuucuuacgcaaguuaacaucaagagaaaaucucuuauuaggggucggccuggcaauggcaaccacucuacaauuacccgaggacauugaacaaauggcuaacggaauugccuuagguuuaauggcacucaaacuaauaacacaauuugaaacuuaccaacucuggacugcucuaauaucgcuuacauguagcaacacaauauucacgcuaaccguagcuuggagaaccgcgacauuaauauuggcgggcguaucuuuauuaccaguuugccaaaguucuucaaugaggaaaacggauuggcugccaaugacaguagccgcaaugggaguuccgccauuaccacuguucauauuuucacuuaaagauacacuuaagagaaggucauggccauugaaugagggaguuauggcuguaggacuugugucaauucuugcaaguucuuugcuuaggaaugauguacccauggcuggaccucuuguugccggugguuuguuaauagcauguuauguuaucacaggaacuagcgccgauuuaacaguagaaaaagcggcggauguaacgugggaagaagaagcggaacagacggguguaucccauaacuuaaugauuacuguagaugaugaugguacuaugcguaucaaagaugacgaaacggaaaauauacuuacaguacuuuugaaaacugcuuuauuaauuguaucugggauauucccuuacaguauuccagcgacucuccuaguauggcauacuuggcaaaaacagacucaacgaagugguguucuaugggacguaccuuccccacccgaaacucagaaagcugaacuagaggaaggcguuuauaggauuaaacaacagggaaucuucggaaaaacccaggugggugugggaguccagaaggaggggguauuucacacuauguggcacguuacaagaggggcgguucugaccuacaauggaaagcggcuagagcccaacugggcaucgguuaaaaaggauuuaauuucauaugguggcggcuggcgucucucagcgcaauggcaaaaaggggaagagguccaaguaaucgccgucgaaccugguaaaaacccgaaaaauuuccagacaaugcccggaacuuuccaaacuaccacaggugaaauuggggcgaucgcuuuggauuuuaaaccagguacgucagguucgccuauaauuaaccgcgaggggaaaguaguuggacuguacggaaacgguguugugacaaagaacggaggcuacguuagcggcauagcccaaacgaaugcagagccagacgggcccacuccugagcuugaagaagaaauguuuaaaaagcggaaccucacaauaauggaccuacauccaggaucaggaaaaaccaggaaauaucucccagccauaguucgugaagcuauaaaaaggagacuacguacgcuaauccucgcccccacaaggguaguugcugcagaaauggaagaagcacucaagggacugccaauacgcuaucaaacuacagcaacuaaaagugaacauacaggaagggaaauaguugaucucaugugucacgcuaccuucacaaugagacuuuugucaccagucagaguuccuaauuacaauuuaaucauaauggaugaagcacacuuuacagaccccgcaaguauugcugcacgaggauacauuucaacaagaguuggaaugggagaagcagcugccauuuucaugacagcaacaccacccggaacagcugaugccuucccacaaucgaaugcacccauacaagacgaagaaaaagauauccccgaaaggaguuggaacucaggcaacgaauggauuacagauuucgcaggaaaaaccguuugguuugugcccaguauuaaagcagggaacgauaucgcuaacugcuuaagaaagaauggaaagaaaguuauacaacuuucaagaaaaacuuucgacacagaauaucagaaaaccaaauuaaaugauugggacuuuguaguuacaaccgacauuagcgaaaugggagcuaacuucaaagcggacagaguuauugauccacgaagguguuugaaaccaguaauuuuaacugacgguccggagcgcguuauacuagccggaccuaugccaguuacagcggcuucugcugcacaacguagagggcguguaggacggaacccacaaaaagaaaaugaucaguauauuuucacuggacaaccauuaaacaaugaugaggaccaugcucauuggacggaggcaaaaauguuguuggacaacauuaauacaccugaaggcauaauuccugccuuauucgagcccgaacgugaaaaaucagccgccaucgauggagaguaccggcuuaaaggggagagcagaaaaaccuucguagaacuuaugcgcagaggcgauuuaccuguuuggcuggcgcauaaaguagcuucggagggaauaaaauauaccgaucguaaaugguguuucgacggacaacgaaauaaccaaauacucgaagaaaacauggauguagaaaucuggacaaaagaaggugagaagaagaaacuaagacccagauggcuagaugcgagaacauauucugacccucuggcacuaaaagaguucaaagauuuugcggcuggucguaaaaguauugcucucgaucuuguaacagaaauugguagaguaccaagccaucuugcacauagaacucgaaacgccuuagauaauuuagugauguugcacacaucugagcacggugguagagcauauagacacgcuguugaagaacuucccgaaaccauggaaacccuacuuuugcucggguugaugauauuacuaacgggaggagccaugcuuuucuuaauaaguggaaaagggauaggaaaaacuagcauaggauugaucugugucaucgcaaguagcggaauguuauggauggcagaaaucccacuucaauggauagcguccgcaauuguguuagaguucuucaugaugguauuauuaauccccgagccagaaaaacagagaacaccgcaggauaaccaacuagcauauguaguaauaggaauacuaaccuuggcugccauaauugcagcaaaugagaugggacuguuagaaacuacaaaacgcgaucuaggaaugucuaaagaaccuggaguugucucaccaacuagcuauuuagacguagauuuacauccagccagugcauggacuuuauacgcuguagcaacuacaguaauaacccccauguuacgucauacgauagagaauaguaccgcgaaugucucacucgcagcgauugcuaaucaagcggucguauugaugggacucgauaaagguuggccaauuaguaaaauggauuugggagugccuuuguuagcacuuggcugcuacagucaaguaaauccuuuaacucuaacagcugcuguacuauuauugauaacacauuacgcgauuauuggccccgguuugcaagccaaggcaacaagagaagcgcagaaacgaacagcagcaggaaucaugaagaauccuacgguugacggaauuaugacaauagaccuagauccagugauauacgauaguaaauucgaaaaacaacuaggucaaguaaugcugcuuguccuuugugcgguucaacuauuauuaaugcguaccuccugggcacuuugugaggcauuaacauuggcaacagggccuauuacaacucuaugggaaggcucacccggaaaauuuuggaauacuacuauagcgguaucaauggcgaacauauuuagggggucuuauuuggccggugcaggauuggcauuuaguauaaugaaaagugucggaacuggcaaacguggaaccgguagccagggggaaacauuaggugagaaauggaagaagaaacuaaaccaacuaucuagaaaagaguuugauuuauauaagaaaucaggcauaacggaaguagacagaacugaagcuaaagaaggcuuaaagagaggagaaauuacgcaucacgccguauccagagguagcgcaaaauuacaaugguucguagaacgcaauauggugaucccagagggccguguuauagauuuagguugugguaggggagguuggucuuauuacugugccggacuuaagaaaguuacugaaguaagaggcuacacgaaaggcggcccgggucacgaagaaccugucccgaugucgacguauggauggaauauuguaaaacuaaugucagguaaggauguauuuuauuuaccuccagaaaaaugugauacgcuauuaugugauaucggagaaaguucuccgagcccaacuguagaggagagcaggaccauuagaguuuuaaaaaugguagaaccaugguuaaagaauaaucaauuuugcaucaaagucuuaaacccauacaugccgacaguaauugaacaucuggaaagacuacagagaaagcauggaggaaugcucguaagaaacccacuaucaagaaauaguacucacgaaauguacuggauuucgaacggaacuggaaauauagucgccucaguaaacaugguuucuagauuauuacugaaucgguucacgaugacacaccgaaggccuacaauagaaaaagacguagaccuaggagcaggaacgcgucaugucaaugcagagcccgaaacaccuaauauggaugucauuggagaaaggauaaagcguauaaaagaagaacauaauuccacuuggcauuacgaugaugaaaauccauacaaaacgugggcauaucauggaaguuacgagguuaaagcaaccgguucggccagcucgaugauuaacggcguagugaaacuauugacuaaaccgugggauguagugccaaugguaacucaaauggcuaugacggacacuacgccauucggucaacagagaguauucaaagaaaaagucgauacuagaaccccaagaucaaugccagguacaagacgggugaugggcauaacugcugaauggcuguggagaaccuugggcagaaacaagaaaccaagacuguguacacgagaggaguucaccaagaaaguacgcacaaaugcugcgaugggugcggucuuuacggaggagaaucaaugggacucggcaaaagcagcuguugaagacgaggauuucuggaaguuaguagaucgugaacgugaauuacacaaguugggcaaaugugggaguugcguguauaauaugauggggaagcgggagaagaaacuuggggaguuugguaaagccaaggguaguagggcaauaugguauauguggcuuggggcacgguaccuagaguucgaggcccucggauuucugaacgaagaccauugguuuagucgugagaauaguuacucaggugucgaaggagagggauugcauaaauuaggauauauacuucgagacauauccaaaauaccgggaggugcgauguacgccgaugauacagcuggaugggauacacgaauuaccgaagaugacuugcacaaugaagaaaagaucacucaacaaauggaucccgaacaucgucaacuugcaaaugcuauauucaaacugacguaccaaaacaaaguaguaaagguacaaagaccuacuccaacagguacaguaauggauauaauuucgagaaaagaucaaaggggcucgggucaaguaggcacguacggccuaaauacguuuacaaauauggaagcacaacucauccgucaaauggagggagaaggaguguuaucaaaagcagaccuggagaauccccacuuaccggagaagaaaauuacccaauggcuagaaacaaaaggagucgaaagacuuaagagaauggcaauuuccggugaugacuguguagucaagcccauagacgauagguucgcaaaugcgcuauuagcucucaaugauaugggaaaaguccgaaaagauauuccacaauggcagccgucuaaagguuggcaugauuggcaacaaguacccuucugcagccaccauuuucaugaacuuauaaugaaagaugggcgaaagcuaguuguccccuguagaccgcaggacgaacugauuggacgggcaaggauuagccaaggugcagguuggagccuuagggaaacggcuugucucgguaaagcguaugcacagauguggucacucauguauuuucaucguagagaucuacggcucgcaucaaacgcaauuugcagcgcaguaccaguacauugggugccuacaucucgaacuacuuggagcauucaugcacaccaucaauggaugaccacugaagauaugcugacaguguggaaucgcguauggauugaggacaauccuuggauggaggacaaaacuccuguaacaacaugggagaacguaccuuaucuagguaaacgagaagaucaaugguguggauccuuaauuggauuaacuucaagggcgacgugggcccaaaauauacccaccgcgauucagcaaguacgcagucuaauaggaaaugaagaauuucuugacuauaugccaagcaugaaacguuuccgaaaagaggaagagagugaaggcgcgauaugguga

SEQ ID NO: 23164 - RNA, 9873 nt, Artificial Sequence
  derived and/or modified CDS sequence (opt6) from DENV-3__FJ882576__SS-prME
accucacuauguuuaaugaugauccugccagcagcauuagcguuucauuuaacuucucgcgacggagaaccacggaugaucguugguaaaaacgaacgaggaaaaucauuguuauuuaaaacugcaucugguauaaauauguguacgcugaucgcaauggacuugggagaaaugugugacgacacaguaacauacaaauguccacacaucacagaaguagaaccggaggauauugauugcugguguaacuuaacaaguaccuggguaacuuauggaaccuguaaccaagcaggagaacauaggcgcgauaaaaggucuguugcauuagcgccccauguagguaugggacuggauaccaggacacaaacuuggaugucugcagaaggagccuggcgacaaguagaaaaaguagaaacgugggcccuucggcaucccgguuuuacgauccuugcuuuauuuuuagcucacuauauuggcacauccuuaacucagaaagugguaaucuucauauuauugauguuaguuacaccaaguauggcaaugcggugcguugguguaggaaaccgugauuuuguggagggucugucgggugcgacauggguugacguaguacuugaacacggaggcugcguaacgacaauggccaaaaauaaaccuacacuagauauagagcuacagaaaacugaagcuacgcaauuggcaacccuucguaaacuguguauagagggaaaaaucacaaacauaacuacagacuccagaugcccaacucaaggcgaggcuguacuacccgaagaacaagaucaaaauuacguguguaaacacaccuauguugaucgcgggugggguaauggauguggacuuuucgguaaaggaucacucguuacaugugcuaaauuucaaugccuagaaccaaucgaaggaaaagucguacaauacgaaaaccucaaauauaccguaauaauaacagugcauaccggcgaccaacaucaaguaggaaaugagacacaagguguuacugcggaaauuacaccacaagcauccacaacagaagcaauuuuaccagaauacggaacucucggccuugaauguucacccagaaccgguuuagauuucaaugaaaugaucuuacuaaccaugaaaaauaaggcuuggaugguucaucggcagugguucuuugaucuaccacuacccuggacaaguggagcaacaacagaaacaccaaccuggaauagaaaagaacucuuagugacuuucaaaaaugcacaugccaagaaacaagaaguaguaguacuaggaucucaggagggagccaugcauacagcucugacaggugcaacagagauccaaaauagcggagguaccucuauuuucgcgggacacuuaaaauguagacugaaaauggauaaacuggagcuaaaagguaugaguuaugcuauguguaccaauacauucguucuaaagaaagaggucucugaaacccaacaugguaccauccuuauaaaaguagaauauaaaggugaggauguucccuguaaaauaccauuuagcacagaggacggucaggggaaagcucacaacggucgauuaauaacagcuaauccgguugugacuaagaaagaagaaccuguuaauauagaagcagaaccaccguucggagaaaguaauauaguuauaggaauuggugauaacgcauuaaaaaucaauugguacaagaaaggaucuagcauagggaaaauguuugaagcgacagcaaggggagcaagacgcauggcgauacugggcgacacagcuugggauuucggaucuguaggaggaguacuaaauucacuaggaaaaaugguccaucagauuuuuggaucugcguacacggcacuauuuagcggcgucaguuggguuaugaaaauugggauuggagugcuccuuacauggauagggcuaaauagcaaaaacacaaguaugucauuuuccuguauagcuaucggaauaauaacucuuuaccuuggagcggucguccaggcagacaugggcuguguaauuaacuggaaagguaaagaacuuaaaugcggaagugggaucuucguaacgaaugaagugcacacuuggacggaacaauauaaauuccaagcagacuccccgaaaagacuggcaaccgccauagcuggagcaugggaaaauggcguauguggaaucagguccacgacgagaauggaaaauuuauuauggaaacaaaucgcuaaugagcucaacuacauacuaugggaaaauaauauuaaacuaacaguggucguuggggacaucauagggguacucgaacagggaaaaagaacauuaacaccccaaccaauggagcuaaaauauucauggaaaacuugggggaaagccaaaauuguaaccgcagaaacucaaaauaguucuuucaucauagauggccccaauacgccagagugucccucagcuucacgagcauggaacguuugggaaguagaagacuauggcuuuggaguuuuuacgacaaauauaugguuaaaacuucgagaagucuacacacaacugugugaucaucgucuaauguccgccgccgucaaagacgaacgcgcagugcacgcagauaugggauauuggauugaaagccagaaaaauggcucuuggaaacucgaaaaagccagucuaauagagguuaagacuuguacguggcccaagucgcauacauuguggucuaacggcgugcuagaaagcgauaugauaaucccaaaaagucucgcaggaccuauuagucaacacaauuacagaccuggauaucauacccagacggcagggcccuggcaccuaggcaaauuagaauuagauuucaacuauugugaaggaaccacugucguuauaacugagaacugugggacucguggaccaucucuacgaacaacuacaguaucaggcaaacuuauucaugaauggugcugcaggucuuguacacuaccuccgcuacguuacaugggcgaagauggguguugguacggaauggagauaaggccgaucucugaaaaagaagaaaauaugguuaaauccuuggucagcgccgguagugggaaggucgauaacuucacuaugggcguauugugcuuagcaauauuauuugaagaggugaugagaggaaaauuugguaaaaagcauaugaucgcaggaguauucuuuaccuuugucuuacuccuaucaggucaaauuacuuggcgcgauauggcccacacacuaauuaugauagguucuaaugccucagaucgaauggguaugggugugacauacuuagccuuaauugcaacauuuaaaauacaaccguuucucgcacuaggcuucuuuuugcggaaauuaacaaguagagaaaaucuacuuuuaggcguagguuuagcuauggcaacaacucuacaacuaccugaagacauagagcaaauggccaacgguauugcguuaggauuaauggcucugaaguuaauaacgcaauuugaaacguaccaacuguggacagcgcuuauaagucuuacuugcucaaauacaauauuuacuuuaacaguagcauggcggacagccacguugauacuggccggaguuucccuacugcccguaugucaaaguagcucuaugaggaaaacugacugguugccaaugacuguugcugcaauggggguacccccacuaccuuuauuuauauuuagucucaaagauaccuugaaacgaaggagcuggccuuuaaacgaaggugugauggcaguuggacugguaucaaucuuagcuucaucacuauuaagaaaugauguaccaauggcugggccccuagucgcuggugguuuacuuauugccugcuacguuauaacgggaacuagcgcagaucucacuguugaaaaagcagcagacgucacaugggaggaagaggccgaacaaacugguguaucucacaaccuaaugaucacugucgacgacgacgguacaaugagaauaaaagaugacgagacagaaaacauacugaccguauuauuaaaaaccgcgcuucuaauugucagcggaauuuuuccauauagcaucccggcgacuuuguuaguauggcauaccuggcagaaacagacccagagaucgggcgucuuaugggauguccccucaccuccugagacgcaaaaagcugaguuggaagaaggcguguaucggauaaagcaacaagguauuuuuggcaaaacccaaguaggcguugggguacaaaaagaaggagucuuccauacgauguggcauguuacaagaggggcaguacuagcguauaacgguaaacgcuuagaaccaaacugggcaucugucaagaaagaucuaauaagcuauggcggaggauggagauuaagcgcacaauggcagaaaggugaagaggugcagguuaucgcuguagaaccagguaagaacccuaagaauuuucaaacaaugccuggcacguuccaaacaacuacaggggaaauuggugcaauugccuuagauuuuaaacccgguacaucugggucgccaauaauuaaucgcgaaggaaaagugguugguuuguaugggaacggaguaguaacaaagaaugguggauacguaucugguauagcgcagacaaaugcugagccugauggaccaacuccagaacuugaggaagaaauguucaaaaagaggaauuuaacuauuauggaccuccacccugguaguggaaaaacaagaaaauauuugccugccauagugcgagaagccauaaagcguaggcuuagaacacucauucuagcaccaacacgagugguugcagcagaaauggaagaagccuuaaagggucuuccgauucguuaccaaacgacugcgacaaaaucagaacauacgggccgugagauuguagaccuuaugugccacgccacauucacaaugcgucuucucagucccguacgaguaccaaauuacaaucuuauuauaauggaugaagcacacuucacugauccagcgaguauagcagcaagagguuauauuagcacuagaguaggaaugggugaagcagcagcaauauucaugacugcgacuccaccuggcaccgccgacgcauucccucaguccaacgccccaauacaagacgaagaaagggacaucccugaacguaguuggaauagugguaacgaauggauuacugacuucgcugguaaaacaguuugguucguacccaguauaaaagccggcaaugacauagcuaauugccuuaggaaaaacgggaagaaaguaauccaauugagucguaagaccuuugacacugaauaccagaaaacgaaacugaacgacugggacuucguaguaacaacggacaucucugaaaugggggcuaauuuuaaggcugacagggugauagacccaagacgaugcuugaaacccgugauccuaacggacgggccugaaagaguaauccuugcagguccuaugccggugacugcugcuagugcugcccaaagacgaggaagaguaggaagaaauccccaaaaagaaaaugaccaauauauuuuuacugggcaaccccuuaacaaugacgaagaucaugcacacuggacugaggccaaaauguuacuagauaacaucaauacuccagaaggaauuauaccagcauuauuugagccugaaagagagaaaucagcugccauagacggugaauaccgguuaaaaggugaaucccgaaaaacauuuguagaacuaaugagaaggggagacuuaccuguaugguuagcacauaaaguggccuccgaagguauuaaauacacugaucgaaaaugguguuuugauggcgaaagaaauaaucaaauauuggaagaaaauauggacguugaaauuuggacaaaagaaggugagaagaagaaacuaaggccacgaugguuagacgcgagaacauacucggauccccuagcuuugaaagaauuuaaagacuucgcagcaggaagaaaaucuauagcuuuggauuuagucacugaaaucggaagaguuccaucccaccuagcucaccggacuagaaacgcucuagacaaucuaguuaugcuccacacaucugaacacggugguagggcauacagacaugccguagaagaauuacccgaaacuauggaaacgcuucuguugcuaggacuuaugauucuccuaaccgguggugcuaugcuguuucuaauuaguggaaaagguauuggaaaaacaucaauuggauuaauauguguaauugcaaguucggggauguuguggauggcggaaauuccauuacaauggauagcaucagccauaguuuuggaguucuuuaugaugguucuucugauaccagagccugagaaacaacggaccccucaggacaaucaacuagcguauguuguuauugguauauuaacauuagcagcgauaauugcagcaaacgaaaugggacuauuagagacuacaaaacgugacuuagggaugucaaaagagccuggaguagugagcccaaccagcuacuuagauguagaccuccaccccgcgagugcauggacucucuaugcaguggcuacgacggucauuacaccuaugcugagacauacgaucgaaaauucuacggcgaacguuucacuagcugcaaucgcuaaucaagcuguggugcuaaugggccuagacaagggcuggcccauaucaaaaauggauuuagggguaccccuccuugcauuaggaugcuauagccaaguaaacccacuuacucugaccgcagcaguacuacucuugauuacacauuacgcgauaauaggaccaggauuacaagccaaggccacuagagaagcucagaaaagaacagccgcugguauaaugaaaaauccaacuguggacggcauaaugacaauagaccucgauccagucauauacgacuccaaauuugaaaagcaacuaggacaaguaaugcuauuaguacugugcgcugugcaauugcuacuaaugagaacuucuugggcacuaugcgaagcccuaacccuggccacaggcccuauuaccacacuuugggaaggaaguccgggaaaguucuggaauacaacaauagccguuaguauggcaaauauauucagaggauccuacuuagccggagcagggcuagccuuuucuauuaugaaaucagucgguaccgguaaacgagguacagggucgcaaggugaaacuuugggggaaaaauggaagaagaaauugaaucaauugucacguaaggaauuugacuuauacaagaaaucaggaauaacggaagucgacagaacggaagcuaaagagggcuuaaagagaggagagauuacacaucacgcaguuucuagaggcucugcgaagcuacagugguuugucgaacgcaacaugguaaucccagagggacgagucaucgauuuggguugcggacgaggaggauggucauauuacugcgcaggccuaaagaaaguaacagaagucaggggcuauaccaaggguggaccaggacaugaagaaccaguuccaaugaguacguauggcuggaauauaguaaaguugaugaguggaaaggacguauuuuaucuaccaccagagaaaugugauacucuccuuugcgauauaggugaaaguucaccaaguccuacuguagaagagaguagaacaauaagaguacuaaaaaugguugaaccauggcuuaaaaauaaccaguuuugcauaaaaguguugaauccauacaugccuacagucauagaacacuuagaacgacuucaaaggaaacacggaggaauguuggucagaaauccguuaucgcgaaacucaacccacgaaauguauuggauaaguaaugguacgggcaacaucguaagcaguguuaacauggucucacggcuacuacugaaucgauucacaaugacucauagacgaccgacgauagagaaggauguagaucuuggagcagggacacgucauguaaaugcagaaccugaaacgccgaauauggaugugaucggagaaagaauaaaacggauaaaagaggaacauaacucgacauggcauuaugaugaugagaacccauauaaaacuugggcauaucacggaucuuacgaaguaaaagcgacugguucagcuucgaguaugauaaaugggguaguaaaguuauuaacaaaaccaugggacguuguacccaugguuacucaaauggcgaugacugauacgacaccuuucggucagcaacguguauuuaaagaaaaaguggauacacgaacuccaagaaguaugcccgggacacguaggguaauggguaucacugccgaauggcuauggaggacccuggggagaaacaagaaaccaagauuauguacuagagaggaauuuacuaagaaaguaaggacaaacgcugcgaugggagccguuuuuaccgaagaaaaucaaugggacucagcaaaagcugcaguagaagaugaagauuuuuggaaauuaguagacagggaacgggaacuccacaaacuggguaaauguggaucuuguguuuauaauaugaugggaaaacgcgaaaagaaacuuggugaguuugguaaagcuaaaggaagcagagcuaucugguauaugugguuaggggcaagauauuuagaauuugaggcguuagguuuccuaaaugaagaucauugguuuucacgagaaaauucauauucuggagucgaaggagaggguuuacacaagcuggguuauauccuuagggacaucucuaaaauaccaggaggugccauguaugcagaugacacagcaggcugggacacccguauuacagaagaugauuugcacaaugaggagaaaauaacacaacagauggauccagaacacagacaauuggcaaaugcuauauuuaaacuaaccuaucaaaauaaaguagucaagguacaaaggccaacuccuacggggacaguaauggauauaauaucgcggaaggaccaacguggcucgggacaagucggaacguauggauuaaacaccuuuacgaacauggaagcccagcucauucgucagauggagggggaagguguacucucgaaagccgaccuagagaauccgcacuuaccagagaagaaaauuacucaguggcuugaaacaaaagguguugaaagauuaaaacguauggcuauaucaggggacgauuguguaguaaagccuauagacgaucgauuugccaaugcucuauuggcacuaaaugauaugggcaaaguacgaaaagacaucccacaauggcaaccaucuaagggauggcacgacuggcagcaagugccauuuuguucucaccauuuccacgaacuaauaaugaaggacgggagaaaguuaguagugccgugcaggccucaagacgaguugauagggcgagcuaggaucucucaaggugccggguggucuuugagagagacggccugccuugguaaagcguaugcacagauguggucacuaauguacuuccaucgaagagacuuaagguuagcaucgaaugcaauuugcuccgcugucccgguccauuggguuccaacgucacgcacaacauggucaauccaugcacaucaucaauggaugacgacugaagacaugcuaacgguguggaaccgaguauggauagaggauaacccauggauggaagauaaaacgccagucacuacgugggaaaauguaccauaccucgggaaacgagaagaccaauggugcggcagccuuauuggucuuacaucacgagcaaccugggcacaaaacauaccgacugcuauucaacagguccgcucauuaauuggaaacgaagaguuccuugauuauaugccaaguaugaaacgguuuaggaaagaagaagaaagugaaggagcgauaugguaa

SEQ ID NO: 23165 - RNA, 9873 nt, Artificial Sequence
  derived and/or modified CDS sequence (opt6) from DENV-3__FJ850052__SS-prME
accucccuaugccugaugaugauacuaccggcugcacuugcauuucaucucacaaguagagauggugaaccaagaaugauuguuggcaaaaaugaacgaggaaaaucguuacuuuuuaaaacugcuuccggaauaaauaugugcacauuaauagcgauggauuuaggugaaaugugugaugauacaguaaccuauaaauguccacauauuacagaaguggaaccagaagacauugacugcugguguaauuuaacaagcacauggguuacauauggaacauguaaccaagcuggugaacaucggcgugacaaacguucaguugccuuagcuccacacgucgggauggggcuagacacacgaacacaaacauggauguccgcugagggggcuuggaggcaaguugagaaaguagaaacuugggcgcuaaggcacccagguuuuacuauucuugcgcuauuucuggcacauuauauagguacaucgcuuacucaaaaaguaguaaucuuuauccuucuaauguuagucacuccaaguaugaccaugaggugcguugguguaggcaacagagauuuugucgagggauuaucaggagcaacuuggguagacgugguauuagagcauggcgguugcgucacaacgauggcgaaaaauaaaccuacucuggauauagaacugcagaaaacugaggcaacgcaauuagccacucuaagaaaauuguguauagaaggcaaaaucacaaacauuaccacagauucacgcugcccuacccaaggcgaagcaaccuuaccggaagaacaagaccagaacuacguuugcaaacauacauauguagacagggguugggggaauggauguggguuauucgguaaaggaucucuggugaccugugccaaauuccagugcuuggaaccgauagaaggaaaagugguacaauaugagaacuuaaaauauacuguuauaauaaccguacauacaggugaccagcaccaaguugggaaugaaacacaagguguaaccgcagaaaucacaccucaagccucaacuacugaagccauacucccugaauaugggacuuuagguuuagaaugcuccccgcggaccggauuagauuuuaacgaaaugauucuguugaccaugaaaaauaaagcguggaugguccacagacagugguucuuugaucuaccauuacccuggacgucgggugcaacgacggagacaccaacuuggaaccgaaaagaauuauuagucacauuuaaaaacgcacaugccaagaaacaagaaguaguaguucucgguucucaggaaggcgcgaugcauacagccuugacgggggcgacagaaauacaaaauucagggggcacgucaauuuuugcuggccauuuaaaaugccguuuaaaaauggacaaauuagaacuuaaagguaugucuuaugcuauguguacaaacaccuuuguacucaagaaagaaguuucggaaacgcaacacgguaccauuuugauaaaaguagaguauaaaggugaggaugucccuuguaaaauaccguucaguacggaggauggccagggaaaagcgcauaauggacgucuaauaacagccaacccagucgucacgaagaaagaagaaccuguuaauauugaagccgaacccccuuucggcgagucgaauauugugauugguauuggagacaacgcacuuaaaauaaauugguauaagaaaggauccucuauuggcaaaauguuugaagcgacugcaagaggagcccgcagaauggccauacuaggugauacagcuugggauuucgguagugugggagguguauugaacagccuagguaaaaugguucaucaaauauucggaagcgcauauacagcacuuuucaguggcguaaguugggucaugaaaaucgguauagggguacuacucacauggaucggacuuaacucuaaaaacacaagcaugagcuuuaguuguaucgcaauaggaauaauuacacuauauuuaggcgcagugguccaagcggauaugggaugcguaauaaacuggaaaggaaaagaacuaaaaugcggaaguggaaucuuuguuacaaacgagguacauaccuggacagaacaauacaaauuucaggcagacaguccaaaaagacuagcaacggcuaucgcuggggcaugggaaaaugggguaugcggcaucagaaguacaacacguauggagaaucuucuuuggaaacagauagcaaaugaauuaaauuauauauuaugggaaaauaauauaaaacuuacaguagucgugggggauauaauaggcguacuugaacaaggcaaaagaacacucacuccccaaccaauggagcucaaauauuccuggaagacuugggggaaggccaaaauuguaacagcagaaacccaaaauuccucauuuauaaucgacgguccaaacacuccugaguguccgucagucagcagagcuuggaauguaugggaaguagaagacuauggcuuugguguauucacaaccaacauuuggcuaaaacuacgagagguauauacacaacuaugugaccauaggcuuaugucagcggcagugaaagacgagcgagcaguccacgccgauaugggguauuggauagaaucgcagaaaaauggaucauggaaauuagaaaaagcaucuuuaauugaagucaaaacauguaccuggccaaaaagucacacucucuggucuaauggcguacuagaaucugauaugauuauccccaagagcuuagcaggaccaauuucacaacauaaucauaggccaggauaccauacccaaacagcaggucccuggcauuuagggaaacucgaauuggauuuuaauuacugugaggggacaacggugguaaucacugaaaacugugggacacguggcccaagccugcgaacaacuacuguaucgggcaaacuaauacacgaauggugcuguagaucgugcacacuaccaccgcuuagauauaugggggaggacgguugcugguacggaauggaaauuagaccaaucagugagaaagaggaaaauaugguaaagagcuuaguuucugcaggcagcggcaaaguugauaacuuuacaaugggagucuugugucucgccauuuuguucgaagagguaaugagaggcaaauucggcaagaaacacaugauugcugguguauucuuuacauucgucuuauuauuaaguggacaaauuacuuggagggauauggcucauacuuuaauaaugauaggauccaaugcgucggauagaauggggaugggugucacuuaucuagcgcuuauugcaacauuuaaaauucaaccauuuuuagcacugggauucuuuuuaagaaaauuaacuucucgugagaauuuauugcucggugucgguuuggcaauggccacaacauugcaguuaccugaagauauagagcaaauggcaaacggaauagcauugggauugauggcccuuaaauugauaacccaguuugaaaccuaccaacuauggaccgcgcugauuucacuuacuuguuccaauaccauauuuacauuaaccguagcuuggcgaaccgcaacucuuauccuagccggaguaucauugcuacccguaugucaaucaucauccaugcgaaaaacggacuggcuuccaauggcaguagccgcaaugggagucccaccguugccguuauucauauucggccucaaggacacucugaaaaggagaucauggccuuuaaacgaagguguaauggcggucggucuuguuucaauacuagcaagcagucuuuuacggaacgauguaccgauggcuggaccgcugguugcggguggacuacuuauugcuuguuauguaauaacuggaacaucagccgauuuaacuguggagaaagcagccgauauaacgugggaggaagaagcggaacaaacgggcguaagccauaaucuaaugauaacuguggaugacgaugggacaaugcggauaaaggacgaugagacagagaacauacuaaccguauuguuaaaaacugcuuuacuaauuguuucgggaauauuccccuauagcauaccggcaacucuacugguguggcauacguggcaaaaacaaacacaaaggagcgguguauuaugggaugucccaucaccgccggagacgcaaaaggcggaauuagaggaagguguuuauaggauaaagcagcaaggcaucuucgguaagacacaaguuggugucgguguucaaaaagagggaguguuccauacgauguggcacgugacacgaggcgccguacuaacauauaauggaaaaaggcuggagccuaacugggcgagugugaaaaaggauuuaauaaguuaugguggugguuggagauuaagcgcucaauggcaaaaaggugaggaaguacaaguuaucgcgguagaaccggguaagaaccccaaaaauuuccaaacaaugccaggcacuuuucaaacaacaacuggcgaaauuggugcgaucgcacuagauuucaaaccugggaccucagggucgccgauaauaaacagagaagggaaaguagugggauuauaugggaauggagucguaaccaaaaacgggggauauguuucaggaauugcacaaacgaaugcugaacccgauggacccacccccgaacuugaagaagagauguuuaagaaaagaaacuugacaauaauggaucuacaccccgggucugguaaaaccaggaaauauuuaccugcaauaguaagagaggccaucaaacggagacuacgaacgcucauucuagcaccuacaagaguuguggcagcagagauggaagaagcguuaaagggccuaccaauucgcuaucagacuacugcgaccaaaucagaacacacgggucgagaaauugucgacuugaugugucaugcgacauuuaccaugcgauuacuaucgccgguaagaguaccgaauuacaaucuuauaauuauggaugaagcucacuucaccgauccggccucaauugcggcaaggggguacauaucuacacgaguaggaaugggugaagcugcagcuauauuuaugacugcaaccccuccagguacagcagaugcuuuuccacaauccaaugcgccuauccaagacaaagaacgagacauaccugaacggucguggaacuccggaaacgaauggauaacagacuucgcgggaaaaacgguuugguucgugccaaguauuaaagcuggaaacgauaucgcuaauugucuaaggaaaaacgggaagaaagucauacaguuaucacgaaagaccuuugacacugaguaucagaaaaccaaguuaaaugacugggauuuuguagucacgacggacauaucagaaaugggggccaacuuuaaagcagacagagugaucgacccgcgaagguguuugaaaccagugaucuuaacugacggaccagaacgagugauauuggcaggaccaaugccgguuaccgcagcauccgccgcucaaaggagaggccgagugggccgcaacccgcaaaaagaaaaugaccaauacaucuucacggggcagcccuuaaauaaugacgaagaccacgcacacuggaccgaggcaaaaauguugcuagauaacauuaacacuccagaagggaucauaccagcuuuguuugaaccagagcgugagaaaagcgcagcuauagauggagaauauagauuaaaaggugaaucaagaaaaacauucguagaauuaaugcgucggggagauuugccggugugguuagcccacaagguugcuucagaagguauuaaauacacagaucguaaguggugcuucgacggucagcgcaauaaccaaauuuuagaagaaaauauggaugucgaaauuuggacaaaagaaggcgagaagaagaaauuaagaccaagauggcuagaugcuaggacauacagugauccucuagcucugaaagaauuuaaggaauuugcugcggguaggaaauccauagcgcuugaccuugucaccgaaauagguagaguacccucucauuuagcgcacagaacgcgaaacgcauuagacaaucugguaauguugcauaccucugaacauggagguagggcguaucgucacgcaguagaagaauugccggagacgauggagacacuacucuuguugggccuuaugauauuauuaacggguggggcuaugcuauuuuugaucagugguaagggcauuggcaaaacaagcaucggacucauaugcguuauugcgucaagcggaaugcuauggauggcagaaauuccucuccaauggauagcaucggcaaucguuuuggaauuuuucaugaugguacucuugauaccagaaccugaaaaacagagaacaccacaagauaaucaacucgcauacguuguaaucgguaucuugacccuagcagcaauuaucgcugcgaaugagaugggauuauuagaaacgacgaagcgugaucuugggaugagcaaagaaccgggugugguuucaccaacgucauauuuagacguugaccuacaucccgcaagugcauggacauuauaugcaguugcaaccacaguuauaacgccaauguugaggcauacaauagaaaauagcacugcaaacgugagcuuagccgcgauagcuaaucaagccguaguacuaaugggccuggauaaagguuggcccaucucaaaaauggauuuaggagugccccuguuagcguuaggauguuauagucaagucaacccgcuaacucuaacggccgcaguacuccuauuaauuacacauuacgcuaucauaggaccgggguuacaggcaaaagcgacaagggaggcucagaaaagaacagcagcaggaauuaugaagaaucccacaguagaugggauaaugacaauagaucuugauccuguaauuuaugacuccaaauucgagaaacaacucggucaagucauguuauugguauuaugugcaguacaacuuuuguuaaugaggacaucuugggcguuaugcgaggcauugacgcuagcaacaggaccaauuaccacauuaugggaagguagcccugguaaauucuggaacacgacuauagcagugaguauggcaaauauauuccgcgggagcuaucuugccggugcggguuuggcuuucaguaucaugaagaguguaggcacugggaagcgugguacugggucacaaggugaaacucuaggagaaaaauggaaaaagaaacuuaaucaacucagucgaaaagacuuugaccuuuacaagaaaagugguauaacugagguagaucggacagaggcuaaagaaggauugaaacgaggcgaaauuacccaucaugcagucucaagaggcucagccaaacuucaaugguucguagaaagaaauaugguuauccccgaagggagaguuauagaccuagguugcggccgaggagguuggucuuacuauugugcaggacucaagaaggugaccgaaguuagagguuauacaaaaggugggccagggcacgaagaacccguaccuaugucaacguauggcuggaacauagugaaauuaaugaguggaaaagaugucuucuacuuacccccagaaaaaugcgauacucuacuuugcgauaucggagaaagcucuccuagcccaacaguagaagaaucgagaacaauaagaguucucaagaugguggaaccguggcucaaaaacaaccaauuuugcauaaaaguucugaauccauauaugcccaccgucauagagcacuuggaaagacuacagagaaagcauggcggaauguuaguccgaaauccuuuaagucgaaauucaacacacgaaauguacuggauuucaaauggaacuggaaacaucguggccuccgugaacaugguaucaagguuacugcucaaucguuucacaaugacgcaccgccguccaacaauagaaaaggauguagaucugggagcuggaacgcgucauguuaaugccgaaccagaaacuccaaauauggauguaauaggagagagaauaaagcgaaucaaagaagaacauaauaguacauggcacuacgacgacgagaacccauauaaaacaugggccuaccauggaucauaugaaguaaaagcaacagggucagcaaguucaaugauuaacgguguaguaaaacuacuaacuaaaccaugggauguaguuccuaugguaacgcagauggcuaugaccgauaccacaccauuuggacaacaacgaguauuuaaggagaaaguagacaccaggacgccgagaucuaugccaggcacgagaagaguuaugggaaucacugccgaauggcuauggaggacucugggacggaauaagaaaccaagauuauguacacgugaagaauuuacuaagaaagucagaacaaaugcugccaugggagcuguauucacugaggaaaaucaaugggauagcgcaaaggcagcuguugaagaugaggauuucuggaaacuuguagacagagaacgagaguuacacaaacucgggaaauguggaagcugcgucuauaauaugaugggaaaaagggaaaagaaacuuggugaguuuggaaaggccaaagguucacgagcuauaugguauauguggcugggagcgagauaccucgaauuugaagcucucggauuccuaaacgaagaucacugguuuaguagagaaaauagcuacuccggcguagagggugaagguuugcauaaacugggauacauuuuaagagauauaucuaaaauacccgggggcgcuauguaugcggaugauacagccggaugggauacaaggauuacagaggacgaucuccauaacgaggagaaaauuacucagcaaauggauccugagcaucgacaacuugcuaaugcaauauuuaaacuuacuuaucaaaacaagguagucaaggugcaaagaccaacaccgacugggacagucauggacauaauuucuagaaaggaucaacgagguucggggcagguugguacauauggacugaauacauuuacaaauauggaagcucaacuaauucgacaaauggaaggcgaaggugugcuuaguaaagcagaucucgaaaauccucacuugccagagaagaaaaucacucaauggcucgaaacaaaaggaguagagagacuaaagcgaauggcgauauccggagacgacuguguaguuaaacccauugaugacagauuugcuaaugcauuauuagcguuaaacgacauggguaaaguaaggaaagauaucccucaauggcaaccaaguaaggguuggcacgacuggcaacaaguaccauuuugcagucaucauuuucaugaauuaauuaugaaagauggaaggaagcucgucguaccauguagaccccaagaugaacuaauugggagagcaagaauuucccaaggagcuggcuggucacuaaaagagacagcauguuugggaaaagcauaugcgcaaauguggucucugauguacuuucaucgacgagaccuaagacuugcgucuaacgcaaucuguuccgccguaccuguccauuggguuccaacaucccgcacaacuuggucaauccaugcacaucaccaauggaugacaacagaagacauguuaacgguauggaaccgagucuggauugaagacaaucccuggauggaagacaaaacgccaguaacaacaugggaaaauguuccguacuuggggaaacgcgaagaucaauggugcggaaguuuaauugggcugacuagccgugcgacgugggcacagaauauuccuacggcaauacaacaaguacgcagucuaauagguaaugaagaauuucuagauuauaugccuucaaugaagcgcuuucgcaaagaagaagaaagugaaggggcaauuugguaa

SEQ ID NO: 23166 - RNA, 9873 nt, Artificial Sequence
  derived and/or modified CDS sequence (opt6) from DENV-3__FJ873812__SS-prME
acaucuuuaugucuuaugaugauauuaccagcagcgcuugcguuccauuuaacuucaagggauggagaaccucggaugauugucgggaaaaacgaacgcggaaaaucacuuuuauucaaaacagcgaguggaauaaauauguguacuuuaauagcaauggauuuaggagaaaugugcgacgacacaguuacuuauaaaugcccccauauaacugaaguagaacccgaagacauugauuguugguguaauuuaacaucaacauggguaacuuaugggacgugcaaccaagcaggggaacauagaagagauaaaagaaguguugcacuagcaccucauguaggaauggggcuugauacccgaacgcaaacguggaugucagcagaaggagcauggcgacaaguggagaaaguagaaacuugggcacuuagacacccgggauucacuauacuagcauuauuuuuggcgcacuacauagguacuucuuugacacaaaaaguuguaauauuuauuuuacuaaugcuaguaaccccaucaaugacuaugagaugcgugggaguagguaaucgcgacuuuguagaaggguuaucuggagcuacauggguggaugugguauuagaacacggaggauguguaacaaccauggccaaaaacaaaccaacauuagacauugaauugcagaaaacagaagcaacgcaauuagcaaccuuaagaaaauuaugcauugaagguaaaauaacaaacauaacgacagauucucguuguccaacucagggugaggcgacucuaccagaggagcaggaccaaaacuacguuugcaaacacacuuaugucgauagaggcuggggaaauggcugcggacuguuugguaaggguucauuaguuacuugugcuaaauuccaaugccuugaacccauugaggguaaagucguacaauacgagaaccugaaauauacugucauaauuaccguacacacuggcgaucaacaucaagucgggaaugaaacacagggaguuacagcagaaauaacuccacaagccuccacaacggaagcaauacuucccgaauacgggacuuuaggccuggaauguagccccaggacuggucuugauuuuaaugagaugauauuauugacaaugaagaauaaagcauggaugguccaccgacaaugguuuuucgaccuaccacuaccuuggacaaguggagccacaacugaaacgccaacauggaacagaaaagagcuauuaguaaccuuuaaaaaugcacaugcuaagaaacaagaaguuguuguauuaggaucucaagagggugccaugcacacagcauuaacuggugcuacugaaauacaaaacaguggcggaacaucaaucuucgcaggacacuuaaaaugucgacucaaaauggauaaauuagaauugaaaggaauguccuacgcuauguguacaaacacauuuguacuaaagaaagaaguaucagaaacgcaacacggaacaauauugauaaaaguagaauauaaaggagaagauguuccgugcaaaauuccuuuuaguacagaagacggccaaggaaaggcucacaauggacgacuuauuacagcaaauccaguaguaaccaagaaagaagaaccuguaaauauagaggcugaaccgccguuuggggagaguaauaucgugauuggaauuggugauaacgcauuaaaaaucaauugguauaagaaagguagcuccaucggaaaaauguuugaagcaacugcaagaggggcgaggagaauggcuauacugggagauacugccugggauuuuggaagcguaggcggaguacuaaacucucucgggaaaaugguacaccaaauauuugguucagcauauacagcauuguucaguggaguaaguuggguaaugaagauuggcaucggaguacucuuaaccuggauuggauuaaauagcaaaaauaccucuaugaguuuuucuuguauugcgauaggaauaaucacuuuguaucuaggagcggucguucaagccgacaugggauguguuauaaauuggaaagguaaggaauuaaaauguggaaguggaauauuuguaacaaaugaaguucauacauggacggaacaauauaaauuucaagcugauucaccuaagcggcuugcaacugcaauagcuggugcaugggaaaacggaguuugcggcauacguucaacuacccgaauggaaaaucuuuuauggaaacaaauaucaaaugaguugaauuacauauuaugggagaacaacaucaaacuuacaguagucgugggagauauaauaggggugcuugagcagggaaaaaggacucuuacaccucaaccuauggaacuuaaauacuccuggaaaacaugggguaaagcaaaaauugugacugcagaaacccaaaauucauccuucauaauugaugguccuaauacuccagaaugcccuagcgugagucgugcguggaacguuugggaaguugaagacuacggauucggaguauuuacaacgaacaucugguugaaauuaagagaaguauauacccaauugugugaucaucgucuaaugagcgcggccgucaaggaugaaagggcuguacaugcggacauggguuacuggauugaaucacagaaaaacggaucauggaaacuugaaaaagcgagccuuauagagguaaagacuuguacguggccaaaaucacacacgcugugguccaacgggguucuagaaagugacaugauaauaccuaaaagucucgcaggcccaauaagccaacauaaccauagaccugguuaucauacacaaacagcaggacccuggcaccuaggaaaacuugaguuggacuuuaauuauugcgaaggaacuacaguaguuauaaccgagaacuguggcacacgcggcccuucacuacguacaacaacuguguccggaaagcucauucaugaaugguguuguagaucguguaccuugccaccacucagauacaugggagaggaugggugcugguacggaauggaaauucgcccgaucagcgaaaaagaagaaaacaugguaaaaaguuuaguguccgcaggaucaggcaagguagauaauuucacaauggggguacuaugccuagcaauacuauuugaggaagugaugagaggcaaguuuggcaagaaacauaugauugcagggguguucuuaacauucgucuuacuccuaaguggucaaauaacauggagagauauggcccacacuuuaauuaugaucggaucaaaugcuagugacagaaugggaauggggguuaccuauuuagcucuuauugcaaccuuuaaaauucaaccuuuucuagcgcuaggauucuuuuuaagaaaauuaacaagcagagaaaauuuacuacuuggcgugggauuagccauggcuacuacucugcaguuaccagaagacaucgaacaaauggcaaacggcaucgcucuaggguuaauggcgcuaaaauugauaacacaauuugaaaccuaucagcucuggacagcucuuauaagucuuaccuguuccaacaccauuuucacacucacaguagcguggcgaacggccacauuaauacuggcugguguuagcuuguugccaguaugccaaagcucauccaugagaaaaacggacuggcuuccaauggcgguagcugccaugggaguaccaccauuaccauuauucauauucucgcugaaagacacucuuaaacguagaucuuggccgcuuaaugaaggggucauggcaguuggauuaguuaguauuuuggcuagcucauuacuccggaaugauguuccgauggcuggccccuugguugcuggugguuuacuaauugcgugcuauguaaucacuggaacauccgccgacuuaacugucgagaaagcagcagacauaacgugggaagaggaagcagaacagaccgggguaagucacaaccuuaugauaacaguugaugacgacgguacaaugagaaucaaagaugacgaaacugagaacauccuaaccguucuacuuaaaacugccuuguuaauagucucagggaucuucccguacucaauuccagcaacauuguuaguuuggcauaccuggcaaaaacaaacgcaacgaagugguguacugugggacguacccucuccaccugaaacacaaaaagcagaauuagaagaaggaguauacaggauaaaacaacaagguaucuucgguaagacccaaguugggguagggguacaaaaagaaggcgucuuccacacaauguggcauguaacacgaggagcuguguugacguacaacggaaaacgucuagagccaaauugggcgucuguuaagaaagauuuaauuucuuauggugguggcuggcgcuugucagcccaguggcaaaaaggugaagagguacaaguaaucgcugucgaacccggcaaaaacccuaaaaauuuccaaaccaugccuggaacauuccaaaccacaacuggagaaauaggagcuauagcauuagauuuuaaaccgggcacuucaggaucacccaucauaaaucgggaaggaaagguuguuggacuauauggaaacggaguaguaacuaaaaauggggguuacguaucaggaauugcccagaccaaugcagaaccagacgggccgacuccugaauuagaagaggaaauguucaagaaaaggaaccuaacgauuauggacuuacacccagguucuggaaagacccgaaaauaucugccagcgauagucagagaggcuauaaaaagaagauuacggacacuuaucuuagcgccgacgagaguuguugcggcggaaauggaagaagcauuaaaaggguugccaauccguuaucagacgacggcaacuaaaucugagcauaccggaagagagauaguagaccuaaugugucaugcaacauucacuaugcgauuacuuucgccgguacgggucccuaauuauaauuugaucauuauggaugaggcucauuucacggacccagcaagcauugccgcaaggggcuauauaucgacaagaguaggaaugggagaagcggcggcgauuuuuaugacugcaacuccucccgggacugcagaugcauuuccccaaagcaacgcaccaauucaagaugaagaaagggauaucccagaacguucauggaauaguggaaaugaauggauaacggauuucgccgggaagaccgucugguuuguucccaguauaaaagccggaaaugauaucgccaacugccuacgcaaaaacgguaagaaagugauucaauuaagucgcaaaacauuugauaccgaauaccagaaaacgaaauuaaaugauugggauuuuguagucaccacagauauaucagaaaugggugcaaauuucaaagcugaucguguaauagauccgaggcgauguuugaagccagugauuuuaacggauggaccagaaagggugaucuuagcaggaccgaugccugugaccgcagcaucagcugcccaaagaaggggcagaguaggacgcaacccacagaaagagaaugaucaauacauauuuacaggucagccacuaaacaaugaugaagaccaugcgcauuggacagaggcaaaaauguuguuagauaauaucaauacaccagaagggauaauuccugcauuauuugaacccgaaagagaaaaaucggcagcgauagacggugaguacagacucaaaggagagucaagaaaaacauuuguagaacugaugagaagaggcgaucugccaguguggcucgcccauaaaguugcgucagaaggaauaaaauacacagaucguaaaugguguuuugacggccaaaggaauaaccaaauacuggaggagaacauggauguggaaauauggacaaaggagggugagaagaagaaacuuagaccacgcugguuagaugcacgaaccuauagcgauccacuggcacuaaaagaguucaaagaguucgcagcaggaaggaaaucaauugcucuggaucucgugacugaaauuggucgcgugccgucacaccuagcacaucggacgaggaacgcauuagauaaccuagucauguuacacacuucugaacauggagguagggcauaccgacacgcgguagaggaauuaccagagacaauggaaacuuuacuacuucuggguuuaaugauauuauuaacaggaggagcgaugcuguuucuaaucagcggcaaaggaauaggcaagacuuccauuggguugauaugugugauugcaucuagugguaugcuauggauggcagaaauuccucuccaauggauagcaagugcaaucguucuagaguuuuucaugaugguguuauuaauaccugaaccggaaaaacagcgaaccccgcaagauaaccaacuagcuuacguaguuauugggauacuuacauuggccgcuaucauugcagcaaacgaaaugggauuacuggagaccacaaagcgugaucuaggcaugucuaaagaacccgguguaguuaguccaacaagcuaccuugaugucgaccuccauccggcguccgcauggacucuguaugcaguagcaacuacgguuauaacaccgaugcugcgacauacaaucgaaaauucuacugcuaaugucucccuugcggcgaucgcaaaccaagcagucguuuuaauggggcuugauaaaggguggccuauaucuaaaauggaucuagggguaccauugcuagcuuuaggauguuauucccaggucaacccauugacacucaccgcugcaguauuguuacucauaacgcacuaugcuauaauagggccaggucuacaagcaaaagcuacaagagaggcacaaaagcggacagcugcagguauuaugaagaacccgaccguagaugguauaaugacaauugauuuagauccuguaauauacgauucaaaauuugaaaaacaguuagggcaagugauguugcuagucuuaugugcugugcaauuauuauuaaugagaaccaguugggcauuaugcgaggcauuaacauuagcuacaggaccaauaacaacguuaugggagggaucaccagguaaauuuuggaauacaacuauugccguaaguauggcaaauauauuucgcgggucauaucuagccggugcaggccuggccuucucaaucaugaaaucagucgguacagguaaaagaggaacuggaucucaaggagagacacuaggagaaaaauggaagaagaaacugaaucaacuaucaagaaaagacuuugacuuauauaaaaagucgggaauaacggaaguagacagaacugaagcuaaagaaggacuaaaacgaggcgaaauaacgcaccaugcuguguccaggggauccgcgaaacuacaaugguuugucgaacgcaauaugguuauucccgaaggaagaguuaucgacuuaggauguggacgcggagggugguccuacuauugugcaggauugaagaaggucacugagguuagaggauacacaaaaggaggcccugggcacgaagaaccaguaccaaugaguaccuacggguggaacauaguaaaacuuaugagugguaaagacguauuuuauuugccaccagagaaaugugauacauuacucugugauauaggagaaucaucaccaucgcccaccguggaagaaaguaggacaauacggguucuaaaaaugguagaaccaugguugaaaaauaaucaauucugcauuaagguccuaaacccguauaugccaacagugauugaacacuuagaacgauugcagcgaaaacacgguggcaugcugguacgaaacccucuaagcagaaauucaacacacgaaauguauuggauuagcaauggaacgggaaacauuguugcuuccguaaacaugguaucgagauuguuacuuaaccgcuuuacuaugacacaccgaagaccuaccauagaaaaggacguagauuugggugcaggaacgagacacguuaacgcagaaccagagacgcccaacauggacguaauaggcgaaagaauaaaacgcauaaaagaggaacacaauaguacauggcauuacgacgaugaaaauccuuacaagacaugggcuuaucauggaucguaugaagucaaggcuacugguagcgcaucaucaaugaucaauggcguuguuaaguuacuuacuaaaccaugggacguaguaccgaugguaacacaaauggcaaugaccgacacuacgccauuuggucaacaacgcguguuuaaagaaaaaguggacacgagaacaccacgauccaugccagguacaaggaggguaaugggaaucacggccgaguggcuuuggagaacguuaggaaggaauaagaaaccgaggcugugcacaagagaagaguucaccaagaaaguucguaccaaugcugccaugggugcaguuuuuacagaagaaaaucaaugggacucagccaaagcagccguagaagacgaagauuuuuggaaauugguagauagagagagagagcugcacaaacucggaaaaugcggaaguugcgucuauaauaugaugggaaaacgcgagaagaaauugggcgaauuuggaaaagccaaaggaaguagagcaauaugguacaugugguuaggagcacgguauuuggaguuugaagcucuaggguuccuaaacgaagaccauugguucucgagagaaaauucuuacagcggaguugaaggagaaggauuacauaaguuaggguacauauuacgagauaucucgaaaauuccugguggugcgauguacgcugacgacaccgcagggugggauacuagaaucacugaagacgacuuacacaacgaagaaaagauuacucaacaaauggacccggaacauaggcagcuugccaaugcaauauuuaaauuaacguaccaaaacaaagugguaaaaguucaacggccuacaccaaccggaacugugauggacauaauaagccguaaagaucaaagaggauccggccaagucgggacauacggcuuaaacacuuuuacgaauauggaagcccagcucauacgucaaauggagggugaagguguacucaguaaagccgaccuggagaauccacacuuacccgagaagaaaauaacgcaauggcuggaaacaaaaggagucgaaagauugaaaagaauggcaaucaguggagacgauuguguuguuaaaccuauagacgaccgcuuugcuaaugcauuauuagcucuuaaugauaugggcaagguuagaaaagacauaccucaauggcaacccucaaaagguuggcaugacuggcaacaaguuccuuucugcagucaucauuuccaugaacuuauaaugaaagauggaagaaaauuaguaguuccuuguaggccccaggacgaauuaauaggucgcgcacgaauaagucaaggugcuggguggaguuugaaagaaacagcgugcuuagguaaagcauaugcccagaugugguccuuaauguacuuccauagaagggauuugcgacuagccaguaaugcuauaugcucagcaguaccuguucauugggucccaacaagucguacaacuuggucuauacaugcacaccaucaauggaugaccacagaagacaugcuaacgguuuggaauagaguuuggauagaggauaauccuuggauggaagacaaaacuccaguuacaacuugggagaacguaccuuaccuuggaaaacgagaagaucaguggugcgguaguuugauaggacucaccucccgagcuacgugggcgcaaaacauccccacugcuauucaacaagugcgaagccuaauuggaaacgaagaguuuuuagacuacaugccuucaaugaaacgguuucgcaaagaagaggagucugaaggagccauaugguaa

SEQ ID NO: 23167 - RNA, 9873 nt, Artificial Sequence
  derived and/or modified CDS sequence (opt6) from DENV-3__FJ873813__SS-prME
acaucuuuauguuuaaugaugauucugccugcagcuuuggcuuuucauuugacaucccgggauggggaaccgcggaugauaguggggaaaaaugaaagggggaaaaguuuauuauuuaaaacggcaucagggaucaacauguguacgcuuaucgccauggaucuaggugaaaugugugaugauacaguuacuuacaaauguccgcacaucacggaaguugaaccggaagacauagacuguugguguaaccucacaaguacuuggguaacuuauggaacguguaaucaagcuggagaacauaggcgagauaaaagauccgucgcucucgcaccgcauguagguaugggacuugauaccaggacccaaacauggaugagugcagaaggggcguggcgacaaguugagaaaguagaaacaugggcgcugcgucacccaggauuuacaauauuagcacuguuccuagcucauuauauaggaacuucucucacccaaaaaguugugauuuuuauccuacucauguuagugaccccuagcaugacaaugagaugcguaggcguagguaacagagauuucguagaaggccuaucaggagccacauggguggacguuguucuggaacauggaggaugcguuacuacgauggccaaaaacaaaccaacccuagauaucgaauugcagaaaacugaagcaacacaauuagccacauuaagaaaauuguguauagaaggcaaaauuacaaauauuaccacagacucaagauguccaacacaaggcgaagccacauuaccggaagaacaagaucaaaauuauguauguaaacacacuuauguggacagagguugggggaauggguguggucuauuugggaaagggagcuuggugacaugcgcgaaauuucaaugucuugaaccaaucgaagguaaaguagugcaacaugagaaccuaaaauauacaguaauaauuacaguccauaccggagaucaacaucagguugguaaugaaacccaagguguaacugccgaaauuacgccacaggcuucaacgaccgaagcaaucuuaccugaauacggaacauuaggauuagaauguaguccaagaacugguuuagauuucaaugagaugauccuucuaacgaugaaaaauaaggcuuggaugguacaccgacaaugguucuucgaucuccccuuaccuuggacaaguggagcaaccaccgaaaccccaaccuggaaucgcaaagaacuauugguaacauucaaaaacgcacaugcaaagaagcaggaaguugugguauuaggaucacaagaaggugcaaugcacacagcauuaacgggagcuacggagauacaaaauucuggagggaccaguauauucgccggacauuuaaagugucgcuuaaaaauggauaaacucgaacucaaaggcauguccuaugcaaugugcacuaauacauuugugcugaaaaaggagguuagugagacacaacaugguacgauauuaauaaaaguggaauacaagggagaagacguaccaugcaaaauacccuuuaguacagaagaugggcaaggcaaagcacauaacggcaggcucauuacggcuaauccuguagugaccaagaaagaagaaccaguaaauaucgaagcggaaccgccauuuggagaaaguaauauaguaauagggauuggagauaaugccuuaaaaauuaauugguacaagaaaggauccagcauagggaaaauguuugaagcuacagcaagaggugcuaggagaauggccauccuaggggacaccgcuugggauuuuggcucggucggaggcguacuaaauucucugggcaaaaugguacaccaaauauucggauccgcauauacagcguuauuuaguggaguaaguugggugaugaaaaucggcaucggggugcuauugacguggauaggacuaaauuccaaaaacacuuccaugucuuucuccugcauagccauugggauaaucacauuauaucuuggcgcaguuguacaagccgacaugggauguguaauaaacuggaaggguaaagaacuaaaaugcggaagcgggauauuugugacgaaugaggugcacaccuggaccgaacaauauaaauuucaagcagacucuccgaaaagacuagccaccgcaauagccggcgcaugggaaaacgggguuugcgguauucguuccacaacacgaauggagaaccuacuauggaaacagauagcgaacgaauuaaauuacauauugugggaaaacaauauuaagcuaacaguuguugugggugauauuauaggaguuuuggagcagggcaaacggacgcucacaccccaaccgauggaacuaaaauauagcuggaaaacaugggguaaagccaagauaguaacagcggaaacucaaaauucaaguuucauaaucgacggaccaaauacaccugaaugcccgucaguaucaagagccuggaaugugugggaggucgaggauuacggcuucggugucuuuacaacuaauauauggcuaaaguugagggaaguguacacccaauugugugaucaccgacucaugucugcagcgguaaaagacgaaagggcuguacaugcggauaugggauauuggaucgagucacagaaaaaugguucuuggaagcucgaaaaagcauccuuaauagaaguuaagaccugcacauggcccaaaagucacacgcuuugguccaacggaguacuagaaagugauaugaucaucccuaaguccuuggcaggaccuauaucgcaacacaaccaucgaccagguuaucauacacaaaccgccggaccguggcacuuaggcaaauuggagcuugauuucaauuauugugagggcacaacaguuguuauaacagagaauugugguacacgcggaccgucauuacgcacaacaacaguuaguggaaaacuuauacaugaauggugcugcaggaguugcacauuaccuccauuaagauacaugggugaagacgguuguugguacgggauggaaaucagaccaauaucggaaaaagaggaaaacaugguuaaaucauugguaucagcuggcagcggaaaaguagauaacuuuacaaugggcguacuaugucuagcaauccuguuugaggaagugaugaggggaaaauucggcaagaaacauaugaucgcugguguauucuuuacauucguguuacuuuugucgggacagauaacguggagggauauggcgcacacacuaauaaugauaggaaguaaugcgagcgauagaaugggaaugggaguaacauauuuggcuuuaauagcuaccuuuaaaauacaaccauuuuuggcauugggauucuuucuccgaaaacuaacaucuagagagaauuuauuguuaggagugggccuagcgauggcuacgacauuacaacuacccgaagacaucgaacagauggcaaauggaauagcauuaggauuaauggcacuuaagcuaaucacacaauucgaaacauaccaacucuggaccgcauugauuuccuuaacuuguagcaauacaauauuuacgcuuacaguggcauggagaacagcgacuuugauacuagcaggcguaucacucuugccaguuugucagaguucgucaaugagaaaaacagauuggcugccuauggcagucgcugccaugggaguaccaccauugccgcuguucaucuuuucuuuaaaggauaccuuaaagcgaagguccuggccccuuaaugagggcguaauggcuguuggauuagucucuaucuuagcaucaucauuauuaagaaaugauguaccgauggcggggcccuuaguagcaggcggacuccuaauagccuguuauguaauaacaggaacuucagccgaucuaacgguagaaaaggcagccgauauaacgugggaggaggaggcugaacagaccggagucucacauaauuuaaugauuacuguagaugacgauggaacuaugagaauaaaagaugaugaaacugaaaauauuuugacagucuuacugaaaacagcucugcuaauagucaguggaauuuuucccuacaguauaccggcaacauuauuaguauggcauacauggcaaaagcaaacgcaaagaucaggaguacuaugggauguaccaucaccuccagaaacacaaaaagccgagcuagaggaggggguuuauagaaucaaacaacaagggauauuuggaaaaacccaaguaggaguuggaguccaaaaggaaggaguuuuccacacaauguggcacgucacgagaggagcaguacucaccuacaauggaaaaagacucgaaccaaacugggcauccgucaagaaagauuuaauuuccuauggaggugguuggagauuauccgcccaauggcaaaaaggugaagaaguucagguaauagcaguugaaccaggcaaaaaucccaaaaauuuccaaaccaugccagguacguuccaaacgacgacgggugaaauuggagcuaucgcccuagacuuuaaaccugguacaucaggaucaccuauuauuaaucgggaaggaaaagugguuggacuauauggcaauggggucguaaccaaaaacggaggauacguuaguggaaucgcacagacaaaugcagaaccagacggaccaacaccugaacuagaagaggaaauguuuaagaaacgcaauuugacuauuauggaccuucacccgggaucagguaaaacaaggaaguacuuaccggcaauuguucgcgaagcaauaaaacgucgacuucguacgcuuaucuuggccccaacccguguagucgcagcugaaauggaagaagcacuuaaagggcuaccaauacgauaucagacgacugcaacuaaaucagaacauacagguagagaaauagucgaccucaugugucaugcuacguuuacuaugcgacuccuaaguccugugagaguaccgaauuauaaccucauuauuauggaugaagcacauuucacugacccugcuagcauagcagcacgaggguauaucucaacucguguaggaaugggggaagcugcggcaaucuuuaugacggcuaccccgccagggacugccgacgccuuuccgcaauccaacgcacccauacaagacgaagaaagggacauacccgagcggucauggaacucgggaaacgaguggauaaccgacuucgccggaaaaacaguaugguucguaccaaguauuaaagccggaaacgauaucgcuaacugcuuacgcaaaaaugguaagaaagucauacaauuaucaagaaagaccuuugacacugaguaucagaaaacaaaacuuaaugauugggauuucguaguaacaacggauauuucugagaugggagcuaacuuuaaagcagauagagucauugaccccagaaggugccugaagcccguaauacuaacagacggucccgaacgaguaauacuugcgggaccaaugccagugacagcagcauccgcagcucagagaagaggaagaguaggaagaaauccacagaaggagaaugaucaauacaucuucaccggucagccacuaaacaacgacgaagaccaugcccacuggacagaagcuaaaaugcugcuagauaauauuaauacaccggaagguauuauaccugcacucuucgagccagaacgagaaaaaucagcggcaauagauggagaguaccguuuaaaaggugaaagcaggaagacauuuguggagcuuaugagacggggagauuugccagucugguuagcucauaagguggcaucagaagguauuaaauacacugaccgcaaguggugcuuugaugggcagcguaacaaucaaauucuugaggaaaacauggaugucgagauauggacaaaggaaggcgagaaaaagaaacuacgaccgagaugguuggaugccagaacauauucagauccucuagcccuaaaagaauuuaaagaguuugcugccggccgaaagaguaucgcuuuagauuuggucacugaaauugggagaguacccucgcaccuagcacaccggacaagaaacgcacuagauaacuuaguaaugcuacauacuucagaacaugguggaagggcuuaucgccacgccguagaggaauuaccggagacgauggaaacacuacuacuucuuggacuaaugauccuacuuacaggaggcgccaugcucuuuuuaaucucggggaaggggauagggaaaacuucaaucggacuaaucugcgucauagcaucuucggguauguuauggauggcagagaucccacugcaauggauugcaucagcaauaguuuuagaauuuuucaugaugguucugcuaauuccugaacccgagaaacaacgaacaccacaagacaaccaauuagccuauguuguaauuggaauauugacucuggcagccauuauugcagcaaaugaaaugggauuauuagagacaacaaaacgugauuuaggaaugaguaaagaaccugguguaguaaguccuaccucauacuuggauguagauuugcacccagcaagugcauggacauuauaugcuguagcuacaacgguaauaacaccuaugcuccgacauacuauagaaaauuccaccgcaaauguauccuuggcagcgauagcuaaccaagcaguuguguuaauggguuuagauaagggcuggccaauaucaaaaauggaucuagggguaccacuacuggcacugggcuguuacucacaaguuaaucccuugacuuuaacggcugcagucuuacuacugaucacacauuacgcgauuauugguccaggucuacaagccaaagcuacaagagaagcucaaaaacgcacagcugcgggaauaaugaagaaucccacgguggauggcauaaugaccauugauuuagacccagugauauacgacucgaaguucgaaaaacaacuaggccaagugaugcuccucguccucugcgcaguacaacuacuacuuaugaggaccucuugggcacuuugugaagcauuaacgcuggcaacugggccuauaacuacauuaugggaggggagcccaggcaaauucuggaauaccacaaucgcuguaucgauggcuaauauauuccgagguaguuaucucgcgggcgcagguuuagccuucaguauaaugaaaucuguagguaccgggaaaagagggacugguucacagggagaaacucuaggcgagaaauggaagaaaaagcuaaaucaauuaagcagaaaggauuuugaucuuuauaagaagucagguaucacugaaguggaucgaacagaagcgaaggagggucugaaacggggagaaauuacccaccaugcuguuaguagaggaucugcuaaauuacaaugguuuguagaaagaaauauggugaucccagagggacgaguaauugaccuaggaugcggcagagguggguggucauacuauugugcaggccuaaagaaagugacagaaguacguggguacacaaaaggagggccuggacaugaagaaccugugccuaugucuacuuaugguuggaauaucguuaagcuaauguccggaaaagacguguuuuaccugcccccugaaaaaugugauaccuugcugugcgacaucggugaaucaucaccauccccuaccguagaagaaaguaggaccauaagaguccuaaaaaugguagaaccauggcuuaaaaauaaucaguuuugcaucaaaguacucaauccauacaugccaacaguaauagaacaucuggaacgccugcaacggaagcauggaggcaugcuuguuagguauccacuaagcagaaauuccacacaugagauguauuggauaaguaaugggacagguaauaucguggcgagugugaacaugguaucaagacuacuacuuaacagauuuacuaugacucauagacgcccgacuauagaaaaagauguugaucuuggugcugguacaagacacguaaaugcugagccagaaacuccgaacauggacguaauaggcgaaagaaucaagcguaucaaagaagaacauaauagcaccuggcauuaugaugaugaaaauccguauaagaccugggcauaccaugguaguuacgagguaaaagcuacagggagcgcuucgaguaugauaaacggaguaguaaaauuacuuacaaaacccugggacguaguaccaaugguuacacaaauggcaaugacagauacuacaccuuuuggacaacaacgaguguuuaaagaaaaaguagauaccagaacgccacggucaaugccaggaacuaggcgaguaaugggaauaaccgcagaauggcuuuggagaacauugggucguaacaagaaaccuagauugugcacacgggaggaguuuacgaagaaagugagaacaaacgccgcaaugggugccguauucacagaagaaaaccaaugggauucagcaaaagcagcggucgaagacgaagauuucuggaaguuaguagacagagagcgugaacuacacaaauuggggaaaugugggagcugcgucuacaauaugaugggaaaacgagagaaaaaguuaggcgaguucggaaaagccaaagguucuagagccaucugguauaugugguugggggcacgauauuuggaguuugaggcacuaggcuuuuuaaacgaagaucacugguucucacgagaaaauucauauucaggcguagaaggcgaaggauuacauaaacuagguuacauacuccgagauauuucaaaaaucccagggggugcgauguaugcagacgauacagcugggugggauacacguauaacugaggaugaucuucacaaugaggagaaaaucacucaacaaauggacccugaacauagacagcuugcaaacgcaauauucaaacuaaccuaccaaaauaaaguuguaaaaguucaacgaccaaccccaaccggaacggucauggauauaauaucacguaaagaucagcgagguucuggacagguaggaacguauggacuuaauaccuuuacuaauauggaagcccagcugauacgacaaauggagggagaagggguacuaaguaaagccgaucuggaaaacccucaucuucccgagaagaaaauuacacagugguuagaaacaaaaggaguggaacgauuaaaaaggauggcuauaaguggagaugauuguguggucaaaccgauagacgauagauucgcuaaugcuuuauuagcguuaaaugacauggggaaaguuaggaaagauauaccccaguggcagccaaguaaagguuggcaugauuggcagcaaguuccuuucuguucccaucacuuucaugaauuaaucaugaaagauggacgcaaacuuguaguuccaugcagaccgcaagacgaacuaaucgguagagcaagaauuucucaaggagcaggguggagccuuaaagaaaccgcaugccuugggaaggcuuaugcgcaaauguggucacuaauguacuuucacaggagggacuuaaggcuugcuagcaacgcgauauguucggccguuccaguucauuggguaccaacgaguagaacaacguggagcauccacgcacaucaccaguggaugacuaccgaagacaugcuaacggucuggaaccgcguauggauugaggauaauccauggauggaagacaaaacuccgguuacuaccugggaaaacgucccguauuuggguaaaagagaagaucaauggugugguaguuuaauugggcuaacaucacgcgcaacaugggcacagaacauaccgaccgcaauucaacaaguaagaucccuaaucggaaaugaggaguuccuagauuauaugccaagcaugaaaagauuccguaaagaagaagaaucggaaggagcgauaugguag

SEQ ID NO: 23168 - RNA, 9873 nt, Artificial Sequence
  derived and/or modified CDS sequence (opt6) from DENV-3__FJ850048__SS-prME
acaaguuuguguuugaugaugauucuuccagcagcauuagcauuucacuuaacaucaagagauggugagccaagaaugauuguuggcaaaaaugaaagagguaaaucuuuguuauuuaaaacagcgucuggaaucaacaugugcacauugaucgcaauggauuugggugaaaugugcgacgacacaguaacguauaaaugcccacacauaacagaagucgagccagaagacauagacuguugguguaaucuaacaucaacuuggguaacuuauggaacauguaaccaggccggugaacacaggcgagauaaaagaagcguagcauuagcaccacauguggggaugggguuagacacgaggacucaaacauggaugagcgcggaaggagcauggcgacaaguggaaaaaguagaaacuugggcuuuacgacauccaggauuuacgauucuggcgcuauuucuagcacacuacaucggaacaucauuaacacaaaaagugguaauuuucauccuguuaauguuaguuacgccaucaaugacuaugagaugcguagguguaggaaaccgagacuuugucgaaggauuaucaggggcgacauggguagauguuguacuagaacacgggggaugugugacuaccauggccaaaaauaaaccaaccuuagauauagaacuucagaaaacagaagcaacucaacuugcaacuuugagaaaauuauguauagaggguaaaauaacaaauauuaccaccgauucaagaugucccacgcagggugaagccacacuuccagaagaacaagaucagaauuauguguguaaacacacuuacgucgaccgcgggugggguaauggaugugggcuuuuugguaaggguagccuaguuaccugugcaaaauuucaaugccuggagccuauagaaggaaaagugguccaauaugaaaacuuaaaauauacugugauaauaacaguacacacuggagaccaacaccagguaggaaacgaaacucagggcguaacagcugaaaucacgccacaagcgucuacaacagaagcaauacuaccagaguaugguacauugggcuuagaaugcucaccucgaacugguuuagacuuuaaugaaaugauacuucugacuaugaaaaacaaagccuggaugguccauagacaaugguucuuugacuugccgcuaccauggacaaguggagcgacaacggaaaccccgaccuggaaucgaaaagaguuauuaguuaccuuuaaaaaugcgcacgcaaagaaacaagaagucguaguucuuggaucacaagaaggagccaugcacacugcucuuaccggagcaacggagauucaaaauucugguggaacaaguauauuugcaggacauuuaaaaugcagauugaaaauggauaaacucgaauugaaaggaaugaguuaugcaaugugcacaaacacuuuuguacucaagaaagaagugagcgaaacacaacaugguacaauauuaauuaaaguugaauacaaaggugaagaugugccauguaaaaucccauuuaguaccgaagauggucagggcaaagcucauaacggacgccuuauaacagcuaacccaguagugacuaagaaagaagaacccguuaauauagaagcggaaccucccuuuggagaaaguaacauagugaucggaauaggagacaaugcacuuaaaauaaauugguauaagaaaggaucuuccauaggaaaaauguuugaagcaacagcuaggggagcaaggcguauggccauauuaggugacaccgcgugggacuuuggaucaguagggggaguccuaaauucguuagguaaaaugguucaucaaauauuugguucugcuuacacagcauuauuuaguggcguaaguugggugaugaaaauuggaauaggcguucuuuuaacuuggauaggauuaaauaguaaaaauacuucuaugucauucaguuguaucgcaaucggcauaauuaccuuauauuugggcgcuguaguucaagcagacaugggauguguuauaaacuggaaagggaaagaacuuaaaugcggaaguggaauauucguuacuaacgaaguacacacguggacagagcaauauaaguuucaggcggauucaccaaagcgccuagcaacagcuauugcuggagccugggagaacgguguauguggaauuaggucgaccacucgaauggaaaaccuuuuguggaaacaaauagcaaacgaguuaaacuauauuuuaugggagaauaauauaaaacuuacaguugugguaggugauauuauuggcgugcuugagcaggggaaaagaacucugacaccucaaccuauggagcucaaguacaguuggaaaaccuggggaaaagcaaaaauagugacagcagaaacgcaaaacucgucauucauaaucgacggucccaauacaccugaauguccgucaguaucaagagcauggaacguaugggaaguagaagacuacggauucggugucuucacuacuaauauauggcuaaaacuccgugagguuuacacucaguugugcgaucaccgauuaaugucagcagcaguaaaagacgaacgagcuguacacgcugauaugggguauuggauugaaucacagaaaaacggaaguuggaaauuagaaaaggcuucccuuauugaagucaaaacguguaccuggccaaaaucacauacacuauggucaaaugguguguuagaaucagauaugauuaucccuaagucucuagccgggccaaucagucaacacaaucacagaccgggauaucacacacagacggccgguccauggcaccuuggaaaauuagaauuagacuuuaacuacugcgagggaacaaccguugucauaaccgagaauugcggaacaagaggaccuagucuccgaacaacuacuguaucugguaaacuuauccaugagugguguugcaggucauguacucuaccaccuuuaagauacaugggggaagauggcugcugguaugguauggagauacguccuauuagugagaaagaggaaaacaugguaaagaguuuagugucugcaggaucagguaaaguagauaauuuuacgauggggguauugugccuggcaauacuuuuugaggaaguaaugagagguaaauuuggcaagaaacauaugauagccgguguguucuuuacauucguacuccucuuaucuggacaaauuacuuggagagauauggcacauacauugauaaugaucggaaguaaugcauccgacagaauggggaugggcgucacauaucucgcccugauugcaacuuuuaaaauacaaccauuuuuggcacuaggauucuuuuuaagaaaacuuacaucgcgugaaaauuuauuacuaggcguaggauuagcaauggcgacgacccuucaauuaccugaagauauugaacaaauggcuaauggcauagcgcuaggucuuauggcauuaaaauuaauaacacaauuugagacauaucaacuguggaccgcccuuauaucauugacaugcucuaacacgauuuuuacucuaaccguugcuuggagaaccgcgacgcuuauuuuagccggaguuucgcuccuuccagugugucagaguucgagcaugaggaagacugauugguuacccauggcaguugcggcaauggguguuccaccucuaccauuauucauauuuucucuaaaggacacguuaaaaagacgaucuuggccacuaaaugaagguguaauggcagugggauuggugagcauauuggcgagcaguuuguugagaaaugauguucccauggcagguccacucguugccgguggguuauuaauugcauguuauguaaucacaggaacgagcgcagacuugacuguugagaaagccgcagauauaacuugggaagaagaggcagagcagacgggaguaucgcauaaccuaaugauaacaguagaugacgauggaaccaugagaauaaaagaugaugagacagaaaauauucucacuguccuauuaaaaacagcucuauuaauugucucaggaaucuucccuuacaguauuccagcaacauuauuggucuggcauacauggcagaaacaaacucaaagguccggcgugcuaugggacgugcccucucccccagaaacgcaaaaagcagaacuagaagaagguguguacaggaucaaacaacaagguauuuuugguaagacgcaaguagguguaggugugcaaaaggagggaguuuuccacacuauguggcauguaacuagaggagccguguuaacauauaacgggaagagacuggaaccgaauugggcaagcgugaagaaagauuuaauaucauaugggggaggguggagacuuucagcacaguggcagaaaggagaagaaguacagguaauagccguugagcccgggaaaaaccccaaaaauuuucagacgaugccuggaacauuucagacuacgacuggggagaucggagcuauagcgcuggauuucaaaccagguacaagugguucuccaaucauuaacagagagggaaagguaguuggauuauauggcaauggcguagucaccaaaaauggaggcuacguuucagggauugcacaaaccaacgcggaacccgauggcccaacuccagaauuggaggaagaaauguuuaagaagcguaaucucacuauaauggaccuucauccaggcucaggcaagacgcggaaauauuugccagcaauuguuagggaagcaauaaagagacgucuacgaacauuaauuuuggcaccuacaagggucguagcagcggaaauggaggaggcuuuaaaaggucuaccuauaagguaccagacgacagcuaccaaaagugaacauaccggaagagaaauugucgacuugaugugccacgccacauucacgaugcgcuuauuaucuccggucaggguacccaauuauaaccuuauuauuauggaugaagcacacuucacagacccugcaagcauagcagcuagggguuacauaucuacgagagugggaaugggggaggcugcugcuauauuuaugacugcuacuccgcccgguacagcagaugcguuuccacagaguaacgcuccgauacaagaugaagaacgugauauuccagaaagaaguuggaacucggggaacgaguggauaacggacuuugcuggaaaaacagugugguucguuccaagcauaaaagcuggaaaugauauagcuaauugucucaggaaaaacgggaagaaaguuauucagcucucacgaaaaacuuuugauacugaauaucagaaaacgaaacuaaacgacugggauuuugucguaaccacggauauaagcgaaaugggcgcgaacuuuaaagcugaccgggucauagacccacgucguuguuuaaaacccgucauccuuacugauggucccgagcgagucauacucgcugggccaaugccagucacagcagcaagugccgcacaaaggagaggucguguaggcagaaauccucaaaaggaaaacgaucaauacauauuuacuggucaaccauuaaauaacgacgaagaucacgcccauuggacugaggcuaagaugcuuuuagauaacauaaacacaccagaagggauaauaccagcccuauucgaaccagagcgcgagaaaucggcggcuauugauggggaauaucgguuaaagggagaaucaagaaaaacguuugucgaacuaaugcgcagaggugauuuaccuguguggcuugcccacaagguugcuucugaaggaauuaaguauacagaucguaaaugguguuuugauggucaacgaaauaaccaaauacuagaagagaauauggacguggaaauauggacuaaagaaggugaaaagaagaaacuacgaccucgauggcuagacgcacguacuuauagcgacccacuggcacuaaaggaauuuaaagaauuugccgcgggaaggaaaucuauagcacuugaucuagucacggagaucggacggguuccaagccacuuggcucacagaacucgaaaugcauuggacaauuuaguaaugcugcacacaagcgagcacggagggcgugcauaucgacaugcuguggaagaacuaccugaaacgauggagacguuacucuuacucggauuaaugauucucuuaacaggaggggcgaugcuguucuugauuuccggaaaagguauaggaaaaacauccauuggguuaauuuguguuaucgcaucaaguggcaugcuuuggauggcagaaauaccuuuacaauggauugcaucugcaauuguauuagaguucuuuaugaugguacugcucaucccagaacccgaaaagcagagaacgccacaagauaaccaacuagcauacguugucauaggcauucuaaccuuagcagcaauaauugcggcuaaugaaaugggacuauuagagacaacuaaacgagauuuaggaaugagcaaggaaccaggagucguaagcccuacuucauauuuagacgucgaccuucacccggcuagcgcuuggacgcuuuacgcgguagcaacaacuguuauuacccccaugcucagacacacuauagaaaacucuacugcaaauguaagucuggcugcaauagcgaaucaagcagugguucuuaugggacuagauaaaggcuggcccaucucaaaaauggaucuaggagugccacuauuagcuuuaggauguuacucacaaguaaacccgcuaacccuaaccgcagcugugcuauuauuaauuacacauuaugcuauaauagggccaggucugcaagccaaagcaacaagagaagcucagaaacgcacggcagcuggaauaaugaagaauccaacuguagauggaauaaugacgauugaccuagauccagucauauaugacucaaaguucgagaaacaacuaggucaaguaauguuauugguucuuugugcggugcaauuauugcucaugcgaaccucuugggcucuuugugaggcacuaacacucgcgaccgguccuauaacgacauuaugggaaggaagcccugguaaauucuggaauacuacgauagcaguauccauggcuaauauuuuuagaggaagcuacuuagcaggggccggauuagccuuuaguauuaugaaauccguaggcacaggaaaaagaggcacuggaagccaaggcgaaacauugggagagaaguggaagaagaaauuaaaccaacucaguagaaaagauuucgaucuauacaagaaaucugguaucacagagguagaucggacugaagccaaagagggacuaaaaagaggggaaauuacacaucaugcgguuaguagagguuccgcuaaacugcaaugguucguagaacgaaauaugguuaucccagaaggucgcgugauagaccuaggaugcggaagagguggauggucauacuauugcgccggccucaagaaagucacagaagucaggggguauacuaagggaggaccagggcacgaagaaccuguuccuaugaguacuuacgguuggaauauagucaaguuaaugagcgggaaagacguauuuuacuugccaccugagaagugugauacacugcucugugauauaggggaauccucacccuccccaacaguugaagaaucacgaacaaucagaguucuaaaaaugguagaaccguggcucaaaaacaaucaauuuugcauuaaaguauuaaauccuuauaugccaacugugaucgaacaccuagaacguuuacaaagaaaacacggcggaaugcuuguucguaauccauugagucgcaacaguacacaugaaauguacuggauaucgaacggaacaggaaauaucguugcgucaguaaauaugguaucaagauugcuacuaaaucguuuuacaaugacacaccgaagacccacaauagagaaagacgucgacuuaggcgcagguacuagacauguaaaugcagaaccagagacuccaaauauggacguaauaggugaaagaauaaaacgaauuaaagaggaacauaauaguacauggcauuaugacgacgaaaaucccuauaaaaccugggccuaucaugguucuuacgaagugaaagcuacaggaagcgcaaguaguaugauaaacgguguugugaaacuacuuacaaaaccgugggaugucguuccgaugguuacacaaauggcuaugacggacacaacgccguuuggacaacaaagaguauuuaaagaaaaaguagauacacguacacccaggucaaugcccggcacacgacgcgugaugggaauaacagcagagugguuauggcgcacguugggccgaaauaagaaaccuagacuguguacaagagaagaauuuacgaagaaaguaagaacaaaugcagcaaugggcgcaguguuuacugaagaaaaccaaugggauagugcaaaagccgcaguagaagaugaagacuucuggaaguugguugacagagaacgagaacuacauaagcuagggaaaugcggaucauguguauauaauaugauggggaagagagaaaagaagcugggagaguucggaaaagcaaaaggaucacgagcuauaugguacauguggcuuggagcuagauauuuggaguucgaggcuuuagguuuucuaaaugaagaucauugguuuucgcgagagaacucauauucaggcgucgagggagaaggucuacacaaauuaggguacauuuuacgagacauaaguaaaauaccugguggggcaauguaugcugaugauacugccggaugggacacgaggauaaccgaagacgauuuacacaacgaagaaaagauaacacaacagauggaucccgaacauaggcaauuagcgaacgcgauuuuuaagcuaacuuaucaaaacaagguggugaagguacagagaccaacuccgacggguacugugauggauauaauaucacgaaaagaccagagaggaucaggucaaguuggcacauacggccuaaauaccuuuaccaauauggaagcacaauuaauucgccaaauggaaggugaagguguccuaaguaaagccgacuuggaaaauccucauuuaccagaaaagaaaauaacucagugguuagaaaccaagggaguugagagacuaaaaagaauggcgauuucgggcgacgauuguguaguaaaaccuauugaugaucguuuugcgaaugcccuacuagcgcuaaacgauaugggaaaagugagaaaagauauaccacaauggcaaccgucaaaaggauggcaugacuggcaacaggucccguuuugcucgcaccauuuccacgaacuuauaaugaaagauggaaggaaacucguugucccaugccguccacaagaugaacugaucggcagagcgagaauaagccaaggggccgguuggucacucaaagagacugcaugucuuggaaaggccuacgcgcagauguggucauuaauguauuuccacagacgagaccugagauuagccucuaaugccauuuguucugcuguaccaguacacuggguuccgacaagccguacuacuuggaguauucaugcacaucaucaauggaugacaacagaagacauguuaaccguauggaauagagucuggauagaagacaauccauggauggaagauaagacucccgucacaaccugggaaaaugucccauauuuaggaaaacgcgaagaucagugguguggaucacucauaggcuugacaagucgcgccacaugggcacaaaacauacccaccgcgauacaacagguacgaucauugauuggcaacgaagaguuucucgauuauaugccaaguaugaaaagauuucgcaaagaagaagaaagcgaaggcgcgauuugguaa

SEQ ID NO: 23169 - RNA, 9873 nt, Artificial Sequence
  derived and/or modified CDS sequence (opt6) from DENV-3__FJ850049__SS-prME
acuucccugugccugaugaugauucucccugcggcauuggcguuccaucugacuucuagagauggugaaccacguaugauaguagguaaaaaugaacgcgggaaaucccuguuauucaaaacugcaagugguauuaauauguguacucuaauagcuauggaucuaggagaaaugugugacgacacaguaacauauaaaugcccacacauaacagaaguagaaccugaagacauugauugcuggugcaauuuaacauccacauggguaaccuacggaacaugcaaccaagcgggcgaacaccgacgagacaaaagaucggucgcguuagcuccccauguagguaugggacucgauacucgcacgcaaacauggaugagugcggaaggcgcauggagacaaguggaaaaaguagaaacuugggcgcuuagacauccgggcuuuacaaucuuagcgcuguuuuuagcucauuauaucgguaccagucuuacacaaaaagugguaauauucauucuguugaugcucguaacaccaucaaugaccaugcgguguguuggcguuggaaaucgggauuuuguagagggcuuaaguggugcgacuuggguugacgucguuuuagaacauggaggcuguguaacuacuauggcgaaaaauaaaccuacgcuugauauagaacuacagaaaacugaagcgacgcaacuugcaacucuacgcaaacuuuguauugaaggaaaaauaacuaauaucaccacggacucacgaugcccgacacaaggggaagcaacguugccggaagaacaagaucaaaacuauguauguaaacauacauacgucgauagaggcuggggaaaugggugugggcuauucgguaaaggaucacuuguaacgugugcuaaauuucaaugcuuggaacccauagaaggcaaagugguucaacaugaaaauuugaaauacaccguuauuauaacuguacacacuggagaucaacaucaaguuggaaacgaaacacaaggcguaacugcugaaauaacaccacaggcuagcacaacagaggccaucuuaccagaauacggaacgcucggacucgaaugcucuccgagaacaggacuagauuuuaacgagaugaucuuguuaacaaugaaaaacaaagccuggauggugcacaggcaaugguucuuugaccugccuuugccauggacgaguggugcuacaacagagacaccaacguggaacagaaaagaguuguuaguuaccuucaaaaacgcgcacgcuaagaaacaagaaguugugguuuuagggucucaagaaggcgcaaugcauacugcauuaacaggugcuacagagauucaaaauagcgggggcacaaguauuuuugcuggccacuuaaaaugcagauuaaaaauggacaaacuugaauuaaaggguaugaguuacgcuauguguacaaacacauuuguuuuaaagaaagaagugagcgaaacucagcauggcacgauacuuauaaaaguggaguacaaaggcgaggauguuccauguaaaauaccuuuuagcacugaggacgggcaaggcaaagcucauaacgguaggcucauaacagcuaacccaguugugacuaagaaagaggagccaguaaauauagaggcugaaccacccuuuggagagucgaacauuguaauaggaauuggagacaacgcacugaaaauaaauugguauaagaaaggaucaucuauaggaaaaauguuugaagcgacagcaagaggcgcucgacguauggcuauccucggcgacaccgcuugggacuucggcucaguaggggguguccuaaauucguuagguaaaaugguccaucaaauuuuugguagugcauacacugcacuguucaguggcguuucuugggucaugaaaaucggaauuggaguguugcucacauggauaggucucaacagcaaaaauacuucaaugucuuucucguguauagcaauuggaauaauuacauuguauuuaggagcuguuguucaagcugauaugggaugcguaauaaacuggaaagguaaagaauugaagugcgguucaggaauuuucguaacgaacgagguacauaccuggacagaacaguacaaguuucaagccgauucaccaaaacgucuagccacugcgauugcuggugcaugggagaauggaguaugcgguauucgcucaacuacuagaauggaaaacuugcuuuggaaacagaucgccaaugaauugaauuacauacuaugggaaaauaacaucaaacuaacuguagucgucggggauauaauuggaguacuagaacaaggaaaacguacuuugacgccucaaccaauggaacuaaaguauagcuggaaaaccugggguaaggccaaaauaguaacagcagagacgcaaaacucaucguuuauaaucgaugguccaaauaccccagaaugccccaguguaucuagagcauggaauguaugggaaguagaggacuacggcuuugggguuuuuacaacuaauaucuggcucaaacuccgagaaguuuacacccaguuaugcgaucacaggcuuaugagugcagcaguuaaagacgaaagagcuguacacgcagauauggguuauuggauugaaagucagaaaaacggaucuuggaagcuagaaaaagcaucucucauugaagugaaaacguguacuuggcccaaaucccauaccuuauggucuaauggcguauuagaaagugauaugauaaucccuaaaucgcuugcugguccuauaucacaacauaaccauagaccaggcuaccacacacaaacagcaggaccauggcacuuagguaaacuagaacucgacuucaauuacugugaagggacuacagucguuauuacagagaauugugggaccagaggccccucccucagaacaacgaccguaucggggaaauugauccacgaguggugcugcagguccuguacucucccuccauugagauacaugggagaagauggcuguugguacgggauggaaauacgaccaaucagcgaaaaagaggagaacaugguuaaaucccuuguauccgcaggcuccgggaaaguugauaauuuuacuaugggagugcuaugcuuagccauauuauuugaggaaguaaugaggggaaaauuuggaaagaaacacaugaucgccgguguuuucuuuacguuuguccuauuguuaagcggacaaauuacauggcgugacauggcccauacauuaauaaugauagguaguaacgcaucagaucgaaugggaaugggagugaccuaucucgcccuaauugcgacuuucaaaauacagccauuuuuggccuuaggcuucuuccuacgcaaauuaacaucaagagaaaaucuuuuauugggugucggacuagcaauggcaacaacuuuacaacuaccggaggauauagaacagauggccaauggaauugcucucggacuaauggcacuaaaacucauuacacaauucgaaacauaccaacucuggacugccuuaauuucauugacguguucuaacacaauauuuacauuaacaguugcauggagaacggccacacuuauauuagcuggaguaagccuacugcccaugugccaaaguucgaguaugagaaaaacagauuggcucccuauggccguagcugcgaugggaguaccaccccuaccuuuauucaucuucucccuaaaagauacuuuaaaacggaggucauggccauuaaacgaaggagugauggccguugggcuugucucuauucucgccaguucguuauuaagaaacgacguaccaauggcgggcccuuuagucgcugguggucuacugauugccuguuacguuauaacgggcaccucggcggaccucacaguagaaaaagcagcgaauauaacaugggaagaagaagcggaacaaacugguguuucccauaaucuaaugauaaccguagacgaugacgguaccaugaggauaaaagaugaugaaaccgaaaauauucuaacaguacuccuaaaaaccgcauuacugauaguuucaggaauauucccuuacaguauuccugcuacacuuuugguauggcauacauggcagaagcagacacaaagaaguggcguguugugggacguaccaaguccaccugagacccaaaaagcugaacuugaggaaggaguauaccggauaaaacaacaagggauauuuggcaaaacucaaguaggaguagguguucaaaaagaaggugucuuccauacaauguggcacguuacucguggagcgguacuuacauacaacggcaaacgauuggaacccaauugggcgagugucaagaaagaccuuauuucuuacggaggcggcuggaggcugucagcucaguggcaaaaaggagaggaaguacaagugaucgcgguugaaccugguaaaaaucccaaaaauuuccaaacuaugccuggaacguuccaaacaacaacaggagaaauuggagcuauagcucuagacuucaagccaggaaccagcggaaguccaauaauuaaucgcgaaggaaaagugguaggacuauauggaaacggcguagucacuaagaauggaggguacguaucuggcaucgcccaaacuaaugcagaacccgaugguccaacaccagaauuggaggaagaaauguucaaaaagcguaacuuaacaauaauggaccuacaucccggauccgggaagacuagaaaauaccugccggcuauagucagagaagcgauuaaaagacgccuaagaacacuuauccuggcaccuacgagaguaguagccgcagaaauggaagaagcacuaaaaggauuacccauaagauaucaaacaacugcaacgaaaucagaacacaccggaagagaaauuguagauuuaaugugccaugcuacauuuacuaugcguuuauugucgccuguacggguuccaaacuauaauuuaauaauaauggaugaggcacauuuuacugauccagccuccauagcugcaagagguuacauaucaacuaggguggguaugggagaagcugcugcaauauuuaugacggcaacaccgccgggcacagcagaugcuuucccacaaucaaaugccccuauucaagaugaagaaagagacauuccagaacggucauggaacucgggaaacgaguggauuacggauuucgcagguaagacaguaugguucgugccgucaaucaaagcuggcaacgauauugcuaauugccuucgcaaaaauggcaagaaggucauacaauuaucgaggaaaacauuugauaccgaauaccagaagacgaaacuuaaugacugggauuucgucguaacaacagacauaucugaaaugggcgccaauuuuaaagcagaucggguaaucgacccacggaggugcuuaaagcccgugauucuaacggacgggcccgaaagaguuauucuugcuggaccuaugccaguuaccgcagcuagugcugcacaacgaagaggaagagucggccguaauccacaaaaagagaacgaucaauauauuuucacggggcaaccucucaauaacgaugaagaccaugcucacuggaccgaagcuaagauguuguuagacaacauuaauacgccagaaggaauuaucccagcauuauuugaaccugaacgagagaaaagugcggcaauagauggggaguaucgacuuaaaggugagucacguaaaacauuuguagagcugaugagaagaggugauuuaccaguuuggcuagcacacaaaguagcaucggaaggaaucaaguacacagauagaaaguggugcuuugacggacaacgcaauaaccaaaucuuagaggaaaauauggaugucgaaauauggaccaaggaaggcgaaaagaagaaauugagaccaagauggcuagaugcucguacauauuccgauccucuugcuuuaaaagaauuuaaagaguuugcagccggucgaaaaucaauagcauuggaucuagucacagaaauaggaagaguacccucgcaucuugcacauagaacuagaaacgcauuagacaaccucgugauguugcacacaagcgagcacggcggucgugcauaucgacaugcaguugaagaacuaccagaaacaauggaaacacuucuauuauuagggcugaugauauuacucaccggaggggcaaugcucuuuuuaauuuccgguaaaggaaucggaaaaacauccauagguuugaucugugucaucgcuaguucuggcaugcuguggauggcugagaucccucuacaauggauugcaucagcgaucguauuagaguucuuuaugaugguacuccuaauccccgaaccagaaaaacaaagaacaccacaagauaaccagcuagccuaugucgugauaggaaucuugacacuugccgcaauuaucgcagcaaaugagaugggucuucucgagacgacaaaacgcgacuuagggaugaguaaagaaccgggaguaguauccccaacguccuauuuagauguugaccuccaccccgcuucugcuuggacgcuauaugcuguggcaacaacugucaucacucccauguuacgacauacaauugaaaauucuacagcaaacgucagcuuagcggcgauugcuaaucaggcuguuguacuuaugggcuuggauaaagguuggcccauaucuaaaauggauuuaggaguacccuuauuagcacuagggugcuacagccaagucaauccauugacucuuacugccgcuguacuccuacucaucacccacuaugcaauaaucggaccgggacugcaagcuaaggccacacgugaagcacagaaacgaacagcagccgggauuaugaaaaacccaacaguggaugggauuaugaccauagacuuagacccaguaauauacgauuccaaauuugagaaacaacucggacaagugaugcuccuaguguuaugugccguucaacuccuccucaugaggacaaguugggcguuaugugaagccuuaacauuagccacgggaccaaucacaacccucugggaagguagccccgggaaauuuuggaauaccacaauugcagugucaauggccaauauuuucagagggaguuacuuagccggugcuggccuagccuucucuauaaugaaaucaguaggaacagggaaaagagguaccggcucgcaaggagaaacucuaggagagaaauggaagaagaaauugaaucaauugucucgaaaagacuucgauuuauacaagaaaaguggaauaaccgaaguugaucguaccgaggccaaagaaggacuaaaacguggcgagaucacacaucacgcuguaucucggggauccgcgaaacugcaaugguuuguggaaagaaacaugguuauuccugaagguagagugauagacuugggaugcgguagaggcgguuggaguuauuauugcgcaggccugaagaaaguuacagagguacgaggguacacuaaaggaggcccgggucaugaagaaccaguaccuaugucgaccuauggguggaacauagucaaauuaaugaguggaaaagaugucuucuauuuaccaccagaaaagugugacacauuacuuugugauauaggcgaaucgucaccaucaccuaccguugaggagagccgaacaauuaggguccuuaaaaugguggagccauggcuaaagaauaaccaauucugcauuaaaguuuuaaaucccuauaugccuacgguaauagaacaucuagagagguuacaaagaaaacacggggguaugcugguccgaaauccacuaagucgaaauucaacucacgaaauguacuggaucagcaauggaacuggaaauauuguagcuagugucaacaugguaucacgacugcuauuaaauagauuuaccaugacgcacaggaggccaacaauagaaaaagauguugacuuaggugcaggaacacgccauguaaaugcagaaccagaaacacccaauauggacguaaucggugaaagaaucaaaagaauuaaagaagaacacaauucuacauggcacuaugaugaugagaacccauacaagacaugggccuaucauggaucauaugaaguaaaagcuacgggcucagcuucaucgaugauaaacggaguuguuaaguuguuaacgaagcccugggaugugguacccaugguuacacaaauggcaaugacagauaccacaccauucggacaacaacguguauucaaagaaaaaguagauacacgcacuccgagaucaaugccagguacaagaaggguuaugggcauuaccgcagaaugguuauggagaacgcuaggccgaaacaagaaaccacggcucugcacgagagaagaguucacgaagaaaguacgaacgaacgcagcgaugggugcaguauuuacagaagaaaaucagugggacagugcgaaagcggcgguagaagacgaggauuuuuggaaacuuguagauagagaaagagaacuucacaaacuggguaaaugcggcucaugcguauauaauaugauggguaaacgagagaagaaacucggagaauuugggaaagcaaaagguuccagagcuaucugguauauguggcuaggagcaagauacuuagaguuugaggcacuuggauuccuaaacgaagaucacugguucuccagagaaaauucuuacucggguguggagggcgaggggcugcacaagcuaggguauauacucagagauaucagcaagauuccaggaggagccauguaugcagaugauaccgcggguugggauacacgaauuaccgaagaugacuugcauaaugaggagaaaauaacacagcagauggauccagaacauagacaauuggcuaacgcaauauucaagcuaaccuaccagaacaagguuguuaaaguucaaagaccaacaccgacagguacgguuauggauauuauuucaagaaaagaucaaaggggaagcggacaaguaggcacuuaugggcuaaacacauuuacuaacauggaggcccaauuaauuagacaaauggaaggugaggggguauuaagcaaagccgauuuggaaaauccacaccuuccugaaaagaagauaacccaauggcuggaaacaaaagguguugaaaggcuaaaaagaauggcaauuaguggagacgauuguguaguaaaaccgauagaugacagauucgcaaacgcauuauuggccuugaaugacaugggcaaaguacguaaagauauaccucaauggcagccaucaaaaggauggcacgacuggcaacaaguccccuuuuguucacaucauuuccaugaacucaucaugaaggacggcaggaaacucguagucccgugucguccucaagacgaacuuauaggacgagcgaggauaucacaaggugcgggguggagucuuaaagaaacagcaugucuaggaaaagcauacgcgcaaauguggagucuuauguauuuucacagaagagaucucagacucgcauccaaugcaaucuguucugcgguaccaguucauuggguuccaacaagcagaacuaccuggucaauucaugcacaccaucaauggaugaccacugaggacauguuaacagucuggaauagagucuggauagaagacaacccauggauggaagauaagaccccaguuaccacaugggagaauguaccauacuuaggcaagcgggaggaucaauggugugguagccuaauaggguugacaagucgagccaccugggcucaaaauauuccaacagcaauucaacaagugagaucauugauuggaaacgaagaauuucuugauuacaugccguccaugaagagguuccgaaaggaggaggagucggaaggcgcuauaugguga

SEQ ID NO: 23170 - RNA, 9873 nt, Artificial Sequence
  derived and/or modified CDS sequence (opt6) from DENV-3__FJ898476__SS-prME
acaagucuaugucucaugaugauucuaccagcugcacuagcauuucacuugacaagucgcgacggagaaccgagaaugaucgucgggaaaaacgaaaggggaaaaagccuccuuuuuaaaacugcuagcgggaucaauaugugcacucuaauugcaauggaucuaggagagaugugcgaugauacagucacauacaaaugcccgcacauaaccgaaguggaaccugaggacauagauugcugguguaaucucacuuccacauggguaacauauggaacguguaaucaagcaggagaacauaggagagauaaaagaagcguugcccucgcaccacauguagguaugggcuuagauacacguacgcaaacuuggaugagcgcugagggugcguggaggcaaguggagaaaguugaaacaugggcucuccgucauccgggguuuacaauacuugcguuguuucuagcacauuacauaggaacaaguuuaacgcaaaaaguaguuauuuuuauccuauuaaugcugguaacaccuaguaugacuaugagaugcguaggcgucggaaaucgcgauuuuguagaaggacucaguggggcaacuuggguggacguaguccucgaacaugggggauguguuaccacaauggccaaaaacaaaccgacgcuggacauugaauuacagaaaacugaagcuacacaauuagcuacguuaagaaaacuaugcaucgaaggcaaaauaaccaacaucacgacagacucacgcuguccuacucaaggagaggccaccuuaccagaagaacaagaccaaaauuacgugugcaaacacacguauguagaucgcggcuggggaaacgguugcggccucuuuggaaaaggcagcuugguuacaugcgcuaaauuucaaugccuggagccaauugagggaaaagugguacaguaugaaaacuugaaauacacaguuaucaucaccgugcauacaggggaucaacaccaaguagguaacgaaacacaaggcguuacagcugaaauaacuccacaagcgucuacgacagaagcaauauuaccugaauaugguacauuaggauuggaaugcucgccacguacaggacuugacuuuaaugaaaugauucuucuuacuaugaaaaauaaagcauggaugguacaccgacagugguucuuugaucuucccuuaccauggacguccggggcaacuaccgaaacaccuacauggaaccggaaagaacuacugguaacauuuaaaaacgcgcacgcuaagaaacaagagguaguuguacuaggaucgcaagaaggagcaaugcacacugcuuuaaccggagcaacagaaauucaaaauagcgggggaacauccaucuucgcaggacaucuaaaaugcagacuuaaaauggauaaacuagaguuaaaagggaugucguaugcaauguguacaaacacauucguacucaagaaagagguaagcgaaacucagcauggaacgauauuaauaaaaguagaauauaaaggagaagaugugcccuguaaaauaccuuuuagcacagaagauggacaaggaaaagcacauaacggcagguuaauaacagcgaacccggucguaacuaagaaagaggaacccgugaauauagaagccgaacccccauuuggugaaagcaauauaguaauagguauaggagauaaugcucugaaaaucaauugguauaagaaaggcaguucaauaggaaaaauguuugaagccaccgcccguggagcaagacgaauggcuaucuugggagauacugcuugggacuuuggaucaguaggggguguacuaaacucguugggcaaaaugguacaccaaauuuuuggaucggcguacacagcauuauuuucaggaguaaguugggugaugaaaauaggaauugggguccuccuuacauggauagguuuaaacagcaaaaacacaucaaugaguuucucauguauagcuauugguauaauaacucuuuaccuaggcgcugucguacaagcggauaugggaugcgucauaaauuggaaaggaaaagaguugaagugcggaaguggaauuuucguaacgaaugaaguucauacuuggacagagcaauacaaauuccaggcagacucaccgaaacgccuagcuacagccauagccggugcaugggagaauggcgucugcgguauccgcucaacuaccagaauggaaaaucuccuguggaaacagaucgcuaaugaacugaauuauauacucugggagaauaauaucaagcugaccguaguagugggagauauuauagguguauuagaacaaggaaagagaacuuugacuccacaaccaauggaacucaaauacucuuggaaaacuugggggaaggcgaaaauaguaaccgcagaaacucagaauagcaguuuuaucaucgaugggccaaacacaccagaaugcccgucgguaagcagggcuuggaauguaugggaaguagaagacuauggauucgguguauuuacuaccaauaucugguuaaaacuaagagaaguauauacucaguuaugugaucacagacucaugucagcugcuguaaaagacgagagggcgguacaugcugacaugggauauuggauagaaucccagaaaaauggaaguuggaaacuagagaaggcaucucuaauagaaguuaaaacaugcacuuggccaaagucccauacguuguggaguaacgggguuuuggaaagcgacaugauuauuccuaaaagccuugcagguccuauaagccaacacaaucacagaccaggauaccacacacaaacagcgggaccauggcaucuaggaaaauuagaguuagauuuuaauuauugugaaggaaccacaguuguaauuacagagaacugcggcacacgugggcccagcuugaggacuacuacuguuagugggaaacucauucacgaguggugcugcagaucgugcacacugccaccacucagguacaugggugaagacggaugcugguaugguauggagauaaggccaauaagugaaaaggaagaaaauaugguaaaaaguuuaguaucagcuggcagugguaaagucgacaacuuuacaauggggguguuaugucuggcuauauuguuugaagaaguuaugcgaggaaaauuuggcaagaaacauaugaucgcaggggucuucuuuacauuuguauuacuucuaaguggacaaauaacguggcgugacauggcacauacacugauuaugauaggaaguaaugcuagugaucgcaugggaaugggcguaacguaucuagccuuaauugcuaccuuuaaaauacaaccuuuccuagcacuuggauucuuucuucgaaaauugacaagucgugaaaaucuacuuuuaggaguuggguuagcaauggcuacuacguugcaauuaccagaggacauugaacagauggcaaauggcauugcacuugguuuaauggcuuuaaaauugauaacgcaauuugaaacauaucaacucuggacagcauugaucagccucacauguaguaacacgaucuuuacacuaaccguggcguggcguacagccacucuaauuuuagcggguguaucgcuucucccagucugucaaucgaguaguaugagaaagacagacugguugccaauggcaguagcugcaaugggaguacccccacucccgcuguuuauuuuuggauugaaagauacauuaaaacguagaaguuggccauuaaaugaaggcguuauggcgguuggacuugucaguauccuagcuagcuccuugcuaagaaaugauguaccuauggcaggaccucuuguagcaggaggauuauuaaucgcguguuacgucauuacugguacuucagccgauuuaacgguagaaaaggccgcugauaucaccugggaagaagaagccgagcagacaggaguaucgcacaacuuaaugauuacagucgaugaugacgggacaaugagaauaaaagacgaugaaacagaaaauauacugacuguauuacugaaaacugcucuacucaucguuaguggaauuuucccuuauucuauaccagcuacacuguuaguauggcacacguggcagaaacaaacgcaacggagcggaguauugugggaugugccaagcccuccagaaacgcaaaaagccgagcuagaagaaggcguguacagaauaaagcaacagggaauauuugggaaaacgcaaguaggggucgggguacaaaaagaaggugucuuccauacaauguggcauguaacacguggcgcuguacuuacuuauaaugguaaaagacuggaacccaacugggcaagugugaagaaagaucuaauaagcuacggugguggcuggagauuaucagcucaauggcaaaaaggagaggaaguccaagugaucgcaguagagccgggaaagaaccccaaaaacuuccaaacaaugccaggaaccuuccaaacuacaacgggugaaaucggagcaauugccuuagacuuuaagccugggacaaguggaucaccaauaauuaaccgggaagggaaggugguaggucuauauggaaacggcgucgugacuaaaaacgguggguaugugucaggcaucgcgcagacaaaugcagaaccagauggcccuacaccugaacuagaggaagagauguucaagaaaagaaaccuaacaauuauggaccuacauccggguucagggaaaacacgcaaauacuuaccagccauuguaagggaggcaauuaagcgucgacuuagaacccuuauacuugcuccuacgagagucguagccgcugaaauggaagaagcccuaaaagguuuacccauucguuaccaaacuacugccaccaagucagagcacacgggccgagagauuguugaccuaaugugucaugcgacauuuaccaugcggcugcuaagucccguacgugugccuaacuauaaucuuauuauaauggaugaggcacauuuuacagaucccgcgucuaucgcagcacgcgguuacaucaguacaaggguuggaaugggcgaagccgcugcaauauucaugacagcaacaccaccagguacagcagaugcuuuuccacaaaguaacgccccgauacaagaugaagaaagggacauuccagaacggucauggaacucagggaaugaauggauuacagauuuugccggaaaaaccguaugguuugugccgagcaucaaggcggggaaugacaucgcaaauugcuuaagaaagaaugguaagaaaguuauccaauuaucuagaaaaaccuuugauacagaauaccagaaaacaaaacugaaugacugggauuuuguggucacgacagauauaucugaaaugggugcaaauuucaaagcugaucgggucauagacccgagaagaugucuaaagccugucauacucacggacggucccgaacggguaauacuggcaggccccaugccaguaaccgcugcaagugccgcacagcgaagaggaagaguaggaagaaacccucaaaaagaaaacgaucaguacauauuuacuggacaaccauuaaauaaugacgaagaucaugcccacuggacugaagcaaaaauguuacuagacaacaucaacacaccagaagguauuauuccugcacuauuugagccugaaagagaaaaaucggcagccauugauggcgaauaccgacuaaagggggagaguaggaaaaccuucguagaacucaugcgcagaggagaucucccugucuggcuagcucacaaaguagcaagcgaaggaauuaaauacacggauagaaaaugguguuuugauggccaacgcaauaaccaaauucuggaagaaaauauggacgucgaaauauggacuaaagagggagagaagaagaaauuaagaccaagauggcuagacgcaagaacauacucagauccacuagcccuaaaagaauuuaaagaauuugccgcagggaggaaaucgauagcccuagaucuaguaacagagauuggacgaguaccaagucauuuagcucaucgaacaagaaaugcacuugacaaucuaguuauguuacacacgagcgaacacggggguagagccuauaggcacgcuguagaagaacuuccggaaacaauggaaacguuguuacuccuaggguugaugauacuguugacaggaggggcuauguuauuuuuaauaagugggaaagguauaggaaagacgagcaucggcuuaauaugugucauagccucuaguggaauguuauggauggcagaaauaccccuucaguggauugcaucugcaauaguauuggaauuuuucaugaugguacuacuaaucccagaaccugaaaagcaaagaacaccucaagauaaccaguuagcauacguaguaauagggauacugacuuuggcggccauuaucgccgcgaaugagaugggucuacuggaaaccacaaagcgggauuuaggaaugucuaaagaaccaggcgucgugucaccuacaucguaccuagacguggacuugcacccagcuucugcuuggacccuuuacgcagucgcaaccacuguaauuacacccaugcugagacauacaauugaaaacucaacugcuaaugugagucuugcugcaauagcaaaccaagccguuguccugaugggauuggauaaaggauggccaaucucaaaaauggacuuggguguucccuugcuugcacugggauguuauagucaggucaaccccuugacccuaacagcagcugucuuauuacuuauaacacacuaugcaauuauaggaccaggucugcaagcgaaagcuacacgagaggcccaaaaacgaacggcagcagguaucaugaaaaauccuaccgucgaugguauuaugacaaucgauuuggauccuguuauauaugauucuaaauucgagaaacaauugggacaagugaugcugcuaguacuuugcgccguacaauugcuacuaaugcgcaccuccugggcauugugcgaagcucucacucuagcuacagguccuauaacaaccuuaugggaagguucaccagguaaauucuggaauacaacuauagcaguaaguauggcaaacauuuucagagggaguuacuuagcuggagcuggccuagcauuuagcauuaugaaaaguguggguacagggaaaagaggaacggguucccaaggugagacacuuggagaaaaauggaagaagaaauuaaaucaacucucacgaaaggauuuugauuuauacaagaaaagcggcauuaccgaaguagacagaacagaagcuaaagaaggacuuaagagaggagaaaucacucaucacgcuguaucaagaggcucugccaaguuacagugguuugucgagagaaauaugguaauuccggagggacgcguaauagauuuaggcuguggacguggugguuggagcuauuauugcgcaggauuaaagaaaguuacagaaguacgagguuauacaaaaggaggaccgggucacgaggaaccaguuccgaugucuacguacgguuggaauauuguuaaacuaaugaguggaaaggacguauuuuacuuaccgccagaaaaaugugauacgcuuuuaugugacauaggagaaucaucacccucuccaacagucgaagagucucgcacgauaagaguccucaaaaugguugaaccauggcugaagaauaaucaauucuguauaaaaguacugaacccauauaugccaacuguuauugaacaucuagaaagauuacaaagaaaacauggagguaugcuuguaaggaauccgcuaagucgcaauucaacucaugaaauguauuggauaucaaaugguacaggcaacauaguagcgagugucaacaugguuucuagauuauuacugaacagguucacaaugacgcacaggaggccuacaauagaaaaagaugucgauuuaggagccgggacucgacacgugaacgcggaaccggaaacuccaaacauggacgucaucggagagagaaucaagcgaaucaaagaggagcauaauucaaccuggcauuacgaugacgaaaacccguacaaaacgugggccuaccauggaucguaugaaguaaaagcgacugguagcgcgucgucaaugaucaauggaguagucaagcuauugacaaagccaugggaugugguaccaaugguaacgcagauggcuaugaccgauaccacucccuuuggucagcaacggguuuuuaaggaaaaaguagacacaagaacucccagaaguaugccggguacgagacgaguaaugggaauuacagccgaauggcucuggagaacuuugggaaggaauaagaaaccaagauuauguacgcgggaggaguuuacuaaaaagguaaggacuaaugcugcaaugggugccguauucacugaagaaaaccaaugggauagcgcaaaagccgcugucgaagaugaggauuucuggaaauuaguagaccgugaaagggaauugcauaaacuagggaagugugggaguugugucuacaauaugaugggaaaacgugagaagaaauuaggagaauuuggcaaagcgaaagggucuagagcaauuugguacaugugguugggugcaagauauuuagaauuugaggcuuugggcuuucuaaaugaagaucauugguuuagcagagaaaauuccuauaguggggucgaaggggaaggucuacacaaacuaggcuauauauuaagagacauuaguaaaaucccggguggagcuauguaugcagacgauacugcugguugggauacacgcaucaccgaagaugauuuacacaacgaagagaaaauaacccagcaaauggauccugaacauaggcaacuugccaaugcaauauucaaacuuacuuaccagaauaagguggucaagguacagagaccaacuccgaccggaacaguuauggauaucauuaguagaaaagaucaacgcggaaguggucagguugguacuuauggccuaaauacguuuacaaacauggaagcacaauuaaucagacagauggaaggugaaggaguucuaucaaaagcugaccuagaaaauccacaucuuccugagaagaaaauaacucaauggcuagagacaaagggaguagaaagauuaaaaagaauggcgauuucaggugaugacuguguuguaaaaccaauagaugaucgguucgcaaacgcguuauuggcauuaaaugauauggggaaaguacggaaagacauaccucaauggcagccgucaaaaggauggcaugacuggcaacaggugccauucuguagucaucacuuccaugaacuuauaaugaaagacgggcgaaaauuaguuguucccugucggccacaggaugaacuuauaggcagagcuaggauaucacagggugcagguuggucuuugaaggaaacagcuugcuuagguaaggcauacgcacagauguggucauuaauguacuuccauagaagagauuuaagacuggcgucaaaugccauaugcucugcgguaccaguacauugggugcccacuucaagaacaaccuggagcauacaugcacaccaucaauggaugacaacagaagauauguuaacaguauggaacagaguuuggauagaagauaauccauggauggaagauaaaacuccugucacuacuugggaaaaugucccauaucugggaaaaagagaggaucaauggugcgguucgcuuaucggacucacuucaagagcuacaugggcucaaaauauaccaacugcuauucaacagguacgaucuuuaaucggaaacgaggaauuucuggauuacaugccuaguaugaaacgauuuagaaaggaagaggaaagugaaggggcuaucugguag

SEQ ID NO: 23171 - RNA, 9873 nt, Artificial Sequence
  derived and/or modified CDS sequence (opt6) from DENV-3__FJ898475__SS-prME
acaucauuauguuuaaugaugauacuuccggcugcgcuugcauuucaccuaacaucacgugacggggaaccccgaaugauaguaggcaaaaaugaaagagguaaaagccuauuauucaaaacggcaucugguauuaauauguguacacugauugcgauggaccuuggagaaaugugcgacgacacuguuacuuacaaaugcccacacaucacagaaguggaaccagaagauauagauuguuggugcaaccuuacgagcacaugggucacguacgguacguguaaucaagcaggagaacaccguagggauaaaagauccguggccuuagcaccucacguuggaaugggguuagauacacgaacacaaacauggaugucugcugagggagcauggcggcaaguugaaaaaguugaaacaugggcauugagacacccgggauucacgaucuuagcucuguuucucgcacacuauauaggaacaucuuuaacucagaaagugguuauauucauuuuguuaaugcuuguuacaccaaguaugacuaugcguugugucggagucggaaaucgagauuuuguggagggccuaagcggugcaacguggguagauguaguauuagagcauggagguuguguaacaacgauggcuaaaaacaaaccaacacuagauauagaacuccagaaaacugaggcaacucaacucgcuacucucagaaaauuguguauugagggaaaaauaacaaacauaacuacagacucaagauguccuacacagggugaagcaacccuaccagaagaacaagaccaaaacuacgucuguaaacauacuuauguagauaggggauggggaaauggcugugguuuauuugggaaaggaucauuagucaccugugcgaaauuucaaugcuuagaacccauagaaggcaaaguagugcaguaugaaaaucuaaaauacaccguaauaauuacaguacacacgggugaccaacaucaaguggguaacgaaacacaaggaguuacugcggaaauuacaccucaagcaucgacuaccgaagcaauacuaccagaauauggcacuuuagggcuggaaugcucaccgaggacgggacuggauuucaacgaaaugauuuuauuaacaaugaaaaacaaagcauggaugguacauagacaaugguucuuugaucucccucucccguggacguccggagccacuacagaaacaccgacuuggaaccguaaagaauuauugguuacauuuaaaaaugcucaugcgaaaaagcaggaaguaguuguucugggaucucaagagggugccaugcauacggcgcucacaggcgcuacagaaauucagaacucaggcggaacgucgauauucgcaggucaucuuaaauguagacuaaaaauggacaaauuggaacugaaagggaugucguacgcgaugugcacuaacacauucguauugaagaaagagguuucugagacucagcaugguaccauauuaauaaaaguagaguacaaaggagaagauguaccauguaaaaucccuuucagcacagaagauggacaggguaaggcucauaauggucggcucaucacugcaaauccaguaguaaccaaaaaggaggaaccaguuaauauugaagcugaaccaccuuucggcgaaagcaacauaguaauagggaucggagacaacgcacuuaagauaaauugguacaaaaaggguaguucgauaggcaaaauguuugaagccacagcgcggggagcgaggagaauggcgauuuuaggagauacugcgugggauuucgggucaguuggaggcguauugaacagcuuagguaagaugguccaccaaauauuugggucggcguauacagcgcucuuuagcgguguuucguggguuaugaaaauagggauuggggucuuacuuacguggaucggacuaaacagcaaaaacacaagcaugucuuucucgugcauagcuaucgguauaauaacuuuguauuuaggcgcagugguucaagcugacaugggcugcgucaucaauuggaaaggaaaggaguuaaaaugcggaucgggaauauuuguaacaaacgaaguacauacauggacggaacaauauaaauuccaggcugauaguccaaaacgacuggcaacggcuauagcaggggcaugggaaaauggaguauguggaauacguagcacaacucguauggaaaacuuguuauggaaacaaauugcuaaugaacucaacuauauucugugggaaaacaauauaaaguuaaccgucguaguuggagauaucauaggaguuuuagagcaaggaaaacguacacuuacaccccagccuauggaauuaaaguauucauggaagacguggggaaaagcaaaaauaguaacugcagaaacacaaaauucuucauucaucaucgauggaccaaacacucccgaaugcccaucugugaguagagccuggaaugucugggaaguugaagacuaugguuucgguguguuuacgaccaauauuugguuaaaauuaagagagguguacacucaauuaugcgaucauagauuaaugucggcugcagugaaggacgaaagagcggugcaugcugacaugggcuacuggauagaaagucagaagaacgggaguuggaaauuagaaaaagccucccuuauugagguaaaaacuugcacguggccaaaaucgcauacccuauggagcaauggcguuuuagagucagacaugauaauaccaaaaucgcuugcgggaccaauaucacaacauaaccaccgaccaggguaccacacgcaaacagcaggaccguggcaccuaggaaaauuagaacuugauuuuaacuauugcgaaggaacaacaguuguaauaaccgaaaacugugguacgaggggaccaaguuuacguaccacaacaguaucuggaaaacucauucaugaauggugcuguagaagcugcacgcuaccuccacuaagauacaugggugaggaugguuguugguacggcauggaaauucgaccaauaucugaaaaagaagagaauaugguaaaaaguuuaguauccgcagggucuggaaaaguagauaacuuuacuaugggagucuuaugcuuggcaauccuauucgaggaaguaaugcgcggaaaauucggaaagaaacauaugauugcugguguauuuuuaacguucguacuacuccuaucuggccaaauuacuuggagagacauggcacacacacugaucaugauuggaagcaaugccagugauaggaugggcaugggugugacauacuuagcuuuaaucgcaacguuuaaaauacagccuuuccuugcucuaggauucuuucucagaaaacucacaucacgcgaaaauuuauuacuagggguaggauuagcaauggcgacaaccuuacaacuccccgaagauaucgaacaaauggcgaauggaauagcauuaggacugauggcguuaaaauuaauaacucaauucgaaacauaucaacuuuggacagcacuuaucucacuaacgugcucaaauacgauauuuacgcuuacaguugcauggaggacagcaacguuaauccuugcgggcguaucguuguugccaguaugccaaagcucaaguaugcgaaaaacugauugguuaccaauggcuguagcagcuauggggguuccaccucuaccacuauuuauauucagucuuaaagauacacuaaaaagaagaaguuggcccuugaaugagggagugauggcaguuggucuuguuucuauucuagcuucaucacuauuacgcaaugauguccccauggcuggcccacucguagcaggaggacugcuuauagcaugcuauguuauaacagggacaagugcagaccugacaguagaaaaagccgcugauauaacgugggaagaggaggcagaacaaacaggagugucacacaaccuaaugauaacugucgacgacgaugguacaaugagaaucaaggacgacgaaaccgaaaacauacugacaguuuuacucaagaccgcauuacugauuguauccggaauauuuccauauucaauacccgccaccuuacuggucuggcacacauggcaaaaacaaacgcaaagaagugggguuuuaugggacguacccucaccaccggaaacgcaaaaagcugagcuagaagaggguguauauagaauaaagcaacaagggauauuuggaaaaacucagguagguguaggcguucaaaaggaaggaguauuccauacaauguggcacguuacaagaggcgccguacuaaccuacaaugguaaacgauuggaaccgaacugggcgucgguuaagaaagaucugauuucauacgguggagguuggcgcuugucggcgcaauggcagaaaggagaggagguacagguuauagcaguggaaccagguaaaaauccgaaaaauuuccaaacgaugccuggaacuuuccaaacgacaacaggcgaaauaggggcaauugcauuagauuucaaaccaggcacaagugguucaccaaucauaaaccgagaagguaaaguagucggauuauauggaaauggagucguaaccaaaaaugguggauaugugagcgggaucgcacagacaaaugcggagccagacggucccacuccagaauuagaggaggaaauguucaagaagagaaauuugacaauaauggaucuucauccaggaucgggcaaaacaagaaaguaucuacccgcaauugucagagaagccauuaaaagacgacuaaggacacuaauauuggcuccuacaagaguaguugcagcggagauggaggaggcucuaaaagggcucccaauacgauaucagacuacagcaacaaaaucagagcauacugguagggaaauaguagaccuaaugugucacgcgaccuuuacaaugcgacuguuaucgccuguaagaguaccuaauuauaaucugauaaucauggacgaagcccacuuuacggacccagcuucgauugcugcuagaggauauauaucaacuaggguaggaaugggagaagcugcugcaauauucaugacagcuaccccgccaggaacugcagacgcuuuuccgcaaucuaaugccccuauucaagaugaggagcgagacauuccugaaagaucguggaacucuggcaacgaauggauuacggacuuugcagguaagacuguaugguucguuccaaguauaaaagccggaaacgacauagcaaauugcuuacggaagaacggcaagaaagugauucaacugagucggaagacuuucgacaccgaguaccagaaaacaaaacucaacgacugggacuucguuguaacgacugauauaucugaaaugggugcaaacuuuaaagccgacaggguuaucgaccccaggagaugucugaaaccugugauacuaaccgacgguccggagcgugugauacucgcugggccgaugccagucacagcggcauccgcagcacaacgcagagggagaguaggccgcaacccacaaaaggaaaaugaucaauacaucuuuacgggccaaccuuuaaauaaugacgaagaccaugcacauuggacugaagccaagaugcuauuggauaauauaaacaccccggagggcauuauuccagccuuguuugaaccggaacgugagaaaagcgcggcuauugauggagaauaucgguugaaaggagaaagccggaaaacuuuuguagagcuaaugagaagaggggaucugcccguauggcuagcacauaagguagcaagugaggguaucaaauauacugaccggaaaugguguuuugacggucagagaaauaaucaaauucucgaagagaauauggacguagagauauggacaaaagaaggagagaagaagaaacuccggccuagaugguuagacgcccguaccuauagcgacccacuggcucuaaaagaguuuaaagaauuugcagcagguaggaaaagcauugcauuggauuuagucacagagauaggccgaguaccaucccaucuagcacacaggacacguaacgcucuggauaacuuaguaaugcuacacacuucagaacauggaggacgggcguauagacaugccguugaggaacugccagaaacgauggaaacauugcuacuccuuggacuaaugauauuacuaacaggaggugcgauguuauuucucaucagcgguaaagguauaggcaaaacgagcauaggucuuaucuguguaauagcgaguucagggauguuauggauggccgaaauaccguuacaauggauagcaucagccauagucuuggaguucuuuaugaugguauugcugaucccagaaccagaaaaacaaagaacaccgcaggacaaucagcuggcguacgugguuauuggaauacuaacauuagccgcaauaauagcagcaaacgaaauggguuugcuagagacaacaaaaagggauuuagguaugucuaaagaaccagggguaguaucacccaccuccuaccuugauguagaucuccacccagcaucugcguggacauuauaugccguggcaaccacggucauaacgccgauguugagacacacgauugaaaacucaacagcaaaugucucacuagcggcaaucgcaaaucaagcugugguauuaaugggauuggacaaaggguggccaaucuccaagauggaccuuggaguuccgcuauuagcacuuggaugcuacagucaggucaauccacuaaccuugacagcugcaguccuuuuauuaauaacccauuaugcgauuaucggaccgggccuucaagccaaagcaacucgagaagcccagaaacggacagccgccggcauaaugaaaaauccaacaguagacggaauaaugacaauagaucuagauccuguuauuuaugacucuaaguuugaaaaacagcuaggacaaguaaugcuauuaguguugugcgcuguacaauuauugcucaugcgaacgucaugggcauuaugcgaagcauugacauuggcgaccggaccuauaaccacgcuaugggagggaucaccagguaaauucuggaauacaacaauugcugugaguauggccaauauuuuucgcggaucuuauuuagcaggggcugguuuagcuuucucuaucaugaaaaguguugguacaggaaaaagggguaccggaagucaaggugaaacauuaggcgagaaauggaaaaagaaauugaaccaacugucaagaaaagacuuugaucuauacaagaaaucaggaauuaccgaaguagacaggaccgaagcaaaagagggccugaaaagaggagagaucacacaccacgcaguaagccgcggaucugcgaaacuacaaugguucgucgaaagaaacaugguuauuccugaagggaggguuauagaccuugggugugguagaggggguuggucauauuauugcgcugggcuaaagaaagugacggaggugagaggguauacaaaaggaggaccagggcacgaggagccaguuccuauguccacauauggauggaauauagugaaacugaugucagggaaagauguuuucuacuugccucccgaaaagugugauacuuugcuuugcgacaucggggaaucaucaccaucacccacaguugaagagucucgaacgauaagaguacucaaaaugguagagccauggcuaaagaauaaucaguuuuguauaaagguccuaaauccauacaugccaacgguaauagaacacuuagagagauuacaacgaaagcaugguggaauguuaguuagaaauccuuuaaguagaaauucaacacacgaaauguauuggauuucaaauggaacuggcaauauuguagcaagcgugaacauggucagccgacuguuauugaaccgauuuaccaugacucacaggagaccaaccauugaaaaagaugucgacuuaggggcugguacgaggcauguaaacgccgagcccgaaaccccgaauauggaugugauaggagaaagaauuaaaagaauaaaagaggaacauaauaguacuuggcacuacgaugacgaaaacccauauaaaacaugggcauaucacggcaguuacgaaguaaaagcaacaggaucugcaucaucaaugauuaacggaguaguaaaacugcuaacaaaaccuugggacgugguaccgauggucacccaaauggcaaugacagacacgaccccauuugggcagcaaagaguuuucaaagaaaaggucgauacucgaacaccaagaaguaugccagggacacgaaggguaauggguaucacugccgaguggcuuuggcggacucuaggcagaaacaagaagccacgucuguguacaagagaagaauuuaccaagaaaguucgaacaaaugcagcaaugggggcgguauucacagaagaaaaccaaugggacucugcaaaagcagcaguggaagaugaagauuucuggaagcuaguggaucgugagcgagaacuacacaaauuaggcaaaugugggagcuguguauacaauaugauggguaaaagggagaagaaacuaggggaguucgguaaagcgaaaggaaguagagcuaucugguacauguggcuuggcgcaagauauuuagaauuugaagcacucggauuucucaaugaagaucauugguucaguagggaaaacucuuauucgggcguagaaggggaaggccuacauaaacuuggguauauuuuacgugacauuucgaagauaccugguggagcuauguacgcagaugacacugcuggaugggauacgagaauaacugaagaugaccuacauaacgaagagaaaauuacccaacagauggauccugaacaucgccagcuggcaaaugcaauuuucaaguuaacauaccaaaacaaaguaguaaaaguucaaaggccgacacccacuggcacagugauggacauaaucucgcgaaaggaucaacgggguucaggacaagugggaacauauggauuaaauaccuuuacaaacauggaagcccaacuaauaaggcaaauggaaggcgaaggaguauuaucuaaggcagaccuagaaaauccucaucugccagagaagaaaauaacucaaugguuggagaccaaagguguagaacgccuaaaaagaauggcaauuucaggugaugauuguguagugaaacccauagacgacagauucgcaaaugcccugcucgcgcuaaaugauaugggaaaaguaagaaaagauauaccucaauggcaacccagcaaaggauggcaugacuggcaacaaguaccuuuuuguucucaucauuuccacgaauuaaucaugaaagaugggcguaaacuuguggugccaugccggccccaggaugaacuaauuggaagggcuaggauuucucagggcgcgggauggaguuuaaaggaaacggccuguuugggcaaagccuaugcucaaauguggucucuaauguauuuucacagaagagaucucagguuagcgucaaaugcaauaugcucggcaguuccgguacacuggguaccaaccucaagaacaaccuggaguauacaugcccaucaucaauggaugacaaccgaggauauguuaaccguguggaaccgcguauggauagaagacaaucccuggauggaagauaaaacaccagucacaacgugggaaaacguaccauaccuaggcaaaagagaagaccaauggugugguucgcuuauaggauuaacaucaagggcgacaugggcucaaaacauacccacagcaauacaacaaguacgcucauuaaucggaaaugaagaauuuuuagauuauaugccuaguaugaaacguuuuagaaaagaagaagagucugaaggggcgauaugguag

SEQ ID NO: 23172 - RNA, 9873 nt, Artificial Sequence
  derived and/or modified CDS sequence (opt6) from DENV-3__GQ199861__SS-prME
acuucccuaugcuugaugaugauacugccugcugcacuagccuuccaccuuaccucaagagauggagaaccacgcaugauagucggcaaaaacgaaagagguaaaagucugcuuuucaaaacugcaucggggauaaauauguguacuuuaaucgcuauggaucuaggugaaaugugugaugacacuguaacauauaaauguccgcauauuaccgaaguagaaccggaagacaucgauuguugguguaauuuaaccagcacuuggguuacauacgggacauguaaucaagccggggaacauagacgcgacaaacguucaguagcauuagcgccgcacguagguaugggauuagauacucgaacccaaacguggaugagugcagaaggugccuggaggcaaguggagaaaguagaaacaugggcucuaaggcacccaggauucacgauauuagcccuguuccuagcacacuauauagguacaaguuuaacacaaaaaguuguuaucuuuauucuuuuaauguuaguaacaccaucaaugaccaugagauguguaggcgugggaaacagagacuucguagaaggauuaucaggggcaacauggguugacguaguacuagaacacggaggaugugucacaacuauggcgaaaaauaaaccuacucucgacaucgagcuacagaaaacagaagcuacccaauuagcuacgcuuaggaaacuuugcaucgagggaaaaaucaccaauauaacaacugacagcagauguccaacacaaggugaagcuacguuaccagaggaacaagaucagaacuacguauguaaacauacuuacguggaucguggaugggggaacggguguggacuuuuuggcaaaggcucgcuaguaaccugugcgaaauuccagugcuuagagccaauugaaggaaaaguaguacaacaugaaaauuuaaaauacacuguuauuauaacuguacauaccggcgaccagcaucagguuggaaaugaaacacaagggguuacagcagaaauaacaccgcaagccuccacuacggaagcaaucuugccagaauauggcacucucggauuagaauguucacccagaacaggauuagacuucaaugagaugauccuacuaacgaugaaaaauaaagcauggaugguacacagacaaugguucuuugaccuacccuuaccguggacgagcggagccacuaccgaaacaccaaccuggaaucgaaaagaacucuugguuaccuuuaaaaaugcucaugcaaagaaacaagagguagucguauuagguucgcaggaaggagcgaugcacacugcauuaacuggagcaacggaaauucaaaauucgggugguacaaguaucuucgcaggacaucuaaaaugucguuuaaaaauggacaaauuagaacuuaaagggaugaguuacgccauguguacaaauacguuuguacuuaagaaagaaguaucugaaacccaacaugguacaaucuugaucaaaguagaguauaaaggagaagauguaccuuguaaaauaccauuuaguacagaagacggucaaggaaaagcucauaauggacgucugauuacagcuaauccuguggucacuaagaaagaagaaccgguaaauauagaagcggaacccccguuuggugagagcaauauaguuauagguaucggagauaacgcucucaaaauuaauugguauaagaaagguuccagcauaggaaaaauguucgaagcaacugcaagaggagcccgaagaauggcaauucuuggagauacagccugggacuucgguucaguaggagguguucuaaacucacuugggaagauggugcaucaaauauucgguuccgcuuacacagcuuuauuuucuggagucucaugggucaugaaaaucgggauuggcguacugcuuacuuggaucggacuuaauagcaagaacacuucuaugaguuucucguguauagcaauaggaaucauuacccuauauuuaggcgccguagugcaagcagauauggguugugugauaaacuggaaaggaaaagagcuaaaauguggcuccggcaucuuugugaccaacgaaguacauacguggacagaacaauauaaguuccaagcagacucaccgaaaagauuagccacugcuauagcaggagcgugggagaaugguguuuguggaauaaggucgacaacgagaauggaaaacuuacuauggaaacaaauagcaaaugaacucaauuacauuuuaugggaaaacaauaucaagcuaacgguuguaguaggagauauaaucggcguucucgaacaagguaaacgaacucucacgccacagccgauggaacuuaaguauucauggaaaacauggggaaaagcuaaaauuguuacugcggaaacucaaaauucuucauuuauaauugauggaccaaauacccccgaguguccaucuguaagccgagcauggaacguaugggaagucgaagauuacggauuuggagucuuuacuaccaauauauggcugaaauugagagaggucuacacgcagcuaugcgaccauagacugaugucagcagcagugaaagaugaacgggcaguccacgcggacauggguuauuggauugaaucacagaaaaaugguucguggaaacuggagaaggcuucacuuauugaaguuaagaccugcacauggccaaaaucgcauacgcuauggucaaauggaguauuagaauccgauaugauaaucccuaaaucauuagcaggaccaauaucacaacauaaucaucgaccgggauaccauacgcaaacggcaggcccguggcaucuaggcaaacuugaauuagauuuuaauuauugugaggguaccacuguuguaauuacagaaaacugugggacuaggggacccucacuuagaacuaccaccgucucaggcaagcuaauacacgaauggugcugucgaucgugcacacuuccgccacugagguauaugggggaagauggauguugguauggcauggagauaagaccaauaagugagaaagaagagaacaugguuaaaagccuuguaucugcuggaaguggaaaaguagauaauuucacuauggggguauuaugccucgcaauauuauuugaggaaguaaugagaggaaaauuuggaaagaaacacaugauugcggguguguucuuuacauuuguuuuacuucugucaggacaaauuacauggagagauauggcacauacccuuauaaugauagguuccaaugcaucagauagaaugggaauggguguuacauauuuagcguuaauugcgacauuuaagauucaaccauuucuagcacugggauucuuuuuaaggaaacuaacuucccgagagaauuuacugcuuggaguaggguuagcgauggcuacuacacuacaacuaccagaagauauagaacagauggcaaaugggauagcccuugguuuaauggcuuugaaacuuauaacacaauucgaaacuuaccaauuauggacagcauuaauuaguuuaaccugcucgaacacaauauuuacucugaccguggccuggcgaacugccacccuuauuuuagcaggaguaucccuauuaccgaugugucaaucaucgucuaugaggaaaacagauugguuaccgauggcuguggcagcgaugggugucccaccccuaccauuguuuauauuuucgcugaaagacacuuugaagcgucgaucguggccuuuaaacgaaggaguaauggcgguaggccuggucagcauacucgcaucuagcuugcuaagaaacgacguuccaauggcagggccauugguagcuggaggauuacugaucgcauguuacgugauuacuggcaccagugcagacuuaacugucgaaaaagcagcugacauaacuugggaagaggaagccgaacagacgggggugucucacaaucuuaugauuacaguagaugacgacgguacaaugagaaucaaagacgaugagacugaaaacauauuaacaguccuuuugaaaacugcguuacucaucguuucuggcauauuuccauacucuaucccggccacgcuucuaguuuggcauacauggcaaaaacaaacgcaacgaaguggcguucugugggacguaccgagcccaccagaaacacaaaaagcggaacuugaggaagggguuuacaggauuaaacaacaggguauauucggaaagacccaaguaggagucgguguacaaaaggagggcguauuucacacaauguggcacguuacgcguggugcagugcucacguacaauggaaaacgauuagaaccaaacugggccaaugugaagaaagauuuaauaagcuaugguggagguuggagacuuagugcucaauggcaaaaaggcgaagagguacaaguaauagcaguagaaccaggcaaaaaucccaaaaauuuccaaacuaugccuggaacuuuucaaacaaccacgggggaaauaggagcaaucgcacuagacuuuaaaccgggaaccucaggaucaccuauuauaaacagagagggaaagguggucggucuauaugguaauggaguugucacuaaaaauggggguuauguaucaggcauugcacaaacuaacgcugaaccagacggacccacgccagaauuagaagaagaaauguucaagaaaagaaacuuaacaauaauggaucugcacccagguucaggcaaaacccgaaaauaccuuccagcgauaguaagagaagcaauaaaaaggagauugagaacucuuauucuggcaccuaccagaguaguugcugccgagauggaagaagcauuaaaaggccucccgaucagauaccaaacuacagcaacaaagagugaacacacagguagggaaaucguagaccugaugugccacgcaacauuuacuaugcguuuguuaagcccuguacgugugccaaauuauaaucuaaucauuauggaugaagcucacuucacagauccagcuagcauagccgcgagaggguauauaucuacgagaguagguaugggagaagcggcagcaauuuucaugacagcuacaccaccggguacagccgaugcauuuccacaaucaaaugccccaauacaagacgaggagagggauaucccugaacggucuuggaacucuggaaacgaauggaucacagauuucgcaggaaaaacggucugguuuguaccaucuauuaaagcugggaacgauauugccaacugucuaaggaaaaauggaaagaaaguaauacaauuaucccgaaaaaccuucgacacagaguaccagaaaacuaaauuaaacgacugggauuuuguagucacgacggauauaagugagaugggugcgaauuuuaaagcggacagggucauugauccgaggagaugucuuaaacccgucaucuuaaccgacggaccagaaaggguaauucuagcgggcccaaugcccguuacggcagcaagcgcagcacagcgucgugggcgaguagguagaaacccgcaaaaggaaaaugaucaauauaucuuuacuggucaaccacuaaacaaugaugaagaucaugcucauuggacagaagcgaaaaugcuacucgacaauaucaauacaccagaaggcauuauaccagccuuauucgaaccagaacgcgaaaagagcgcagccaucgacggggaguacaggcuuaaaggagaaagcagaaaaacauucguagaauugaugagaagaggcgacuuacccguauggcuagcucacaaagucgcuucugaaggaauaaaauacacagaccguaaauggugcuuugauggacaacgcaacaaucagauacucgaggaaaauauggacguggaaaucuggacgaaagaaggagagaagaagaaauugcguccacgaugguuggaugcaagaacauauagugacccgcuagcucuaaaagaauuuaaagaauuugccgcugguagaaaaagcauagcguuagauuuagucacugaaauagggaggguaccaagucaucuugcccaccgaacccguaaugcacuugauaauuuagugaugcuacauacuucagaacauggcgguagagcauacagacaugcgguugaagaauugccugagacaauggaaacuuuacuuuuacugggucuaaugauacucuuaaccgguggcgcaauguuauuuuuaauuucagguaaagggauuggaaagacuucuauaggcuuaauauguguaauagcaucguccgguaugcucuggauggcagaaaucccguuacaauggauagcguccgcgaucguacuugaguucuuuaugaugguguuacugauaccagaaccugaaaaacaaaggacgccacaggauaaucaauuagcguauguuguaauagguauucuuacccuagccgcaauaauagcagcuaaugaaauggguuuacuagaaacuaccaaacgagaucuagggaugucgaaggaacccggcgugguaaguccuacuucguauuuagacgucgauuugcauccggcuucggcauggacccuguacgccguugccacuacgguuauaaccccaaugcuuagacauacaaucgaaaacucuacggcaaauguuucauuggcugccauagcuaaccaagcuguaguucuaaugggguuagacaagggguggcccaucuccaagauggauuuaggaguaccccuucuggcuuuagguuguuacucgcaaguaaauccucuuacucugacagcagcaguguuacuauugauuacacacuaugcaauaauaggcccaggacuacaagcuaaagcaacacgagaagcgcaaaaacgaacagcagcaggaauuaugaaaaacccgacaguggacggaaucaugacuauagaccuagauccaguaaucuaugacucuaaauucgaaaagcaauuaggucaagugaugcuauuaguauugugcgcuguucagcugcuuuugaugagaacaucaugggcucuuugcgaagcucuuacuuuggccacugguccgauuaccacacuaugggaaggaaguccaggcaaauuuuggaauacaacgauagcuguuagcauggccaacauauuuagaggcuccuaccuagccggugcugguuuggcguucuccauuaugaaguccguaggaaccggaaaaagggguacagguagucagggugaaacgcucggagaaaaguggaagaagaaacucaaucaauuaagucgaaaagacuucgacuuauauaagaaaaguggcauuaccgaaguagaucgaacagaagcaaaagaaggauuaaaacggggugagaucacucaccacgcggucagccgcggaagugcgaaauuacaaugguucguagaaagaaauaugguuauaccagaggguagaguaauagaucuuggaugcgggagaggaggaugguccuacuacugcgcaggcuuaaagaaagugacagaaguaagagguuauacaaaaggugggcccgggcaugaagaaccagugccgaugagcacauacggauggaauauaguuaaguuaaugaguggaaaagacguguuuuaccucccucccgaaaaaugcgacaccuuauuaugugacauaggugaaucuucuccaagcccaacaguugaagaaucaagaaccauacgagucuugaaaauggucgaaccguggcucaaaaauaaccaguuuugcauaaagguccuaaacccguauaugccuacggugauagaacacuuagagcgauugcaaagaaaacauggagguauguugguacguaauccauuaagccguaacucaacucaugagauguacuggauaagcaaugggaccgguaauaucgucgcgaguguaaacaugguuucaagguugcuucuuaacagauuuacaaugacucaucgaagaccuaccauugaaaaagauguugaucugggggcggguacaagacauguaaacgcugaaccagagacuccuaauauggauguuaucggggaaagaauaaaaaggauaaaagaagaacacaauucgacauggcauuaugaugaugagaauccauauaagacgugggccuaccacggaucguaugaaguaaaagcuacagguagugccaguucuaugauaaauggaguggugaaauuacucacuaaaccaugggacguuguuccuaugguaacgcagauggcgaugacugacacaacucccuuuggucaacaacguguauuuaaagaaaaaguugauacucggacaccaagaagcaugccaggaacaaggcgaguuauggguauaaccgcggaaugguuauggagaacuuugggucgaaacaagaaaccgagacuauguacucgagaagaauuuacgaaaaagguaaggacaaaugccgccaugggggcaguauucacggaagagaaucaaugggauuccgcaaaggcagcaguugaagacgaagauuuuuggaaauuaguugauagagaaagagaauugcauaaacucggaaagugugggaguuguguguauaacaugaugggcaagagagagaagaaauugggggaauuuggaaaagcaaagggcaguagagcuaucugguacaugugguugggagcaagauauuuagaauuugaagcgcucgguuucuuaaaugaggaucauugguucagcagagaaaacaguuauucaggcguagaaggugagggauugcacaagcuaggauacauauuacgcgauauaaguaagaucccggguggagccauguaugcagacgauacagcuggcugggacacaaggauuaccgaagaugaucuacacaaugaagagaagaucacucaacagauggacccagaacauagacaauuagcuaaugcaauuuuuaaauuaacuuaccaaaauaagguuguuaaaguucaaaggcccacgccaacaggaacaguaauggacauaauuucccguaaggaucaacgaggaaguggccaaguuggcacauaugggcuuaauacauucacuaauauggaagcgcagcuaauccggcagauggaaggugaagguguacugagcaaggcagauuuagagaauccucaucuacccgagaagaaaauuacccaaugguuggaaacaaaaggugucgaaagacucaaacgcauggcaaucaguggagacgauugcguagucaaaccaauagacgaccgguuugcgaacgcucuauuagcacuuaaugauauggggaaaguuaggaaagacauuccacaauggcagccgagcaaaggauggcaugauuggcaacaaguuccuuuuugcagccaucacuuccaugaacucauaaugaaagacgguaggaaacucgucguaccaugcaggccucaagacgaguuaauaggacgagcgcgcauaucacaaggagcagguuggagccuuaaagaaacugcuugccuuggaaaagcauacgcacaaauguggucccuaauguacuuucauagaagagauuuaagauuggcaucaaaugcuauauguuccgcaguaccugugcacugggucccuacaagucggacaacauggucaauacaugcccaccaucaguggaugacgacagaggauauguuaacuguauggaaucgagucuggauugaagauaauccauggauggaagauaagacaccagugacuacaugggaaaaugugccauauuuggguaaacgugaagaccagugguguggaucuuuaauugggcuaacaucaagagcaacuugggcacagaacauaccgacggcaauacaacaaguucguagucugauugggaaugaagaauuuuuagauuauaugccaucgaugaaacgguucaggaaagaagaagaaucagaaggcgcuauuugguga

SEQ ID NO: 23173 - RNA, 9873 nt, Artificial Sequence
  derived and/or modified CDS sequence (opt6) from DENV-3__GQ199862__SS-prME
acaucgcuguguuuaaugaugauucuacccgcagcacucgcguuccauuuaaccucccgugauggagaaccucggaugauagucgguaaaaaugaaagaggaaagagcuuguuauucaaaacugcaucgggaauuaauaugugcaccuuaauagcaauggaccuaggggaaaugugcgacgauaccguaaccuacaaaugcccacauauaacugaagucgaaccagaagacauagacuguuggugcaaucuaacaagcacuugggugacauacgguacuugcaaccaagcuggugaacaucggagggauaagcggucagucgcacucgcuccacacguggggaugggucucgauacuagaacacaaacguggaugagugcugaaggggcuuggcggcaaguugaaaaagucgaaacuugggcguuacgacaucccggauuuacuauauuagcauuguuucuagcacauuacauuggcacaucauuaacccaaaaaguagucauauucauacuucucauguugguuacacccaguaugaccaugcgcuguguaggagucggaaaccgagauuucguagaagguuugucaggagcgacauggguugaugucguguuagaacacggaggauguguuacaacgauggccaaaaacaaaccgacguuagacauugaacuccagaaaacagaagccacacaauuagcaacuuugagaaaacuguguauugaagguaaaaucacuaacauaacaaccgauucaagaugcccaacacaaggugaagcgacacugccugaagaacaagaccaaaacuauguauguaaacauacuuacguugacagaggauggggcaaugguugcggucuauuuggaaaagguucccucguaacaugugcaaaauuccaaugccuugaaccgaucgaagguaaaguaguucaguacgaaaaucugaaauauacagucaucauaacuguccacacuggagaccagcaucaaguuggaaaugaaacacaaggagucacugcagaaaucacuccucaggcgucgacuacugaagcaauccuaccugaauauggaacacuggguuuagaauguuccccucguacuggucucgacuucaaugagaugauacuacuaacaaugaaaaacaaagcauggaugguucaccgccagugguucuuugaccuucccuugccuuggaccagcggggcuacaacugaaacaccaaccuggaacaggaaagaacuucucgucacauuuaaaaaugcacaugccaagaaacaggaggugguagucuuaggaagccaagaaggagcaaugcauacggcacuuacaggugccacagaaauucaaaacucugguggaaccaguaucuuugccggacaccuaaaaugccgauugaaaauggauaaacuagagcugaaaggaauguccuacgcuauguguacaaauaccuuuguucugaagaaagaagugucggaaacccaacauggaacaauauuaauuaaaguugaguacaaaggcgaggacguuccauguaaaauuccauuuucuacagaagacggacagggcaaagcccacaacggccgucuuaucacagcuaauccgguaguaacuaagaaagaggaaccagucaauaucgaagccgaaccuccguuuggugagucgaauauagugauugggauaggagauaaugcucuuaaaauaaauugguauaagaaaggaagcagcaucggaaaaauguucgaagccacagcccgcggagcacgacguauggcaauccugggagauacagcaugggauuucgggucuguagggggaguacugaauaguuuaggcaaaauggugcaucagauauuuggaagugcguacaccgcccuguucaguggaguaaguuggguaaugaaaauagguauaggugucuuacuaaccuggauugggcuuaauucgaaaaauacgucaaugagcuucaguugcauagcaauaggaaucaucacuuuauaucuaggagccguaguucaagcggauauggggugcgucaucaacuggaaagggaaagagcugaaaugcgguagugggaucuucguaacaaaugagguucauacauggaccgagcaguauaaauuucaagcagauagcccgaaacgucuagccacagcaauagcaggggcaugggaaaacggcgugugcggaauaagaucaacaacgagaauggaaaaucucuuauggaaacaaauagccaacgaauugaauuacauauuaugggagaauaauauuaaauuaacaguaguaguuggagacauaauagguguucuagagcaaggcaaaagaaccuuaacgccccaaccuauggaacuuaaauacucuuggaaaacauggggaaaagcgaaaauaguaacggcagaaacacaaaauucuucauucauaauagaugguccaaauacaccagaauguccgucaguuuccagggcguggaauguaugggaggucgaagacuauggauuuggaguuuuuacuacuaauauuuggcuuaaacuccgggaaguuuauacacaacuuugugaccaucgauuaaugucggcugcugucaaagaugagcgugcugugcacgccgauauggguuacuggauugaaucacagaaaaacgggaguuggaaauuagaaaaagcgagccuaaucgaaguaaaaacuuguaccuggcccaaaagucauacguuauggucaaacgguguguuagagagcgacaugauaauucccaagagucuugcugguccuauaagucaacauaaucacagaccagguuaccauacucaaacugcugggcccuggcaucuagguaaauuagaauuagauuuuaauuacugcgagggaaccacaguaguaauuacugaaaacugugguaccagaggaccaucguuaagaaccacaaccgugucgggcaaauuaauacaugaaugguguugucggagcugcacacugccgccucuucguuacaugggggaagacggauguugguacggcauggagauaagaccaauuucggaaaaagaagaaaacaugguaaagucccuugugagugccggaagcgggaaaguggacaacuucacaaugggaguauuaugcuuagcuauauuauucgaagaagugaugcgaggaaaguucgguaagaaacacaugauagcaggaguauuuuucacguucguuuuacuccugaguggccaaaucacuuggagagauauggcgcauacucuuauaaugauugggaguaaugcgucagauaggaugggaaugggaguaacauaccuugcuuuaauagcuacguuuaaaauucaaccauuuuuagcguuaggauuuuucuugagaaaacuuacgucucgggaaaaucugcuacucggagucggguuagccauggcaaccacucuacaacuccccgaagauauugaacaaauggcaaacggaauagcauugggcuuaauggcccuaaaguuaauaacgcaauucgaaacauaucaacuuuggacugcacuuauaucacuuacuuguucaaauacaauauuuaccuuaacaguggcauggagaaccgcaacauuaauauuagcuggaguuaguuuacuacccgugugccaaaguagcucaaugcgaaaaacugauuggcuaccaauggccguagcagcaaugggaguaccaccauuaccacuguucauuuuuagccuaaaagacacacugaagcgccgcucuuggccacuaaaugaagggguaauggcaguggguuuaguguccauacucgcaucgucauuacuacgcaaugaugugccaauggccgguccccucguugcaggagggcuccuuaucgcuuguuaugugauaacaggaacgagugcugaccuuacgguagaaaaagcagcagauauaacuugggaagaggaagcggaacaaacuggaguuucacauaacuugaugauaacagucgaugaugauggaacuaugcgcauuaaagacgacgaaacagaaaauauucuaacagucuuacuaaagacugcucuauuaauaguaucugggaucuuuccauacucaaucccugcaacucuauugguuuggcauacauggcagaagcaaacacaacgaucaggcguccuaugggauguuccuaguccgcccgaaacucaaaaggcugagcuugaagaagguguauauagaauaaaacaacagggaauuuuaggcaaaacgcagguagguguaggagugcagaaagaaggagucuuucacacaauguggcauguaacgcgcggugcuguucugaccuacaacggcaaaagauuagaacccaacugggcuucagugaagaaagaccugaucuccuacggaggcggauggcgauuaagugcucaauggcaaaaaggagaagaaguucaggucauagcaguggagccaggcaaaaauccuaagaauuuucaaaccaugccaggaacguuucaaacuacaacuggugaaaucggagccaucgcauuagacuuuaaaccuggaacaagcggauccccgauuauaaaccgagagggaaaaguaguuggacuuuacgguaauggcgucguaaccaaaaacggaggauaugugaguggaaucgcgcaaacaaacgcggaacccgauggcccgacgccugaguuagaagaagagauguucaagaaacguaacuugacaaucauggaccugcacccugguaguggaaaaacccgaaaauaucucccggcaauuguaagagaagcaauuaaaagaagauuaagaacacuaauuuuagcaccaacacgagucguggcugcagaaauggaagaggcuuugaaaggauuaccaauuagguaucagacuacggcaacuaagagugaacauacuggaagagaaauuguugaccuaaugugccaugcuaccuucaccaugagacuacucucgccggugagaguaccuaauuauaacuuaauaaucauggacgaagcacauuuuacugacccugccuccauagccgcgagaggauacauuucaacaaggguaggaaugggggaagcggcagcgauauucaugacagccacacccccgggaacagcagacgcauucccacaaaguaaugcaccaauacaggacgaagaaagagacauucccgaaagauccuggaauaguggaaacgaauggauuacagauuucgcugggaagaccguaugguuuguuccaaguauuaaagccggaaacgacaucgccaacugcuugaggaaaaaugguaagaaaguuauccagcuaaguagaaaaacguuugacacugaguaccagaaaacuaagcuaaaugauugggacuuuguagugacaacagauauaagugaaaugggugcaaauuuuaaagccgauagggucauagauccaagaaggugucuuaaaccaguaauuuuaacggacggaccugaacgaguaauacuagccgguccaaugccagucaccgcagcaagcgcugcacaaagacgaggcaggguuggcaggaauccccaaaaggaaaaugaccaguacauauucacaggacaaccauugaacaaugacgaggaucaugcacauuggacagaggccaaaauguuauuggacaacauaaauacaccagaaggcauaauuccagcucuuuucgagcccgaaagagaaaaaucugccgcaaucgauggugaauaucgauuaaaaggagaaagccggaaaacauuuguugaauuaaugagacgaggagauuuaccgguuugguuagcgcacaaaguugcaucugaaggaauuaaguauacugacaggaaauggugcuuugacggccaaagaaauaaccaaauucuagaagagaauauggacguagaaauauggacuaaagaaggagagaagaagaaacuacggccgcgauggcuggaugcaagaaccuauucagauccucuagcacuuaaggaguucaaagaguucgcagcaggccgaaagucuauagcuuuagaccuagucaccgaaaucggcagaguacccagucauuuggcucaccgaacacgaaacgcuuuggacaacuuagugauguuacauaccagugaacaugggggccgagcuuauagacaugccguagaggaguuacccgagacuauggaaaccuuauuacuauuaggauuaaugauccuuuugacuggaggugcuaugcucuuuuugauuucggggaagggaauagggaagacuuccaucgguuuaauauguguuauagcauccucaggaaugcuauggauggcagaaauaccucuucaguggauugcgucagcuauugugcuggaauuuuucaugauggugcuucucauaccagaaccagaaaaacagcgcacuccccaagacaaucaacuggccuauguagugaucggaauacuaaccuuagcugcaauuauagcagcuaacgaaaugggucuguuagaaacuacuaaaagagaucucggaaugucaaaagagccaggaguagucucaccuaccucauauuuagacguagaucuacauccagccagugcauggacacucuaugcuguugcgacaacaguuauaacgccuaugcuuagacauacgauagaaaauaguacggccaacguaagccuugcugcuauagcgaaucaagcuguuguguuaaugggauuagauaaaggauggccgauaucaaaaauggacuuaggagucccacuauuagcuuuggggugcuauucucaagugaauccacuaacgcuaacagcagcaguacuccuacuaauaacucauuaugcuaucauuggcccuggcuuacaagcuaaagcaacaagagaagcucagaagagaacagcagccggcauuaugaaaaacccaacaguagacgguauaaugacuaucgaucucgacccaguaauuuaugauucgaaauuugaaaaacaacuaggccaggugauguuauuaguacucugugcuguccaacuacuacucaugcggacaaguugggcacuaugugaggcuuugacacuagcaaccgggccugucacaacucuaugggaggggucaccgggaaaauucuggaacacgacaauagcaguaaguauggcuaauauuuuccguggcucuuauuuagcgggagcgggcuuggcuuuuaguauuaugaagucagugggcacggguaagaggggaacaggcagucaaggggaaacuuuaggcgaaaaauggaagaagaaauuaaaucaacucagcagaaaagacuuugaccucuauaagaaaucgggaauaacagagguagaucggacagaagcuaaagagggauuaaaaagaggagagauaacacaccacgcuguaaguagggguucugccaaacuacagugguuuguugaaaggaauaugguuaucccggaaggccggguuauugaucuuggcuguggacguggaggguggucguacuacugcgccggacucaagaaaguuaccgagguccgcggauauaccaaagguggaccuggucaugaagaaccagucccgaugaguacauauggauggaacauaguaaaguugaugagcggaaaagaugucuuuuauuuaccgccagaaaaaugcgauacauuacuaugcgacauuggagagucuuccccaucucccacagucgaagaaucgagaacaauacgaguacuaaaaaugguagaacccuggcuuaaaaacaaucaguuuugcauaaaaguucucaauccguacaugcccacgguuaucgagcauuuggaacgccugcaacguaagcacggcggcauguuagugcguaauccguugaguagaaauucaacacaugaaauguacuggauuucaaacgggacagggaacauaguugcuuccguaaauauggucucucgucuccuauuaaaccguuuuacaaugacacauaggcgaccaacaauagaaaaggauguugauuuaggagcagguacacgacauguuaacgcagaaccagaaacgccuaacauggacgugauuggagaacguauuaaacgaauaaaggaggagcauaauuccaccuggcauuacgacgacgagaauccguauaaaacgugggcauaccacggaaguuacgagguuaaggcaacaggauccgcaucuucaaugauuaaugguguaguaaagcuacucacuaagccaugggacguagugcccaugguaacccaaauggcaaugacagacacgaccccguuuggacaacaaagaguauucaaagaaaaaguugacacaagaacaccacgcaguaugccuggaacaagaaggguuaugggcauuacugcugaauggcuauggcgaacucuuggaaggaauaagaaaccaagacuuuguacaagggaagaguucaccaagaaaguaaggacaaaugcagcaaugggugccguauucacagaagaaaaccaaugggauagugccaaagccgcuguggaggacgaagauuucuggaaacucguugaucgagaacgagaacugcacaaauuagggaaaugugguagcuguguuuauaacaugaugggcaaaagagagaagaaauuaggugaguucggaaaagcaaaagguaguagagcaaucugguauauguggcugggugccagguaucuggaauuugaagcacucggauuuuugaacgaggaucacugguucucuagagaaaauucauacucgggaguggagggugaaggcuuacauaaacuaggauauauauugcgagauauaucuaagauaccagggggagcaauguaugcggacgauacugcuggaugggauacuaggauaacagaagacgauuuacauaaugaagagaaaauuacgcaacaaauggacccagagcaccggcaacuggccaaugcgaucuuuaagcucacguaucagaacaagguagucaaaguacaaagaccaacccccaccggcacugucauggauauaaucaguagaaaagaucagagaggaucagggcaaguaggaacauauggacucaacacauuuaccaacauggaagcacaacuuauuagacaaauggagggcgaaggaguauuaucaaaagcagaccuagaaaacccacauuuaccagaaaagaaaauaacacaguggcuugaaacaaaaggaguagaaagacuuaaaagaauggcgauaucuggagaugauugcguaguaaaacccaucgacgauagguuugcuaacgcauuacuagccuugaaugauaugggaaaaguacgaaaagauauuccucaauggcaaccaagcaagggauggcacgauuggcaacaggugccauucuguucacaucacuuucaugaauugaucaugaaagauggcagaaaauuagucgucccaugccgaccacaagaugaauuaaucgggagagcuagaauuagucaaggagcaggaugguccuuaaaagaaacggcaugucuaggcaaagccuacgcacaaauguggucucuaauguauuuccaccgacgcgauuuacgacuggcaucaaacgcaaucugcucugcgguuccaguucacuggguaccaacuucucgaacaacauggagcauccaugcacaucaccaauggaugaccacggaggauauguuaacuguguggaacagggucuggauagaagauaaccccuggauggaagacaaaacuccaguuacaacaugggaaaauguuccauacuuaggaaagagagaggaucaguggugcggcagcuuaauuggccuaaccagucgagcuacaugggcucaaaacauaccgacugcuauucagcagguaaggaguuuaaucggaaaugaagaguuccuugacuacaugccgagcaugaaaagauuucgaaaagaagaagaaucagaaggcgcaauaugguaa

SEQ ID NO: 23174 - RNA, 9873 nt, Artificial Sequence
  derived and/or modified CDS sequence (opt6) from DENV-3__GQ199863__SS-prME
acuucccucuguuuaaugaugauauuaccugcggcauuggcauuucauuuaacuucaagggacggagaaccaaggaugauuguaggcaaaaaugaacgaggaaaaucccuacuguuuaaaacggcuucaggaauuaauauguguaccuuaaucgccauggaccugggggaaaugugcgacgauacgguuacauacaaauguccccauauaacagaaguagaaccggaagauauugacuguugguguaaucucacgaguacguggguuacguacgguacauguaaucaagcuggagagcaccgccgagacaaaagaagcguugcgcuggcuccccacguaggcaugggacuugacacccgcacccaaacuuggaugucggcagaaggcgccuggagacaaguggagaaaguagaaacaugggcauuacgacacccgggcuuuaccauacuggcauuguuuuuggcgcacuauauagggacuucgcuaacccaaaaagucguaauauucauacuuuuaauguuagugaccccuaguaugaccaugcguugcguaggaguuggcaauagagauuucguagaaggauugaguggggcaacauggguggauguaguauuagaacauggagguugugucacuacuauggcgaaaaauaaaccgacgcuggacaucgaacuacagaaaacggaagcaacucaacuagcaacacugcgaaaauuauguauagaagggaaaauaaccaacauaaccaccgauucucgcugcccuacucaaggggaggcaacacuacccgaagaacaagaccaaaacuauguguguaaacacaccuacguugaucgagguugggggaauggaugcggauuauucggaaaaggaaguuuagugacuugugcgaaauuucaaugccuggagccaauugaaggaaaaguaguacaauaugaaaaucuuaaauacacagugauuauuacaguccacacuggugaucaacaccaagucgguaaugagacucaaggaguuacggcagaaauuacuccacaagcaagcacgaccgaaguaaucuugcccgaguacggaacucucggcuuggaauguaguccaagaacuggacucgacuucaaugagaugauauuacuaaccaugaaaaacaaggcuuggauggugcaucgacaaugguucuucgacuuaccucugccauggacuucuggggcgacuacagagacaccaacuuggaauagaaaagaacucuuagucacauucaaaaacgcucaugccaagaaacaagaaguugugguauuagguucacaagagggugcaaugcauacggcuuugacuggagcaacagagauucaaaacucugguggaacaagcauauucgcaggacaucucaagugucgauuaaagauggauaaguuagaguuaaaggguauguccuaugcaauguguacuaauaccuuugugcugaagaaagaggugucugaaacccagcauggaacgauacugauaaaagucgaauauaagggagaagacguaccguguaaaauaccauuuucaacggaagauggacaaggaaaagcucacaauggccgcuuaauaacagcaaaccccguugucacaaagaaagaggaaccaguuaacauagaagccgagccacccuucggcgaaaguaacauuguuaucgguauaggugacaaugcgcuaaaaauaaacugguauaagaaaggcaguucuaucgguaaaauguuugaagcaaccgcacgcggggccagaagaauggcuauacuaggcgauacagccugggauuucgguucagucggaggaguucuaaauucucuuggaaaaaugguucaucaaauauuuggaucagcguacacagcuuuauucagcggcgucuccuggguuaugaaaauuggaauagguguauuacuaacauggauaggucuaaauucuaaaaacacaaguaugagcuuuagcuguaucgccauugguauuauuaccuuauauuuaggagcaguaguacaagcagauaugggcuguguuauuaauuggaaaggaaaagagcugaaaugcgggaguggaaucuucguaacaaacgaagugcacacauggaccgagcaauauaaauuccaagcggauaguccuaagcgacuggcaaccgcuauagcuggagcaugggaaaacggcguuugcgguauacguucaacaacccguauggaaaaccucuuguggaaacagauagcuaaugaauuaaauuacauucuuugggagaacaacauaaaacuaacgguaguaguaggcgacaucauaggaguccuggagcaaggcaaaagaacacuaacaccccaaccgauggaauuaaaauacucauggaaaacuuggggcaaggcaaaaauuguaaccgcagaaacgcaaaauagcucauucauaauugacggacccaauacaccggagugucccaguguaaguagagcuuggaacgucugggaaguagaggauuauggauuugguguuuuuacaacuaacauauggcugaaauuacgugaaguauacacacaacuuugcgaucacaggcuaaugucagcugcagugaaagacgagcgggcuguucaugccgauaugggauacuggauagaaagucagaaaaacgguucguggaaauuagagaaagccagcuuaauugaggucaaaacgugcacauggcccaaaucccauacucuauggagcaaugguguacuagagucugacaugaucauuccgaaaucacucgcaggaccuauuucucaacauaaccauaggccgggauaucacacacaaacggcgggaccauggcacuuagguaaguuagagcuagacuuuaauuacugcgaagggaccaccguuguaauaacagaaaacugcggcacaagaggaccaagccugcgaacuaccacaguuucugggaagcuaauucaugaaugguguuguagaagcugcacuuugccgccuuugagguacaugggugaagacgguuguugguacggaauggagauucguccaaucagugagaaagaagagaauaugguuaaaucucuaguuagcgcgggaaguggcaaagucgauaacuuuacaaugggaguauuaugucuggcgauucuauucgaagaaguuaugcgcggaaaauucggcaagaaacacaugauugcuggaguauucuuuaccuuuguuuuacuuuuaaguggacaaauuaccuggcgagacauggcgcauacgcuuauuaugauagguucaaaugcuagugauaggaugggaauggguguaacauaucuagcacuuauagcuacguuuaagauucagccauuuuuagcauuaggauucuuucuuaggaaguuaacaaguagagaaaacuuguuacuaggaguuggauuggcuauggcuacuacgcuacaauuaccagaagauauugagcaaauggcuaacggaauagcuuuaggauuaauggcguuaaaacuaauaacucaauucgagaccuaucaauuauggacugcacuaauaucccucacauguucuaauacaauauucaccuuaaccgucgcguggagaacugcgaccuuaaucuuggcgggagugaguuuauuaccagugugucagucuaguucaaugagaaaaaccgacugguugccaauggcggucgcggcgauggguguaccaccccugccuuuauuuauauuuucauuaaaagauacccucaaacgaagaaguuggccucuaaacgaaggcguaauggccguuggucucguuucaaucuuagcaucgucacuucugcgaaaugaugucccgauggcaggccccuuaguggcagggggacuauuaauagcauguuaugugauaacgggcacaagugccgauuuaacaguagaaaaagccgcagacauaaccugggaagaagaagcugaacaaacugguguuagccauaaccuaaugauuacaguugacgaugacgguacaaugagaaucaaagaugaugaaaccgaaaauauucuaacuguuuuacuaaaaaccgcacuacugaucguaucagggauuuuucccuauucuauuccagcaacccuuuuaguauggcauacguggcagaaacaaacucaaaggagcggcguucuaugggauguaccaucaccaccagaaacccaaaaggcagagcuagaggaaggcguauauaggaucaagcagcagggaauauucgggaaaacacaaguuggaguagggguacaaaaagagggaguauuucauacuauguggcacguaacucguggcgcuguccuuacauauaacggaaaaaggcucgaacccaauugggccagcgugaagaaggaccuaauauccuacggcggcggcuggagacucucugcccaauggcaaaaaggggaagaaguacaagugauugcagucgaaccagguaaaaacccuaaaaauuuccaaacuaugccaggaaccuuucaaaccacaacgggugaaauaggggcgauagcgcuugauuucaagccagggacguccgggaguccaauuauuaaucgagaaggcaaaguagugggauuauauggcaaugguguaguaacaaagaacgguggcuacguuucaggaaucgcacaaacaaacgcagagccggacggccccacuccggagcuagaagaagaaauguuuaagaaacguaaccuaacaauaauggaucuacacccaggaucgggaaaaacacgcaaauacuuaccugccauaguaagagaagcuaucaaaaggagauuacgaaccuugauccuagcaccaacgagaguuguggccgccgaaauggaagaggcgcuaaaaggacucccuauuagauaucagacaacagcgacaaagucggaacacacuggacgugaaauaguagauuuaaugugucacgccacguuuacaaugcgguuauugucaccaguacgagugccaaacuauaacuuaauuauuauggaugaagcgcauuucacugauccagcuucuaucgccgcuagaggauauauuuccacaagagucgggaugggugaagccgcagccauauucaugacugcuaccccaccagguaccgcugacgccuuuccucaaagcaaugcaccuauacaggaugaagaaagagacauaccugagagaagcuggaacucaggaaacgaauggaucacagauuuugcgggaaaaacaguuugguuugucccaucuauuaaagcugggaaugauauagcaaacuguuuacgcaaaaaugguaagaaaguaauccaacuaucuagaaagacguuugauacagaguaucagaaaacuaaacuuaacgauugggacuuuguagucacgacagauauaucagaaaugggugcaaauuucaaagccgacagaguuaucgacccaagaagauguuuaaaaccagucauucugacugauggcccagaaagagugauauuagcaggacccaugccaguuaccgcggcuuccgcagcacaacgaaggggaagaguaggacggaauccgcagaaagagaacgaucaauacauauucacaggacagccccuuaacaaugacgaagaccaugcucacuggaccgaagccaaaaugcuauuagauaauaucaacacuccagagggaaucaucccugcguuguucgaaccagaacgagagaaguccgccgcgauugacggggaguacagacuuaaaggggaaagucgaaaaacuuuuguagaguugaugaggcgaggggaccuuccaguuuggcuugcacauaaaguagcgagcgaagggauaaaauacacugaucgaaaauggugcuucgauggacaacgaaacaaccaaauauuagaagagaauauggauguagaaaucuggacuaaagaaggugagaagaagaaacuuaggcccagaugguuagaugcccggauauauagugacccucuagcguuaaaagaguucaaagaauuugcggcugggagaaaaagcauugcauuagaccuuguaaccgagauugguagagugccgucacaucuugcacacagaacucguaaugccuuagacaacuuaguuauguugcacacaagcgaacauggcggcagagcuuaucggcaugccgucgaagaguuaccagaaacaauggagacccuauuacuacuaggauuaaugauacuccuuacaggaggagcgauguuauuuuuaauaagcggaaagggaauuggaaaaaccucuaucggccucauaugugugauagccaguucggguaugcuuuggauggcugaaauucccuuacaauggauagcuucagccauaguccuggaauuuuucaugaugguacuguuaauaccugaaccagagaaacagagaaccccucaggacaaccaacuagcuuaugucgugauaggaaucuugacuuuggcagccauaaucgcugcaaaugagaugggacuucuugagacaacaaagcgggaucuagguauguccaaagaaccuggagugguaucuccgaccaguuaucuugacguagauuugcauccugccagugccuggacucuauaugcaguagcuaccaccgugauaacccccaugcugcgucauacaauagaaaauaguacugcuaauguauccuuagcagcaauagcuaaccaggccgugguauuaauggguuuagauaagggcuggcccauaagcaaaauggaccuuggugucccccuguuagcgcuuggaugcuacucacagguaaauccauuaacccuaacagcggccguucuucuauugauaacgcacuaugcuaucauuggcccugguuuacaggcaaaagcgacgcgagaagcacagaaaaggacagcagcaggaaucaugaagaauccaacuguagacggcauaaugacaaucgacuuggauccaguaauauaugauagcaaauucgagaaacaauuaggucaaguuaugcuacugguucuaugcgcaguucaacuacuauuaaugagaacgucgugggcuuugugugaagcguuaacccuugcuacaggcccaauaacaaccuugugggaagguucaccagguaaauucuggaauacuaccauagccgugucuauggcaaauaucuucagaggaucuuacuuagcaggcgccggccuagcuuucucaaucaugaaaucgguagggaccgggaagagagguacaggcagucaaggcgaaacauuaggagaaaaauggaagaagaaauugaaucaacuuaguagaaaagauuuugauuuauacaagaaauccgguauaacagaaguggaucgaacggaagcuaaagaaggauugaaacgaggugaaauaacacaucaugcaguauccaggggaagugcaaaguuacaaugguuuguagaaagaaauaugguaauacccgaaggccgcgucauagauuuaggcuguggccgaggcgguuggaguuacuacugcgcuggacuuaagaaaguuacugaaguacgagguuacacaaagggaggucccggccaugaagaaccaguuccaaugagcacauacggauggaacauaguaaagcuaaugagcggaaaagauguauuuuacuuaccaccagagaaaugugacacauuguugugugauauuggcgagagcucgccuagccccaccguagaagaaucacggaccauacgaguacuaaaaaugguugaacccugguuaaagaauaaccaauucuguauaaaaguauuaaaccccuacaugcccacaguaauagaacacuuagaaagacuucagagaaaacauggagggaugcugguacguaacccacuuagcagaaacucuacgcaugagauguacuggauaucaaauggcacagguaauauuguggccuccguaaacaugguaaguagacuuuuauuaaaucgguucacuaugacccauagaaggccaacuauagaaaaggauguagauuuaggagccggaacacgucauguaaaugcggaaccggaaacuccuaacauggauguaauuggugaacguauuaaacgcauaaaagaagaacauaauucuaccuggcacuaugacgaugagaauccauacaaaacaugggcguaccacggaagcuaugaaguuaaagccacuggcagcgcuaguucuaugauuaacggugugguuaaauuacuaacaaagccuugggacguagugccgaugguaacgcaaauggcuaugaccgacacuacacccuucggacaacagaggguauuuaaagagaaaguugauacaagaacaccgcgcagcaugccagguaccaggcgggugauggggauaacagcagaauggcuuuggcggacauuagggaggaauaagaagccaaggcuaugcacgcgugaagaauuuacuaagaaaguuaggaccaaugcagcaaugggagcuguauucaccgaagaaaaucagugggauucagcaaaggcugcaguggaagaugaagauuuuuggaaacuuguugauagagagcgugaauuacacaaacuuggaaaaugcggaucuuguguguacaauaugaugggaaaaagagagaagaaacuuggagaguucgguaaagcuaaaggcucaagggccauuugguauauguggcuuggcgcgagauaccuggaauuugaagcacugggcuuucuuaacgaagaucauugguucucuagagaaaacagcuauagcggaguggagggagaagggcuccauaaacuuggauauauucuuagagauauaaguaaaauaccagguggagcaauguacgccgaugacaccgcugguugggauacucggauaaccgaagaugaccugcauaaugaagaaaagauaacacaacaaauggauccagaacauaggcaauuagcuaacgcgaucuucaaguuaacguaucagaauaaaguaguuaaaguacagaggcccacgccaacuggcacgguaauggacauaauuucucggaaggaccaacggggauccggccaaguugggacuuauggacuaaacacauucacaaauauggaagcucaauuaauaaggcagauggaaggugagggagucuuaucaaaggcagauuuagagaauccacaucugccagagaagaaaaucacucaguggcuagaaacuaagggaguagaaagacuuaaaaggauggcaauuucaggagacgacugugucgugaaaccuauugaugacagauuugcaaaugcgcuauuagcuuuaaacgauaugggcaaaguacgaaaggauauaccucaauggcagccaucaaaagguuggcacgauuggcaacaaguuccauuuugcucacaucauuuucaugaacucauuaugaaggauggaaggaaauuaguaguccccugcagaccccaagaugaacuaauaggaagggccagaaucucacaaggugccggauggagucuaaaggaaacugccugcuuagggaaggcuuacgcacaaauguggagcuugauguauuuucacaggcgugauuuacguuuagcuucgaacgcaaucuguagcgcagugccaguacauuggguuccgaccucgagaacuacuuggaguauccaugcccaucaccaauggaugaccacugaagauauguuaacuguuuggaauagaguuuggaucgaagauaauccauggauggaagacaagacgccaguaacaaccugggaaaacgucccauauuuaggaaaacgugaggaucaguggugugguucauuaauuggccucacaucaagagcaacaugggcacaaaauauaccuacugcaauucagcagguccgaaguuugauagggaacgaagaguuccuugauuacaugccuucgaugaagagauucagaaaagaagaagaaagugaaggggcaauaugguga

SEQ ID NO: 23175 - RNA, 9873 nt, Artificial Sequence
  derived and/or modified CDS sequence (opt6) from DENV-3__GQ199864__SS-prME
acuagccuuugccuaaugaugauuuuaccagcagccuuagcuuuucaccuaacgaguagggacggugaaccacgaaugauaguagggaaaaacgaacgagggaaaagccuuuuauucaaaacagcaucagguaucaauaugugcacucuaauugcaauggauuugggggaaaugugugacgauacaguuacauauaaauguccacauaucacugaaguugaaccugaagauauugauugcuggugcaaccucacaucuacgugggugacuuacgggacauguaaucaagcaggagaacaucggcgcgauaaacgaucgguugcacuugcuccacauguagggaugggucuuaauaccaggacccaaacguggaugucggcagaaggugcauggaggcagguugaaaaaguggaaaccugggccuuacgacauccagguuuuacgaucuuagcacuauuuuuagcucauuauaucgggacgucucuaacacaaaaaguaguaaucuuuauacuacucaugcugguuacuccguccaugacgaugcgcuguguugguguuggaaaccgcgauuucgucgaaggucuauccggggcuacauggguggacguaguauuggaacacggagggugcguaacuaccauggcuaaaaacaaaccgacauuggacauagagcuacagaaaacggaggcgacccagcucgcgacauuacgaaaacuaugcauagagggaaaaauaacuaacauaaccacugauucaagguguccaacccaaggggaagccacucucccugaggaacaagaucaaaauuacguuugcaaacacacuuacguagauagaggaugggguaaugguuguggauuauuugggaaaggcucccugguaaccugcgccaaauuccaaugucuagaaccaauagaaggaaaaguaguccaacaugaaaaccuaaaauacacgguaauaauaacaguucacacaggggaccaacaccaagucggaaaugaaacucagggaguuacugcagagaucaccccacaagcaucaacaacugaggccaucuuaccagaauacggaacuuuaggcuuagaaugcaguccuagaacaggcuuagauuuuaaugagaugauccugcucacaaugaaaaacaaagccuggauggugcacagacaaugguucuuugacuuaccuuuaccauggacuucuggcgccacgacugagacuccaaccuggaaucgcaaagagcucuuaguaacauucaaaaaugcucacgccaagaaacaggaaguagucgugcucggaucacaagaaggugccaugcauacggcccuaacaggugcgacagaaauucaaaauucagguggcacaucaauauuugcaggccaucuaaaaugcagacucaaaauggauaaacuagagcuaaaaggaauguccuaugccaugugcacgaacacuuucguucuaaagaaagaagucucugaaacgcagcaugggaccauacuaaucaaaguagaguacaaaggugaagacgugcccuguaaaauaccauuuucaacugaggacggucagggcaaagcacauaacgguagacuuauuacagcaaauccgguagugacuaagaaagaagaaccaguaaauaucgaagcagaacccccauucggggaaucaaauauagugauagguaucggagacaacgcuuugaaaaucaacugguacaagaaaggaaguucaauugggaaaauguuugaagcaacagcuagaggagccagaaggauggcaauuuuaggugauacugcaugggacuuuggcagcguaggaggaguccugaacucacucgguaaaaugguacaucagauuuuugggucagcauauacagcguuauucagcgggguuucuuggguuaugaaaauaggaauaggggucuuacucacguggauaggacucaacaguaaaaacaccaguaugucauuuuccugcauugcuaucggaaucauaaccuuguaccuaggugccgucguacaagcagauaugggaugcgugauuaacuggaaaggcaaagaacuuaaaugugguagugguaucuuuguaacuaaugagguacauacauggaccgagcaauauaaauuucaagccgauagccccaaaagacuggcaaccgccauugcaggagcaugggaaaauggggucugcggaauacguuccacaacacguauggaaaauuuacuauggaagcaaauagcaaacgaacucaacuauauucuuugggaaaacaauauaaaauugaccguuguagucggcgacaucauaggaguguuagaacaagggaagaggacucuaacuccucaaccaauggagcuaaaauacagcuggaagacuuggggcaaagccaaaaucgucacggcggaaacacaaaacucgaguuuuauaauugacggcccgaacaccccagaauguccuuccgugucgcgagcauggaacguaugggaaguagaagacuaugguuuuggaguauuuacuacaaacauuuggcucaaacuccgugaaguguauacucaacucugcgaccacagauuaaugucagcugcgguaaaagaugaacgugcaguacaugcagauauggguuauuggauugaaucucaaaagaaugggaguuggaaguuggagaaagcaagucuaauugaagugaaaacguguacuuggcccaaaucacacacuuuauggucaaacggagugcuagaaucagacaugaucauaccaaaaagucuagcagguccuaucagucaacauaaucaucgaccaggauaccauacgcaaaccgcagggccauggcaccuggggaaacuagaacuggauuucaacuauugugagggaacaacaguagugauuacggaaaacugugggacuagaggcccuucguuacgaaccacgacugucagcggcaaacuuauacacgaguggugcuguagaaguugcaccuuaccuccacuacguuauaugggugaagaugguugcugguauggaauggaaauuagaccgauuucugaaaaggaagaaaauaugguaaaaucauuagucucugcagguagcgguaaaguugauaacuuuaccaucgguguacuaugucuagcaauucucuuugaagaggugaugcgaggcaaauucgguaagaaacauaugauagcuggcguauucuuuacauuugucuuauuguuguccggacaaaucacauggagagauauggcacauacauuaauuaugauaggaucuaaugccagcgaucggaugggcaugggaguaacauauuuagcacuaauagcaacauuuaagauucaaccauuucucgcguuggguuucuuuuuaaggaaacugacaucaagagaaaaucuccuuuuaggcguaggucuugcaauggcgacaacacuacaauuaccugaagauauagaacaaauggcaaacgguauagccuuggggcuuauggccuugaaacugauaacacaauuugaaaccuaccaacuuuggacagcucuuauaagccuuacauguuccaauacaauuuucacuuuaacggucgcuuggagaacagcuacucugaucuuagcuggaguuagucuauuaccagucugucaaagcaguaguaugcgaaaaacugacugguuacccauggcaguagcagcuauggguguaccgccuuuaccacucuucauauuuucccuuaaagauacccuuaaaagacgaucuuggccccugaaugaagguguuauggccguuggacuuguaucaauucuugcaaguagucuucuccggaacgaugugccaauggcagguccucucgucgcugggggauugcucauagcguguuaugucauaacgggaacgucagccgaucugacgguugaaaaagcugcugauaucaccugggaggaagaagccgaacagacaggcguaucucauaaucugaugauuacugucgaugaugauggaacaaugagaauaaaagacgaugagaccgagaauauauuaacaguguuauuaaaaacggcucuccucauagugucagggaucuuuccauauucaaucccugcaacacuauuagucuggcauacauggcaaaaacaaacacaacgauccggcguccugugggaugucccaaguccaccagaaacacaaaaggcagaauuagaagaggguguauaccgaaucaaacagcaggguauauucggcaaaacacaaguaggaguuggaguccagaaagaggggguguuccacacuauguggcauguaacucgaggagcgguccugacauauaauggaaaacggcucgaaccaaauugggcaagcgucaaaaaggaccuuaucucguauggaggaggcuggcggcuaagugcucaauggcaaaaaggagaggaaguccaaguaauagcaguagaaccaggcaaaaaucccaaaaacuuucaaaccaugcccgguacuuuucaaaccacuacuggggaaaucggcgcaauugcauuggacuucaagccgggcaccagcgguaguccgaucauaaaucgugaggguaaaguaguagguuuauaugguaacggcgugguuaccaaaaaugggggauacguaucaggcauugcccagacaaacgcagagccagacgggccaacaccagaauuagaagaagagauguucaagaaaagaaacuuaacaauaauggaucuucacccagggagcgguaaaaccaggaaauacuuaccagcgaucguccgcgaggccauaaagagacgucuaaggacgcucauucucgcacccacucgcguaguagccgcagaaauggaagaggcgcuaaaaggacugccuauccgguaucaaacaaccgccacaaagagcgaacauaccgguagagaaaucguggauuuaaugugccaugcaacauucaccaugcgcuuauuaucaccuguacgcguaccuaacuauaaucuaauaauuauggaugaagcacauuuuacggauccagcgucaaucgcugccagaggcuauauaucuaccagagucgggaugggagaagcagcagcaauuuucaugacggcgacuccuccagguacagcagaugcauucccacaaagcaacgcaccaauucaggacgaagaaagggacauuccagagagaucuuggaacucaggaaaugaguggauaaccgauuuugcagggaaaacagucugguucguaccaaguauaaaagcuggaaaugauauugcuaacugccuaaggaaaaacggaaagaaggugauccagcuaucaagaaaaacauuugacaccgaauaucagaaaacaaaacucaacgacugggacuucguagugacaacugauauaucagaaaugggugcaaacuuuaaagcagacagagugauagacccuaggaggugucuuaaaccaguaauacucacggauggucccgaaagggucauacuggcagguccaaugccuguaacggcagcaagugccgcgcaacguagagguagaguugggagaaacccucaaaaagagaaugaucaauauauauucacuggucaaccacuuaacaacgaugaggaucaugcacacuggacagaagcuaaaaugcuauuggacaacauuaauacaccugaagguauaauaccggcacucuuugagccugaacgagaaaaguccgccgcuauagacggugaauaccgucuaaaaggcgaaagucgcaaaaccuucguugaacuaaugcgacguggcgauuuaccugugugguuggcgcauaaaguggcaucagaggggaucaaguauacagauagaaagugguguuucgauggacagaggaacaaucaaaucuuagaagaaaauauggauguagaaauauggacuaaagaaggcgagaagaagaaauugaggccaagaugguuagaugcgaggacauacucagauccacuagcuuuaaaggaauuuaaggaauuugccgcaggccgcaaauccauugcguuagaccuuguaacugaaauaggacguguaccuucccaucucgcgcaucgaacuaggaacgcauuagacaacuuaguuaugcuucacaccucugagcacgggggacgagcuuacagacacgcgguagaagaauuaccagagacaauggaaaccuuacugcugcucggccuaaugauuuuauuaacgggaggagcgauguuauuuuuaauaucaggaaaagguaucgggaagacaucaauuggacuuauuuguguaauugcuagcagcggcaugcuauggauggcagaaauuccccuacaauggaucgcaucagcgauuguguuggaguuuuucaugaugguccuuuuaauuccagaacccgaaaagcagcgaacuccucaagauaaccaacuggcuuauguggucaucggcauacucacgcucgcggcaauaauugcagcgaaugaaaugggccuacuagagacaacgaagcgagacuuggguaugucaaaagagccagguguuguuucgccuacgagcuauuuagacguugauuuacauccagcaagugcauggacuuuguaugcaguggcuaccaccgucauaacacccauguuaagacauacuaucgagaacucuaccgccaacgugucauuagcagcaauagcuaaccaggcgguagucuuaaugggucucgacaaaggguggcccauuagcaaaauggauuuaggaguuccacuucuugcgcuaggauguuauagucaaguuaauccauuaacacucacagcugcggucuuacuacugauaacacauuaugcuauaauuggaccuggcuuacaagccaaagcaacuagagaggcacagaaaagaacugcugcaggaauaaugaagaacccgaccguugaugguauuaugacaauagaccucgaucccguuauuuacgauucuaaauuugaaaaacaacucggucaaguaaugcuucuaguauuaugcgcuguacaacuccuccuuaugcgaacaaguugggcauuaugcgaagcgcuaacucuugcuacugggccaauuaccacucuuugggaaggcaguccagguaaguucuggaauacaacaauagcagucucuauggcaaauaucuuucgaggaaguuauuuagcuggagcaggauuagcguuuaguauaaugaaauccguagguacgggcaaacguggaacaggcucccaaggagagacccucggagaaaaguggaagaagaaacugaaccaacuaucuagaaaagauuucgaucuuuauaagaaaucuggaaucaccgaagucgaccguacagaagcgaaggaaggccuaaaacggggugaaauaacgcaccacgcaguaucgcgaggcagcgcuaaacuacagugguuuguagaaagaaacaugguuauucccgaaggcaggguaauagaccugggauguggucggggaggcugguccuauuauugugcaggccucaagaaaguaacagaaguuaggggauauacaaaaggcgggcccggacacgaggaaccuguaccaaugucgaccuacgguuggaauauugucaaacucaugucgggaaaagacguauuuuauuugccaccugaaaagugugauacucuccuuugugacauuggcgagaguaguccuucacccacuguagaagaaucacgcaccauuagaguauugaaaaugguugaaccauggcuaaagaauaaucaguucuguaucaaaguauuaaauccguacaugccaacugugauagaacauuuagaaagacuacagcguaaacacggagggaugcucguacgcaacccacuguccagaaauucuacgcaugaaauguacuggaucagcaacgguacuggcaauauuguugccucaguuaacaugguaucuagacuguuacuaaaucgauuuacaaugacgcacaggcgaccgacuauagaaaaagacguagaccuaggagcaggcacuaggcauguuaacgcugagccggaaacccccaauauggauguaaucggcgaacgaauaaaaagaauaaaagaagaacacaauucaacuuggcauuacgaugaugaaaauccauauaaaacgugggcauaccauggcagcuacgaaguaaaagcgacaggguccgcaucuagcaugauuaaugguguugugaaacugcuuacaaaaccuugggacguaguccccaugguuacccaaauggcuaugaccgacacaacaccuuuuggacaacaaagaguauucaaagaaaaaguggacacucguacgccaaggagcaugccaggaacccgcagaguuaugggaauaacugccgaauggcuuuggcgaacauugggaagaaauaagaaaccgagguuaugcaccagagaagaauuuacaaagaaaguucgaacaaacgcggcuaugggcgcuguauuuaccgaagaaaaucaaugggauagcgcgaaagccgccguagaagacgaagacuuuuggaaacuuguugaucgugagcgagaacugcacaaacucgguaaaugugggaguugugucuauaacaugauggguaagagagagaagaaacuuggagaauuuggaaaagccaagggaagucgggcaauuugguauaugugguuaggagcgagauaucuagaauuugaggcccuaggauuccuaaacgaagaccacugguucagcagagagaacuccuauucuggaguggaaggagaaggauuacacaaacuagguuacauucuucgagacauuaguaagauaccaggaggagccauguacgcagacgauacagcugguugggauacuagaauaacggaagaugaucuccauaacgaagagaaaauaacacaacaaauggauccagaacaucgacaauuagcgaaugcaauuuuuaaauuaacuuaucaaaacaagguaguaaagguucaacgcccaacuccgacaggaacaguaauggauauaauuaguagaaaggaucaaagaggaaguggccaggucgguacauauggccuaaauacauuuacgaacauggaagcucaauuaaucaggcaaauggaaggggaggguguacucucgaaagcugaccuagaaaauccgcaccucccagagaagaaaauuacacaguggcuagagaccaaagggguugaacgacucaagagaauggccauaagcggagacgacuguguuguaaaaccuauugaugaucgauuugcgaacgcuuuauuagcucucaacgacaugggcaaagugaggaaagacaucccccaauggcagccaucuaaagguuggcacgacuggcaacaaguaccauucugcucccaccauuuccacgaguugauaaugaaggauggaagaaaacuugucguaccaugucgaccucaagaugaacuuauuggaagggcaagaaucagccaaggcgcugguuggaguuuaaaagaaacugccugccucgguaaggcauaugcacaaauguggucacucauguauuuucauaggcgugacuugcgguuagcaaguaaugcaauuuguucugcagucccagugcauugggucccuacaucuagaacuacguggucuauacacgcucaccaccaauggaugaccacagaagauauguuaacaguuuggaaucgugucuggaucgaagauaauccguggauggaagauaaaacaccuguaacaacaugggaaaaugucccauauuuggguaaacgugaagaucaauggugcggaaguuuaauaggccuaacgucacgggcaacaugggcucaaaacauucccacagcaauucaacaagugcgcaguuugauugguaaugaggaguuuuuagauuacaugccaagcaugaaacgauucaggaaagaagaggaaucagagggcgcgauuugguaa

SEQ ID NO: 23176 - RNA, 9873 nt, Artificial Sequence
  derived and/or modified CDS sequence (opt6) from DENV-3__GQ199865__SS-prME
acuagcuuaugucuaaugaugauucuucccgcggcacuagcuuuccaucuuacaagucgggauggggaaccuagaaugauaguagguaaaaaugaaagagggaaaucauuacucuucaaaacggcuagcggaauuaauauguguacacuaauagcaauggaucugggagaaaugugugacgacaccguaacguauaagugcccacauauuacagaagucgaaccggaagacauugauuguugguguaaccuaacuagcacaugggucacuuauggaaccugcaaccaagcgggugaacauagaagagacaaaagaucgguagcauuagcaccucauguggguaugggacucgacacgagaacucaaacauggaugagugcagaaggggcauggcggcaaguagaaaaaguagaaacaugggcacugaggcacccagguuucacaauauuagcauuauuuuuggcacacuacauaggaaccucacuaacucaaaaagucguuauauucauuuuacuaauguugguuaccccuuccaugaccaugcggugugugggggugggaaauagagacuucgucgaaggauuaagcggagcaacauggguagauguuguuuuggaacauggaggaugugugacaacgauggccaaaaacaaaccaacauuggauaucgaacuacagaaaacugaggcuacccaacuugcgacgcuuagaaaauuauguauugaagguaaaauuacaaauauaacaacugacagccggugucccacacaaggggaagcaacuuuaccagaagaacaagaucaaaacuacguuugcaaacauacauauguggauagaggcuggggcaacggaugcggauuauuugguaaggguagccuaguaaccugugcaaaauuccaauguuuagagccaauugaaggaaaaguaguacaacaugaaaacuugaaauacaccguaauaauaacuguacauacuggagaccaacaucaaguaggaaacgaaacccaaggaguuacugcugaaauaacuccacaggcaucaacaacagaagcaauacuuccagaguaugggacacuaggauuagaauguucaccacguacgggacuugacuucaaugaaaugauacuuuuaacaaugaaaaacaaagcauggaugguacaccgccaaugguucuucgauuuaccacuacccuggacaaguggcgcaacaacugaaacgcccacauggaauaggaaggaguuacuuguaacguuuaaaaacgcacaugccaagaaacaagaaguaguuguauuagguagccaagaaggcgcgaugcacaccgcuuuaacgggcgcaacagaaauacagaacucuggugguacaucaaucuucgcaggccauuuaaaauguagacuuaaaauggacaaacuagaacuaaaaggcaugucauacgccauguguacgaacacauucguacuuaaaaaggaaguuucugaaacacaacacggaaccauacugauuaaaguggaguauaaaggugaagauguucccuguaaaauucccuuuuccacagaagauggacagggaaaagcccauaaugggagauuaaucaccgcaaacccuguaguuacuaagaaggaagaaccggucaauaucgaagccgaaccaccauucggggaaaguaauauagugaucggaauaggggacaaugccuuaaagauaaacugguauaaaaagggaaguucgaucgggaagauguuugaggcgacugcaagaggggcacgaaggauggccauucuaggagauacggcaugggacuucggaagugugggaggcguucugaacucacuagggaaaaugguucaccaaauuuuugguucugcuuacaccgccuuauuuucaggcgucagcuggguaaugaagaucggaauuggcguucuuuugacauggauaggccuaaauagcaaaaauaccaguaugucauuuuccugcauagcgauaggaaucauuacuuuauaccuaggcgcaguaguacaagcggauaugggauguguaauuaacuggaaagggaaggagcuaaaaugcggaucggggauauuuguuacaaaugaaguccacacuuggacggagcaauauaaauuccaagcugauagucccaagagauuggcuacagcaaucgccggugcaugggaaaauggcgucuguggaauuaggucaacuaccagaauggaaaaucuucuauggaaacaaauagccaaugaauugaauuauauacugugggaaaacaacauuaaacuuacaguaguugugggugacaucauaggagucuuagaacaaggaaaaagaacgcuuacaccucaaccaauggaguuaaaauauucauggaaaacaugggguaaggcuaaaauaguaacagcggagacacaaaauaguucuuuuauuauugaugguccgaacacuccugaaugccccucaguuucacgugcuuggaacgugugggaagucgaagauuacgguuuugguguuuuuacuacgaauauuuggcuaaaacuacgggaaguauauacacaguugugugaucaucguuuaaugucugcagcggugaaagaugaacgcgcuguacacgcagauaugggauauuggauugagagucagaaaaaugguaguuggaaacuagagaaagcgucauuaauugaagucaaaacauguaccuggccuaaaagucauacucuguggucuaauggagucuuagagagcgauaugaucauccccaaaucuuuggcaggaccaaucucccaacauaaccacagaccaggauaccacacacaaacagcaggacccuggcaccuaggcaagcuggaacucgacuucaacuacugcgaaggcacaacugucguaauaacugaaaauugugggacuagagguccgucucuucgaaccacaacuguuucugggaagcuaauccaugaguggugcuguagaucguguaccuugccuccacuacgauauaugggggaggaugguugcugguauggaauggaaaucaggccaauuagcgaaaaagaggaaaauaugguaaaaucguuaguaagugcaggaucaggaaaaguugauaacuucacaauggguguuuuauguuuggcaauuuuguucgaagaaguaaugagagguaaauucggcaagaaacauaugauagcuggagucuuuuucacauucguauuacuauugucaggacagauaacauggagagacauggcucauacccucauaaugauugggucuaacgcgucugacagaaugggaaugggaguuaccuaccucgccuuaauagccacauuuaagauccagccuuucuuagcucuaggauuuuucuuaagaaaauuaacaucaagggaaaaccuuuuacugggugucggcuuagcuauggcaacaacauuacaauuaccagaagauauugaacaaauggcaaauggaaucgcacuagggcuaauggcucuaaaacuuauaacccaauuugaaaccuaucaauuauggaccgcccuaauaucacuaacauguucaaauacaauuuucacuuugacugucgcauggagaacagcaacauuaauccuagcuggaguuaguuuguugccgaugugucagaguucaucaaugcgaaaaacagacuggcuucccauggcgguugcagcuaugggagucccaccauuaccuuuguuuauauuuucauuaaaggauacuuuaaagaggagaucguggccauuaaacgaagguguaauggcuguaggccucguaaguauauuagcaaguagccuauugagaaaugacguuccaauggcuggcccucucgucgcgggaggcuuguuaauagcaugcuauguaauaacagggacauccgccgaucucacuguugaaaaagcggcagauauuacauggggcgaagaagcugaacaaacaggcgucucacacaugcuaaugauuacaguagaggaugacggcaccaugagaauaaaagacgacgagacggagaacauucucaccguauuauuaaaaacugcauuauugauugugagcggaauauucccuuacagcauaccggcgacucucuuagucuggcauacuuggcaaaagcagacgcaaaggagcgggguuuugugggauguuccaucuccacccgagacgcaaaaagcugaauuagaagaaggaguuuaccgcauaaaacaacaagggauauuugggaaaacucaggugggaguggggguacaaaaggaagggguguuccauacuauguggcacguuacuaggggcgcugugcuaacguauaacggaaagagacuagagccaaauugggccagugucaaaaaggaucuaauaaguuaugggggcgguuggagauuaagugcacaauggcaaaaaggagaagaggugcaaguaauugcuguagaaccuggcaaaaaucccaagaauuuucaaaccaugcccgggacuuuccaaacaacuacuggugaaauuggugcaauugcauuagacuuuaaaccgggaaccucaggaagucccauaauaaaucgggagggcaaaguaguugggcuauaugggaauggcgucgucacaaagaacgggggauauguaagcgguaucgcacaaacuaaugcggaaccugauggcccaacaccugagcuugaagaagagauguucaagaaaagaaaccuaacuauaauggaccuacacccaggaagugguaaaacaagaaaauaucuccccgccauagugcgugaagcaaucaaacggcguuuaagaacacucauccuagcaccgacgagaguugucgcggcagagauggaagaagccuuaaaaggacuaccaauuagguaucaaacaacugcaaccaaaagugaacacacagguagagaaaucguugaucuaaugugucacgcgaccuuuaccaugcgccucuugucaccaguacgaguaccuaacuacaauuuaaucauaauggacgaagcucauuuuacagauccugcauccaucgccgcuagagguuauauuaguacacgaguagguaugggagaggcagcagcaaucuuuaugacugcuaccccuccaggaacugccgacgcauucccucaaagcaaugcaccaauacaggaugaagaaagagauauuccggaacgaaguuggaacagugggaaugaauggauuacagacuucgcaggaaaaacgguaugguuugugccaucgauaaaagcagggaacgauauagcuaauugucucaggaaaaacggcaagaaagugauacaguuaucgcguaagaccuucgauaccgaauaucagaaaacuaaguuaaaugauugggauuucgucgugacaacggacauaucggaaaugggggcgaacuucaaagcugauaggguuauagauccccggcgguguuuaaagccggugauucuaacagauggaccugaacgaguuauuuuagcuggaccaaugccaguaacugccgcuagugcagcacagcgucguggacgaguuggaaggaauccacagaaagaaaacgaccaauauauauuuacaggacaaccgcuuaacaaugacgaagaucaugcacauuggacggaggcgaaaaugcuacuagacaacauaaauacuccagaaggaauuauaccagcacucuuugaaccagagcgagaaaaauccgcugccauagauggggaguacaggcuuaagggagaaagcagaaaaacuuucgucgaacuaaugcgaagaggagaucuaccagucuggcuagcgcauaagguggcaucagaaggaauuaaguacacagaccgaaaaugguguuuugauggacagcguaauaaucaaauacuagaagagaauauggacgucgaaaucuggacaaaagagggugaaaagaagaaacuaagaccucguuggcuagaugcucgcacuuauagugauccucuagcauugaaagaauuuaaagaguucgcagcggggaggaaaagcaucgcucucgaucuuguaacagaaauaggaagaguuccaucacacuuagcucauagaacacgaaaugcucuggacaauuuagugaugcuccauacgucggaacauggaggccgggcuuaccgucaugcugucgaagaacuuccugaaacaauggagacgcuauuacuauugggguugaugauuuuauugaccgguggggcgauguuauuuuugauauccgguaagggcauuggaaaaacaaguauugguuuaauaugcguaauugcaaguucaggaaugcuuuggauggcagagauaccacuacaguggauagcaucagcuauaguccuugaguucuucaugaugguacuccucauaccugaaccugaaaaacaaagaacuccgcaggacaaucaacuugccuauguaguuauugguauacuaacauuagcagcuauaaucgccgcaaaugagaugggccuauuagagacaacaaaacgugaucuugguaugucuaaggaaccuggaguuguaaguccgacaaguuacuuagaugucgaucugcaccccgcaagcgcauggacgcuauaugcagucgcaacaacugucauaacgcccauguugagacacacaauugaaaauucaaccgcaaaugugucauuagcagcaauugcaaaccaggcaguuguuuuaaugggccuagacaaaggguggccaauaaguaaaauggaucuaggaguuccccugcuagcauuagguuguuacagucaaguaaauccacugacccuaaccgcggcaguacuauuauugauuacacacuacgcuauaaucggacccggacuacaagcuaaagccacacgugaggcgcaaaagaggacagccgcgggaauaaugaaaaauccaacgguugacgggauaaugacuauagaucucgacccaguaauauaugauucgaaauuugaaaaacaacuuggccaaguuaugcuauuaguucugugugcuguucaacuauuacuuaugagaacuagcugggcauuaugugaagcccuuacacuagcaacuggacccauuacuacauuaugggaaggcaguccagguaaauucuggaauacgacgauugccguaaguauggccaauauuuucagggguuccuaucuagcaggggccggauuagcguuuucgauaaugaaaagcgucggaacugguaaacgagggacaggaagccaaggugaaacguuaggagagaaguggaagaagaaacugaaucaacuuaguagaaaagacuuugacuuauacaaaaagucagggaucacugaaguggauagaacugaagcuaaagaaggauugaaacggggcgaaauuacucaccaugccgugucaagaggcucugcaaaauuacaaugguuuguagagcgaaacaugguaauuccggagggaagagucauugaucugggaugcgguagaggaggauggagcuauuauugugcugguuugaagaaagucacagagguaagaggcuacacuaaaggcggaccgggacaugaagaaccuguaccaaugaguacauauggguggaacauuguaaaacuuaugucuggaaaggauguuuucuaucucccgccugaaaaaugcgacacucuuuuaugcgacauaggcgaaucaucuccaucacccacaguagaggaaagcagaacuauucgaguguuaaaaauggucgagcccugguugaaaaacaaccaguucuguauuaagguccuaaauccauauaugccgacaguaauugagcauuuagaaagacuucaacggaaacauggaggaaugcuaguaagaaauccccugagcaggaacagcacacaugagauguacuggauuagcaacggcacaggaaacauagucgcuuccgucaacauggucagcagauugcuauuaaaccgauuuaccaugacccauaggagaccuacaauugaaaaagacguagaucucggggcuggaacacggcacgucaacgcagaaccugaaacaccuaauauggacguuaucggcgagagaauaaaaagaauaaaggaagaacauaacagcacuuggcacuacgaugacgaaaauccauauaagacaugggcauaucacgggaguuaugaaguuaaagcaacagguagcgcuucaaguaugauuaaugggguagucaaacuuuuaacaaagccaugggacguaguacccaugguaacacaaauggcaaugacagacaccacuccuuucggccaacaaagaguauuuaaagaaaaggucgauacgaggacaccaagaucgaugccagguacaagacgcguaaugggaauaacugcggaaugguuauggcgaacacuuggaaggaauaaaaagccacgcuuguguacaagagaagaguucacaaagaaggucagaacuaacgcugcaaugggugcaguauuuacggaagagaaucaaugggauucagcaaaagccgcaguagaggaugaggauuucuggaaacucguugaucgggaaagggaauugcacaaacuuggaaaguguggaucuugcguauauaacaugauggggaagagggagaagaaacuuggugaguucggaaaagcaaaaggaagcagagccauaugguacauguggcuuggugcacgauauuuagaguucgaggcccugggauuuuugaacgaagaucauugguucucuagagagaacucguauucuggugucgagggugaaggccugcauaaacuagguuacauuuuacgagauaucagcaaaauuccaggaggagcuauguacgcagacgauacagcagguugggacacucguaucacugaagaugauuuacacaacgaagaaaagauaacacagcaaauggacccugaacauaggcaauuggcaaaugcuauauuuaaacuaacauaucaaaauaaaguuguaaaaguccagaggcccaccccuacaggaacuguaauggauauaauaucuagaaaagaucaacgaggaaguggacagguaggaacguacggauuaaauacuuuuacaaacauggaagcacagcucauuaggcaaauggaaggggaagggguuuuaagcaaagccgaucuugaaaauccacauuuaccggagaagaaaauuacucagugguuggagacuaaagggguugagcgauuaaaaaggauggcaauaucaggugaugauugcgucgugaaaccaauagacgaucgguucgcaaaugcgcugcuggccuugaacgauaugggaaaaguccgaaaagauauaccucaauggcaaccaucuaaaggguggcacgacuggcaacaaguuccauucuguucccaucacuuucaugaacucauaaugaaagacgggcggaaauuaguaguaccaugcagaccccaagacgaauuaauaggccgagcuagaauaagucagggcgcuggcuggucucuuaaagaaaccgcauguuuggguaaggcuuacgcucaaauguggucucuaauguauuuccauagaagggaccuccgucuagccagcaaugcuaucuguagcgcgguaccaguacauuggguaccaacgagccgcacuacauggucaauacaugcacaucaccaauggaugacaacggaagacauguuaacgguauggaaccgaguauggauagaagacaacccguggauggaggacaaaacgccuguaacaacaugggaaaacguacccuacuuggguaaaagggaagaccaauggugugguagccuuaucggacuuacaucacgggcgacgugggcacaaaacauuccuacugccauacaacaagugagaucucuuaucgggaaugaggaauuuuuagauuauaugccuagcaugaaacgauucagaaaggaagaagaaucugaaggggccauaugguaa

SEQ ID NO: 23177 - RNA, 9873 nt, Artificial Sequence
  derived and/or modified CDS sequence (opt6) from DENV-3__GQ199870__SS-prME
acguccuuaugccuaaugaugauacuuccagcagcauuagcuuuucacuugacuagccgugacggagaaccuagaaugaucguaggcaaaaaugaaaggggaaaaucauuacuauuuaaaacagcaucaggaauaaacauguguacucuuauagcgauggaccuaggagaaaugugugaugacacggucacauacaaauguccccacauaacugaaguagaaccagaagacauugacuguuggugcaauuuaacaaguacauggguaacauacggcaccuguaaccaagcgggagaacaucgaagggauaaacggucaguagcucuagcuccgcacguugggaugggacuagacacuagaacgcaaaccuggaugagcgcagaaggagcuuggcgacaaguagaaaaaguagaaacuugggccuuacgucauccaggauuuacuauucuugcccucuuucuggcucauuacauuggaacaucucucacacaaaaagucguaauauucauacuccucaugcuaguaacaccaucaaugacuaugagaugcguaggugugggaaauagggauuucguagaaggauuaagcggugcaaccuggguugauguaguacuagaacauggaggaugcguaacaacuauggccaaaaauaaacccacuuuggauauagaauugcagaaaacagaagcaacucaauuagcaacauuacgcaaacuaugcauugaagguaaaauaacuaauauaacuacggacagccguugcccaacacaaggagaagccacccuaccagaagaacaggaucagaacuauguuugcaaacacacauacguggaucgcgguuggggaaacggaugcggauuguuuggaaaagguagccuuguaacaugcgcuaaauuucagugcuuagaacccauagaaggaaaaguaguucaguacgaaaauuuaaaauacacagucauaaucaccguucauacuggugaccaacaucaaguggggaacgaaacacaaggcguuacugcggaaauaacgccacaagcaaguacuacagaagcuauacuuccagaguacggcacucucgguuuagaaugcaguccaagaaccgguuuagauuuuaaugaaaugauauuauugacaaugaaaaauaaggcuuggauggugcauaggcaaugguuuuucgauuuaccuuuaccguggacuucgggugcuacaaccgagacaccgacauggaauagaaaggaacucuuaguaacauucaaaaacgcucaugcuaagaagcaagaaguuguaguccuagggucacaagaaggugcaaugcacacggcucuaacaggugcuacugaaauucaaaauucuggagggacaucaauauucgccggacaccuaaaauguagacuaaaaauggacaaacuugaauugaaaggcaugucauacgcaauguguaccaauacauucguacuaaagaaagaagugucagaaacccaacauggcacaauauuaauaaaaguggaauacaaaggcgaggaugugcccuguaaaauaccauucucuacggaagauggccaaggaaaagcucauaauggaagauugauaaccgccaacccagugguaaccaagaaagaagaaccuguaaauauugaagcugaaccgccuuuuggugagucaaacauuguaauagguauaggcgacaaugcacuaaaaauaaauugguacaagaagggaucuucaauugggaaaauguucgaagcaacagcccguggagcucgucguauggcuauauuaggggauacagcaugggacuuuggcucuguuggcgggguucuaaauuccuuggggaagaugguccaccagauauucggcucugccuauacugcguuguuuagugguguuaguuggguaaugaaaaucggcaucggaguucugcuaacauggauaggacuaaauucuaaaaauacgucaaugucauuuucaugcauagcuauaggaauuauuacauuguaucuaggcgcgguaguacaagcagauaugggaugcguuaucaauuggaaagggaaagaauuaaaaugugguucaggcauuuucgugacaaaugaagugcauacuuggacagagcaauauaaguuucaggcagacaguccaaaaagacuagccacagcuauugcaggagcuugggagaauggaguaugcggaauuagaaguacaacaagaauggagaauuugcuauggaaacaaauagcaaacgaauuaaacuauauucuuugggagaacaacauaaaacucacgguagugguaggagauaucaucggcguccuugagcagggaaaaagaaccuuaacaccacaaccaauggaauugaaauauucauggaagacguggggaaaggcaaaaaucgucacagcagagacgcaaaacagcucguucauuauagacggaccaaacacaccagagugccccuccguuucacgcgccuggaacgucugggaagucgaagauuauggguuuggcguauucacaacaaacauauggcucaaacuaagggaaguguauacgcagcuuugcgaucaucgcuugaugucagcugcgguuaaggaugagcgugcaguacacgcagauaugggauauuggauugaaagccagaagaaugguucguggaaacuugaaaaagcaucacuaauagaaguuaaaacaugcaccuggccaaagucccauaccuuauggaguaaugguguccuggagucagauaugauaaucccuaaaucauuagcaggaccuauuucucaacauaaccaucgaccuggguaccacacccaaaccgcgggaccauggcaucuaggaaaauuagaacuagacuucaacuauugugaggguacgacaguagucauaaccgaaaacugcggcacacggggccccucauuacgcaccacaacaguaucaggaaaacucauacacgaauggugcuguagaucgugcacucucccuccuuuacgauacaugggugaagauggaugcugguacggaauggaaauucguccaauaucagaaaaagaagaaaauaugguaaaaucacuuguaagugcaggcagcggcaaaguugauaacuuuacgaugggaguguuaugcuuggcaauuuuauuugaggaaguuaugagggguaaauuugguaaaaagcauaugauagccgguguauucuuuacuuuuguauuguuacuauccggacaaauaaccuggcgggauauggcucauacguuaauuaugauuggaucuaaugcgucagaucguaugggaaugggagucacauaccuggcauuaauugcaaccuuuaagauacagccauuuuuagcacugggcuucuuuuuaagaaaauuaaccaguagggaaaaucuccugcuggggguaggauuggcuauggcgacgacacuacaauuaccagaagauaucgaacaaauggccaacgggauugcuuugggccuuauggcacuaaaauuaauaacacaguuugagaccuaccaguuauggacagcgcuaaucaguuuaaccugcucuaauacaaucuuuacccuuacaguagccuggcgaacggcaacauuaauacuggcagggguaucacuacuaccgguaugucagaguaguucaaugaggaaaacagacugguugccuauggcaguagcugcaaugggugugccuccgcuaccccuuuuuauauucgguuugaaagauacguugaaacggcggucuuggccucuaaacgaagguguaauggccgucggcuuagugucaauacuggcaaguucucuuuugcgaaaugacgugcccauggcugggccauuaguggcaggaggucuacucauagcgugcuauguuauaacaggaacuucagccgauuugacuguugaaaaagcagcugauauuacaugggaggaagaagcagagcaaacaggcguaagucauaauuuaaugauaacaguggaugacgacggcacuaugaggauaaaagacgaugaaacggagaauaucuugacaguacucuuaaagacagcuuuacugaucgugucaggaauauuuccauauaguauccccgccacgcuauugguuuggcauacauggcaaaaacaaacacagcgguccggaguacuuugggaugugccuucuccaccugaaacacaaaaagcagaauuagaggagggaguauacaggauaaaacaacaaggcauuuuugguaaaacacagguagguguggggguucaaaaagaagguguuuuccacaccauguggcauguaaccagaggagcgguuuuaacauauaauggaaagcgacuagaaccaaauugggcuucggucaagaaagacuuaauuaguuauggcggcggauggagacugagugcgcaguggcagaagggggaagagguucaggugauugccguagaacccggcaaaaaucccaaaaauuuucaaacaaugccagggaccuuucaaacgacaacaggggagauaggagcaauagcccuggauuucaaaccugguacaucgggaucaccuaucauaaacagagaaggaaagguggucggccuauaugggaacggagucguaacgaaaaacggcggauacguauccgguauagcacaaacaaacgccgaaccagaugguccaaccccggaguuagaagaagaaauguucaaaaagagaaacuuaacuauaauggaucuacauccaggaucaggaaaaacacguaaauauuuaccggcuauaguaagagaagcaauaaagcgacgcuugaggacgcuuauucuggcaccaacacgaguuguagccgccgagauggaggaagcguuaaaaggacucccaauaagguaccagacaaccgcaacgaaaagcgaacauacggggagggaaauuguagaucucaugugccacgcuacauucacaaugagauuauuaucuccaguuagagugccgaauuacaaccuuauaauaauggaugaagcacacuuuacggacccggcguccauagcagcucguggcuauauaagcacgcgaguaggcaugggcgaagccgcagcaauuuucaugacagcaacuccucccggaacagcagaugccuuuccgcagaguaacgccccuauacaggacgaagaacgugacauacccgaaaggaguuggaacucugguaacgaauggauaacagacuuugcuggaaaaacuguaugguucguuccaucaaucaaagcugggaaugacauagcaaauugccuaagaaagaacgggaagaagguuauucaauuaucccggaaaaccuuugauacugaauaucaaaagacuaaacuaaaugauugggauuuuguuguuacaacggacauaagcgagaugggcgccaacuuuaaagcggauagagucauagauccacggagaugccucaaaccaguuauacuaacagacgggccggaacguguuauauuggcagguccuaugccaguaacugcagcaucugcagcacaacguagagguagaguaggcaggaauccacaaaaagaaaacgaccaauauauuuucacgggacagccccuaaauaacgaugaagaucaugcgcauuggacagaagcuaaaauguuacucgacaauaucaacacacccgaagguaucauaccugcgcuuuuugagcccgaacgggagaaauccgcagcaauagauggugaauaucgacuuaagggggaaagccguaaaacguucgucgaacuuaugaggcguggcgauuuaccugugugguuagcacauaaggucgcgucggaaggcauaaaguauacagauagaaaguggugcuucgauggucaaagaaauaaccagauauuagaagaaaauauggacguugaaauuuggaccaaagaaggugagaaaaagaaacuccgaccucgauggcuggacgcgcgaacauacucagauccacuugcacuuaaagaauuuaaagaguucgcugcaggaaggaaaucaauagccuuagacuuaguuacagaaauaggaaggguaccaagucaucuagcgcaccgcacacguaacgcccucgauaacuugguaaugcugcacacaagugagcauggcgguagagcauauaggcaugcgguagaagaauuaccggagacaauggaaacgcuauuacuucucggauugaugauauuauugaccggaggagcgaugcuguuucuaauaucagguaaaggaauagggaaaacaagcauaggauugauuuguguuauagcuucuucaggaauguuauggauggcugaaaucccauugcaguggauagcuucugccauaguguuagaguucuucaugaugguauuacugauuccagaaccagaaaaacaaagaacaccccaagauaaccaguuagcguauguuguaauaggaauauugacucuggcagcgaucauagccgcaaaugaaaugggccuacuagaaacuacuaagagagaccuuggcaugagcaaggaaccaggaguaguaagucccacaaguuaccuugaugucgacuugcacccugcaagcgcguggacgcuuuaugcgguagccaccacaguuauaacgccgauguuaagacacacuauagaaaacucaacagcuaauguaucgcuagccgcuauagccaaucaagcaguugucuuaaugggccuugauaaaggauggccaauuucaaaaauggaucuggggguucccuuguuggcacuaggauguuauucgcaaguaaauccauuaacacugacggcagcgguacuucuucuaauaacacacuacgcaaucauaggaccuggacuacaggcaaaagcaacgcgagaagcacaaaagcguacagcagcuggaauuaugaaaaauccaacuguagacgguauaaugacaauagacuuagauccgguuauauaugauucuaaauuugagaaacaacugggucagguaaugcuucuaguucucugugcggugcaacuacugcucaugagaacaagcugggcauuaugcgaagcauugacgcuggccacuggaccaauuacaacauugugggaaggaaguccagggaaauuuuggaacacaacgauagcuguuagcauggcaaauauauuuagagguagcuauuuagcgggugcaggacuggccuucucaauuaugaaauccguugguacuggaaaaagaggaacgggaucucaaggcgaaacacuuggggaaaaauggaagaagaaauuaaaccaguuaucaagaaaagauuuugaccucuacaagaaaaguggcauaacagaaguagaucguacugaggcaaaagaaggauugaaacguggugaaauaacucaucacgcaguauccagagguucagcuaaauuacagugguucguggagcgcaauaugguaauaccagagggccgagugauagauuuaggcuguggcaggggcggauggaguuauuauugcgcaggguugaagaaagugacggaagugcgcggauauacgaaaggcgguccgggacaugaagaaccugugccaaugaguacauaugguuggaacauugucaaauuaaugagugggaaagauguauuuuaccugccaccagagaagugcgauacguuacuaugcgacauaggagaaucgagucccucuccaacagucgaagagucgagaaccauacgaguuuuaaaaaugguugagccuugguugaaaaacaaccaauuuuguauaaaaguacucaauccuuacaugccaaccgugauugaacacuuagaacguuuacagcgaaagcacgggggcaugcuuguucggaauccauugucaagaaacuccacgcaugaaaugaguuggauuagcaaugguacggguaauauuguugcuucaguaaauaugguuucucggcuauuauugaaccgcaguaccaugacacaucguagaccuacgauugagaaagaugucgaccucggugcuggaccccgacacguuaaugcagacccagagccaccgaauauggaugugauaggugaaaggauaaaacggguuaaggaagaacauaauuccacuuggcauuacgaugacgagaacccauacaaaacuugggcauaccauggauccuacgaggucaaagcaacagggucagcgucaucuaugauuaacggaguugugaagcuauuaacuaaaccgugggacguagucccaaugguaccacaaauggccaugacggacacaacacccuuuggccaacaaagagucuucaaggaaaagguugacacgaggacuccgcggucaauaccaggaacaagaagagugauggggauuacagcggaguggcuguggcgcacccuuggcagaaauaaaaagccacggcucugcacgagggaggaauuuaccaagaaaguucgaaccaaugcugcaaugggagcgguuuucacugaagaaaaucaaugggacucggcaaaagcugcugucgaagaugaagacuucuggaaauugguugaucgagaaagggaauuacacaaguuaggcaaaugcgguaguuguguauauaauaugaugggaaagagagagaagaaauuaggagaauuuggaaaagcgaaaggcagcagggcgaucugguauaugugguuaggugcgcguuaccucgaauuugaggcccuaggauuucuuaaugaagaccauugguuuagucgagagaacaguuauucagguguggaaggugaaggauuacauaaacuggguuauauucuacgugacaucucaaaaauuccgggcggagcaauguacgcggacgacacugcaggcugggacacacgaaucacagaggacgaucuacauaacgaagagaaaauaacucaacaaauggacccagaacauaggcaauuagcaaacgcaauuuuuaaacucacuuaucaaaauaaagugguaaaaguccagaggccuacgccgacagguacaguuauggauauuauaagucgcaaagaucaaaggggaucuggucaaguaggaaccuauggauuaaauacuuuuaccaauauggaagcgcagcugauccgacaaauggaaggugaggggguacugagcaaggcggaccuagaaaauccacauuuaccagagaagaaaauuacacaauggcuagaaacgaaaggaguagaaagacuaaaaagaauggcgaucagcggggaugacugcguuguaaagccaauugaugaucgauucgcgaacgcguugcuugcacuaaaugauaugggaaaaguaagaaaagacauaccccaauggcagccuucgaaaggcuggcaugacuggcaacaggucccauuuugcucacaucacuuucacgaacucauuaugaaggaugggagaaaguuagucguaccauguagaccucaggaugaauuaauuggucgagcaagaauuucucagggagcaggcuggucccuaaaagaaaccgcaugucuagggaaagcauaugcgcaaauguggucucucauguacuuucacaggcgcgaucuucggcucgcauccaacgcaauuuguagcgccguuccugugcauugggugcccacuucucggacuaccuggucaauucacgcccaccaccaauggaugaccacugaggauauguuaacaguuuggaacagggucuggaucgaagauaacccauggauggaagauaaaacacccguaacuacuugggaaaacgucccauacuuaggaaaacgcgaggaucaguggugcggaucuuuaauaggcuugacuucacgugcaaccugggcgcaaaauauaccaaccgcuauacaacaaguaaggaguuuaaucggaaaugaagaguuuuuagauuauaugccaucaaugaaaagauuccgaaaagaagaggaauccgagggugcuauuugguag

SEQ ID NO: 23178 - RNA, 9873 nt, Artificial Sequence
  derived and/or modified CDS sequence (opt6) from DENV-3__JF937630__SS-prME
acgagccugugcuuaaugaugauuuuacccgcugcccucgcuuuccacuugacaucaagagauggagaaccgaggaugauagucgguaaaaaugaaagaggaaaaucauugcuauucaaaacugccuccggaaucaauauguguaccuuaauagcaauggaucuaggugaaaugugugaugauacgguuacguauaaauguccgcacauaacggaaguggaaccagaagauaucgacuguugguguaauuuaacuucaaccuggguaacguacggaacguguaaccaagcaggagaacaucgaagagauaaacgaucaguagcacuggcaccacacguagguaugggguuggauacuagaacucaaacauggaugucugcagaaggggcauggagacaaguggaaaaaguugaaacgugggcuuugcgacacccugguuucacgauacuugcacuauuucuggcucacuacauagggacgagucucacacaaaaagugguaaucuuuauacuacuuaugcuuguuacgccgucuaugacuaugcguuguguggguguugggaacagagacuuuguagaagguuugaguggagccacguggguggacguaguacucgaacacggagguugcguaacuaccauggcuaaaaacaaaccuacacuggauauugaauugcagaaaacugaagccacacaacuggcaacacuaagaaaauuguguauagaagguaaaauuacuaauauuacaacagauuccagaugcccuacacaaggagaagcgaccuuaccggaagaacaagaucaaaauuacguauguaaacauacauauguugacaggggguggggcaacggaugcggauuguucggaaaaggaucguuagugacaugugcgaaauuucaaugcuuagaaccgauugaaggaaaggucguacaguaugaaaaccuaaaauacacaguuauuauaacaguacauacaggugaucaacaccaaguaggcaacgaaacccaaggcguaacugcagaaaucacaccacaagcaagcacuacagaagcuauuuugccugaauacggaacguuaggauuggaaugcagcccccguacgggauuagauuucaaugaaaugauuuuacuaacaaugaaaaauaaggccuggaugguacaccgucagugguucuuugaccugccguuaccguggacaagcggggcaacaacggaaacuccaacuuggaacagaaaagaauugcuaguaacuuuuaaaaaugcucaugccaagaaacaggaaguuguuguguugggaucucaagaaggugcuaugcacaccgcccuaacaggagcuacagaaauucaaaauucagggggcaccucgauuuuugcaggacacuuaaaauguagacuaaaaauggauaaacuggaauuaaagggaaugucuuaugccaugugcacuaaugccuuuguuuuaaagaaagaagugagugagacucaacacggcaccauauugauaaagguggaguauaaaggugaagacguacccuguaaaauaccauucucgacugaagauggacagggaaaagcucauaacggaagauugauaacugcaaauccaguugugacuaagaaagaggaaccagugaauaucgaagccgagccgcccuuuggagagucaaacaucgugauaggaauaggagauaaugcauuaaagauuaacugguacaagaaagguaguucaauagggaaaauguuugaagcgacagcaagaggggcaagaagaauggcaauuuugggagauaccgcuugggauuucgggucuguuggcgguguacuaaacaguuuagguaaaaugguacaucaaaucuuuggcucugccuauacagcguuauucucaggaguuaguuggguuaugaaaauugguauaggaguacuguugacuuggauuggguugaauaguaagaauacuagcaugucuuuuaguuguaucgcaauugguauaaucacauuauacuuaggugcuguuguucaagcggauaugggcugcguaauaaacuggaaaggaaaggaacucaaaugcggauccggaauauuuguaacgaacgaaguacauacuuggaccgaacaauauaaauuccaagcugacagcccgaaacgccuggccacggcuauagccggugcuugggaaaauggagugugcgguaucaggucaacgacuagaauggagaauuuacuauggaaacaaauugcaaaugaacuuaacuauauucucugggaaaauaauaucaagcugacaguuguaguuggggauaucaucggugugcuugaacagggcaaaagaacauuaacaccgcaaccaauggaauuaaaauauucguggaaaacauggggaaaagcaaagauuguuacugcagaaacacaaaauagcuccuucaucaucgacggcccaaauacacccgaauguccgaguguuucgcgugccuggaauguaugggagguagaggacuauggcuuugggguguucacaacuaacauuuggcuaaaacuaagagaaguuuauacccaacuuugcgaccauagacucaugagugcagccguaaaagaugagagagcuguacaugcagauaugggauacuggaucgagagucagaagaacgguucguggaaacuugaaaaggcaucccuaauagaagugaaaacauguacuuggccaaagucucacacucuuuggucaaauggcguccuugaaagugauaugauaauacccaaaucccuagcaggucccauaucacaacauaaccaucgaccuggcuaucauacacagacagcuggaccauggcauuuagguaaacuggaacuagacuucaauuacugugagggaacaacaguuguaauuacugagaauugcgggacacguggaccaucccuacggacuacaacaguaagcgggaaacucauacaugaaugguguuguagaucaugcacacuaccaccuuuaagguauaugggagaggauggcuguugguacgguauggaaauaagaccaaucagugaaaaagaagaaaauauggugaaaucacuggugagugcagggagcggcaaaguagauaacuuuacaaugggagugcucugucuagcaaucuuauuugaggagguaaugcguggaaaauuugguaagaaacacaugauugcugggguuuucuucacuuucguauuauuauuaucaggucagauuaccuggcgagacauggcacacacauugaucaugauagggucgaaugcaucggacagaauggguaugggaguaacauaucuugcauuaauugcuacauucaaaauccagccauuccuugcuuuaggcuucuuucugcggaagcuaaccaguagggaaaacuuauuacuagguguuggccuagcaauggcaacaacguuacaauugcccgaagauauagaacaaauggccaauggcaucgcgcuaggacuuauggcacugaaauugauaacccaguucgaaacauaucaguuguggaccgccuuaaucagucuaacuugcagcaacacaauauucacacuuacuguagcguggcgaaccgccacucuaauuuuggccggagugaguuugcugcccguuugucaaagcaguucgaugaggaaaacagauugguuaccgauggccguagcagcaauggguguuccuccguuaccccuauucaucuuuucacuuaaagacacauuaaaacgccgcagcuggccacuuaacgagggaguaauggcaguagguuuagugucaauucuagcaucaagccuacuacggaaugacguaccaauggccgguccuuuggucgcagggggauuacuaauagcgugcuacguuauaacugggacaagugcagaucuaacaguagaaaaagcggcugacauuacgugggaagaagaagcagaacaaacagguguaagucauaacuuaaugaucacaguggacgaugacggcacgaugcguauuaaagaugaugagacugaaaauauauuaacgguacuacugaaaacugcucuguuaaucguuucugguauauuuccauacucuauuccggcuacucuguugguguggcacacauggcaaaagcaaacucagcgcagcggugucuugugggacgugccgagcccaccugagacucaaaaagcagaacuagaggagggcgucuauagaauaaagcaacaagggauauuuggaaagacccaaguuggaguuggaguccaaaaagagggugucuuucauacaauguggcacguaacgagaggugcagucuugacauauaauggaaaaagacuugaaccuaacugggccucaguaaagaaagacuuaauuagcuacggaggaggguggcgucuaucagcccaauggcaaaaaggugaagaagugcaagucauagcaguagagccggggaagaacccgaaaaauuuucaaacgaugccagggacuuuccaaacgacaacuggggaaauuggugcgauagcgcuggauuuuaagccggggacaucgggaucaccaaucauaaauagggaaggaaaaguuguuggccuauacgguaacggaguaguaacuaaaaauggagguuaugugucagguauagcacagacgaaugcugaacccgauggcccgacaccagaacuagaagaagaaauguucaagaaacgaaauuugaccauaauggacuuacacccagggucgggaaaaacaagaaaguaccuuccggcaauaguacgagaagcaauaaagcguaggcugagaacuuugauccuagcgccaacuagaguaguagcugcagaaauggaagaagcauuaaaaggcuugccuauccgauaccagacaaccgcgacaaaaucagagcacacagguagagagauuguggacuugaugugucaugcaaccuucacaaugcgacugcuuagcccaguaagaguaccuaacuacaacuuaaucauaauggaugaggcucacuucacggacccugcaucaauagcggcucguggauauauaucgacaaggguuggaaugggggaagccgcagcaaucuucaugacggcgacaccacccgguaccgcugaugccuuuccccagaguaacgccccuauacaagaugaggagcgagauauaccagaacgcucauggaacucaggaaaugaauggauuaccgauuucgccggaaaaacggucugguucguccccucgauaaaagcgggaaaugacauagccaacugccuacguaagaauggcaagaaaguaauucaacugaguagaaaaacuuuugauacugaauaucagaaaacgaaacuaaacgacugggacuucguggugaccacggacauaucagaaaugggcgcuaauuuuaaagccgacagggugauagacccacgaaggugccucaagccggugauacuaacagacggaccggagagaguaauacuagcaggaccuaugccagugacagcugcuagcgcagcucaaagaaggggccgagucggucggaauccacagaaagagaaugaccaguacauauuuacaggccaaccgcuaaauaacgacgaagaccaugcgcauuggacagaagcuaaaaugcuucuugacaacauaaauaccccugaaggaauuauaccggcauuauuugaaccagaaagagagaaaagugcugccauagacggugaauaccgcuuaaaaggcgaaucaaggaaaacuuuuguugaauugaugcgucguggcgaccuaccuguauggcuugcacauaagguugcuucugaggggauuaaauauacggaucgaaagugguguuuugauggucaaaggaauaaccaaauuuuagaagagaauauggaugucgaaaucuggacaaaagaaggcgagaagaagaaacuaagaccgagauggcuagaugcccguacauacagugauccacuugcucuuaaagaauuuaaggaguucgccgcuggcagaaaaagcaucgcacuugaucuaguaacagaaauuggaagagucccuagucacuuagcucauaggacgaggaaugcacuagauaaccucguaaugcuucacacaagugaacauggagggagagcauacagacaugcgguugaagaguugccugaaacaauggagacgcuacuucuacucgggcuaaugauacuccuaacgggaggggcaauguuauuucuaauaucugguaaaggaauugguaaaaccaguauuggccugaucuguguaauugccagcagcggcauguuguggauggcagaaauuccacuacaauggauugcaucagcaauaguauuggaguucuuuaugaugguacuccugaucccugaaccugaaaaacaacgcacaccccaagauaaucaauuagcuuauguugugauaggaauacuaaccuuagccgcaauaauagcagccaaugagaugggccuuuuggaaacuaccaagcgugacuuaggaaugaguaaagaaccaggaguggucaguccaacaaguuauuuagauguagaucuacacccagcuagugcauggacauuauaugcggucgcuacaacaguaauuacaccaaugcuucgucacacuauagagaacucgaccgcaaaugucucuuuggcagcuauagccaaccaagcugucgugcuaaugggauuagacaaaggcuggccuaucuccaaaauggauuugggagucccauuguuggcccuugguuguuauucacaaguaaacccccuaacgcuaacggcagcgguuuuauuauuaauaacacacuaugcaaucaucgguccgggacuacaagcgaaagcaaccagagaagcacaaaagagaacagcagcaggcauaaugaaaaauccuacgguugacggcaucaugaccauagacuuagauccugucauuuaugauaguaaguucgaaaaacaacucggacaagucauguuauuaguccucugcgcuguucaauuacuuuuaaugcgcacaagcugggcucuaugugaggcuuuaacuuuagcaacggggcccauuacuacgcuuugggaaggguccccaggcaaauuuuggaauaccacuauagcaguuucaauggccaauaucuuucgagggucauacuuagcuggcgcgggacucgcuuucagcauaaugaagucuguaggaacuggaaagcggggaaccgggagucagggggagacgcuaggggaaaaauggaaaaagaaacugaaccaauuaucucgaaaagacuucgauuuauacaagaaaucaggaauaacugaaguagauaggacggaagcaaaagaaggacuuaaaagaggagaaauaacacaucacgcugugucacgaggaucagcaaaauuacaaugguucguagaacgaaauaugguaauaccggaaggaagaguaaucgaucuugguuguggcagaggggguuggucuuacuacugcgcuggauugaagaaagugacggaaguacgggguuauacgaaaggaggaccuggucaugaagaaccaguuccaaugagcaccuauggauggaacauaguaaaacuaaugucuggaaaagauguauucuauuuaccuccggaaaaaugcgacacguugcuaugugacaucggggaaaguucuccuucuccaaccguggaagaaucaagaacaauucggguauuaaaaaugguagaacccuggcucaaaaauaaccaguuuugcauaaaaguuuuaaauccuuauaugccgacuguuauagaacacuuagaaaggcuacaaagaaagcacggagggaugcuaguaagaaacccauuaucacgcaacucaacacacgaaauguacuggauaucaaauggcacaggaaauaucguagcgagcguaaauauggucucgagacugcuauugaaccgauucacaaugacacaucgacgucccacuauugaaaaagauguugacuuaggagccgggacaagacauguuaaugcagaacccgaaacuccaaauauggacgucauaggugaacgaauaaaacgaauaaaagaagaacauaauucaacuuggcauuaugaugacgagaacccauacaagacaugggcauaucacggaucauacgaagucaaagcgacagguucagccaguaguaugaucaacggaguuguuaaguugcuaacaaaaccaugggacguagugccaauggucacucaaauggcaaugacugacacaacgccauucggccaacaacguguuuucaaggagaaaguagacaccaggacaccuagaagcaugccuggaacgcggcgagucaugggaauuacugcggagugguuauggaggacacuagguagaaauaagaaaccacgauuauguacccgcgaagaguucaccaagaaaguccggacuaaugccgcgaugggagcaguuuucaccgaagaaaaccaaugggauagcgcaaaggcggcggucgaagaugaggacuuuuggaaacucguugauagagaacgggaacuucauaaacucgggaaaugugguagcuguguuuauaacaugauggggaaacgagagaagaaauuaggugaguucggaaaagcaaaaggaucucgcgcgauaugguacaugugguuaggagcuagguacuuagaguuugaagcauuaggauuucuaaaugaagaccacugguuuucacgagaaaauucauauucaggaguggaaggagaaggauuacauaaauugggauacauuuugagggauauaagcaagaucccgggcggcgcgauguaugcggaugauacugcaggaugggacacucggauuacagaagaugauuuacauaaugaggagaaaauaacacaacaaauggauccggaacauagacaacuggcuaacgccauuuucaaauugacuuaccaaaacaagguuguaaaagugcaacgaccuacucccacuggcacuguuauggacauaauaucuagaaaggaucaacgagguaguggacagguuggaacuuacggacugaacacauuuacaaacauggaagcacaauuaauuaggcaaauggagggagaaggugucuugucaaaagcggacuuagaaaauccacacuugcccgagaagaaaaucacccaaugguuagagacuaaaggaguagaaagacuaaagagaauggcgauuucaggugaugauugcguuguuaaaccuauugaugauagauucgcuaaugcauuacuagcgcuaaaugacaugggaaaaguacguaaggacauaccgcaauggcaacccucgaaggguuggcacgauuggcagcaaguaccuuucugcagucaucauuuucaugaguuaauaaugaaggauggucggaaacuuguuguaccauguagaccacaagaugagcugauagggcgggcaagaaucucucaaggcgcugguuggucuuuaaaggagacggccugccuugguaaggccuacgcucaaauguggucguuaauguauuuucaucgcagggaucucagguuagcaagcaacgcaauauguagcgcaguacccguacacugggugccgacaucgagaaccaccuggucaauacaugcacaucaucaguggaugacgaccgaagacauguugacgguauggaacaggguuuggauagaggauaauccuuggauggaggacaaaacgccuguaacaacaugggagaauguaccauacuugggaaagagagaagaucaauggugugggagccuaauaggauuaacgaguagagccacuugggcacagaauauaccuacagcuauucaacaaguaagaagccuaauuggaaacgaggaauuucuugauuacaugccuaguaugaaacguuuuagaaaggaagaagaaucagaaggcgcaauaugguaa

SEQ ID NO: 23179 - RNA, 9873 nt, Artificial Sequence
  derived and/or modified CDS sequence (opt6) from DENV-3__JN000936__SS-prME
acuucauuaugccugaugaugauacuaccggcggcacuagcauuucaucuaacaucucgggacggagaacccaggaugauuguaggcaaaaaugaaaggggaaaaagccuccuguuuaaaacagcgucaggaaucaacauguguacauugaucgcuauggaucuuggggaaaugugugacgauacuguuacauacaaauguccacacauuaccgaaguggaacccgaagauauugauuguuggugcaaucuaacgucgaccuggguuacauauggaacuugcaaccaagcaggagaacacaggcgcgauaaaagaagcguagcguuagcaccgcacguuggaaugggucuagauacuaggacacaaacuuggaugagugcagaaggggcauggcgacaagucgaaaaaguagaaaccugggcauuacgacacccaggauucacaauacuugcauuauuucucgcacacuauauaggaacaagucuaacacaaaaagucgucaucuucauacuacugauguuagugacucccaguaugacuaugcgguguguagggguugggaauagggauuuugucgaagggcuuaguggugcaacuuggguagacgucgugcuggaacacggagguugugugacaacaauggcuaaaaauaaaccaacucuagacauagaacuccagaaaacugaagccacacaacuagcaacuuuaagaaaauuaugcaucgaaggaaaaaucacgaauauaacaacugacagcagauguccuacacaaggggaagcuacauugccggaggaacaagaccaaaacuauguuugcaaacauacauauguggauaggggauggggcaacggauguggcuuauuugguaaaggcucucuaguuacuugugcuaaauuucaguguuuagaaccaauugaggggaaagugguucaauacgaaaaccugaaauauacaguuaucaucacgguacauacaggugaucaacaucagguuggcaacgagacacaaggggucacagcugagauaacuccacaagcaaguacgaccgaagcuaucuugccggaauaugggacauuagguuuggaauguucuccaagaaccggauuggauuucaacgaaaugauauuacugacgaugaaaaacaaggcuuggauggugcaccgacagugguucuuugaucuuccuuuaccuuggacuucuggagcuacuacugaaacucccacuuggaauagaaaagaacucuuaguaaccuuuaaaaacgcucaugcaaagaaacaagaagugguaguauuaggaucacaagaaggagcaaugcacaccgcuuuaacaggagcgacagaaauacaaaauucaggcggaacaucaauuuucgcaggccaccucaaaugucgccugaaaauggacaaacuagaauuaaaaggaaugagcuacgcaauguguaccaauacuuuuguguugaagaaagaagucuccgaaacucaacaugguacaaucuugauaaaaguagaguauaaaggggaagaugucccauguaaaauccccuuuaguaccgaagacggccaaggaaaagcccauaauggaagauuaauaacagcuaauccuguagucacaaagaaagaagaaccagucaacauagaggccgaaccaccuuucggagagaguaauauagucaucgggauaggagacaacgcguuaaaaaucaacugguauaagaaagguucuucuauagguaaaauguucgaagcgacggcuagaggcgcaagacgcauggcgauauuaggagauacggcaugggacuuuggcaguguaggcggaguauugaauagucuugguaaaauggugcaucaaaucuuugguucggcauauacagcccuuuucagugguguaucguggguaaugaaaaucgggauuggcgucuuauugacuuggauagguuuaaauagcaaaaauacuucaaugucauucucauguauagcuauagguauaauaacacuauaucuuggagcagugguacaggcugauaugggcuguguaauaaacuggaaagguaaagagcucaaaugcgggagugguauauuuguuacaaacgaaguucauacuuggacagagcaauauaaauuucaagcagacucaccgaaaagauuggccacagcaauugccggcgcuugggaaaacggaguauguggaauaaggucaacaacacgaauggaaaaccucuuguggaaacaaauugcaaaugaguuaaacuauauauuaugggaaaacaacaucaaacuaaccgugguggucggagauauaauugguguacucgaacaagguaaaaggacauuaacaccacagccuauggaauuaaaauauucauggaaaaccuggggaaaagcaaagaucgugacagcggaaacucaaaacuccucauucauuaucgauggaccuaauaccccugaguguccaucgguuucccgcgccuggaauguaugggaagucgaagacuauggcuuuggaguuuuuaccaccaacauuuggcuuaaauuacgggaaguuuauacucaacuuugugaucauagauuaaugucggcugcaguaaaagaugaacgugcaguacaugccgacaugggcuauuggauagaaucacagaaaaauggaucauggaaacuggagaaagcaucgcucaucgaaguuaaaacaugcacauggccaaagagccauacgcuauggucaaauggcguauuggaauccgacaugauaauaccaaaaucauuagcuggcccuaucucucaacacaaccacagacccgguuaccauacacagacggccggaccuuggcaucuggguaaacuugaacuagauuuuaacuacugcgaagguacaacaguuguuaucacugaaaauugcgguacaagaggaccaagucuacgaaccacgaccguuagugggaaauuaauucacgaauggugcuguagaaguugcacucugccacccuugcgauauaugggugaggauggauguugguaugggauggaaauuagaccaauaucggagaaagaggaaaacauggucaaaaguuuagugucagccggcucugguaaaguggauaacuucacaauggguguucuaugcuuagcuauucuguuugaagaaguaaugagagguaaauucggcaagaaacauaugauugccggugucguauucaccuuuguguuauugcuaagcggacagauuacuuggagagauauggcacacaccuuaauuaugauugggucaaacgcaucggaucgcauggggaugggugucacguacuuagcauuaauugcaacuuuuaaaauacaaccauucuuagcacucggauucuuucucagaaaauugaccucgcgagagaauuuauuauugggcgugggcuuagcaauggcaacgacucuacaauuaccugaagauauugaacaaauggcuaacggaauagcacuugggcuaauggcucuaaaauugauaacacaauucgaaauauaccaacuuuggacagcucuaauuucccuaacuuguaguaacacuauauuuacguuaacaguggcauggagaacagcuacgcugauucuggccggaguaucuuuacuaccuaugugccaaucaucaucuaugcgcaaaaccgacuggcuaccaauggccguagcagcuaugggaguuccaccccuaccucuguuuauauuuucacugaaggauacgcuaaaaaggcguagcuggccacugaacgaagggguuauggccguugguuugguaaguauauuagccaguucuuuauugcgaaaugaugugccgauggcugguccacucguagcugggggucuauuaauugcauguuaugucaucacugguacauccgcugaucuuacgguagaaaaagcugcugacauaacaugggaagaagaggcugagcagaccgguguuucacacaaucuuaugauaacaguagaugaugaugggacaaugcggauaaaagaugacgaaacagaaaauaucuuaacaguccugcuaaaaacugcucuacuuauaguuagugguaucuuucccuacucaauacccgcaacguuacucguuuggcacacuuggcaaaaacagacucaacgcucgggaguacucugggauguaccgaguccaccggaaacucaaaaagcugaacucgaggaaggaguuuaccggauaaagcaacaggguauauucgguaaaacucaagugggcgucggaguucaaaaagaaggaguauuucauacgauguggcacguuacccgaggugccguauugacuuacaauggcaagcgguuagagcccaauugggcaagugucaagaaagaucuuauaucauacggcggcggauggcgauuaagcgcucaguggcaaaagggagaagaaguacaaguuauagcgguagagccaggcaaaaauccaaagaauuuccaaacgaugccuggcacguuucaaacgacaacgggggagauaggcgcaauugcacuagacuucaaaccugguacuagcggcucaccaauaauaaacagggagggaaaaguaguaggcuuauaugggaacggagucguaaccaaaaauggagguuacguuagcggaaucgcucaaacuaaugcagaaccagauggcccaaccccagaauuggaagaagagauguucaagaaacgaaaccucacaauuauggauuuacacccagguagugguaaaacaagaaaauacuuaccagccauagucagagaagcaauaaaacgaagacuucguacguugauucucgcgccgacaagggucguagcagcagagauggaggaggcuuuaaaggguuugcccaucagauaucaaacaaccgcaacuaagucugaacauacaggaagggaaaucguagaccuuaugugccaugcaacguucacuaugagacuauuauccccuguuagaguaccaaacuauaauuugaucauaauggaugaagcacacuuuacugacccggcaucuauugcagcuagaggauacaucagcacgagaguagggaugggcgaagcugcagcuaucuucaugacagcgaccccaccugguacugcagaugcguucccacaauccaaugcuccuauccaagacgaagaacgagacauuccagaacguaguuggaacucaggcaacgaauggauaacggauuucgcagguaaaacuguuugguuuguaccaucuauuaaggcuggaaacgauauugcgaacugccuacggaagaaugguaagaagguuauucaguugucaagaaaaacauuugauaccgaguaucagaagacgaaauuaaaugauugggacuuugucguuacaacugauaucagugaaaugggagcgaacuucaaagccgaucguguuauagacccuaggcguuguuuaaaaccuguuauacucacggacggcccggaaagagugauccuugcaggcccuaugcccgucaccgcagcuucagcugcacaacgccgagggagaguggguagaaauccucagaaagagaaugaccaguacauauucacaggccagccacuuaauaacgacgaagaccaugcacauuggacagaagccaaaaugcuccuagauaauauuaacacgcccgaaggaaucauaccagcacuauucgaaccagaaagagaaaagucagccgcaauugacggagaauacagacuaaaaggggaaucaagaaaaacauucguggaguuaaugcgaagaggggacuuaccgguauggcuagcccauaaaguagccucugagggaauaaaguacaccgaucgaaaaugguguuuugacggacaaagaaauaaccaaauacuagaagaaaauauggaugucgaaauuuggacgaaagaaggagagaagaagaaacuacgcccgagaugguuagacgcuaggacguauagugacccucuugcccuuaaagaauuuaaagaauuugcugcaggaagaaaaaguauagcuuuagaucuuguaaccgaaauaggacgagugccaagucacuuggcccaucggacaagaaaugcuuuagacaaccuagucaugcuucacaccucggaacacggaggacgagcauaucggcaugccguggaggagcuaccugaaacaauggaaaccuugcuauuguuaggcuugaugauccugcugacugggggcgcgaugcuauucuuaaucucugguaaaggcauugguaaaacaaguauaggacuuauuugcguuauaaccaguucaggcaugcuguggauggccgaaaucccccugcaguggauagcgagugcaauuguucuugaguucuuuaugaugguacuuuuaauucccgaaccagaaaaacaaagaacaccccaagauaaccaacuagccuauguggugauugggauacuaacguuagcagcaauuauagccgcaaacgaaaugggucucuuagaaacaacuaaacgagaucuuggaaugucaaaagaaccgggaguggucucaccaacuuccuaucuagacguggaucuacaucccgcaagugccuggacguuauacgcugucgcaaccacaguuauaacgccuauguugcgucauaccauagagaacaguaccgcuaacguaucauuggcagccauugcuaaucaagcuguuguauugaugggacuagauaaaggauggccaauuagcaaaauggauuuaggaguaccauuauuagcauuaggaugcuacucucaaguaaauccacuuacacucaccgcugcaguccugcuauuaaucacgcacuaugcgauuauuggaccaggacuucaagccaaagcaacaagggaagcccagaaacggacagcagcagguauaaugaagaacccaacaguugaugguauuaugacgauagauuuagauccuguaaucuaugauucaaaauuugagaaacaauugggacaaguaauguuacuuguccuuugugcuguucaacuacuauuaaugagaacuucgugggcauugugcgaagcacuaacguuagccacaggaccuauaacaacgcuaugggaagggucaccagggaaauucuggaacacuaccauugcaguaagcauggccaauauauuucgcggcucuuauuuggcgggggcaggacuagcguuuucaaucaugaagucgguaggcacugggaaacguggaacaggcagccaaggcgaaacguugggugaaaaauggaaaaagaaacuuaaccaacuaucuaggaaagauuuugaucuuuacaagaaaucugguauaacagaaguagacaggaccgaagcaaaggagggcuugaaacggggugaaauuacacaccaugcgguaagccgcggaucagcuaaacuacagugguuuguagaacguaauaugguaauuccggagggaagaguaauagacuugggcugcggaagaggcgguuggucuuauuacugugcaggacucaagaaggucacagaggucaggggauauaccaaaggugggccaggacaugaggagccuguucccaugucaacguauggauggaauauaguuaaacuuaugagcgguaaagauguauucuauuuaccuccagaaaagugugacacauuacuuugcgauauaggggaaucgaguccauccccaacuguagaagagucccggacuauuagaguccuaaaaaugguggaacccuggcuaaagaauaaucaauuuuguaucaaaguguuaaauccguauaugcccacggugauugaacacuuggaaaggcuacaaagaaaacacggcgggaugcucguaagaaauccccugaguagaaauucaacacacgaaauguauuggauaaguaaugggacuggaaacauaguagcauccgucaacaugguaucacgauuauuauuaaauagguucacgaugacgcauagaaggccuacaauagaaaaagacguagaccuaggugcuggaacaaggcacguaaaugcggaaccagagacgccaaauauggacguuauaggugaaaggauuaaaaggauuaaagaagaacacaauucaacguggcauuaugaugacgagaauccauacaaaacgugggcguaccaugggucauaugaaguaaaggcaacaggaucagcaucauccaugauaaauggugugguaaagcucuuaacuaagccgugggauguaguuccgauggugacucagauggcaaugaccgauacaacgccuuuugggcagcaacgugucuucaaagaaaaaguagauacaaggacgccccguaguaugccaggaacccgaagaguaaugggaaucacugcugagugguuguggcguacuuugggucgaaauaagaaaccucgacuuugcacccgagaagaguucaccaagaaagugcgcacaaacgccgcaaugggugccguuuuuacagaggagaaccaaugggacagugccaaagccgcggucgaggaugaggauuuuuggaaauuagucgaucgagaacgagaacuacauaaacugggaaaaugugguagcuguguauauaauaugaugggcaaaagggagaagaaacuaggugaguuuggaaaagcuaaagguagcagagcgauuugguacauguggcuaggcgcaagauacuuggaauuugaagcucugggauuccucaacgaagaucauugguucucuagagaaaauuccuauagugguguagaaggugaaggacuacauaaacuuggguacauccuaagagauaucucaaaaauacccggaggagcaauguaugcugacgauacagcaggaugggacacgaggauaaccgaggaugacuuacacaaugaggagaaaauaacccaacagauggacccggaacacagacaacuugccaacgcaauuuucaaguugacauaccaaaauaaagucguuaaaguccaaagaccaacgccuaccggaacgguaauggauauuaucucgcgaaaagaucaaagggggucaggacagguuggaacuuacgggcuaaauacauuuacaaacauggaagcacaacuuaucagacagauggaaggugaaggaguucuaaguaaagcugauuuagaaaacccgcacuuaccugagaagaaaauaacccaauggcuugaaaccaagggaguagaaaggcugaaaagaauggcgauaucgggggaugauugcguaguuaagcccauugaugaucgguucgcgaacgcccuacucgcuuuaaacgauauggguaagguaaggaaagacaucccccaauggcaacccucaaaaggguggcaugauuggcaacaaguaccuuucugcucgcaccacuuucaugaacuuauaaugaaagauggucgaaagcuaguugucccuugcaggccacaagacgagcuaauagggcgugcccgcaucucacaaggugcgggcuggucauuaaaagaaacugcaugcuuggguaaagcguaugcacagauguggagucugauguacuuccacaggagagaucuaagacuugcuaguaaugcaaucuguucagcugugccaguucauuggguaccaaccucgcgaacaacguggucaauccaugcucaucaucaguggaugacaacagaugauauguuaaccguguggaauaggguauggauagaggacaauccuuggauggaggacaaaacuccuguaacaacuugggaaaauguccccuacuuagggaaacgagaagaucaguggugugggagucuuaucggucuuacaucaagagcaaccugggcacaaaauauuccuacugcuauucagcaaguaagaaguuuaauuggcaacgaagaguuccuagacuacaugccaagcaugaaaagauuuaggaaagaagaggaauccgaaggggcuauaugguaa

SEQ ID NO: 23180 - RNA, 9873 nt, Artificial Sequence
  derived and/or modified CDS sequence (opt6) from DENV-3__HQ541796__SS-prME
acaagucuauguuuaaugaugauauugccagcagcauuagcuuuccaccucaccagcagagauggagaaccacgaaugaucgugggcaaaaacgaacguggaaaauccuuacuuuucaaaacugcgagugggauaaacaugugcacgcuaauugcuauggauuugggagaaaugugcgaugacacuguaacuuauaaaugcccccauauaacggaaguagaaccagaagauaucgauuguuggugcaacuuaacaaguacauggguuacguacggaacuuguaaucaagccggcgaacacagaagagacaaaaggucgguagcacucgccccacauguuggaaugggacuugauaccagaacacaaacauggaugucagcggaaggcgcauggcgccaaguugagaaaguagaaacaugggcauuaaggcacccaggauucacuauacuagcauuguuucucgcucauuauauagguacaucacuuacucaaaaaguaguuauuuucauauuguuaauguuaguaacgccaucaaugaccaugagaugcgucgggguuggcaauagagauuuuguagaaggcuuauccggagcgacauggguagauguuguauuggaacacggcggaugcguuaccaccauggcgaaaaacaaaccgaccuuagauauagaauuacagaaaacagaagcuacgcaguuggcaacucucaggaaacuuuguaucgaagggaaaauuacgaauauaaccacagacucaagauguccgacccagggagaagcuacauuaccagaggaacaagaucaaaacuacgucuguaaacacacauacguagacagaggaugggguaauggcuguggacuuuucgguaaaggaucccuaguaacuugcgcaaaauuccaauguuuagaaccaauagaaggaaagguagugcaauacgaaaauuuaaaguacacgguaauaauaacaguacauacaggcgaccagcaccaaguagguaaugaaacccaaggagugacugcagagauuacaccccaagcaagcacgacagaagcaauccuacccgaauacgggacucugggauuagaguguagcccgcgcacgggcuuggacuuuaacgagaugauucuauugaccaugaaaaauaaggccuggauggugcacagacagugguucuuugacuuaccauuaccauggacauccggagcaacaacugaaacaccuaccuggaaccgaaaagaauugcuagucacuuuuaaaaaugcccacgcaaagaaacaggagguaguaguauugggaucacaggaaggcgcgaugcauaccgcucuuacuggugcaacagaaauccaaaacucggguggaaccucaauauuugcuggacauuuaaaguguagguugaaaauggacaaacuggaauugaaagguaugaguuaugcuaugugcacaaauacuuuuguucugaagaaggaaguaagcgaaacacaacaugggacaauccuaauaaagguugaguacaaaggcgaggacguaccauguaaaauaccuuucucaacagaagauggccagggaaaggcacauaacgggcgacuaauaacggccaacccaguaguaacgaagaaagaagaaccuguaaacauugaagccgaaccaccauuuggugagucaaacacuguuauagggauuggugauaacgccuugaagauuaauugguacaagaaagguaguaguauuggaaaaauguuugaggcuacagcacgcggugcuaggcgaauggcaauacuaggggauacugcaugggauuuuggcucagucggagggguccuuaauucacuaggaaagaugguccaucaaauauuugguucagcauauacugcucucuuuucaggaguaagcuggguuaugaaaauuggaauaggggucuuacugacuuggauaggacuuaauaguaagaauaccagcaugagcuuuaguuguaucgcuaucgggauaauaacauuauaucuaggcgcgguagugcaagcagauaugggauguguaauaaauuggaaaggcaaagaacucaaauguggcucugguauauucguaacaaacgagguacauacauggacugaacaguauaaguuucaagcggauucucccaagagguuggcaaccgcuaucgcaggagcaugggaaaauggaguaugcggaauccgaucuacgaccagaauggagaaccuauuguggaagcaaaucgcgaacgaauuaaauuauaucuuaugggagaauaauauuaaacuuacaguagugguaggugacauaauagguguucuggagcaaggaaagagaacucuaacaccacaaccaauggaguuaaaguauaguuggaaaacaugggguaaagcaaagauaguuacugcagaaacucaaaauuccuccuuuauaauagacggaccaaauacaccugaauguccuuccgucucgagagcauggaauguuugggaaguugaggauuauggguuuggcguguuuacaacaaauauaugguugaaacuaagggaaguauacacacaacugugcgaccaucgucuuauguccgcggcagugaaagacgaacgugcaguacacgcugacauggguuauuggauagaaucgcaaaagaaugguaguuggaaacucgaaaaagcaucucuuauagaggugaaaacguguacguggcccaaaucacauacuuuauggucaaaugguguauuagaaucagauaugauaauaccuaaaucgcucgcuggacccauaagccaacauaaucacagacccggauaucacacacaaaccgcgggaccguggcaccuagguaagcuagagcuagacuucaacuauugcgaaggaacuacaguuguaauuacugaaaacuguggaacgcgaggacccagcuuaagaacaacaacgguaucugggaaacuuauucaugagugguguugcaggucauguacucucccgccucuuagguauaugggcgaggauggauguugguaugguauggagauaagacccauuucggagaaagaagaaaauaugguaaagucauuagucucagcugguagcggcaagguggacaauuuuacaaugggaguauugugcuuagcgauccucuuugaagaagucaugcgggggaaauuuggaaagaaacauaugauugcggggguauucuuuaccuucguucuucuuuugucagggcagauuacguggagggauauggcucacacacucauaaugauuggauccaacgcuagugauagaauggguauggguguuacuuaccuagcacuaauagcaacuuuuaaaauccagccguuuuuagcccucggcuucuuucuccguaaauuaacgucucgugagaauuuacucuuaggcguaggguuagcuauggcgacaacacuacaauuacccgaggacauugagcaaauggcaaacgggauagcccugggucuaauggcacuaaaguuaauaacacaauuugaaacguaucaacuauggacugcgcuaaucucuuuaaccuguagcaauacuauauuuacacuaacugucgcauggaggacagccacccuaauuuuagccgguguuaguuuguugccgguuugccaaucuucuaguaugcggaagacagauuggcuaccaauggcuguugcugcuaugggaguuccaccguugccucuauuuauauucggccugaaggacacgcuaaaaagaagaucauggccacuaaacgaagguguaauggcagucgggcuaguuucaauacuagcuucaucacugcuacgaaacgauguuccaauggcagguccauuaguggccggaggacuuuuaauagccuguuacgucaucacagguacaagugcagauuuaacaguggaaaaagcugcagauauaacuugggaagaggaagcugaacaaacuggcguaagucauaauuugaugaucacaguagaugacgaugguaccaugagaauuaaagacgaugagaccgagaacauacuaaccguacuacugaaaacugcacuauuaauuguaucgggcaucuuuccguacucaauaccugcuacgcuucucguauggcacacguggcagaaacagacacaacgcagcggagucuuaugggacguuccaagcccacccgagacgcagaaagcggagcuagaggaagguguauaccgaauaaaacaacagggaauauuugguaaaacacaagucggagucgguguucaaaaagagggcguuuuccacaccauguggcacgugacgcguggagcaguacugacauauaaugguaaaaggcuagaaccgaacugggcaagugucaagaaagaccuaauaaguuaugguggcggguggagacuuucugcgcaauggcaaaaaggagaagaaguacaagucauagcaguggagcccggcaaaaacccuaaaaacuuccaaaccaugccagguacuuuccagacgacaacaggcgagauuggagcgauugcucucgacuucaaaccagguacaucaggaucaccaauuauuaacagggaaggcaagguaguggguuuguauggaaacggaguuguuaccaaaaaugguggcuauguaaguggaauagcgcaaacuaaugcagaaccugauggaccgacaccagaacuagaagaagagauguuuaaaaagcguaaucuuaccauaauggacuuacacccaggaucuggaaagacacguaaauaucuaccagcaaucguucgcgaagcgauaaaaaggcgucuccggacacugauuuuagcucccacaagaguuguugccgcggaaauggaggaagcauugaaggguuuacccauucgauaccagacuacugcaacuaaaagcgaacauaccggcagagagauugucgauuugaugugucaugcgacauucacaaugcgacuacugucacccguuagaguaccuaacuauaauuugauaauaauggacgaggcucauuucaccgauccggcaucgauugcggcgagagguuacauaagcacacgcguuggaaugggagaagcggcggcgauuuuuaugacagccacaccaccaggaacggcagacgccuuuccacaauccaacgccccgauacaagaugaagaacgcgauauacccgaaagauccuggaacucugguaaugaauggaucacggacuucgccgguaaaaccguaugguucguuccuucaauuaaagcaggaaaugacauagcaaauugucuuagaaagaacgggaaaaagguaauucaauuaaguagaaaaacguuugacacugaguaccagaaaaccaaguugaaugauugggauuuugucguaacgacagauauaucagaaaugggagcaaauuuuaaagccgaccgcguaauugacccaagacgaugucugaaacccguuauccuaacagaugggccugaaagaguuauuuuggccgguccuaugccagugacagcagcaagcgcagcacagcgacggggccguguaggucguaauccgcagaaggaaaaugaucaguauauuuucacugggcaaccucuaaacaaugacgaagaucacgcucauuggacggaagccaagauguugcuugauaauauaaacaccccagagggaauaauucccgcacuuuucgagccugaaagggaaaaaucggcugcgauagauggagaauauagacucaaaggggaaucgaggaaaacuuuuguugaauuaaugagaaggggagaccugacaguauggcuagcccacaaaguagcuucagaaggaauaaaguacacagaucggaaguggugcuucgauggucaaagaaacaaccagauauuagaagaaaacauggacguagaaauauggacaaaggaaggagagaagaagaaacuaagacccagaugguuagacgcgcgaacguacagugacccauuagcucugaaagaguucaaagaauuugcagccggacguaaaucuauugcauuagacuuagucacagaaauuggaagaguuccgucgcacuuggcacacaggacaagaaaugcauuagauaaucuaguuaugcuacauacaagugagcaugguggcagggcuuauagacacgcuguugaagaguugccagaaaccauggaaacucugcuauuauuaggacuuaugauucuucuaaccggaggagcaaugcuuuuucugauaagcggaaaggguauaggaaaaacaucaauagggcuaauuugugucauagcuaguagcggaauguuguggauggcugagauaccacugcaauggauagccagugcaauaguuuuagaguuuuucaugaugguccuuuuaauaccggagccugaaaaacagcgaacaccccaagacaaccaguuggcauacguaguaauagguauauuaacauuagcugcaaucauugcugcuaaugaaaugggacuauuggagacaacgaaaagggauuugggcaugagcaaggaaccuggcgucguuucaccuacuucguacuuagaugucgaucuacacccagcaagugcguggacgcuauacgcaguugcuacaacaguuauaacaccaauguuaaggcauacgauagagaauaguacggccaauguuagccuggcugcaauagcuaaccaagcugucguacucaugggacuagauaaaggcuggccaaucucaaaaauggacuuagggguuccuuuguuagcuuuaggauguuacagccaaguuaacccgcuaacgcuaacagcagccguauugcuauugauaacucauuaugcgauaauuggaccugguuuacaagcaaaagcaacccgcgaagcacagaaaagaacugcagcuggaauuaugaagaaucccacaguagaugguauaaugacaauagaccuagauccagugauauacgauaguaaguuugaaaaacaacucggucagguaaugcuauuaguacuaugugcugugcaauugcucuuaaugcgaacauccugggcauugugugaagcucuaacucuagcgacagguccaauaacuacccuaugggaaggcaguccaggaaaauuuuggaauaccaccauagcuguuaguauggcaaauauauuucgcggaucuuaucuggccggcgcuggucuugcauucaguauaaugaagucugugggaacaggaaaaagagguacaggaagucaaggcgaaacacuaggggaaaaauggaagaaaaagcuaaaccaacuuucucgaaaagacuuugaccuauacaaaaaguccgguauaacugagguugacagaaccgaggcuaaagaaggccuaaaaaggggagagauaacacaucaugcuguaucgagagguucugcaaaacugcagugguuuguugaaaggaauaugguaauuccugaaggccgcgucauagaccuaggauguggacgaggcggguggaguuauuauugcgcgggccuaaagaaaguuacugagguaagagguuauacaaagggaggcccaggacaugaggaaccgguaccaauguccacauauggauggaacauaguaaagcuaaugaguggaaaggacguauucuaucuaccaccggaaaagugugacacacuucuaugcgauauaggagaaaguucaccaucuccaacgguugaagaaaguagaacaaucagagucuuaaaaaugguagaaccaugguuaaagaacaaucaauuuuguauaaaagucuuaaauccguauaugccaacagucauugaacaccuagagagacuucaacgaaaacauggcggcauguuggucagaaauccuuuaagucggaacucgacacaugaaauguacuggauaagcaauggcacgggaaauauaguagccuccguaaauaugguuucacgacuccuauuaaauagauuuacuaugacacauagacgaccuacaauagagaaagauguagacuuaggugcagggacacgacacguaaacgcugagccugaaaccccuaacauggacgucauuggggaaagaauaaaaaggauaaaagaagaacauaauucgacauggcauuacgacgaugaaaacccauauaaaacuugggcauaucaugggucuuacgaaguaaaggccacgggaucugcuuccagcaugaucaacggaguaguaaagcuauuaaccaaaccaugggacguaguaccgaugguaacgcagauggcuaugacagauacaacaccauuuggacaacaacguguauuuaaagagaagguugauaccagaaccccaagaaguaugccggguacaagaagggucaugggaauaacagcagaguggcuuuggcgaaccuuagggaggaauaagaagccuagauuaugcaccagagaagaauuuaccaagaaaguucgaaccaaugcagcgaugggagcuguguucacagaagagaaccaaugggauuccgcuaaagcugcgguugaagacgaagauuuuuggaaauugguagauagagaaagagaauuacauaaacucggcaaaugcggaucgugcguauauaauaugaugggaaagcgagagaagaaacuaggagaauuugggaaggcuaagggauccagggcaaucugguauauguggcugggagcacgguaccuagaguuugaagcacuagguuuccuuaaugaagaucauugguucagucgcgaaaacucauauucgggaguugaaggugaaggucuacacaagcucgguuauaucuuacgagauauauccaaaauaccagguggagcuauguacgcagacgacacugcaggcugggauacaagaauaacagaggacgaucuucacaaugaagagaaaauaacacaacaaauggacccagaacauagacaacuagcuaaugccauauuuaaauuaacuuaccaaaauaaagugguuaaaguucagcguccaacuccaacaggaacuguaauggacaucauuucuaggaaggaucaacgcgguucuggccaaguagggacguauggacuaaauaccuucacaaacauggaagcccaguugauacgacaaauggaaggggaagggguauugaguaaggccgauuuagaaaacccacaccuucccgaaaagaagauaacacagugguuagaaaccaaaggaguagaaagacuaaaaaggauggcaaucucaggugaugauuguguaguuaaaccaauagacgaccgguuugcaaacgcguuacucgcccugaaugacaugggaaaggucagaaaagauauuccacaauggcaaccaucaaaaggauggcaugacuggcaacaaguaccauucugcucacaccauuuucaugaacuaauuaugaaggauggacgcaaacuuguaguccccugcagaccacaagacgaauuaauugguagggcgaggauuucccaaggagcagguuggucguuaaaagaaacggcuugucucgguaaggcauaugcccaaauguggucuuugauguauuuccauaggcgugaucuacguuuagccuccaaugcgaucugcuccgcaguuccaguacauuggguaccaaccucgcgaacaacuuggucuauacaugcacaccaucaauggaugacuaccgaggacaugcuuaccguauggaaucgaguuuggauagaggauaacccuuggauggaggacaaaacuccgguaacuacgugggaaaacguacccuauuuaggaaagcgagaagaccaaugguguggcucuuugauaggauuaacaucacgugcgacgugggcucagaacaucccaacugcaauucaacaaguccguucucuuauugguaacgaagaauuuuuagauuacaugccuuccaugaaacgauucagaaaagaagaggaaagugaaggagcuauaugguaa

SEQ ID NO: 23181 - RNA, 9873 nt, Artificial Sequence
  derived and/or modified CDS sequence (opt6) from DENV-3__HQ166034__SS-prME
acuucacuauguuugaugaugauccuaccagcugcacuugcuuuccauuuaacaagcagagacggagaaccaaggaugauaguugguaaaaaugaaagaggaaaaucccuacuguucaaaacugcaaguggaauuaauauguguacuuugaucgcuauggaccuuggagaaaugugcgacgacacagugacauacaaauguccucauauaaccgaaguggaaccugaagacauagacuguuggugcaauuuaacuucgacaugggucacuuauggaacuuguaaucaagccggagaacaucgaagagauaaaagaagcguggcauuagcaccucacgugggaaugggacuagacacaagaacccaaacauggaugucggcugaaggagcauggcgucagguugaaaaaguugaaacaugggcgcuaaggcacccugguuuuacaauucuagcucuauuuuuagcacauuauauugggacaucccuaacucaaaaagucgugauauuuauauuauuaaugcuaguaacacccaguaugacaaugcgguguguagguguagguaauagagauuucguagaaggccuuucuggggcaacuuggguggacguaguuuuggaacacggcggauguguaacaaccauggcgaaaaauaaaccuacacuggacauagaauuacagaaaacggaagcuacccaauuagcuacauuacguaaacuauguaucgaaggaaaaauaacuaauaucaccacagacagcagaugcccaacucagggugaagcaacguuaccugaagaacaagaccaaaauuacguguguaaacauacauauguugauagagguuggggcaauggaugcggauuauuugguaaagggagccuagugacaugugcgaaauuucaaugucuagaaccuauagagggaaaaguuguacaacaugaaaaucuuaaauauacgguaauaauaacaguucauacaggggaccaacaccaaguugggaacgaaacccaaggagucaccgcagagauuacgccccaagcauccacuacagaagcaauacuaccagaauacggcacucuaggauuagaaugcucuccuaggacagguuuggacuuuaaugagaugauacuauuaacuaugaaaaauaaggcuuggaugguacacagacaaugguucuuugauuuacccuugccauggacgucuggagcaacaacagaaacucccacguggaacagaaaagaauuacuuguaaccuucaaaaacgcucaugcuaagaaacaagagguggugguuuuggguucacaggaaggugcgaugcauaccgcacuuacuggcgcaacagaaauucaaaacucaggaggaacaaguaucuuugcuggacaccucaaauguagauuaaaaauggauaaguuagaacugaaagguaugaguuaugcgauguguacuaacaccuuuguacugaagaaagaagugucagaaacucaacaugguacgauauuaauuaaagucgaauauaaaggggaagaugucccguguaaaaucccuuucucgacagaggacggucagggcaaggcucauaaugggcgauuaauaacggcuaauccggucguaacgaagaaagaggaaccggucaauaucgaagcugagccaccauuuggugaaucaaauauugucauagggauuggggauaacgcacuaaagauaaauugguauaagaagggauccucaauaggaaaaauguuugaagcaacugcuagaggagcacgaagaauggcaauacuuggcgacacugcgugggacuuuggcagcguugguggcguuuugaauagucuagguaaaaugguccaucaaauauucggaucugcuuauaccgcucuguuuucgggggugucuugggucaugaaaauaggaaucggcguacuucugacuuggauuggacuaaauaguaaaaauaccucgaugucauucaguugcauagcuauaggaaucauaacucuauaucugggugcagugguucaagcagauaugggaugcguaauaaauuggaaggggaaagaacuuaaauguggcuccggaaucuucguaacaaacgaaguacacacuuggacugaacaauacaaauuccaagcggauucacccaagcgacuagcaaccgcaaucgccggugcaugggaaaacgggguauguggaauaagauccacgacacgaauggagaaucuacuguggaaacaaaucgcuaacgagcucaauuauauuuugugggaaaauaauauaaaacuaacggugguagugggcgacauuauuggcgugcuagaacaaggaaaaagaacuuuaacaccucaaccaauggaacuaaaauauucauggaaaacuuggggcaaggcaaaaauuguuacggcugagacacaaaauagcagcuuuauaauugaugguccaaauacaccagaguguccuaguguaucucgagcauggaacguuugggaaguagaggacuauggauuuggaguauucacgacaaauauaugguuaaagcuaagagaggucuacacacaauugugugaucauagacuuaugucggcagcagugaaggaugagagagccguacaugcagacaugggauauuggauagagagucaaaagaauggaucauggaaacuugaaaaagcgucacugauagaggugaaaaccuguacuuggccaaaaucucauacauuauggucuaacggcguacuugaaucugacaugauaauacccaagagucuagcugguccaauaucacaacauaaccauagaccaggcuaccauacucaaacagcaggaccauggcauuuaggcaaauuggaauuggauuuuaauuacugcgagggaacuacugucgugaucacagagaauugcggaacaagagguccgucuuuacgaacgacgaccgugagcgguaagcuaauccacgaauggugcuguagauccuguacacugccaccacuucgguacaugggcgaagacggguguugguauggaauggaaaucagaccaauauccgaaaaagaggaaaauauggucaaaagccucguuucggcuggaagugguaaaguagacaacuucacaaugggaguauuauguuuagccauucuuuucgaagaggucaugagagggaaauucggcaagaaacauaugauagcagggguauucuuuacuuuuguauuacuauuaucaggccaaauaacauggagagauauggcccacacccuuauaaugaucggcucaaaugcaucugauagaaugggcaugggcguaaccuacuuggcauuaaucgcgacauucaaaauacaaccauuuuuagccuuaggcuucuucuuaaggaaacugacaucacgagaaaacuuacuucuaggcguaggucuagcaauggcuacaacauugcaauuaccagaagauauugaacaaauggcaaauggaauugcauuaggguuaauggcuuuaaaauuaauuacacaguuugagauauaucaacuauggacagcccuaauuucauuaacuuguucaaacaccauuuuuacucugacaguagccuggagaacggcaacacuaaucuuagcaggagugucguuauuaccgaugugucaauccucauccaugagaaaaacugauugguuaccaauggcgguagccgcaauggguguaccaccauuaccacuuuucaucuucucauuaaaagauacucuaaagagacguaguuggcccuuaaaugaagggguaauggccgucggccuuguaaguauuuuagcaucgagccuucuaagaaaugauguaccaauggcaggcccguuggucgcaggaggacuauuaaucgcguguuacguuauaacaggcacuucugcggauuuaacgguagaaaaagcggcagauauaacgugggaagaggaagcugaacaaacugguguaucccacaaucucaugauuacgguugaugaugaugggacgaugcgcauaaaggacgaugaaacugaaaauauccuuacaguauuguuaaagacggcucugcucaucguaaguggaauauucccauacucaauacccgcaacucuauugguauggcacacauggcagaaacaaacacagagauccggugucuugugggacgucccgucaccaccugaaacacaaaaggcagaauuagaagaagguguauaucgaaucaaacaacaaggaaucuuugggaagacacagguggguguuggugugcaaaaggaaggaguuuuucauacuauguggcacguuacucggggugcuguucuuaccuacaauggaaagcggcuagaacccaauugggcaagugugaagaaagaucuuauaaguuacggaggagguuggcgacucagugcucaauggcaaaaaggagaggaaguccaagugaucgcaguugagccaggcaagaaucccaaaaauuuccagacuaugcccggaacuuuucaaacaacaacaggugagaucggagcgauagcacuagauuuuaaaccaggcaccagcggaucaccuauuaucaaccgugaaggcaaaguugucggauuauauggcaauggcguuguuacaaagaaugguggguacgucucuggaauagcacagacaaacgcggaaccugacgggccgacgccagaauuagaagaagagauguuuaagaaaagaaaucucacgaucauggacuuacacccugguucggguaaaacacgcaaguaccuaccugccauaguuagggaagcaauaaaaagaagguuacguacauuaauccuugcuccaacacgaguuguagcugcagaaauggaagaggcacuaaaagggcuuccaaucagauaucagacgaccgcaacaaaaucugaacacacugggagagaaauaguagacuuaaugugucaugccaccuucacuaugagacuauuaucucccgugaggguaccaaacuacaauuuaauaauuauggaugaagcacauuuuacagacccggcgucuaucgcagccagagguuacauuaguacgagaguagguaugggcgaagcggcugcuauuuucaugacagcaacaccaccggggacagccgacgcguuuccacagaguaaugcaccaauacaggacgaagaacgagauauuccagaacguuccuggaacucaggaaaugaguggauaaccgacuuugcggggaaaacugugugguuuguaccaaguauaaaggcaggaaacgauauugcaaauugccuucgaaagaaugguaagaagguuauucaauuaucacgaaaaacauuugauacugaauaucagaaaacuaaauugaacgauugggauuuuguuguaacaacugauauaucagagaugggggcaaauuuuaaagcugacagggucauagauccaagacgaugucucaaaccagucauauuaacugaugggccagaacgaguaauucucgcagggcccaugccugugacugcggcauccgccgcacaacgacgagggaggguuggcagaaauccacagaaagagaaugaccaauacauuuuuacuggucaaccgcuaaacaacgacgaggaccaugcgcacuggacugaagcaaagaugcuauuagacaacauaaauacacccgaggggaucauuccugcacuuuuugaaccagaaagagagaaaagugcagcuaucgacggggaguacagacuaaaaggcgagucgagaaaaacuuuuguggaguugaugcgacgaggagauuuaccuguuuggcucgcgcauaaaguugcaagugaaggaauuaaauauacugaucgcaaaugguguuucgacggacaaagaaauaaucaaauuuuagaggagaacauggauguagagauauggaccaaagaaggugagaagaagaaacuaagaccaagguggcuagaugcgcguacuuauucagauccauuggcgcuaaaagaauuuaaagaauuugcagcggggcguaaaucaauagcauuggauuuaguuacagagauuggaagggucccuagccauuuagcucaccgaacacguaaugcauuagacaaucugguaauguuacacaccucagaacauggaggcagagccuacaggcaugcgguagaagaacuaccggagacgauggaaacccuuuuguuauuaggauugaugauacuauuaacaggaggagcuaugcuauucuuaauaagcggaaaaggaaucggaaaaacuucgauagguuuaauuugcguuauagcuucgagcggcauguuauggauggcagaaauaccauugcaauggaucgcauccgcuaucguucuggaauuuuucaugaugguucucuuaauuccggagccugaaaagcaaagaacuccgcaggauaaccaauuagcauauguagucauugggauauuaacccuugcagcuauuauagccgcaaaugaaaugggucucuuagaaacuaccaaacgugaccucgggaugaguaaggaaccgggcguuguuuccccgacaaguuaucuagaugucgaccuacauccggcaucugcauggacacuuuaugcaguagcaacaacaguaauuaccccaauguuaagacacaccauagagaauagcacggcgaauguuucauuagccgcgaucgcuaaucaagccguuguauuaaugggacuggauaaaggguggccgauuucaaagauggauuugggagugccauuauuagcccuaggaugcuauagccaaguuaacccucuuacacuuaccgcagcgguccuauuguuaauaacucacuacgccauaaucgguccaggauuacaagcaaaagcaacacgagaagcgcagaagaggacugcugccgguauuaugaagaauccgacuguggauggaauaaugacgauagauuuagauccaguuauauacgacucuaaauuugaaaaacaacuagggcaagugaugcuccuaguccucugcgugguacaacugcucuuaaugagaacauccugggccuuaugcgaagcguugaccuuagcaacaggcccaauuacgacucuuugggaagggucuccagguaaauucuggaacacaaccauugcuguaaguauggcaaauauauuuaggggauccuacuuggcaggcgcuggucucgcuuucaguaucaugaaaaguguugguacuggaaaaagggguacagggagucaaggcgaaacuuuaggugaaaaauggaagaagaaacuuaaccaacucucgcgcaaagauuuugauuuauauaagaaaaguggaauaacggaaguggauaggaccgaagccaaagaaggcuugaagagaggggaaauuacgcaccacgcagugucuagaggaucggccaaauugcagugguuuguagaacgaaauaugguaaucccugaaggaaggguaauagacuuaggcugcggccguggagguuggagcuacuauugugccggauuaaagaaaguaacagagguaagaggcuauacuaaaggagguccuggccacgaagaaccagugcccaugucaacauaugguuggaacaucgugaaacuuaugucgggcaaagaugucuucuaucuuccucccgaaaaaugcgauacucuucuaugcgauauaggagagucaagccccuccccgaccguagaagaaucucguaccauaaggguuuuaaaaauggucgaaccauggcuaaagaacaaccaauucuguauaaaaguuuuaaacccauacaugccuacuguaauagaacaucuggaaagauuacaacggaaacauggaggaaugcugguacggaauccccuaucgagaaauucgacucaugaaauguauuggauaucaaaugggacagggaauaucguugcuagcguaaauauggugucaagacuacuacuaaauagguuuacaaugacgcacagaagacccacaaucgaaaaagacguagaucuaggagcggguacaaggcacgucaaugcagaacccgaaacuccuaacauggauguuauaggagaacgaaucaaacgcaucaaggaagaacauaacaguacguggcacuaugaugaugaaaauccguauaaaacgugggcauaucauggcucauacgaagugaaagcgacuggcagugcaucguccaugauuaacgguguuguaaaauuacuaacuaaacccugggauguaguuccuauggugacccaaauggccaugaccgauacgacgccuuuugggcagcaacgcguauuuaaagaaaagguugauacuagaacgccuagguccaugccagggacgagacggguaaugggaauuacagcggaguggcuuuggcgcacgcuaggaaggaacaagaaaccaagguuauguaccagagaggaauuuacuaagaaaguacgaacaaacgccgcaaugggagcagucuucacagaggaaaaucagugggacucugcaaaggccgccguggaagaugaagacuucuggaagcugguugauagagaaagggaacuccauaaacucgguaagugugguaguuguguuuauaauaugauggguaagagagagaagaaacuuggugaguucggcaaggcaaaaggcuccagggcgauaugguauauguggcuaggagcucgcuaucuugaguucgaagccuuaggauuccugaaugaggaucacugguucagucgagaaaacaguuacagcgguguugaaggggaaggacuacauaaacucggauauauauuaagagauauaaguaaaauaccgggagcagcuauguaugcggaugauacagccggcugggauaccagaauuacugaagaugaucuacacaaugaagaaaagauaacacaacagauggauccagaacacaggcaguuagcuaaugcaauauuuaagcucacauaccaaaauaaaguaguaaaaguucaaagacccacaccuacggggacuguaauggacauaauuucacgaaaggaccagcgggguucaggacagguuggaacuuauggauugaauacauucaccaauauggaagcacaguuaauuagacagauggaaggugagggcguacuuucaaaagcggaucuggaaaauccucauuugccggagaaaaagauaacacaaugguuggagacaaaaggagucgagaggcugaaacguauggcaauaucaggggaugauugcguggucaagccuauagaugacagguuugcaaaugccuuauuggcacuaaacgauaugggcaaaguaagaaaggauauuccacaauggcaacccucgaaaggauggcacgauuggcaacaagucccauuuuguagccaucauuuccacgaacuaauuaugaaagacggacggaaacuugucguaccgugcagaccccaagaugaacuaaucggccgugcucggaucagccaaggugccgguuggucacuuaaagaaacugcgugucuuggaaaagcauacgcacaaauguggaguuuaauguauuuccaccgacgagauuuaagauuagcaagcaaugccauaugcuccgcuguuccgguacauuggguuccuacaucaaggacuacuuggaguauccacgcacaucaucaguggaugacaacagaagauaugcucacaguauggaaucgcguuuggauagaagacaauccauggauggaagauaaaacuccgguuaccacuugggaaaauguaccguaucucggaaagagagaagaucaauggugcgguucacuuauaggguuaacaagccgagcgaccugggcacaaaacauaccaacagcgauccaacaagugcgaagccuaauugguaacgaagaguuccuagauuacaugccuaguaugaaacgauuuagaaaggaagaggaauccgagggagcuaucugguaa

SEQ ID NO: 23182 - RNA, 9873 nt, Artificial Sequence
  derived and/or modified CDS sequence (opt6) from DENV-3__HM756274__SS-prME
acuagccucugccuuaugaugauacuaccggcagcguuggcauuccaucugacaaguagagacggugaaccaagaaugauaguuggcaaaaaugaacgagguaaaucacucuuauuuaaaacagccaguggcauaaacauguguacucuuauagcaauggauuugggagaaaugugcgaugauaccguaacuuacaaauguccacauauuaccgaaguagaaccugaagauauugacuguugguguaauuugacgaguacuugggucacuuaugguaccugcaaccaagcuggagaacaucgaagggauaaaagaagcguagcacuugccccucauguuggaaugggauuagauacccggacacaaacguggaugucagcagaaggagcuuggagacaaguagaaaaagucgaaaccugggcuuuaagacaucccgguuuuacuauauuggcacuuuuccuggcgcacuauauugguacaucucuuacccaaaaaguuguaauauucauucuauugaugcugguuacaccgaguaugacaaugcgaugcguaggaguagggaaccgagacuucguagaaggauuaucuggggcaacuuggguagauguaguccuagaacaugggggcuguguaaccacaauggcgaaaaauaaaccuacacuugacauugaauugcagaaaacugaagcaacucaauuggcaacuuuaagaaaauuaugcauugaagguaaaaucaccaacaucaccacggauucgcgguguccaacacaaggugaagcaacccuacccgaagaacaagaccagaauuacguuuguaaacauacauacguugaucguggcuggggaaaugggugcggauuguuuggaaaaggaagccucguaacaugcgcgaaauuccaaugucuugaaccaauagaaggaaaaguuguccaauacgaaaauuuaaaauauacuguaauuauaacaguucacacaggggaccagcaccaaguugguaaugaaacgcaaggugugaccgcagaaauaacgccgcaggcuuccaccacugaagcgauuuugccggaauaugggacucuagguuuagaauguucuccuagaacagggcuugauuuuaaugaaaugauauuacuuacaaugaaaaauaaagcguggaugguacaccgucagugguucuuugaccuuccucuaccauggacuucaggugcuacaacagaaacaccaacguggaacagaaaagaauuguuaguaacauucaaaaacgcucaugcuaagaaacaagagguugugguguuggggucucaagagggugcaaugcauacugcgcucaccggcgcaaccgaaauucaaaacagcggagguacaucuaucuucgcuggucacuugaaauguaggcucaaaauggacaaauuagaacugaaagguaugaguuaugccauguguacaaaugccuuuguauuaaagaaagaaguuucggaaacgcaacacgggacaauuuugauuaaaguugaauauaaaggugaggaugucccauguaaaauaccauuuucaaccgaagaugggcaaggaaaagcacauaauggcagacuaaucacagcaaauccaguuguaacuaagaaagaagaaccaguaaacauagaagcagaaccaccauucggcgagucgaauauuguaauugguauuggagauaaugcuuuaaaaaucaauugguacaagaaaggcuccucaaucgggaaaauguuugaggcuacagcacgcggugcacguagaauggcaauauuaggggauacagcaugggauuucggaagcguuggcggcguuuuaaauagucuuggaaaaaugguccaucaaaucuuuggaucugcguacacugcauuauuuaguggaguauccuggguaaugaaaauaggcauaggagugcuuuuaaccuggauaggacuaaacucgaaaaauaccucaaugucuuuuaguuguauagcaauaggaauaauuaccuuauauuuaggcgcaguuguucaagcagauauggggugcguaauaaauuggaaagggaaggaauuaaagugugggucuggcauauuugugacaaaugaaguccauaccuggacugagcaguacaaauuccaagcagauaguccgaagcguuuagcaacagcaaucgccggugcaugggaaaauggggucugugggauucggucgacgaccagaauggaaaaccuauuauggaaacaaauugccaacgaauugaauuacauccucugggaaaacaacaucaaacuaacuguugugguaggugauauuauaggaguacucgaacagggaaagagaacauugacuccacaaccgauggaauuaaaauauucauggaaaacgugggggaaggcuaaaauagugacugcagaaacacaaaauucgaguuuuaucauugacggaccuaacacaccagagugucccucuguaagcagagcauggaaugucugggaaguugaagauuacggcuucggaguuuuuacuacaaacauauggcuaaaauugagagaaguuuauacacaauugugcgaccaucgucuaaugagcgcugcuguaaaggacgagagagcuguacacgcugauaugggauauuggauagaaucgcagaaaaauggcaguuggaaacuagaaaaagccucccugauagagguaaaaaccuguacuuggccaaagagucauacauuauggucuaauggcguauuagaaagugauaugauuauacccaaaucgcuugcaggacccauaucucaacacaaccaccgaccaggcuaucacacccagacagcaggcccauggcaccucgggaagcuagaauuagacuucaacuauugcgaggggacaacuguggugauaacagaaaacugcggaacgagaggaccuagcuugagaacuacaaccguaucagguaaguuaauucacgaaugguguuguagaagcuguacauuacccccuuugagauacaugggggaagacggauguugguauggaauggagauuaggccgauuuccgagaaagaagagaauaugguaaaaagccuaguuagcgccgggucgggaaaaguagauaacuucaccaugggcgucuuaugucucgcaaucuuguuugaagaaguuaugagaggaaaauuugguaagaaacacaugauagccgggguauuuuucacauucguauugcuauuaucugggcagauaacauggcgugauauggcacacacguuaauaaugauagguaguaaugcuucugacaggaugggaaugggcguuacauauuuggcacucauugcuacguucaaaauacaaccauuucuagcucucggauucuuuuuaagaaaauuaacaaguagagaaaauuuauuauuagggguuggauuagcaauggccacuacacuacaauuaccagaagauaucgaacaaauggcaaauggaaucgcgcuaggguuaauggcauuaaaacuuauaacgcaauuugagacuuaccaacuauggacugcuuugauaagucuaacuugcucaaauacaaucuuuacucugaccguugcauggagaacagcuaccuugauacucgcuggugugagucuccucccaguaugucaaaguaguaguaugcguaaaacugacugguuaccgauggcgguagcagcaaugggaguuccaccauuaccacuguuuauauucggacuuaaggacacguuaaaacgcagaucguggccgcuaaacgagggaguaauggcuguaggauuaguuaguauacuagcaucuuccuuacuucgaaaugauguuccaauggccggcccuuugguugcaggaggacugcugauugcuuguuauguaauuacaggaacaagugcagacuugacaguagagaaagcugcagacauaacgugggaagaggaagcggaacaaacuggcguuagucacaaccuuaugauuacaguagaugaugauggcacuaugcguaucaaagacgaugaaacagaaaauauacuaacaguacuucucaaaacugcgcuacuaauaguaagcggaaucuucccuuauucgauacccgcgacauuacucgucuggcacacauggcaaaaacaaacacaacgaucaggagugcuaugggauguaccaucaccuccugaaacccagaaagcagagcuagaagaagguguuuauagaauaaaacaacagggaaucuuuggaaaaacucagguaggcgugggaguacaaaaggaaggugucuuccacacaauguggcacgucacccgaggagcgguuuuaacucauaacgggaagcguuuagagccaaauugggcuuccgucaagaaagaccuuauaucauacggcgguggauggaggcugucagcacaguggcaaaaaggugaagaggugcaagucaucgcaguggaaccuggaaagaaccccaagaacuuucaaacaaugccugguacauuucaaaccacaacgggcgaaaucggagcuauagcacuggauuucaaaccagguaccaguggcuccccuauuauaaaucgggaagguaagguaguuggguuauacggaaacgggguagugacuaaaaauggaggauauguuucugggauugcacaaacaaaugcagagccugacggcccaacaccagaacucgaagaagaaauguucaagaaaagaaaucuaacuauaauggacuuacaccccggaucaggcaagaccagaaaauacuugccagcaauuguuagagaagcaauaaagcgaagauuacggacccuaauccuugcaccuacaagaguugucgcagcugagauggaagaagcauuaaaaggacuaccgaucagguaccaaacaacagcaacuaagucagaacauacaggucgcgaaauaguagauuuaaugugccaugcuacauucaccaugcgucuauuauccccagucagagugcccaacuauaaucuaauaauuauggacgaagcucauuucaccgacccagcguccauagcagcgagaggauauauaucuacaagaguaggaaugggagaagccgcagcaauuuucaugacugccacuccaccgggcaccgccgacgcuuuuccucaaaguaacgccccaauccaagaugaagaaagggauaucccugaaagaucauggaacucgggaaacgaauggauaacagauuucgcgggaaaaaccguuugguucguaccauccauaaaagcaggcaacgacaucgcaaacugcuugcguaagaacggaaagaaagugauacaguuaucaagaaaaacauucgauacagaguaccagaaaacgaaauuaaacgauugggauuucguugugacuaccgacauaucugaaaugggugcuaauuucaaagcggauagaguuauagauccaagacguugcuuaaaaccugugauauuaacugacgggccagaaagaguaauacuagcagguccuaugccuguaacugccgcaucggcugcucaacgacguggucgcguaggcagaaauccgcagaaagaaaacgaucaauauauuuucacaggccaaccauugaauaaugacgaagaucacgcucacuggaccgaagcuaaaaugcuuuuggauaacauaaacacaccagaaggaauuauacccgcguuauucgagccagagcgugaaaaaucugcagcgauugacggagaauaucgacuaaaaggcgaaucaagaaaaacauucguugaguuaaugcgcaggggugaccuuccaguauggcuugcucacaaaguugcaagcgaaggcauuaaauacacagaccggaagugguguuuugauggccaaagaaauaaccaaauacuugaagaaaacauggauguugaaauauggacgaaagagggggagaaaaagaaacuuaggccacguugguuggacgcaagaacauacucggaucccuuagcgcuuaaagaguucaaagaauuugcagccgggcgaaaaagcauugcauuagaucuggugacagaaauagguagagucccaucccacuuggcucauagaacuaggaaugcuuuggauaaucugguaaugcuacauacaucugaacacggugggagagcguauagacaugccguagaagaacuaccagaaacuauggaaacauugcugcuacuugguuugaugauacuccuuacugggggugccauguuauuccucauuagcgguaagggcauagguaagacgucuauaggauuaauaugugugauagcuucaucaggaauguuauggauggcagaaauaccgcuacaguggauagcgucugcaauaguccuugaguucuuuaugaugguacuuuuaauaccggaaccagaaaagcagagaacaccacaagauaaccaacucgcuuauguaguaaucggcauacuaacuuuagcagcgaucaucgccgcaaaugagaugggcuuacuugaaacaacuaaaagagaccugggaaugagcaaagaaccagguguagugucaccuacaucauaucuagacgucgaccugcaccccgcuucugcuuggacguuauacgcuguugcaaccacaguaauuacaccaauguuacgacacacuauagagaauagcacugcgaauguaaguuuagcagcuauugcuaaccaggcaguagucuugaugggauuagauaagggauggccaauuucaaaaauggauuuaggcguaccccuucuugcucuaggauguuauagucaagugaauccgcuaacgcuuacagcugcaguacuccuuuuaauaacacacuacgcgauuauagguccagggcuacaggcuaaggcaacgagagaagcucaaaagagaacggcggcuggaauuaugaaaaauccaacuguagauggaaucaugacaauugaccuagacccaguaauauacgacagcaaauuugaaaaacaauuggggcaaguaauguuacugguucuaugugcaguacaauuacuuuugaugcgaacaucaugggcucuaugugaagccuugacauuagcaacaggaccuauuacuacguuaugggaagguucgccggguaaguuuuggaauacgacaaucgcggugucaauggcgaauauauuucgaggcucauaucuugcaggagcuggacuugccuuuagcauaaugaaauccguaggcacaggaaagagaggcacuggcagccaaggagaaacacugggggagaaauggaagaagaaauuaaaucaguuaucaagaaaagacuuugauuuauauaagaaaagcggcauuacagaaguugauagaacugaagcaaaagaaggauugaaaagaggcgagauaacucaucaugccgucagccgcggaucagcaaaauuacaaugguuuguagaacggaauaugguaauuccagaagggagagugaucgaucuaggauguggacgcggagggugguccuacuauugcgcuggucuaaagaaaguaacugaaguacgaggguauaccaagggagggccuggccaugaagaaccgguucccaugucgacauacggauggaacauagugaaauuaauguccgguaaggauguauuuuaucuaccaccggagaaaugcgauacauuguuaugcgauauaggggaaaguucuccaucacccacuguugaagaaucaaggacaauuagggugcuaaaaaugguggaaccauggcugaagaauaaccaguuuuguauaaaaguauuaaauccauacaugccaaccguuauagaacacuuggaacgacuacaaagaaaacacggcgguaugcuaguaagaaauccguugucaaggaacucaacccacgaaauguauuggaucucgaacggaaccggaaauauaguggcaagcguuaacauggucagucgauuguugcuuaaucgauuuacaaugacccauaggcgaccuacuauagaaaaagacguggaccuaggugcgggaaccaggcauguuaacgcggagccggaaacaccaaauauggauguuauuggggaacgcauuaaacgaauaaaagaagaacacaacagcacauggcauuacgaugacgaaaauccuuauaaaacaugggcauaccacgguucguacgaaguaaaagccacaggaucagcaagcucaaugauaaauggaguagugaaacuucuaacuaagccaugggacgugguaccaaugguaacucaaauggcgaugacagacacgacacccuucggucagcaaagggucuuuaaagagaagguagacacuaggacuccgagaucuaugccuggaacgagaagaguuaugggaauaacagcggaauggcuauggcgcacacucgguagaaacaaaaagccaaggcuuuguacccgugaagaauuuaccaagaaaguacgaacuaacgcagcaaugggagcuguuuucacagaagagaaccagugggauagcgcgaaagcagcuguagaagaugaggacuucuggaaauuaguugacagggaaagagaacuucacaaacuaggaaaaugcgggagcuguguguauaacaugauggggaagagggagaagaaauugggagaauuugggaaagcgaaaggaagcagagccauuugguauaugugguuaggagcaagauaucuagaauuugaggcuuuaggauuucucaaugaggaccacugguucucacgcgaaaauagcuacagcggaguagaaggugagggacuucauaaauuagguuauauacucagagauauuucuaaaaucccagguggagccauguacgcagaugacacagcaggaugggacacacgaaucacagaggaugauuugcauaaugaagaaaagauaacucagcagauggacccagaacaccgucaacuagcuaacgcuauauucaaacugaccuaccaaaauaaggucgucaaaguccaaagaccgaccccaacuggaaccguaauggacauuauaagcagaaaagaccaacgagguucaggacagguaggcacauacggcuuaaauacuuucacaaacauggaggcucaacuuauaagacaaauggaaggugagggaguccucaguaaagcagaccuagagaacccccacuuaccugagaagaaaauaacacaguggcuagaaacgaaagguguagaaaggcugaagagaauggcgaucucaggugaugauuguguggugaagccaauagaugaccgauucgccaaugcccuacuagcucuaaacgacaugggcaaaguacgaaaggauauaccccaauggcaaccuucaaagggguggcaugauuggcaacaaguuccauucugcucgcaucauuuucacgagcuaauuaugaaagacgggcguaagcuaguaguuccauguagaccacaggacgaauuaauaggcagagcuagaauaucacagggugccggauggagccugaaggaaacugcauguuuaggaaaggcuuaugcacaaauguggucucuaauguauuuccaucgaagagaucuucgguuggcaucaaaugcaauaugcagcgcaguaccggugcauuggguaccaaccucacguacaacauggucuauucaugcgcaucaccaauggaugacuacggaagauaugcuaacagucuggaauagaguauggauagaagacaaucccuggauggaggacaagaccccagugacuaccugggagaaugucccauaucugggaaagcgugaagaucaauggugcgguagucuuauuggacuuacaaguagggcaacuugggcccaaaauaucccuacagcaauucaacaaguaaggagcuuaauaggaaaugaagaguuccuagauuauaugccgaguaugaagcgauuuagaaaagaagaagagucggagggugccauaugguaa

SEQ ID NO: 23183 - RNA, 9873 nt, Artificial Sequence
  derived and/or modified CDS sequence (opt6) from DENV-3__HM756275__SS-prME
acgaguuuguguuugaugaugauauuaccugcagcuuuggcauuccaucugacaaguagggacggggaaccaagaaugauuguggggaaaaaugaacggggaaagagcuuacucuuuaaaacugcaucaggaauaaauaugugcacacugauagccauggaccuaggugaaaugugugaugauaccgugacuuacaaaugcccccacauaacugaaguagaaccggaagauauugauugcugguguaaccuuacaucaacauggguaaccuacggaacauguaaucaagcaggcgaacauagacgcgauaaacgcagcguagcgcucgcaccacacguuggaauggguuuagauacaagaacacaaaccuggaugucagcggaaggagcauggcgucaaguagaaaaaguugaaacaugggcucuacgacacccagguuuuacaauucucgccuuguuuuuagcucauuacaucgggaccaguuugacacagaaagugguaauauuuauacuacuuaugcuugugacaccaucuaugaccaugcgauguguuggaguagguaacagagacuucguugagggauuaucaggagccacuuggguagauguaguuuuagaacauggaggauguguuaccacgauggcuaaaaauaaaccaacuuuggauauugaguuacagaaaacggaagccacgcaacuggcgaccuugagaaaacugugcaucgaagguaaaaucacaaauauaacuacagacucacggugcccaacacaaggagaagcaacccuucccgaagaacaggaucaaaauuacguuuguaaacauacauacguagaucgcggcuggggaaauggauguggcuuauuugggaaaggaucucuaguuacuugcgcaaaauuucaauguuuggaacccauugaaggaaaaguagugcaacaugaaaaucuuaaauauacagucaucaucacaguccacacuggagaccaacaccaaguaggaaacgaaacccaaggcgucacugcagaaauaacaccgcaagcaucgacaacagaagcuauacuuccagaauacggaacccugggccuagagugcagcccccgcacaggucuugauuuuaacgaaaugauacuuuugacuaugaaaaauaaagcguggaugguacaucgacaaugguucuuugauuuacccuuaccauggacaagcggggccacuacagaaacuccaacauggaauagaaaagaauuacuugugacauucaaaaaugcacaugccaagaaacaagaaguugucguccuaggaagucaggaaggggcaaugcauacagcucuaacuggggcuacagaaauacaaaauaguggcggaacaaguauauucgccggucauuugaaauguagauugaaaauggauaaauuagaacucaaagggaugucuuaugcaauguguaccaacacuuuuguucuaaagaaagaaguaucugaaacucagcacggcacaauacuuauuaaaguagaauauaaaggugaagacguaccauguaaaaucccauuuaguacggaagacggacaagggaaggcacacaaugggagguuaauuacagcaaacccaguggucacgaaaaaggaagaacccguuaacauugaagcugaaccuccauuuggugagaguaacauaguaauugguauaggagauaacgcauuaaaaaucaauugguauaagaaaggaagcaguauugggaaaauguucgaagcaaccgcaagaggggccagaaggauggcaauacuuggugacacagcaugggauuucgguaguguagggggaguucuuaacucuuuagguaagauggugcaccaaaucuuugguagcgcauacacggcccuauucagugguguuagcugggucaugaaaauagguaucggaguauuauuaacauggaucggucuuaauucaaagaauacaucaaugucguuuaguugcauugcaauaggaauaauaacuuuguacuuaggugcaguaguucaagcagauaugggguguguaauuaacuggaaaggaaaagaauuaaaguguggcucggggauauuugugacaaaugaaguccacacuuggacugaacaauacaaguuccaggcagacuccccuaaaagacuagcaacagccauugcaggcgcaugggaaaauggaguauguggcauucguucaacaacuagaauggagaaucuauuguggaaacaaaucgcaaaugaauugaauuacauucuaugggagaauaauauuaaauugaccguagucguaggagauauaauaggaguccuagagcaaggaaaacgaacauuaacuccccaacccauggaauuaaaauauuccuggaaaacauggggaaaggcaaaaaucguuacugcagaaacccagaacagcagcuucauaauugaugguccuaauacgccggaaugcccaagcgugucacgugcuuggaacguaugggaaguagaagacuacggauucggaguauuuacaacaaacaucuggcugaaacuaagagaaguauauacucaauuaugugaucaucgguuaaugagugcggcaguaaaagacgaacgagccguacaugccgauaugggauauuggauugagucgcagaaaaacggcuccuggaaacuagaaaaggcuucccuuaucgaagugaaaacuugcacauggccaaaaucucauacguuauggagcaauggaguuuuagaaucagacaugauaauaccuaaaucacuugccgggccgauaucccagcauaaucaccggccagguuaucauacgcaaacugcaggaccguggcacuugggaaaacuagaauuagauuuuaacuauugcgaggguacuaccgucguaauaacagaaaacuguggcaccagagggccaucuuuaaggacuacuacaguuucgggaaaauuaauacaugaauggugcugccgcaguugcacacugccgccuuuacgcuacaugggagaagacgguugcugguauggcauggaaauacgcccuaucagugagaaagaagaaaauaugguuaaaucauuaguuuccgcaggcagcggcaaagucgauaacuucacuauggguguacugugccuagccauauuauuugaggaaguuaugagaggcaaauuuggaaagaaacacaugauagcuggcguguucuucacauuuguucuuuuacugucaggucaaaucacguggagggauauggcacauacauuaauaaugauaggaucaaaugcuucagacagaauggguauggguguaacguaccuagcuuuaauagcuacuuucaagauucagccauuuuuagcacuaggauucuuuuugaggaaacuaacaucacgagaaaauuuacuucugggaguggguuuagcaauggcaaccacucuucaauuaccagaggauauugaacaaauggcaaacggaauagcguuggguuuaauggcccuaaaacuaauaacgcaauucgaaauauaucaguuauggacggcacuuauaucacugacauguucaaauaccaucuuuacguuaacaguugccuggcguaccgcaacacuaauacuagcaggaguaucgcuauuaccaaugugccagucuagcucgaugaggaaaacagacugguuacccauggcaguagcggcaaugggaguuccaccacuacccuuauucauauucucucuuaaggauacucuaaaaagacguaguuggccauuaaaugagggagugauggcugucgggcucguaucuauacuggcaagcucauuauugagaaaugacguacccauggccgggccacucguagcaggaggccuccuuauugcuugcuaugugaucacagggaccucggcagaucuuaccgucgaaaaggcagcagacauaacaugggaggaagaagcagaacaaaccggaguaagucauaaccugaugauuacgguggaugacgacggaacgaugagaauaaaagacgaugaaacagagaauauauuaacaguacuguugaagacggcccuacuuauaguuucaggcauauuuccuuacaguauaccagccacgcuucuaguuuggcacacuuggcaaaaacagacccagaggaguggugucuugugggauguuccuucgccacccgaaacacaaaaagcugaacuugaagaggggguguacagaauaaaacagcaggggaucuucggaaaaacacaagucgguguaggaguucagaaagaaggaguuuuccauacuauguggcauguaacuaggggagcaguucucaccuacaauggaaaaagacuugaaccuaacugggcuucggucaagaaagacuuaaucucuuauggggguggauggcgacugagcgcacaauggcagaaaggagaagagguacaagucauagcagucgaaccuggcaaaaaucccaagaacuuucaaaccaugccuggaacuuuccaaaccacaaccggugaaaucggugcaauagcccuagauuucaaaccaggaacaaguggaucgcccauaaucaacagggagggaaagguuguaggcuuguauggcaauggagucguaacaaagaauggcggcuacguaucuggcauugcgcaaacgaaugccgagccagauggacccacaccagaauuagaagaagagauguuuaagaaacgaaaccuaaccaucauggauuuacacccaggaucagguaaaacaagaaaauauuuaccggcuauagugcgagaggcaauuaagagacguuuaagaacgcugauauuagcuccaacccgaguugucgcugcggagauggaggaagcgcucaaggguuugccgauaagguaccaaacaacagcgacaaaaucagagcauacaggucgcgaaauuguggauuuaaugugccaugcaacuuucacaaugcgacuucuaucucccgugcguguaccaaauuacaaucugauaaucauggaugaagcucauuucacagacccagcauccauagcagcuaggggguacaucuccacacgaguugguaugggugaagcugcagcaaucuucaugacggccacaccaccagguaccgcagaugccuuuccacaaaguaaugcaccuauucaagaugaggaaagagacaucccagaaaggucguggaauagcggaaacgaguggauaaccgauuuugcaggaaaaaccguaugguuuguuccaucaauuaaggcugguaacgauauugcuaauuguuuaagaaagaacggcaagaaagucauacaacuaucuagaaaaacuuucgauaccgaauaccagaaaacaaaauuaaacgauugggacuuugucguuacaacagacauauccgagaugggggcaaauuucaaagccgacaggguuauagauccaaggagaugccuaaagccagugauacuaacugacggaccggagaggguaauacuggcagguccaaugcccgugacagcagcgucggcggcucagcgacgcggccgugucgguagaaauccucaaaaggaaaacgaucaguauauauuuacagggcaacccuuaaauaacgacgaagaccacgcgcacuggacggaagcaaaaaugcugcuagauaauauaaauaccccggaaggcaucaucccugcauuauuugaacccgagagagaaaaaucagcugcaauugauggggaauaucgucugaaaggcgaaucgcguaaaacauucguagaauuaaugcggagaggugaucuuccaguguggcuugcacacaaaguugccagugaagguaucaaauauaccgaucgaaaaugguguuucgacgggcaaagaaauaaucagauacuagaggaaaacauggacguugaaauauggacaaaggaaggugagaagaagaaauuaaggccgaggugguuagaugcaaggacguauagcgaucccuuagcauuaaaagaauuuaaggaauuugcagccgggaggaaaagcauagcccuagauuuagucacagagaucggcagggucccuucacauuuagcucacagaaccagaaacgcucuggacaacuuaguaauguuacauaccuccgaacacggagggcgagccuaccgucacgcaguugaggaacucccugaaacuauggagacuuuacuguuauuaggguuaaugauacugcuuacaggaggcgcaaugcuguuccuaauaagcggaaaaggaaucggaaaaacauccauuggacuaauaugcguaauagcuuccagcgguauguuguggauggcugaaauacccuuacaauggauagcgucugcaauuguucuggaguuuuucaugauggucuuacuaauaccugaaccagaaaaacagagaacgccucaggauaaucaguuagcauacgugguuauagguauuuuaacauuagcagccauaauagcugcaaaugaaaugggccuauuagaaaccacgaaaagagauuuggguaugaguaaagagcccggggucgucucgccuacgucuuaucuugacguggauuuacaucccgccucagcauggacuuuauacgcuguugcuacaacgguuaucacacccauguuacgacacaccaucgaaaacagcacagcuaauguuuccuuagcggcaauugccaaucaagcgguagugcuuaugggacuagauaaaggauggcccauaaguaaaauggaccuaggcguaccguugcuagcuuuggggugcuacucucaaguuaauccauuaacauuaacagcugcuguccuucucuuaauaacucauuaugccauuaucggcccaggacugcaggcgaaagcaacaagagaagcccagaaaaggacugcugcugguauaaugaaaaauccuacagucgacggaauuaugacaaucgaccuagauccaguaauuuaugauaguaaguuugaaaaacagcuaggacagguaauguuauuaguauuguguguaguacaacuuuuguuaaugagaacuucaugggcgcuaugugaagcacugaccuuggcaaccgguccgauaacaacgcuuugggaagguagcccuggaaaauuuuggaauacaacuauugcggugaguauggccaacauauuuaggggcucuuaucuggcaggggcugggcuugcuuucucaauaaugaaauccgugggaacagggaagcgaggaacaggaagucaaggcgaaaccuuaggugaaaaauggaagaagaaacuuaaccaauuaagucggaaagauuucgaccuauacaagaaaucuggcauaacugaagucgaccgcaccgaggcaaaggaaggauuaaaacgaggagaaauaacacaucaugccguuucacgugggagcgccaaacuacaaugguuuguggaacgaaauauggucauaccugagggucgaguuauagacuuaggauguggcaggggaggauggucuuauuauugugcaggguuaaagaaagucacggaagugagaggauacacaaaaggcggacccggucacgaagaaccugugccaaugagcacauaugguuggaauauaguuaaacugaugagcgguaaagauguauucuaccucccaccugaaaaaugcgauacccugcugugugauauaggggaaucuucaccgaguccaacaguugaagaaagucggacaauaagaguuuuaaaaaugguugaaccgugguuaaagaacaaccaauuuuguauaaaagucuuaaauccuuauaugccaacagucauugagcauuuggagaggcuacagcguaaacacgguggaaugcuagucagaaauccguuaucgcggaacucaacucaugaaauguacuggaucagcaacggaacaggaaacauuguggcuagugugaacaugguaucacgacugcugcuuaaucguuuuacgaugacgcacaggagaccaaccauagaaaaagauguagacuugggagcagguacgagacauguaaaugcagaaccagagaccccuaacauggauguaauaggagaaagaauaaaacgcauuaaggaggaacauaauagcacauggcacuacgaugaugagaauccauacaaaacaugggcauaucacgguaguuaugaagugaaagcaaccggcucugcuucgagcaugauaaacggaguugucaaauuacugacuaaacccugggauguaguaccgauggucacucaaauggcaaugaccgauacaacaccauuuggacaacaaagaguuuucaaagaaaaaguggauacacgaacuccgagaucuaugcccggaacucgucguguaaugggaaucacagcagaauggcuauggcggacauugggccgaaauaaaaagccucggcuauguacucgagaggaguuuacaaagaaagucagaacaaaugcugccaugggcgcgguuuuuacggaggaaaaucagugggauucugccaaggccgcggucgaagacgaagauuucuggaagcuaguagaucgagaacgugaauuacauaaauuaggaaaguguggaaguugcguuuauaacaugaugggaaaacgugagaaaaaguugggagaguuuggaaaagcuaaaggcucucgugcuaucugguauaugugguuaggcgcacgauaccuggaguucgaagcauugggauuucucaacgaggaucauugguucagcagggaaaacaguuauucaggaguagagggagaaggacugcacaaauuaggauauauauuaagggauauauccaagauuccugguggagcaauguacgcugaugauacugcagguugggacacccgaaucacagaagaugauuuacacaaugaagaaaagauaacacaacaaauggacccagaacauagacaauuagcgaacgcaaucuuuaaacuaacuuaccaaaacaagguagugaaaguucagagaccaacuccaacagguacuguaauggacauaaucucgagaaaagaccaacguggaaguggacaaguagguaccuauggcuuaaacacuuucacgaacauggaagcucaauuaauacgucagauggagggcgaaggaguauuaucuaaagcagauuuagaaaacccacaucuaccagaaaagaaaaucacacaauggcuugaaaccaagggaguagaacgauuaaaacgcauggcaauaucaggagacgacugugucguaaaacccauagacgaccgauuugccaaugcucuccucgcacucaacgauauggguaaaguacgcaaagacaucccucaguggcaaccgagcaaagguuggcaugacuggcagcaaguuccauucugcagucaucauuuucacgaacuaaucaugaaagacggucgaaaauuaguaguaccuugccgcccacaagaugaacuuauagggagagcccggauuucacagggagcaggguggagcuugaaggaaaccgcgugccucggcaaagccuaugcacaaauguggagucuaauguacuuccauagacgagaccuuagauuggcaucaaacgcgauuugcucagcggucccugugcauuggguuccaacgucacgaacuacauggucuauacacgcacaucaccaguggaugacgacugaagauaugcuuacagucuggaacaggguuuggaucgaggauaacccauggauggaagacaagacucccguaaccacuugggaaaacguuccauaccuugggaagcgcgaggaucaaugguguggaucucuuauagguuuaacgucacgagccacaugggcacaaaacauaccgaccgcaauacaacaagugagaucacugaucggaaacgaagaauuucuggauuauaugccaucaaugaagagguuuagaaaagaagaagaaagcgaaggugccaucugguag

SEQ ID NO: 23184 - RNA, 9873 nt, Artificial Sequence
  derived and/or modified CDS sequence (opt6) from DENV-3__JF937632__SS-prME
acgucacuaugccucaugaugauucuaccagcagcacuggcuuuucaucuaacaagcagagauggugaaccaagaaugaucguugguaaaaaugaaagaggaaaaaguuuacucuuuaaaacggcuagcggaauaaauaugugcacacugaucgcaauggaucuaggagaaaugugugacgacacuguaaccuauaaaugcccgcacauaacagaaguagaaccagaagauauagacugcugguguaaucuaacaagcacauggguaacuuauggaaccugcaaucaagcuggagaacaucguagagacaaacgaagcgucgcacucgcgccucauguaggaaugggauuagauacucgaacccaaacauggaugucggcugagggagcauggagacaaguagaaaaaguugagacuugggcacucagacauccaggauuuacuauauuagcuuuauucuuagcacauuacauagggacaagucuuacacaaaaaguagucauauucaucuugcugaugcuugucacaccgaguaugaccaugagaugcguaggagugggaaacagagauuuuguagaagggcuguccggagcgacauggguugauguuguucuagagcacgggggcugcgugacuacgauggcuaaaaauaaaccgacucuugacauagaacuccaaaagacagaagcaacacaacuggcgacacuaagaaaauuaugcaucgagggaaagauuacgaauauaacaacagauucucgauguccaacacaaggagaagcuacacugccagaagaacaggaucaaaauuacguuuguaaacauacauacguggacaggggauggggcaauggcuguggacuauuugggaaaggcagccuugucacuugugcaaaauuucaaugccuggaaccgauagaaggaaagguuguacaauaugagaaccuuaaauauacuguuauaaucaccgugcauaccggagaucaacaccaaguagguaaugaaacucaaggaguaacugcagagaucacuccgcaggcaucaacuaccgaagcaauacuaccagaauaugggacacucggccuugaaugcaguccaaggacggggcucgacuucaaugaaaugauacugcuaacaaugaaaaauaaggcauggaugguacaccgucaaugguucuucgaucuaccacuaccauggacgucaggagccacuacggaaaccccuacuuggaauagaaaggaacuauuaguuacguuuaaaaacgcacaugccaagaaacaagaaguaguaguguuaggaucacaggaaggugcgaugcacacagcauuaacuggagcuaccgagauacagaacagcggaggaacaucgauauucgccggacauuuaaaaugucgauuaaagauggacaaauuagaguuaaaaggaauguccuacgcaauguguacuaacacauuuguacucaagaaagaaguaucggagacucagcacgggacuauucuaauaaaaguugaauacaagggcgaagacguuccguguaaaauaccauucagcacagaggacggacaagguaaggcgcacaauggaagguuaauaaccgcaaaucccgucguaacuaagaaagaagaaccaguuaacauugaagcugaacccccauucggugaauccaacauaguaauuggaaucggagacaacgcuuuaaaaauaaacugguauaagaaagguagcagcauugguaaaauguucgaggcuacugcgaggggcgcuagacgaauggcuauucuaggugacaccgcaugggauuucggaucaguaggagggguacuaaauucgcuaggcaaaaugguccaucaaauauuugggagugcauauacggcucuauuuaguggaguguccuggguaaugaaaauagguauaggaguccuauuaacauggauuggacuaaauaguaaaaauaccucaaugagcuucaguuguaucgccauaggaauaauaaccuuguaucuaggagcaguaguacaagcagacaugggguguguaaucaauuggaaaggaaaagagcuuaaauguggaagcggaauauucguaacgaacgaagugcauacauggaccgaacaauacaaguuccaagcugauucgccaaagcgacuugcgaccgcuauagccggagcgugggaaaaugguguuugcgguauacgcagcaccacacgaauggagaaccuucuauggaagcaaauugccaaugaauuaaacuacauacugugggagaacaauauaaaauugacagucgugguuggugauauaauaggugugcuugaacaaggaaagagaacgcugacaccgcaaccaauggaacuuaaauauucguggaaaacauggggaaaagccaagauaguaacagcggaaacacaaaauucuaguuuuauaauagacggacccaauacgccugaauguccuucaguaucacgugcuuggaacguuugggaaguagaagauuacggguucgguguauucacgacaaauauuuggcuuaaacugagagaaguauauacccaauuaugcgaccauagacucaugucggcagccguaaaagaugaacgagccguacaugcggacaugggauacuggauagaaagucagaaaaacgguaguuggaaauuagaaaaagccagcuuaauugaaguaaaaaccugcacguggcccaagagucauacacuuuggaguaacggaguguuagaaucagacaugauaauaccaaaaaguuuagccggaccuauaucgcaacauaaccaucgccccggcuaucauacacaaacagcaggaccguggcaucuagggaaacuggaauuggacuucaauuauugcgaggggacaacuguagucauuacggagaacugcgguacgaggggaccuagcuuacgcacuacuacuguaucggguaagcuaauacaugaauggugcugucgcaguuguacucugccgccauugagauauauaggggaagacgguuguugguacggaauggaaauucgaccgauauccgagaaggaagaaaauauggugaaaucauuaguaucagcggguaguggcaaaguggacaacuuuaccaugggagucuuaugccuagcuaucuuauucgaagaaguuaugcgcgguaaauuugguaagaaacauaugauagccgguguauucuucaccuucgucuugcucuuguccggucagauaacuuggcgagauauggcacauacucuaauuaugaucggaagcaacgccucugaucgcauggguauggggguaacuuauuuagcccuaauagcgacuuuuaaaauucagccguuucuugcacuuggauucuuccucaggaaauuaaccucgcgggaaaaucuacuacucggcguaggacuugcuauggccacaacacuacaacuaccagaggacauugaacaaauggcaaacgggauagcacuuggccucauggcucuaaaauugauuacucaguucgagacauaucaauuauggaccgcacugauaaguuuaacauguaguaacacgauauuuacacuuacuguugcauggagaacagcaacauuaauauuagcuggugucagucuccuaccuguaugucaaagcucaaguaugcgcaaaacugauuggcuaccaauggcuguagcggccauggguguaccgccccuuccauuguucauauuuucgcugaaagacacucuaaagcguagauccuggccacuuaaugaggguguuauggcgguaggauuaguaagcauccuagccucuucauuacuaagaaacgacguacccauggcaggaccuuuaguagcgggaggacuccuaauagcuuguuauguuauaacagggacaucagcggacuuaacaguggagagagcagcagauauaacaugggaagaggaagcagaacaaacgggaguuucucauaaucuaaugauaaccguagaugacgauggaacaaugcgaauaaaagacgacgaaacagaaaauaucuugacaguacuccucaaaacugcauuguugaucguuagugguauuuuucccuauaguauacccgccacgcuacugguuuggcacacguggcaaaaacaaacucaaaggaguggaguauugugggaugucccaagucccccggaaacucaaaaagccgaacuugaggaaggaguauaucgaaucaagcaacaggguaucuucggaaagacucaagugggcguaggaguucagaaggaaggagucuuucacacaauguggcacguaacaagaggugcagucuugacauauaaugggaaaagauuagaaccaaauugggcaagcguuaagaaagaucugauaagcuauggcggagguuggcgguuaucggcgcaauggcaaaaaggugaagagguacaagucauugcugucgaaccaggcaaaaaucccaaaaauuuccaaacuaugccaggaacuuuucaaacuacaacuggugagauaggggcuauagcgcuggauuucaaaccaggaacaucuggcucacccauaauuaaccgggaaggaaaaguaguaggacuauacggcaacggaguaguuacuaagaaugggggauauguaucuggaauagcacaaacaaacgccgaaccagauggucccacaccagaacuagaagaagagauguuuaagaaacggaaccugacaaucauggauuuacaucccggaagcggcaagacucggaaauaucuaccagcgauugucagagaggcaauaaaacggcguuuacgcaccuugaucuuggcuccaacucgagugguagcugcagaaauggaagaagcucuaaagggacuucccauaagauaucaaacaacagcuacgaaaucagaacauacaggccgggagauaguggaccucaugugucacgccacguuuacuaugcgacugcuaucuccgguuagaguuccaaauuauaacuuaauaauuauggacgaggcacacuuuacagauccggcgaguauagcagcaagaggauauauaucuacgcgggucggcaugggagaagcugcagcaauauucaugaccgcuacuccaccaggaacugccgaugccuuuccccaaaguaaugcaccaauucaggaugaagaacgagacauuccagaaagaucguggaacuccggcaaugaauggauuaccgauuuugcggggaagacaguaugguuuguaccaucuauaaaagcaggcaaugacauugcgaacugcuuaaggaaaaacggcaagaaagucauacaacuaucaagaaaaacauucgacacagaauaccagaaaacaaagcuaaacgauugggauuucguggucacaacggacaucagugaaaugggugcuaacuucaaagcagauagaguaauagacccacgcagaugucuaaagccagugauauugacagacgguccugagagagucauucuagcaggaccaaugccaguuacggcggcaucagcugcgcagcgaagagggaggguagguagaaacccacagaaagaaaaugaucaguauauauucacuggacagccauugaauaaugacgaagaucacgcgcauuggacggaagcaaagauguuauuggauaauauaaacacaccugaagguauaauucccgcacuguuugaaccugaaagagaaaaaucugcugcgaucgauggagaauaucgacugaaaggugaaucccgaaaaaccuucguagaacugaugagaagaggagaucuaccaguuuggcuugcacauaaaguagcaucugaaggaauaaaauacacggaccgaaaguggugcuuugauggacaaaggaacaaccaaauacuagaggaaaacauggacguugaaauuuggacuaaggagggagagaagaagaaauuacggccacgcuggcuugaugcgcgaacguacagugaccccuuggcauuaaaagaauuuaaagaguucgcagcaggccgcaaaaguaucgcacucgauuuaguaacugagauaggcagaguuccuagccaccuugcacaccgaacaagaaaugcauuagacaaucuaguaaugcugcacacaagcgaacaugguggcagagcguacagacaugcaguugaagaguugccagaaacaauggaaacucucuuacuacuaggguuaaugauauuacugacagguggagcaaugcuguuccucauuagugguaaagguauuggaaagacaucgauuggacuaaucugcgucauugccucuagcggaaugcuauggauggcagagauaccuuuacaguggauagcaucagccauagucuuggaguucuuuaugaugguacuccuuaucccagagccugagaagcaaagaacuccucaggacaaucagcuagccuauguaguaauuggaauauuaacguuggcggccauaauugcagcaaacgagaugggcuugcuagaaaccacaaagagagaccuuggaaugucaaaagaaccaggcguaguaucuccaacaucauauuuagauguagauuuacaucccgcaucagcauggacuuuguaugcgguagcuacuaccgugauaacacccaugcugagacauaccauagaaaauagcacugcgaauguaaguuuggcagcgauugcaaaucaagcgguggucuugaugggauuggauaagggauggccaaucucaaagauggaucugggcguuccacuauuggcacugggcuguuauucacaggugaacccauuaacgcuuacugcugcaguacuacuccuaaucacacauuaugcaauuauaggcccuggauugcaggcaaaagccacccgugaggcucagaaacgaaccgcagcugggauaaugaaaaacccaacaguggauggaauaaugacaauagauuuagacccaguaauuuacgacucuaaguucgaaaaacaauuaggucagguuaugcuauuaguucugugugcugugcaauuauuacuaaugagaacuucuugggcacuuugugaagcccugacucuagcuaccggacccauaaccacacuaugggaggguucuccagggaaauucuggaacacgacgauugcaguaagcauggcuaauauauuucggggcuccuaucuagccggugcaggucuggcguucucuauaaugaaaagcguuggcaccgggaaaagaggaacgggaccccaaggagaaacccuaggggaaaaauggaagaaaaaguugaaucaguuaucucgaaaagauuuugaccuuuauaagaagucaggaauaacagagguggacaggacggaggcaaaagaaggccuaaaaagaggagagauaacucaccaugccguuagccguggcucagcaaagcuacagugguuugucgagaggaauauggugauuccugaaggccguguuauugaccuugguugcgguaggggagguuggucguauuauugugcuggauugaagaaaguuacagaaguccgaggauacacaaaaggugggccgggucaugaagaaccuguaccuaugaguacauacgguuggaacauuguaaaacucaugucgggcaaagauguauuuuauuuaccaccggagaaaugcgauacuuuacucugugacauaggagaaucaucacccagccccacaguggaagagucucgaaccauacgaguauugaaaauggucgagccuugguugaaaaauaaccaauuuugcaucaaaguucuuaacccuuauaugccuacaguaauugaacaccuagagagacuacaaagaaaacacggaggcaugcucguaagaaauccccuuucgcguaauucaacacaugaaauguacuggauuagcaauggaacuggaaacauuguugcaucagugaacaugguaaguagauuacuacuaaauagauuuacaaugacacaccggcguccuacaauugaaaaagauguugaucuaggugcagggacacgacacguuaaugccgaaccugaaacuccuaauauggacgucaucggagaacgaauuaaacguauaaaagaagaacauaacucaacauggcauuaugacgaugagaaucccuauaagacuugggcauaucauggauccuacgaagucaaagcgacagggucagcaucaagcaugauuaacggcguagucaagcuguuaacuaagccaugggauguggugccuaugguaacucaaauggcaaugaccgacacaacuccauuuggacaacaacgaguauucaaagaaaaaguagacacaagaacacccagauccaugccugggacgcgucgagugauggggauuacagcagaauggcuauggcgaacauugggccgcaauaaaaagccacguuuguguacaagggaagaauuuacgaagaaaguccggaccaacgccgcgaugggagcagucuucacggaagaaaaccaaugggauagugcaaaagcagcgguggaagacgaagauuuuuggaaauuagucgaccgagagcgggagcuacauaaacuuggcaaaugugguucauguguguauaauaugauggggaagcgugaaaagaaauuaggggaauuugguaaggcuaaagguucccgugcaauuugguauauguggcuaggagcucgauacuuggaauuugaagcacuuggauuucuaaaugaagaucacugguuuucucgagaaaauucguauaguggaguagaaggggagggccuacaucguuuaggguauauauuacgagacauaucuaaaaucccggguggagcaauguaugcugaugauacugccgguugggacacaaggauuaccgaagaugacuuacacaaugaagagaaaaucacacagcaaauggaccccgaacacagacaacuagcaaaugcuaucuuuaaauuaacauaccaaaauaagguaguaaaaguacaaagaccgacaccaacaggaacgguuauggauaucauuagccgaaaggaccaacggggcaguggacagguaggcacauauggguuaaacaccuuuacaaauauggaggcucaauugauucgccaaauggaaggugaaggcguauugucaaaagccgaccuagaaaauccucaccuaccagaaaagaaaaucacacagugguuggaaacgaaaggaguagaaagguuaaaaagaauggcgauuagcggugaugauuguguaguuaaacccauagacgacagauuugcgaaugcuuuguuggcccucaacgauaugggaaagguuagaaaagacaucccucaguggcaaccguccaaaggauggcaugauuggcaacaaguaccauucuguucacaccacuuucaugaacugauaaugaaggacggcagaaaacucgugguuccguguaggccacaagaugaacucauaggcagagcuagaauuucacaaggggccggcuggucgcugaaagaaacggcgugccuagguaaggcuuaugcucaaaugugguccuuaauguauuuucauagaagggaucuuagauuggcgucuaaugcuauuugcagugcaguaccagugcauuggguaccuacaagccgaacaaccuggucgauacacgcccaucaccaauggaugacuaccgaggacaugcugacuguauggaaccggguuuggaucgaagauaauccauggauggaagacaaaacuccaguaacaaccugggagaacguaccguaucuuggaaaacgugaagaucaauggugcggaaguuuaauuggucuaacgagucgugcuacgugggcucagaacauuccuaccgcgauucagcaaguacgaucuuugauugggaaugaagaauuuuuagauuauaugccaucaaugaaaagauuccguaaggaggaagaaucugaaggagccauuugguaa

SEQ ID NO: 23185 - RNA, 9873 nt, Artificial Sequence
  derived and/or modified CDS sequence (opt6) from DENV-3__HM756281__SS-prME
acaucauuaugccuuaugaugauauugccugcagcauuggcuuuccaccuuacgucgcgagauggggaaccucggaugauaguagguaaaaaugaacgagguaaaagccuacuguuuaaaacggccucagguauaaacauguguacguuaauagccauggaucuaggugaaaugugugacgauacuguaacuuauaaauguccucacaucacagaaguggaacccgaagacauugacuguugguguaaucuuaccuccacauggguuacuuacggaacuuguaaucaagccggugaacauagacgcgauaaacgaagcguagcauuggcaccacauguaggcauggggcuugauacucgaacacaaacauggauguccgccgaaggagcauggagacaaguagaaaaaguggaaacaugggcgcuuagacaucccggguucacgauccuagcucuuuuucucgcacauuauaucgggaccagucucacgcaaaaaguagugauuuuuauauugcuuauguuggugacccccagcaugacuaugcguuguguuggaguaggcaaucgugauuucguugaaggacuauccggugcaacauggguagaugucguacuugaacauggaggauguguaaccacgauggcuaaaaacaaaccgacucuagauaucgaacuccagaaaacugaagcaacacaauuagcaacucuacguaaacugugcauagaaggaaaaauaacaaauauuacgacagacuccagauguccaacccaaggagaagcgaccuuaccagaagaacaagaccaaaacuauguauguaaacauacauauguagaccgggggugggggaacgguugugguuuauuugguaaaggaucacuugugaccugcgcaaaauuucaguguuuagaaccuauugaagguaaagucguacaauaugaaaaucucaaauacacugugauaauaacaguccacacgggagaucaacaucaaguaggcaaugaaacucaaggcgugacggccgaaauaacaccacaggcuucuacuacggaagcuaucuuaccagaauacgguacauuagguuuagaauguaguccuagaacuggcuuggauuucaacgaaaugauacuuuuaacaaugaaaaauaaagccuggauggugcaccgucaaugguucuuugaccuaccucuuccauggacaaguggagcaacgacagaaacgccaacuuggaaucggaaagaacuuuugguuacuuuuaaaaaugcacacgcaaagaaacaagaagugguaguuuuaggcucacaagaaggggcuaugcauacggcuuuaacgggagcuacggaaauacaaaauucaggugguacuucgauauucgccggacacuuaaaaugcagauuaaaaauggacaaacucgagcuaaaaggcaugagcuaugcaaugugcacuaacaccuucguauugaagaaagaagucucugaaacccaacacgggaccaucuuaauaaaagucgaauacaaaggcgaggauguaccuugcaaaauacccuuuucaaccgaagacggucaaggcaaagcacauaaugggcgacucauaacagcaaaccccguaguaaccaagaaagaagaaccaguuaacauugaagccgaaccuccuuuuggugaaaguaacaucguuauaggcaucggcgacaacgcauuaaaaauaaacugguauaagaaaggcucgaguauaggaaaaauguuugaagcaacagcacguggcgcuagaaggauggccauucugggcgacacugcuugggauuucgggucaguagguggcguccuuaauucucuuggaaaaaugguccaccaaauauucggcucugcauauacagcccuauucucaggcguuagcugggugaugaaaaucggaauaggcguacugcucacauggauaggacuaaauucgaaaaauacgucaaugucuuucucaugcauagcgauaggaauaaucacguuguaucuuggugcaguaguccaggcggauaugggaugugucguaaauuggaaaggaaaagagcucaaguguggcagcgguauuuucguaacgaaugaggugcauaccuggacagaacaauauaaauuucaggcagacucuccuaaacggcuagcaacagcaauugcuggugcaugggaaaacggaguauguggaauccggagcacuacacgaauggaaaauuuauuguggaagcaaaucgcgaacgaauuaaacuacauucuuugggagaauaacauaaaguuaacaguuguugugggggacaucaucggaguacuggaacaaggaaaaaggacucugaccccacaaccuaaggaacuuaaauauuccuggaaaaccugggguaaggcuaaaauuguaaccgcugaaacacaaaacuccucauucaucauagauggaccgaauacgccugaauguccgucuguuagucgggcauggaauguaugggaaguugaagauuauggauucggcguauuuacaacuaacaucuggcuaaaacuaagagaaguauauacgcaguuaugcgaccaucgguugaugagugcugcuguuaaagacgagcgagcaguacacgcagauauggguuauuggauagaaucucagaaaaaugguucuuggaaauuagagaaagcgucacuaaucgaagugaagaccugcacauggccgaaaucacauacacuuuggaguaauggaguauuggaaucagacaugauaaucccaaagagcuuagcaggaccaauaucucagcauaaucaucgaccgggauaccacacacagacagcugguccguggcacuuagggaaacuagaguuagacuucaacuauugugaagguacgaccguuguuauaacagaaaauugugguacucgagguccaucccuacguaccacgacaguuagcggaaaauugauucaugaaugguguuguagaucuugcacucuucccccuuuaagguacaugggagaggauggaugcugguauggcauggaaauuaggccuauuucagaaaaagaagaaaacaugguuaagucauuagugucggccggaucuggaaagguagauaauuuuacaauggguguacucuguuuagcaauccuguuugaagaagugaugcguggaaaguucggcaaaaagcauaugauagcaggaguauuuuucacuuuuguucuacuuuuaucuggacaaauaacguggcgggacauggcucauacauuaauaaugauagggaguaacgcaagcgaucgaaugggaaugggcguaaccuaucuagcauuaauugcaacguuuaaaauccagccguuuuuagcauuggguuucuuucuacguaaacuuacauccagagagaaucuauuguugggcguaggacuagcaauggcaacaacguugcaacuaccagaggauaucgaacaaauggcuaacgggauugcucuaggauuaauggccuuaaaacuaauaacacaauucgagacauaucagcuguggacugcuuuaauaagucuaacguguucgaauacaaucuucacauuaacuguugcuuggaggacugcuacauuaauacuagcaggaguaucauuacuuccagucugucaaaguucuucaaugcguaaaacugauuggcugccaauggcaguggcagcaaugggugugccuccauuaccacucuuuauauuuagcuuaaaagauacccugaagcgacguaguuggccuuuaaaugaaggagugauggccguuggcuuaguauccauuuuagcuucaucauuauuacggaacgacguaccgauggccggcccccuaguagcuggcgggcugcuaaucgcuuguuauguaaucacaggcacuucagcugaucucacaguagagaaagccgcagauauaacgugggaggaggaagcggaacaaaccggaguaucgcauaaccucaugaucacaguugaugaugaugguacgaugaggaucaaagaugaugagacagaaaauauucuaacaguuuuacuaaaaaccgcacuauugaucgucagcgguauauuccccuacucaauaccagcaacguuacuuguuuggcauaccuggcaaaaacaaacucaaagaagcggaguauuaugggacguacccaguccacccgaaacgcaaaaagccgaauuagaagaaggaguguaccguauuaagcaacaaggaauauucggcaaaacacagguugggguaggcguccaaaaagaaggcguauuucauacgauguggcauguuacaagaggagcuguacugacauauaauggcaaaagacuagaaccgaacugggcaagcguaaagaaggaccuaauaucauacgguggcggcuggagguugagcgcacaauggcaaaagggagaagaaguucaagugaucgccgucgaaccaggcaaaaauccuaagaacuuucagacaaugccuggaacuuuccaaacaacgaccggugaaauaggcgcaauagcucuagauuuuaaacccggaacaucagggaguccaauaauaaaucgugaagguaaaguuguagggcucuaugguaacgguguaguaacuaagaacggaggauacguaaguggaaucgcacagacuaacgcagaacccgacgggccaacaccagaguuggaagaagagauguuuaagaaacgaaaucuuacaauaauggacuugcaucccggaucagguaaaacgaggaaauaccugccugcaauuguucgagaagcaauaaaacgcagacugaggacccuuauauuagcuccaacaagaguugucgcugcugaaauggaggaggcguuaaaaggacuuccaauaagauaucaaacuacggcgaccaaguccgagcacacgggaagagaaaucguugaccuaaugugucacgcaacauuuacaaugcgucuucucucaccaguaagaguuccaaauuacaaucuaaucauaauggacgaggcucauuuuacagauccagcaucaauagcagcucguggauauauuuccacuagaguaggaaugggagaagcagcugcaaucuuuaugacagccacaccuccagggacagcggaugccuuuccccaaucuaacgcaccaauucaagaugaggaacgcgacauuccagagcguuccuggaacuccgggaaugaauggauaacagauuucgcagguaaaacaguaugguuuguaccaucaauuaaagcagggaacgacauagcaaacugucuaaggaaaaacgguaagaaaguaauacaauuaagucggaagacauuugauacagaauaccagaaaacgaaacuaaacgauugggauuuuguagugacaacggacauauccgaaaugggcgcaaauuucaaggccgaccgagugaucgacccucgcagaugcuuaaaaccaguaaucuuaaccgauggcccggaaagggucaucuuggcggggccuaugccugucacggcugccagugcugcccaaaggcgugggagaguuggacgaaacccacaaaaggagaacgaccaauauauuuucacugggcagccauuaaacaaugaugaagaccacgcacacuggaccgaagcaaaaauguuauuagacaauauaaauacaccagagggcauaaucccugcauuguucgaaccagaaagagagaaauccgcagcuauagauggagaauaccgcuugaaaggugagucccguaaaacuuuuguagaacuaaugaggcgcggagauuugccuguaugguuggcccauaaagucgcauccgaaggcauaaaguauacagaccgaaaguggugcuuugauggucagaggaauaaccaaauacuugaagaaaauauggacguggaaaucuggacgaaagagggugagaagaagaaacugagaccccgauggcuagaugcacggacauauucagacccccuagcauuaaaagaguucaaagaauuugcggcaggcagaaaaucgaucgcauuggaucuggugaccgaaauugguagagugcccucgcacuuagcucaccgaacaagaaaugcgcuagacaauuuaguaauguuacauacaucagaacauggagggcgugcauaucgacaugcuguagaggaauugcccgaaacuauggagacgcuauuacuacucggauuaaugauucuauuaacuggaggagcaauguuauucuuaauuucugguaaaggaaucggaaaaacuucaauaggacuaaucugcgugauagcuucuuccgguauguuguggauggcagagauacccuuacaauggauagcaucagcuaucguucuagaauuuuucaugaugguguuauuaaucccagaaccagaaaaacaaagaacaccccaagacaaccaacuagcauacguagucaucggaauuuuaaccuuagcagcuauaauugcugcaaacgagaugggacuacuugaaacuacgaaaagagacuuaggcauguccaaagagccaggcgucguuucgccaaccucuuaucuagacguagaucuacaccccgcaagcgcguggacuuuauacgcuguagccaccacgguuauuacacccaugcuaaggcacacuauugaaaauucaacugcgaaugugagucuagcagcaauagccaaccaggcuguggucuugaugggauuagauaaaggauggcccauaucaaaaauggaccugggcguaccauuacuagcccuagggugcuauucucagguuaauccguugacuuuaaccgcggcaguacuacugcugauaacccacuaugccauuauaggucccggucuucaagcgaaagcuacaagagaagcgcagaaaaggaccgcugcugggauaaugaaaaauccgacaguugacgguauuaugacaauugaucuagaucccguaauauacgacaguaaguucgaaaaacaacuugggcaagugaugcuuuuaguucuaugugcggugcaacuauuauuaaugcgaacuucaugggcccuuugugaggccuuaacacuagcgacgggacccaucacgacucuaugggaagggagcccggguaaauuuuggaacacgacaaucgcaguaaguauggcgaacaucuuccggggauccuaucuagccggcgcugguuuagcauucucaauaaugaaauccguuggaaccgggaaacguggcacaggaucgcaaggugagacuuuaggagaaaaauggaagaagaaacuuaaccaguuaagcaggaaagauuucgaccuauacaagaaaagcggaauaaccgaaguugauagaacagaagcuaaagaaggauuaaaacguggugagauaacacaccacgccgucucacgggggucugcuaaauuacaaugguuuguugaaaggaacaugguuauuccggaaggaagaguuauugaucuaggauguggcagagggggauggucauacuacugugcuggacucaagaaaguaacugaggugagaggauauacaaaaggaggaccgggacacgaagaaccaguuccaaugucaacauaugguuggaauaucguaaaacucaugaguggcaaagacguuuucuaccuaccaccagagaagugugauacacuucugugugauauuggugaaucaucaccaagcccaacaguggaggaaucuagaacgauaaggguccuuaaaauggucgaaccauggcucaaaaauaaucaauucuguauuaaaguuuuaaacccuuauaugccaacgguaauagaacaccuggaaagacuucaaagaaagcacgggggaauguuagugagaaauccacugucaagaaacuccacccaugaaauguauuggauuaguaacggaacugguaacauaguggcaucggucaauauggucucgagacuucuacuuaaucgauuuaccaugacucauaggcgaccaacuaucgaaaaagacguugauuuaggugcgggaacgaggcacguaaaugcagaacccgaaacaccuaauauggacguaauaggcgaacgaauaaaaagaauuaaagaagaacauaauucuacuuggcacuacgaugaugaaaauccuuauaaaacuugggcguaucauggcaguuaugaaguaaaggcuacuggaucugcgucaucaaugauuaacgggguaguaaaacuauugacaaaaccaugggacguaguaccuauggugacgcaaauggcgaugaccgauacaacuccauucggacaacagcgugucuuuagggaaaaaguagauacacgcacgccgcgcaguaugccuggaacaagaagggucaugggcauaaccgcugaauggcuauggcgaacucuuggaagaaacaaaaagccccgucuauguaccagagaagaguuuaccaagaaaguaagaacuaacgcagcuaugggugcugucuuuacugaggaaaaucagugggacucugcuaaggcagccgucgaagacgaagauuuuuggaaacuugucgacagagaaagagaacuacacaaacuaggaaaaugugguaguugcguguauaacaugaugggaaaaagagagaagaaauuaggugaguuuggaaaagcaaaaggaucacgagcuauaugguacaugugguuaggagcuagguaucuggaauuugaggcuuuaggauuuuuaaaugaagaucacugguuuagucgggaaaacucguacucaggcgucgaaggagaaggcuuacacaaauugggauauaucuuacgcgauaucucaaaaauuccaggcggugcuauguaugcagaugauaccgcugggugggauacacgcauaaccgaggacgaucuucacaaugaggaaaagaucacucagcaaauggaucccgaacauagacaauuagccaacgcaaucuuuaaauugacuuaucaaaacaagguaguuaaaguacaaagaccgacaccaacaggaacaguuauggauauuauuucaagaaaggaccaacgaggauccggucaagucgggacauauggacuaaauacuuucacuaacauggaggcacaacuuauuaggcagauggaaggagaaggaguuuuaaguaaagcagauuuagagaacccacaucugccagagaagaaaauaacacaaugguuggaaaccaaagguguagagagguuaaaacgcauggccauaucgggagaugauugcgugguuaaaccgauagaugacagauuugcaaaugcacuucuggcucuaaaugauaugggaaaaguaagaaaagauauaccucaguggcaaccgucaaaaggcuggcaugacuggcagcaaguaccauuuugcucacaucacuuucacgaacuuauaaugaaagaugggaggaaacucguaguccccuguagaccacaagaugaacuaauaggaagggccaggauuagccagggagcaggguggucacuaaaagagacugccugccuaggaaaggcuuaugcacaaauguggucacuuauguauuuucaucgacgggauuuacgauuagccucuaaugcgaucuguucggcuguaccagugcauugggugccuacuagcaggacaaccuggucgauucacgcacaucaccaauggaugaccacugaagacauguuaacagucuggaauaggguauggauugaagauaaucccuggauggaagacaaaacacccguaacgaccugggaaaacguaccguaucucgggaaaagagaggaccaauggugcggaaguuuaauuggauuaacaucacgggcuaccugggcacaaaacauaccaacugcaauacaacaaguucgaagucucaucggcaacgaggaguucuuagauuauaugccaucaaugaaaagauucaggaaagaggaagaaagugaaggggcuauuugguaa

SEQ ID NO: 23186 - RNA, 9873 nt, Artificial Sequence
  derived and/or modified CDS sequence (opt6) from DENV-3__JF937643__SS-prME
acuuccuuaugccuuaugaugauccucccagcugcacuugcuuuccaccucacaucacgagacggagaaccaagaaugauaguagggaaaaaugaacgcggcaaaucauuauuauucaaaacugcaucaggaaucaacauguguacacuaauagcuauggaccuuggugaaaugugugacgacacgguuacuuauaaaugcccucacaucaccgaaguugaaccggaagacaucgauuguuggugcaauuuaacuagcacuuggguaaccuaugggacuuguaaucaagcgggggaacauagacgagacaaaagaagcguagcacuagccccucauguaggaauggggcuugauacuagaacucaaacauggaugagcgcagaaggggcauggagacaagucgaaaaaguagaaacaugggcacuaagacauccaggauucaccauuuuagcacuguuucuagcacacuauauuggaaccagcuuaacacaaaaaguaguaauuuucaucuugcuuaugcuggugacuccaucuaugacgaugagguguguaggagucgguaacagagacuuuguugaaggauuaucaggagccacaugggucgaugucguauuggaacauggaggcuguguaacaacuauggccaaaaauaaacccacacuagauauugaacuucagaaaacggaagcgacucaauuagcaacucuacgaaaacuuuguauagaaggaaaaaucacaaacauaacaacagauagcagauguccgacccaaggagaagccacgcuuccagaagaacaagaccaaaacuacgucugcaaacacaccuauguagaccguggcugggggaauggcugugggcuauucggaaaagggagcuuaguuacaugcgcuaaauuccagugucucgaaccaauagaagguaaaguaguucaauacgaaaaucucaaauauacugugaucauaaccguacacacuggugaucaacaccaaguaggaaaugaaacacaagguguuacugcagaaaucacuccacaagcaaguaccacagaagccauauuaccugaauauggaacacucggacuugaauguucaccacgaacgggucuagauuucaaugaaaugauucuauugacaaugaaaaauaaagccuggaugguacacagacaaugguucuuugauuuaccucuaccguggacaagcggcgcuacaacugaaacacccaccuggaaucgcaaagaauuacugguuacuuuuaaaaaugcucaugcuaagaaacaggaagucguaguuuuaggaucucaagaaggggcgaugcauacagcucuuacaggggcaaccgaaauacaaaauucuggagggacaucaauauuugccggacauuuaaaaugccgcuugaaaauggauaaacuugaacuaaaaggcaugaguuaugcuaugugcacuaauaccuucguccucaagaaagaaguaagugaaacgcaacacgggacuauuuugauaaagguggaauacaaaggugaagauguccccuguaaaauaccauuuucaacagaagauggucaaggaaaggcacacaacggucgauuaaucacggccaacccagucguuacuaagaaagaggagccugucaacauagaagccgaaccaccuuucggggaaagcaauauugucaucgguauuggcgacaacgcacugaaaauuaauugguacaagaaagggagcucaauaggcaaaauguucgaagcuacagcaagaggugcaagacggauggccauuuugggggauacagcaugggacuucggcucugucgggggcguguuaaauucauugggaaaaaugguacaucagaucuucgguucugcguauaccgcacuauuuuccggaguaucauggguaaugaagauagguauagguguucuacuuacauggauuggauugaacucaaagaauacuagcaugagcuuuagcugcauagcaauuggaauuauuacguuauauuugggggcaguaguacaagcagacaugggaugcguuauuaauuggaaagguaaagagcuuaaaugcgguagcggaauauuuguuacaaaugaaguacacaccuggacagaacaauauaaguuucaggccgacucuccuaaaagauuagccacagcaaucgccggggcaugggaaaaugguguaugugggauaagaagcacaacaaggauggaaaauuuacuauggaaacagaucgcaaaugaacugaacuacauauuaugggagaauaacauaaaauugacuguuguaguuggagacaucauagguguucuagaacaaggcaaacguacauuaacaccucaacccauggaacugaaauauucauggaaaaccugggguaaagcaaaaaucgucacugcagaaacucaaaauagcucauuuauuaucgauggucccaacacuccagaauguccgucaguuagcagggcauggaauguaugggaaguagaggacuacggauuuggaguguuuaccacuaauauuuggcuaaaauuaagggaagucuauacacaauuaugugaccaucgucuaaugucugcagcuguaaaagacgaaaaagccguucaugcagauaugggauauuggauagaaucacaaaagaacggcuccuggaagcucgaaaaagcuagcuugauagagguaaaaacauguacauggccaaaaagucauaccuuguggaguaacggaguccuggaaagcgacaugauaaucccaaaaagucuagccggcccuauaucccaacauaaccauaggcccgguuaccauacccaaacugccggaccguggcaucuagggaaacuugagcuugacuuuaauuacugugaagguacuacaguuguaauuacagagaacugcgguacaaggggaccgucacuaagaaccaccacaguauccggaaaacuaauacaugaaugguguugcaggagcuguacgcuaccaccucuuagguacaugggagaagauggauguugguauggaauggaaauucguccaaucucggaaaaagaggaaaauauggugaagagucugguuucggcaggguccgggaagguagacaauuuuacuauggguguguuguguuuagcuauccuauuugaagaagucaugagaggcaaauuugguaagaaacacaugauagcgggaguauucuuuaccuuuguauuacuccugucaggccagauaacguggagggauauggcccauacccucaucaugaucggcaguaaugccagcgaccgcaugggaauggguguaacuuaucuugcauugauugcaacuuuuaaaauacaaccauucuuggcguuagguuucuuccuucgaaaacugacaagcagggaaaaucuucugcucggggucgguuuagcuauggccacaacgcuucaauuaccagaggauauagaacagauggcaaaugguauagcccuggguuuaauggcuuuaaaauuaauagcucaauucgaaacuuaucaauuauggacagcgcuaaucagccuuacauguagcaauacaaucuuuacacuuacaguagcguggaggacagcuaccuugauacucgcagggguaucacuucuaccgguaugucaaaguucuucaaugagaaagacagauuggcuaccgauggcuguagcagcuauggggguuccaccgcucccacuauuuauauuuucgcuuaaggacacguugaaaagaagaagcuggccauugaacgaaggcguaauggccgucggacugguuucgauauuagcaucuucucuauugagaaaugacguucccauggcugguccccuaguugccggagggcuacugauagcuugcuauguuauaaccggaacuagcgcggaccugacaguugaaaaagccgcggauauaacuugggaggaggaggccgaacaaacuggaguaucccauaauuuaaugauugccguugacgaugacggcacaaugcgaaucaaagaugacgaaacagaaaauauucuuacaguucuacuuaagacagcucuacuaauagucagcggcauuuucccauacaguauaccggcgacucuauuaguuuggcauacuuggcaaaaacaaacccaacgaucagguguguugugggacgugccaagcccgcccgaaacgcaaaaagcggagcuagaagagggaguuuacaggauaaaacaacagggaauuuuuggaaaaacucaagugggcguaggaguucaaaaggaaggcguauuucacacgauguggcacguaacacgaggugcgguucucaccuauaaugggaaaaggcuggagccaaacugggcaagcgucaagaaagaccuaaucucauacgguggagguuggcgucuuucagcucaauggcaaaaaggugaagagguacaagucauugcuguagaaccugggaaaaacccgaaaaauuuucaaaccaugccagguacauuccaaacuacaacaggagagauaggugcaauagcacuagacuuuaagccuggaacaagcggaagcccaauaaucaauagagaggguaaaguaguaggauuauauggcaacggaguaguaaccaaaaauggcgguuacguaucagguauugcacaaacuaaugcggaaccggacggaccuacuccugaguuggaagaggaaauguuuaagaaacgcaaucuaacaauuauggauuuacauccugguucaggaaaaaccagaaaauauuuaccugcaauuguucgugaggcuauuaagcgccguuugcgaacguuaauacuugcuccgacacgcgucguagccgcagagauggaagaagcucuuaaggguuugccuauucguuaucaaaccacagcgacaaaaagugaacacaccggacgcgaaauuguggacuuaaugugucacgcaacauuuacaaugcgguugcuaagucccgugagaguaccgaauuacaaccucauaauaauggacgaagcccacuuuaccgauccagcgucuauagcugcuagaggauauaucucaaccagaguuggcaugggagaagcagcagcaauauucaugacagcgacaccaccaggcaccgcggaugccuuuccgcagucaaaugcacccauacaagacgaagaaagagauauucccgaaagaaguuggaacucuggcaaugaauggauaacagauuucgcaggaaaaaccgucugguuuguaccuagcauaaaggccggaaaugacauugcgaauugucuccguaaaaaugguaagaaaguaauccaacugagcagaaaaacuuucgacacagaauaccagaagacaaaauugaaugauugggacuuuguggugaccacagacauuagugagaugggagccaauuuuaaggcagaccguguaaucgauccuagaaggugccugaagccgguaauauuaacagaugggccugagcgcgugaucuuagcugguccgaugccaguuaccgcggcauccgcagcacagcggagaggaaggguaggaagaaacccacagaaggaaaaugaccaauauauuuucacagggcaaccucuaaacaacgacgaagaccaugcacacuggacagaagcaaagauguuguuggacaacauaaauacgccugaggguauaauucccgcauuauuugaaccugaacgggagaaaagcgccgcuauagacggagaauaccgguuaaaaggagaaucaagaaagacauucgucgaauuaaugagaagaggcgaccuaccuguaugguuagcccauaaaguagccagugaaggcauuaaauacacagauagaaaguggugcuucgauggacagcguaacaaccaaauuuuagaagaaaacauggauguugaaauauggacuaaagaaggugagaaaaagaaauugcggccuagauggcuggaugcuagaacauauucagauccacuugcuuuaaaggaguucaaagaguucgccgcuggccgaaaauccauagcucucgaucuaguuacagaaaucgguagaguuccaagucaccuagcucaucgaacaagaaacgccuuagauaacuugguaauguuacauacaagugaacaugguggccgagcguacaggcaugcgguugaagaacugccagaaaccauggaaacacuauuacuccuuggauuaaugauauuguuaacagggggagcaaugcuguuucuaaucucaggaaaaggaauaggaaaaacgucgauuggacucauauguguuauagccucgucagguauguuauggauggcugagauuccacuccaguggauugcuagugcaauaguccuagaguucuucaugaugguccuucuuauaccagaaccagaaaaacaacgaacuccccaagacaaucaauuggcuuauguuguuauaggcaucuuaacguuagccgcagugauugcugcaaacgaaaugggccuucuugaaacaacuaaaagggaucucggcauguccaaagaaccaggaguagugucaccgacaagcuaccuagauguagauuugcauccugcaagcgccuggacacuauaugcgguagcuacaacggucauaacaccuaugcuccgccacacaauagagaacucuacugcuaacguaaguuuggcagcaauugccaaccaagccgugguccuuauggguuuagauaaaggauggccgauuaguaagauggauuuaggagucccucucuuggcccucggauguuacucacaaguaaauccgcugacguuaacugcagcgguacuauuacugauuacgcauuacgcuauaauagguccgggacuucaagcuaaagcaacucgugaggcccagaaaaggacagcugcggguaucaugaagaauccaacaguagaugggaucaugacaauagaccuugauccuguaaucuacgauucgaaauucgaaaaacaacucggucaaguuauguugcuaguauuaugugcuguacagcuuuuacucaugcggaccucaugggcuuuaugcgaagcgcuaacccuugcaacuggcccaauuacaacacuaugggaagguucgccaggaaaguuuuggaacacaaccauagcuguuaguauggcaaauaucuucagaggaaguuauuuagccggggcuggucuagcuuuuucaauaaugaaaagugugggaacgggcaagcgggguacggguagucaaggggagacacucggugaaaaguggaaaaagaagcuaaaucaacuuagcagaaaagacuucgaccuauauaagaaaucuggaauaacggaagucgaucggacagaagcaaaagaaggguuaaaaaggggagagauuacacaucacgcuguaagcaggggcucggcaaaacuucaaugguucguugaaaggaauauggugauacccgaggguagagucauagaccuugguuguggcagaggagguuggaguuauuauugugcaggacucaaaaagguaacagaagugaggggauacacgaaggguggacccggucaugaagaaccggugccaaugucuacauaugguuggaauaucguuaaacuaauguccgggaaggacguauuuuacuuaccaccagaaaaaugugauacacuucuuugugacauaggagaaagcucuccaucgccuaccguagaagagucgcgaacgauacgcguauuaaaaaugguagaaccgugguuaaagaacaaucaauucuguauaaaaguauuaaauccauacaugccaacaguaaucgaacaucucgaacgucuucaacguaaacauggcggcaugcuaguacggaauccauuaucuagaaauucgacucaugaaauguauuggauaaguaauggaacuggaaauauaguugcaucgguaaauaugguaagucgguuacuucuuaacagguuuacgaugacacauagacguccgaccauugaaaaagauguagaucuaggugcagggacaagacacguaaacgcggagccagaaacgcccaauauggacguuauaggugaaagaauuaaacggaucaaagaggaacacaauucuacauggcauuaugaugaugaaaauccuuacaaaacaugggcauaccauggaucguacgaaguaaaggcaacuggaucagcguccucuaugaucaauggaguaguuaagcuauugacuaaaccaugggaugucguacccaugguuacacaaauggcuaugacugauacgacuccuuuuggccaacaacggguauuuaaagaaaagguugacacuaggacaccuaggagcaugccaggcacccgacgaguuauggguauaacagcagaauggcuguggagaacacugggacgaaauaaaaagccuagauuaugcacucgcgaagaguuuacuaagaaaguaagaaccaaugcagcaaugggcgccguauuuacugaagaaaaucagugggauagcgcuaaagcagcuguagaagaugaggacuuuuggaaguuagucgauagggaacgagaauuacauaaacucgguaaaugcggaaguuguguauauaacaugauggguaagagagagaagaaacuuggugaguucggcaaagcgaaagguucucgugcgauaugguacauguggcuuggagccagguaucuugaauuugaagcacuggguuuccuuaaugaagaccauugguuuucaagagaaaauaguuacagcgguguggaaggugaaggccuacacaaacuggguuauauacucagagauauaucuaaaauaccuggaggugcaauguacgcagaugacacggcuggaugggauacaaggauaaccgaggaugaccuacauaaugaagaaaagauaacacagcaaauggauccagaacauagacaacuugcuaaugcuauauuuaaguuaacuuaucagaacaagguagucaaaguacagagaccuacgcccacagguacaguaauggacaucauaucccguaaggaccaaagaggaucaggucaaguaggaaccuacggccuaaauacauuuacuaacauggaagcacaauuaauacgucaaauggagggagaggggguuuugucaaaagcugacuuagaaaacccucacuugccagagaagaaaauaacacaauggcucgagacaaagggaguugagcguuuaaaaagaauggccauuucuggagaugauugcguaguuaaaccaaucgacgauagauucgcgaaugcacuacuagccuugaacgauaugggcaaagugagaaaagauaucccccaauggcagcccaguaaaggauggcacgacuggcaacaaguacccuuuuguucucaucauuuccaugagcucauuaugaaggauggccgaaaacuugugguaccauguagaccacaggacgaacugaucgguagagcgagaauuagucaaggagcugguuggagccuuaaggaaacagcuugcuuaggaaaggcauacgcacagauguggucauuaauguauuuucaucgaagggaccuuagauuagcuagcaaugcaauaugcucagcggugccaguccauugggugccgacuagcaggacaacgugguccauacacgcacaucaucaauggaugacaacagaugauaugcuuacgguauggaauagaguguggaucgaagauaacccauggauggaagauaaaacaccggugaccacgugggaaaauguaccuuaccucgggaaaagggaggaucaauggugugggucccuaaucggguuaacuucucgagcgacuugggcacagaauauaccaacagcaauucaacaagucagaagccucauaggaaacgaggaguuccuugauuauaugccaagcaugaaaagauuccgaaaggaagaagaaucagagggcgcaaucugguaa

SEQ ID NO: 23187 - RNA, 9873 nt, Artificial Sequence
  derived and/or modified CDS sequence (opt6) from DENV-3__HM181972__SS-prME
acuucccugugucuuaugaugauauuaccagcugcuuuagcuuuccacuuaacuucaagggauggugaaccaaggaugauuguagguaaaaacgaaagggggaaaucguuguuguucaaaacggcaagcggaaucaauaugugcacauuaaucgcuauggaccuaggagaaaugugugaugacacggugacauacaaaugcccucacauaacugaaguugaaccggaagauauagacugcugguguaauuuaacgucuacaugggucacauauggcacauguaaccaagcaggcgaacaucgacgugauaaaagaucaguugcacuugcaccacauguugguaugggacuugacacgagaacucaaacauggaugagugcggaaggagcuuggagacaaguugaaaaaguugaaacaugggcucuuagacacccaggauuuacaauucuagcauuauuccuagcacauuacauagguacaagccuaacucaaaaaguaguaauuuucauuuuacugauguuagugacuccgagcaugaccaugaggugcguaggaguagggaauagagauuucguagaaggauuauccggagcgacauggguagauguuguauuagaacacggaggaugugugacuacgauggcuaaaaauaaaccuacuuuagacaucgaacuacagaaaaccgaagcuacucaauuggcgacuuugagaaaacugugcauagaaggaaaaauaacuaacauuacuaccgacucacguuguccaacacaaggugaggcaacauuaccagaagaacaagaccaaaauuaugucuguaaacauacguauguggaucgagggugggguaacggaugcggccuguucggaaaagguucauuagugacaugugcgaaauuucaaugucuugaaccuauugaggggaaaguaguacaauaugaaaauuuaaaauacacaguaauaauuacaguucacaccggagaucaacaucaaguugguaacgaaacacaagggguaacagcugaaauuacaccacaagcuagcacaacugaagcaauacuaccugaguaugguacccucgguuuggagugcagcccuaggacuggauuagauuuuaaugagaugauacuguugaccaugaaaaacaaagcauggaugguucauaggcaaugguucuuugauuuaccacuaccguggaccagcggcgcuacuacggaaacgcccaccuggaaucguaaagagcuuuuaguuacauuuaaaaacgcccaugcgaagaaacaagaaguagucguacuagguagucaagaaggagcgaugcauaccgcgcuaacaggagcaacagagauacaaaacucuggugguacaaguaucuuugcaggccaucuuaaauguagauuaaaaauggauaaauuggaauuaaaaggaaugucauacgccauguguacgaauacguuuguacugaagaaagagguaucggagacacaacauggaacuauucuaauuaaaguagaguacaaaggggaagacguaccauguaaaauaccuuucuccacugaagauggucaaggaaaagcacacaauggacgccuuauaaccgcgaacccuguuguaacgaagaaagaagaacccgucaacaucgaggcagaaccaccauuuggagaaucuaauaucgucauuggaauaggugacaacgcucuaaaaaucaauugguacaagaagggaaguagcauagggaagauguucgaagcaacugcccgaggagcacguaggauggccauauugggagauacggcgugggauuucggaagugucggaggaguuuuaaacucacugggcaaaaugguacaccagauuuuuggcagugcguauaccgcucuauuuucgggggugagcuggguaaugaaaauuggaauaggugucuuacuaacguggaucggacuaaauucaaagaauacuuccaugucguuuuccugcauagcaaucggaauuauuacacucuaucugggggcggucguccaagccgacauggguugcguaaucaacuggaaaggaaaagaauuaaaauguggcagcggaauauuuguaaccaaugaaguacauacuuggacugaacaauauaaauuccaagcagacucaccaaagcgacuagcaacagccauagccggugcuugggaaaauggaguauguggcauucgcucuacaacaaggauggaaaauuuauuauggaagcaaaucgcuaaugaacucaacuauauucuaugggaaaauaauauaaaacuaacuguagucguaggcgauauaauuggcguauuagaacaagggaaaaggacgcuaacaccccaaccuauggaacuaaaauacagcuggaaaacgugggguaaagcaaaaauaguuacugccgaaacacaaaauucuaguuucauaauagaugggccuaauaccccugaaugccccucaguaagucgagcuuggaauguuugggaaguugaagauuauggguuuggaguuuuuacgacuaacauuugguugaaauuaagagaaguauauacacaacuaugugaccacaggcuuaugagcgcagcaguaaaagaugaaagggcaguacacgcugauaugggcuacuggauagaaagucagaaaaauggaaguuggaagcuagagaaggcaucccucauagaaguaaaaacuuguacguggccaaaaucccauacccuguggucaaaugguguacuugaauccgacaugauuauaccuaaauccuuagcaggaccaaucucacaacacaaucaccggcccggguaccacacucaaaccgccggcccuuggcauuuaggaaaauuagagcucgauuuuaauuacugcgaaggcacgaccgucguaauuacggaaaacugcgguacacgaggaccaagucucagaacgacaacaguaucaggaaaauugauccaugaaugguguuguagaagcugcacuuuaccaccacugagauacaugggugaagauggcuguugguaugguauggagauccguccaauaucagaaaaagaggaaaauaugguuaaaucccuugucucugcagguagugguaagguagauaauuuuacuauggguguacuuuguuuagccauauuauucgaagaggugaugagggguaaauuuggaaagaaacauaugauagcaggcguauucuuuaccuuuguacuccuucuaucuggacaaaucacuuggagagacauggcccacacacuaauuaugauaggcucgaaugcuucagaccgaauggguaugggaguaaccuaucuugcguuaauugcuacuuucaaaauacaaccguuucuuguacuagguuucuuucugcggaaacugaccucacgggaaaaccucuuauugggagugggauuagcaauggcuaccacacugcagcuaccggaagauauagaacaaauggcgaauggaaucgcacuuggcuugauggcuuugaaauugauaacacaauuugaaacguaucaauuguggacugcuuuaauuucccuuacuuguaguaacacaauauuuacauuaacgguagcauggcggacggccaccuuaauauuagcagggguaucucuauuacccgucugucaaucaaguuccaugcgaaaaacggauugguugccuauggcugucgcugcgauggguguuccaccccuaccauuauuuaucuuuucacuuaaagacacauuaaaaaggagaaguuggccucuaaaugaaggugugauggccguuggauuaguaagcauacuugcaucuucguuacuccguaacgacgucccaauggcuggaccauuaguagcagggggacuacuuauugccugcuauguaauuacuggaacaucagcagaccugacuguagaaaaagcagcagacauaacgugggaagaagaagcggaacaaacuggaguaucucacaaucucaugauaacgguggaugacgaugggacuaugcggauaaaagaugaugaaaccgaaaacauccugacuguguuauuaaaaacugcucuacuaauuguaucaggcaucuuuccuuacaguauaccagcaacccucuuaguguggcacacauggcaaaaacagacucagcguuccgggguacucugggaugucccgucgccaccagaaacucagaaagcggagcuugaagaaggaguuuauagaauaaagcaacaaggaauuuuuggcaaaacacagguuggagugggaguccaaaaggaaggggucuuucacacgauguggcauguaacaagaggugcgguacuaacuuacaauggaaaaagacuagaaccaaacugggcuagugugaagaaagacuuaauaagcuacgguggcgguuggagacugagugcgcaauggcaaaagggggaagaaguacagguaauugcugucgaaccaggaaagaaucccaagaacuuucaaacaaugcccggaacauuucaaaccacaacuggagaaaucggcgccauagcccuggauuuuaaaccggguacaaguggaucacccauaaucaacagagaagguaaagucguaggguuauacgggaauggcguggugacgaaaaauggugguuacguuucagguauagcucaaaccaacgcagagccugacgguccaacaccugagcucgaagaagaaauguucaaaaagagaaaccugacaauuauggaccuucaucccggcucggguaaaacucgaaaauaucuccccgcaauaguacgugaagcuauaaagaggcggcuacgaacuuuaauuuuagccccuacucgcguuguagccgcagagauggaagaggcacugaaaggucuaccuauaagauaucagacgacagcaacuaaaucagagcauacaggucgagagaucgucgacuuaaugugucacgcuacauuuacuaugcgauuguuaucgccugugcgcguccccaauuauaaucuaaucauaauggaugaagcucauuucacggacccagccagcauagcugcgcgaggauacauaucaacaagaguagggaugggagaagccgcggcaaucuucaugaccgcuacacccccagguacagcagaugccuucccacagucaaacgcaccaauccaagacgaagaaagagauauuccagagcgaucauggaacucaggaaaugaauggaucacugauuucgcugggaaaacuguuugguucguaccuucaaucaaagcagguaaugauauagcuaacugucuaaggaaaaaugguaagaaagucauacaguuaagccguaaaacauucgauacugaauaccagaaaacuaagcugaaugauugggacuucguugucaccacugauauuucggaaaugggcgcaaacuuuaaagcugauaggguaauagacccacgaagaugucucaaaccaguaauauugacagacggaccugaacgugugauauuagcagguccaaugccagucaccgcugcgagcgccgcucaacggcgaggacgcguaggcaggaauccacaaaaagaaaacgaccaauacauuuucacaggacaaccguuaaauaacgaugaagaccaugcacacuggacagaagcuaaaaugcuauuagauaacauuaauaccccggaagggauuauuccagcucuauucgaaccagaaagggaaaaaucagcagcgauugacggagaauauagauugaagggagaaagccgaaaaacauuuguugaauuaaugcgaagaggggaccugccgguuuggcuugcacauaaaguagcaucggagggaaucaaauacacggaucgcaaaugguguuuugacggacagcgcaauaaccaaauccuggaggaaaacauggauguagaaauauggacuaaagagggcgaaaagaagaaacuacgcccccguuggcucgaugcuagaacguacagcgauccauuggcauuaaaagaauuuaaagaguuugccgccgguaggaagaguaucgcguuggaucuugucaccgaaauaggaaggguaccaagucaccuagcucauagaacgagaaaugcucuugacaacuuaguuaugcuacacacaagcgaacacggaggcagagcguacaggcaugccguagaagaauuaccggaaaccauggaaacacuauugcuucuagguuugaugauucuccugacagguggugcaaugcuauuccucauaucaggaaaaggaauuggaaaaaccucaauagguuuaaucuguguaauagcaucgucaggaauguuauggauggcggagauuccgcuacaauggauagccagcgcgauaguacuagaauuuuucaugaugguauuauuaauaccggagccugagaaacagaggacaccccaggacaaucaauuagcauacguaguaauagggauuuuaacucuagcagcaauuaucgcugcuaacgagaugggucugcuagagacuaccaagagagaucucggcaugucaaaagagccuggagucguaucuccgacuucauaucuugacguagacuuacauccugcauccgcguggacgcuuuaugcuguagccacgacgguaauuacaccaaugcuaagacauacgauugagaacagcaccgcaaacguaucacuugcagcaauagcaaaccaagcgguuguacuaaugggacuagauaaaggguggcccauaaguaagauggaucuugguguuccccuuuuagcauuaggauguuauucacaaguuaauccacuuacucuuacggcugcuguucuacuccuaauaacucauuaugcuaucauaggcccaggcuuacaagccaaagcuacacgagaagcccaaaagagaacggcggccgguauaaugaaaaacccaacagucgacggaauaaugacuauagacuuagauccuguaauuuacgacucaaaauuugaaaaacaauuaggacaaguuaugcuacuuguacuuugcgcaguacaacuguuacuuaugagaacgagcugggcacuaugcgaagcacuuacuuuggcaacggguccgauaacgacauuaugggaggguucgccggguaaauuuuggaacaccacuauugcgguaucaauggcuaacauauuucguggauccuacuuggccggagcaggccuagcuuucagcauaaugaaaagugugggcacuggcaaacgaggaacugggagucagggcgagacauuaggagaaaaauggaagaagaaacuaaaucaacuuuccagaaaggauuucgaucuauauaaaaagagugguauuacagagguagauagaacagaggcgaaagaaggacugaagcgaggagagauaacacaccaugcaguuaguaggggaagugcaaagcuacaaugguuuguugagcgaaauaugguaauaccggaaggaagaguaauugaccucggaugcggucgugguggauggucuuauuacugugcgggauuaaagaaaguaacagaggucagagguuacacaaaaggggguccaggucaugaggaaccuguaccaaugaguacauacggauggaauauagugaaacuaaugaguggaaaagauguauucuaccuuccaccagaaaagugcgacacauuguuaugcgauaucggggaauccucuccuuccccaaccguugaagaaagccgcacuauucgcguccuuaaaaugguagaacccugguugaaaaauaaucaguucugcauuaaaguccuaaauccauauaugccaacaguaauagaacauuuagaaagacuccagaggaaacacggaggaauguugguaagaaacccucuaucaagaaauucuacccaugaaauguauuggauaaguaauggaacagggaacauagucgcuucuguuaauaugguaagcaggcuuuugcuuaaccgguuuacaaugacacaccgaagaccaaccauagagaaagauguagaccuuggugcagguacacgucauguaaacgcagaaccugaaacaccaaauauggacguaaucggagaaagaauuaaacggauaaaagaagaacauaauucgacauggcauuacgacgaugaaaauccguauaaaacgugggcauaucacgguuccuacgagguaaaagcgacuggaagugcuucuagcaugaucaauggaguuguuaaacuucuaaccaagccaugggauguuguuccaaugguaacccaaauggcgaugacugacacaacgccauucgggcaacaacgaguauucaaggaaaagguugacacaaggacaccccguucgaugccagguacgagacgcguuaugggaaucacugcagagugguuauggcguacauugggaagaaauaagaaaccacgauuauguaccagagaagaauuuaccaagaaaguacgaaccaaugcagcaaugggggcaguguucacugaagaaaaccaaugggauucagcaaaagccgcuguagaggaugaggauuuuuggaagcuaguggacagggaaagagaauugcauaaauugggaaaaugugguaguuguguguauaauaugauggguaaacgagagaagaaauuaggagaguucggaaaagcuaaaggaucaagggcgaucugguacauguggcuaggcgcucgauauuuggaguucgaggcuuuagguuuccuaaaugaagaucauugguucucgagggaaaacucauauagcgguguagaaggagagggucuccauaaauugggcuacauauuaagagacauuaguaagauuccuggcggagcaauguaugcugaugacacugcagggugggacacaaggauaacagaagacgaucuacacaaugaagagaaaauaacacaacaaauggauccagaacacaggcagcuugcaaacgccauuuuuaaacuaaccuaucaaaacaaggucguaaaaguccaaaggccaaccccaacaggaacgguuauggauauuauaucaagaaaagaccaaagagguaguggccaaguagggacauauggacucaauacuuuuacgaacauggaggcccaguuaaucagacagauggagggagaaggaguguuaucgaaggcugauuuagagaacccgcauuugcccgaaaagaaaauuacccaaugguuagaaacaaaagggguggaacgucuuaaaagaauggcaauuaguggggaugacugugugguaaaaccaauugaugaucgauuugcaaacgcuuuacuugcacucaacgacauggguaaaguacgaaaagauauaccacaauggcaaccaagcaaaggauggcacgauuggcaacaaguuccuuucugcucacaccauuuccacgaauuaauuaugaaggacggucggaaauuagucguaccaugcagaccgcaggaugaacugauaggacgugcgagaauaagucagggcgcaggguggucacuuaaagaaacugcauguuuaggaaaggcguaugcacaaauguggaguuugauguacuuucaccgacgugacuuaagacuggcaucaaaugccauuuguagugcuguccccguucacuggguaccaacaucuagaacuacaugguccauucaugcacaccaucaauggaugacgacggaagauaugcucacaguauggaaccgagucuggaucgaagauaaucccuggauggaagacaaaaccccagugaccaccugggggaaugucccuuaucugggaaagagagaagaucaauggugugggagucucauuggccuaacaaguagagcuaccugggcacaaaauaucccuacagcaauccaacaagucaggagucuuaucgguaaugaagaauuuuuagacuauaugccgucaaugaagagguucagaaaagaagaggaaagugaaggugcuaucugguaa

SEQ ID NO: 23188 - RNA, 9873 nt, Artificial Sequence
  derived and/or modified CDS sequence (opt6) from DENV-3__HM631857__SS-prME
acgucacuaugcuuaaugaugauauugccugcggcacuagcuuuucacuuaaccaguagggauggcgaacccagaaugauaguuggcaaaaacgaaagaggaaaaucacugcuauucaaaacagcuuccggaauuaauauguguacuuuaauagcgauggaucuaggggaaaugugugaugauacaguaacauauaaaugcccgcacauaaccgaaguagaaccggaagacauagauuguugguguaaucuaacaucaacauggguaacauacggcacauguaaucaagcuggagaacaccggagagauaaacggaguguugcauuagcaccucauguagguaugggucuagauacccgcacucaaacauggaugagugccgaaggugcauggagacaaguggaaaaaguagaaacuugggcacuuagacacccuggauuuacuaucuuggcauuauuucuagcgcacuacauaggcacgagcuuaacccaaaaaguagugauauuuauuuugcuuauguuaguuaccccaagcaugacuaugagauguguagggguaggaaacagagacuucguggaggguuuaucaggugcuacaugggucgauguuguauuagaacauggaggcuguguaacuacuauggcgaaaaauaaacccacacuagacauagaauugcagaaaaccgaagcaacucaauuggcaacccuacgaaaauuaugcauagaaggaaaaaucacuaauauaacaacagacucacgauguccaacacaaggugaagcgacacugccggaagaacaagaccaaaacuauguuuguaaacauacauacguagacagaggauggggcaacgguuguggcuuauucggaaaaggcagucucguaacuugugcaaaauuucaaugucuggaacccaucgaaggcaaaguugugcaauaugagaauuuaaaauauacaguaauaaucacaguacacacaggugaccaacaccaaguaggaaaugaaacgcaagggguuacagcggaaauuacuccacaagccagcacgacagaggcuauccuaccagaauacggcacacuuggacuggagugcagcccacgcacgggacucgauuucaaugaaaugauacuuuugaccaugaaaaacaaagcauggauggugcaucgacaaugguucuuugauuuaccauuacccuggacgaguggugcaacaacugagacaccuacguggaauaggaaagaacuauugguaacauuuaaaaaugcacacgcuaagaaacaagaggucgugguauuaggaagucaagaaggggcaaugcauaccgcucuaacuggagccacggaaauacaaaauaguggaggaacuucuauauuugcaggacauuuaaaaugucgacuaaaaauggauaagcuagaauuaaaagguaugucauaugcuaugugcacgaacacuuuuguuuuaaagaaagaagucuccgaaacacaacacggaaccauacuaauaaaaguggaauacaagggagaagauguuccuugcaagauuccuuuuucaacagaagacggucagggcaaggcucacaacggccggcucauaacagccaacccaguagucacgaaaaaggaggagcccgugaacauagaagcugaaccaccauucggagaauccaacauugucauaggaaucggcgauaacgcucuuaagauuaauugguacaagaaaggauccaguauugguaaaauguuugaagcaaccgcgagaggugcuagaagaauggccauucuuggggauacagcgugggauuucggaagugucggugguguauuaaacucacuaggaaaaaugguacaccagaucuuuggcagcgcuuauaccgcauuauucucaggaguaucuuggguuaugaaaauaggcaucggaguauuacuuacuuggauaggucuuaauaguaaaaauaccaguaugagcuucaguugcauagcaauaggaauaauaacucuauaccuuggcgcagugguucaggcagauauggguugcgucauaaauuggaaaggaaaagaauuaaaaugcgggucaggaaucuucgucaccaaugaaguacacacguggacagaacaauauaaguuccaagcugauucaccuaagcgacuagcaacagcuauugcuggagccugggaaaauggaguauguggaauccguagcacgacgcgcauggagaauuuacuauggaaacagauagcgaaugaauuaaauuauauacuuugggagaauaauauaaaacugacaguuguuguaggagacaucauaggugucuuggagcagggaaaaagaacauugacuccccaaccuauggaacucaaauauaguuggaagaccugggggaaagccaagauaguaacagcugaaacacaaaauucuucuuuuaucauugacgguccuaauaccccagagugcccaagcguaucucgagcguggaauguuugggaaguugaagacuacggguuuggaguguucacaacaaacauaugguuaaaacuucgagaaguuuacacucaacuuugcgaccaccgccucauguccgcagcagugaaagacgaaagagcuguucacgcagacaugggauacuggauagagagucagaaaaauggaagcuggaaacucgaaaaggcaucacuuauagaggucaagacuuguacauggccaaaaucucauacacucuggaguaacggaguacuagaaucagauaugauuauuccuaaauccuuagcaggucccaucucccaacauaaucacagaccuggauaucauacccaaacggccggucccuggcauuuagguaaauuagaacuugacuucaauuauugcgaagguacuacaguaguuaucacggaaaauugcggaacaagaggcccaucuuuaagaacgacuacuguuucgggaaaauugauccaugaaugguguuguagaucauguacacuaccuccccucagauacaugggggaagauggaugcugguacggcauggagauaagaccaaucucugaaaaagaggaaaauauggucaaaucauuaguaagcgcggguucaggaaaggucgauaauuucaccaugggugugcuaugccuggcgaucuuauucgaggaagucaugcgugguaaauucggaaagaagcauaugauagcuggaguauucuuuacauuuguucucuuacucucgggucaaauaaccuggcgagauacagcacacacacuaaucaugauagggucaaaugcaucagauagaaugggcaugggcguaacauaccuagcauugauagcgacuuucaaaauccaacccuuuuuggcauuaggguucuuucugagaaaauugacaucuagagagaauuuauuauuaggcguaggauuggcgauggcaaccacccuccaacugcccgaggauauagagcaaauggcuaaugguaucgcauuaggccuuauggcuuugaaauugauaacccaauucgaaacauaucaacuauggacagcgcuaauuaguuugacauguucaaacacaauauuuacguuaacgguggcauggcguacagccacucuaauccucgcaggcguuucuuuacuaccagucugccaaaguaguucuaugagaaaaaccgauuggcuuccaauggcaguugcugcgauggggguaccuccauuaccgcuuuuuauuuuuggguugaaagacacacucaaaagacgauccuggccccugaacgaaggugugauggcaguuggauuaguauccauacuagcaaguagucuauuaagaaacgacgucccaauggcuggaccucuaguagccgguggccuuuuaauagcauguuaugugauaacagguaccagcgcugaccuuacaguugaaaaagccgcugauauuacaugggaggaagaggcugaacaaacgggaguaagccacaauuugaugauaaccguugaugaugauggaacaaugcgcauaaaagaugaugaaacagaaaacauauugacaguauuacuaaaaacagcuuugcuaauuguaucgggaaucuucccauacucuaucccagccaccuugcugguuuggcacaccuggcaaaaacaaacccaaagaagcggcguacucugggacguaccguccccuccugaaacccaaaaagcagaacuagaagaaggaguuuaucgaaucaaacaacaagguaucuucggcaagacccaaguuggcgucggaguucaaaaagaagguguauuucauacuauguggcauguaacgagaggggcgguuuugaccuauaauggaaaacggcucgaaccaaacugggcaucagugaagaaagaucuaauaucauacggagguggauggagacuuagugcccaguggcaaaaaggugaagaaguacaaguaaucgcuguagaaccugguaaaaacccaaagaacuuucagaccaugccaggcacauuccaaaccacgacuggagaaauuggagccauugcauuagacuuuaagccaggaaccagcggauccccaauaaucaauagagaggguaaaguugucggauuguauggaaacgguguugucaccaaaaauggagguuauguauccggcauugcgcaaacuaacgcugaacccgauggaccgacaccggaguuagaggaagaaauguucaagaaaaggaaucuaacaauaauggaucuacauccagguucaggaaaaaccagaaaauaucuuccagcaauaguucgggaagcuauaaaaaggagacuuagaacacugauauuggcuccaacuagagucguggcugccgaaauggaagaagcacuuaaagguuuaccaauacgauaucaaacuacagcuaccaaaagugaacauacaggacgagaaaucgcagauuugaugugucaugcuacguuuacuaugcgcuugcuaucgccgguucgugugccaaacuacaaccuuauaauaauggaugaagcucauuucacggacccggccucgauugcagcacgagguuacauuaguacgcgaguuggaaugggagaagcagcugcuauauuuaugacagcuaccccaccugguacagcugaugcauuuccccaaucgaacgcgccaauccaggaugaggaaagagacauacccgaacgguccuggaacucaggcaaugaguggauaacagacuuugcugguaaaacuguaugguucgugccaaguauuaaagcaggaaaugacauugccaacugccuccguaaaaaugguaaaaaggucauacaacuaucuagaaaaacuuucgacacagaauaucagaaaacaaaguuaaaugacugggacuucguuguuacgacugauauaucugaaaugggcgcaaauuucaaagcugacagaguuauugacccucguagaugccuaaaacccguuauccuuacugauggaccagaaaggguaauacuagcuggcccaaugccugugacagcagcaagugcggcacagcgucgggggagagucggacgaaacccacaaaaagagaacgaucaauacauauuuaccgggcagccacuuaauaacgacgaggaucacgcacacuggaccgaggccaaaaugcuacuggauaauaucaacacuccagaaggaauaauaccugcacuauucgaacccgaaagagagaagagugccgcaauugacggggaauaccgguuaaagggggaaucccgaaagacuuucguggaauuaaugcguagaggagaucucccgguauggcuagcgcauaaaguagccagugaaggcauuaaauauacggauagaaaaugguguuuugauggucagcguaacaaccaaauccucgaagaaaauauggacgucgagauauggacaaaagaaggugaaaagaagaaauugcgcccuagauggcuagacgcaagaacguauagugacccgcuugcccuuaaggaauuuaaggaguucgccgcuggcagaaaaaguauugcucuugaucuuguaacugaaauaggcagaguuccgucgcaccucgcccacagaacucgaaaugcacuagacaauuuagugaugcugcauacaucugaacacggagguagagcguaccgacaugcaguggaagaauuacccgagacuauggaaacucuauuauuacuuggacuuaugauauuguuaacaggaggagcaauguuauuuuuaauaucaggaaaggguaucgguaaaacuucaauaggcuuaauaugcguaaucgcuucuucgggcauguuauggauggcggagaucccucuccaauggaucgcuagugccauuguacuugaguucuuuaugaugguacuccuaaucccagagccggaaaaacaacgaacgccgcaggauaaccaauuagcauauguuguuauugguauacugacauuagcugcaguaaucgcugcaaacgaaauggggcuacuugaaacuacaaaacgagaccuaggaaugucuaaagaaccuggaguugucucaccuacuagcuauuuggaugucgacuuacauccggcguccgcauggacuuuauaugcaguugcaacaacuguaauuacuccaaugcugagacauacgauagaaaauaguaccgcuaaugugagucuggcagcaauugccaaccaagcaguuguguuaaugggucuugauaaaggguggccuauaaguaaaauggauuuaggcgugccacuccuugcacuaggauguuauucucagguuaauccacuaaccuuaacggcagcaguacugcucuuaauaacccauuaugcuauuauaggcccgggucuacaggcaaaagcgacacgagaggcucagaagaggacugcagcagguauaaugaaaaauccuacuguagauggcaucaugacaauagaccuugauccggucauuuacgacagcaaauuugaaaaacaacuaggacagguaaugcuauuaguucucugcgcaguacaguuauuacuaaugcggaccucuugggcuuuaugcgaagcauuaacccuagcaacaggcccgauuacaacacucugggaaggcucaccgggaaaauuuuggaacaccacaauagcagugucaauggccaauauuuuuagagggucuuaucucgcgggagcggggcucgcauucucuauaaugaaaagcguugguaccgguaaaagaggcacuggaucucagggggagacacucggugaaaaauggaaaaagaaacuaaaccaauuaucuagaaaggauuuugaccucuauaagaaaucaggaauaacugaaguagauagaaccgaggcaaaagagggauugaaaagaggcgagauuacacaccacgccguuucacgaggcucagcaaaauugcaaugguucguugaacgaaacauggugauaccugaaggaagaguuauagaccuagggugugggagaggggguuggucauauuacugcgccggacuaaagaaaguaacagaaguaagaggcuauaccaaagggggacccgggcacgaagaaccggucccaaugucaacauacgguuggaauauuguuaaauuaaugucaggaaaggauguauucuacuuaccaccagaaaaaugugauaccuuauuaugcgauauuggugaaaguagcccgucgccuacaguagaggaaucgaggacaauucgaguacuaaaaaugguagaaccuuggcucaaaaacaaucaauuuuguauuaaggucuuaaauccauacaugccuacagucauugaacaucucgaacggcuacaaagaaaacauggagggaugcuugugaggaauccucuaucgcguaauagcacacaugaaauguauuggauuuccaauggaacuggaaauauaguggccucaguuaauaugguuucucgauuauuauugaacagguucacaaugacgcaccgcagacccaccaucgaaaaagauguagaucuaggcgcagguacacgacaugucaauguggaaccagaaacucccaacauggacguaauaggugaaaggauaaaacggauuaaggaagaacauaauaguacauggcacuacgaugaugaaaacccauacaaaacuugggcauaucauggaagcuacgaagucaaagcaacggguucugcaagcucaaugauaaauggaguuguuaagcucuuaacuaaaccaugggacgucguuccgauggugacacagauggcuaugacagauaccacgcccuucggccagcaacgcguauucaaagagaaggucgauacacgcacuccacgaaguaugcccggcacuagacgagucaugggaauuacugcugagugguuauggcgaacauuaggaagaaauaagaaaccaagacuaugcacuagggaagaauuuaccaagaaaguucgcacaaacgcugccaugggugcugucuuuacggaagaaaaccaaugggacagcgcgaaggcggcaguugaagacgaggacuuuuggaaguuaguugaucgagagcgcgaacuucauaagcuggggaagugugggucgugcguuuauaacaugaugggaaagagagagaagaaauuaggugaguucgggaaagccaaaggaagcagagccauuugguacauguggcuaggcgcacguuacuuagaauuugaggcccuaggauucuuaaaugaagaucacugguuuaguagagaaaauaguuauagcggcguugaaggugaaggucuacacaaacuuggauauauucucagggauauaucaaagauaccugguggagcaauguacgcggacgauacagcagguugggacacucgaauaaccgaggaugaccugcacaacgaagagaagauaacacaacaaauggacccugaacauagacaacuagcuaaugcaauauuuaaguuaaccuaucaaaacaaaguagucaaaguacaaagaccaacuccuaccggcacaguuauggauauaauaucaagaaaagaucaaagaggaagcgggcaagucggaacauacggauugaauacauucacgaauauggaagcucaacuuauaagacagauggagggagaagguguauuaucuaaagcagauuuagagaacccacaccuaccagaaaagaaaauaacacaauggcuugagacgaaagguguugaaaggcuaaaaagaauggcuauuaguggagaugacuguguugucaaaccuaucgacgaccguuuugcaaaugcucuccuggcgcuuaaugacauggggaagguaagaaaagacaucccacaauggcagcccuccaagggauggcaugacuggcaacaaguaccauucuguagccaccacuuccaugaauuaauaaugaaggaugguagaaaacucguaguaccaugccgaccucaagaugaacuuauagggagagcaagaaucucccagggagcaggauggagucucaaagaaacagcaugucuagggaaagccuaugcacaaauguggagucuuauguauuuucauagaagagaucugcgauuggcgaguaaugcuauaugcagugcaguuccagugcacuggguaccaacaucacgaacgacuuggagcauucaugcgcaucaucaguggaugacaacggaagacauguugacuguuuggaaccgaguauggauugaggauaauccuuggauggaggacaaaacuccggugacaacgugggaaaaugucccauauuuagguaaacgagaagaucaauggugugguagucucauaggccuuaccucaagagccacuugggcgcaaaauauacccacagcaauccaacaagucagaucuuuaaucggaaacgaagaauuuuuggacuauaugccuagcaugaagcgguuuagaaaagaggaagagagugaaggagcgauuugguga

SEQ ID NO: 23189 - RNA, 9873 nt, Artificial Sequence
  derived and/or modified CDS sequence (opt6) from DENV-3__HM631860__SS-prME
acuucucuauguuugaugaugauauuaccggcggcucuugcuuuucaccucacaucaagagauggggaaccacgaaugaucguagguaaaaacgaaagaggaaaaucuuugcuuuuuaaaaccgcuaguggaauaaauaugugcacacucauagcuauggaccuaggagagaugugugaugacacagucacauauaaauguccacacauuacggagguagaacccgaggauauugauuguugguguaaucucaccaguacgugggugacauacgggaccugcaaucaagcaggggaacaccgaagagacaaaagaagcguugcgcuugcaccccacguaggaaugggcuuagacaccagaacucaaacauggaugagugcagagggagcauggagacaaguagagaaaguggaaacaugggcauuaaggcacccaggcuuuacaauucuggcuuuauuucuugcccacuauauugguacgucucugacacaaaaagugguuauuuuuauacuucuaaugcuuguaacaccaagcaugaccaugagaugugucgguguugguaauagggauuuuguggaaggacuaaguggggcaaccuggguagacguuguucuugaacauggagguugcguuacaacgauggccaaaaacaaaccuacgcuggauauugaacuacagaaaacagaggcaacgcaauuagcuaccuuacgaaaacuauguaucgaaggaaaaauaacuaauaucacaaccgacagucgaugcccaacccaaggcgaagcuacucugccggaagaacaagaccaaaauuauguauguaaacauacuuauguugaucgugguugggguaacggauguggauuauucggaaaaggaucuuuagucacaugcgcaaaauuucaaugucuugagcccauagaaggaaaaguaguccaauacgaaaaucuaaaauauacgguuauuauaacuguacauacaggagaccaacaucaagucgggaaugaaacacaaggaguuacagcugaaauaacaccacaggcuucaacuacggaagcaauuuuaccagaauaugguacacucgguuuagaguguagcccacgcacaggucuugauuuuaacgagaugauccuccuaacaaugaaaaauaaagcauggaugguacaucgacaaugguucuucgaucuuccacucccuuggaccucgggagcuacuacagaaacuccaacauggaacagaaaagagcuauuagucacauucaaaaaugcacaugccaagaaacaagaaguagucguucuggggagccaagaaggugcuaugcacacagcacugacuggcgcuacagagauacaaaacaguggaggcacaucaauuuucgcaggucauuuaaaaugcagguuaaaaauggauaaauuagaauuaaagggaaugucauacgcaauguguacaaauaccuuuguacucaagaaagaaguuagugagacgcaacauggaacaaucuugauaaagguagaauacaaaggugaagacguaccauguaaaauaccauucucaacagaggauggccaagguaaagcacauaauggaagacuaauuacagcuaauccaguuguuacuaagaaagaagaaccagucaacauagaagcagaaccuccauucggagaaucaaacauuguaauugggauuggagauaacgcucuuaaaaucaauugguacaagaaaggaucuagcaucggaaagauguucgaagcuaccgccaggggugcucgcagaauggcaaucuuaggcgauacagcaugggacuuuggaucuguagggggaguacuaaauucauuaggaaagaugguucaccaaauauucggaagugcuuacacagcuuuauuuucaggugucuccuggguuaugaaaauugguauuggagugcugcuaacauggauagguuuaaacuccaagaacacaagcaugucauuuuccugcaucgcaaucggcauaauuacccuguaucuaggcgcuguuguacaagcugauaugggauguguggugaacuggaaaggaaaagaacuaaaaugugguucuggaauuuucgugacgaacgagguacacacuuggaccgaacaguauaaauuccaggcagacagcccaaaacgauuggcaaccgcaauugcuggagcgugggaaaacggagugugcggaauaagaucaacuacgagaauggaaaaucuacucuggaaacaaauugcgaaugaacuuaauuauauauuaugggaaaauaauauuaaauuaaccgucguggucggugauauaauuggaguccuagaacaaggaaaacgaacacuaacaccacaaccaaaagaauugaaauauucuuggaagacaugggguaaagcaaagauuguuacagcugagacacaaaacaguuccuucauaaucgacggccccaacacaccugaaugccccagugucaguagggcguggaauguaugggagguugaagacuauggauuugguguauuuacaaccaauauuugguuaaagcuaagagaaguauacacccaauuaugcgaccaccgcuugauguccgcugcaguuaaagaugagagagcggugcaugcggacaugggcuacuggauagagucgcagaaaaacggaaguuggaaacuagaaaaagcaagccucauugaaguuaaaacguguacauggccaaagagccacacauuguggaguaauggcguucuagagagcgauaugauuauuccuaaaagccuugcagguccaauuagucaacauaaccacagaccuggcuaccacacucaaaccgcugggcccuggcaucugggcaaauuagaauuagacuucaacuacugugaaggaacaacuguugucaucaccgaaaauuguggaacgagaggaccaagucucagaacaacaacggucucggggaaacuuauccaugaaugguguuguagaucguguacauuaccaccccuucgcuauaugggagaagauggcugcugguauggcauggaaauaagaccgauaucagaaaaagaggagaacaugguaaaaucauuaguaagugcugguuccggaaaaguagauaacuucacaaugggaguacuuugucucgcaaucuuauuugaagaaguuaugcguggaaaauuuggaaagaaacauaugauagcaggcguuuucuucaccuuuguccuuuuauuauccggccaaauuacuuggcgcgauauggcacauacuuuaauaaugaucgggagcaaugcaucagaccgcaugggaaugggcgugacuuaccuagcguuaauagcaacguucaaaauucaaccauuuuuagcccuuggauucuuccucagaaaauuaacuucaagagaaaacuuacuauugggaguaggcuuagcaauggccaccacuuugcaacuuccagaggauaucgaacaaauggcaaacggaauagcucuuggcuuaauggcauuaaaacuuaucacucaguucgaaaccuaucaguuauggaccgcguugauuucguuaacauguuccaauaccuacuucacauuaacaguagccuggagaacagcaacacuaauucuagcggguguuagccuauuacccguaugccaaucaucaucuaugagaaaaacugauuggcucccaauggccguugcagccaugggcguaccuccccuuccauuguuuaucuuuucacucaaagauacccuuaagcggagaaguuggccacuaaacgaaggggugauggcuguaggcuuaguuagcauauuggccucaagccuacuucguaacgacguuccgauggccggaccguugguagcaggggguuuacuaauugcaugcuacguaauaacagggacaucagcugaucuaacaguugaaaaagccgccgacauaacuugggaagaggaggccgaacaaacaggcgucucucauaaccuaaugauaaccguagaugacgacggcaccaugaggauaaaagacgaugaaacugaaaauauauuaacuguccuuuugaaaacugcgcuacugauugugucagguauuuuuccauacucuauccccgcaacucuauuaguuuggcacacauggcaaaaacaaacacagaggagugguguauuaugggauguaccgagcccucccgaaacccaaaaagcugaauuagaagaagguguauaucgaauaaagcaacaagguauauuuggaaagacacaaguagggguaggggugcaaaaagaggggguauuucauacaauguggcacguuacaagaggggcuguacuaacauauaaugguaagagguuggaaccuaacugggcuagugugaagaaagauuuaauuaguuacgggggaggguggagauuauccgcccaauggcagaaaggugaagaaguucaaguuaucgcggucgaaccggguaaaaaucccaaaaauuuccaaacaaugccuggaacauuucagacaacaacaggagagaucggagcaaucgcucuggacuuuaaacccgguacaucaggaucuccgauuauaaauagagaagguaaagugguaggauuauacggaaaugguguaguaaccaaaaacggugguuacguauccggaauugcccaaacuaacgcugaaccagacggaccgacaccugaauuagaagaagaaauguuuaagaaacgaaauuuaacaauuauggacuuacaccccggcucugguaaaaccagaaaauaucucccagccaucguuagagaagcaauuaaacgcaggcuuagaacccugaucuuggcacccacgcgggucgucgcggcagaaauggaagaagcucugaaggggcuuccuaucagauaccaaacuaccgccaccaaaucagaacauaccggcagagaaauagucgauuuaaugugucacgcuaccuuuacuaugcguuuguuaucgcccguaagagugccuaauuauaaccuaauuaucauggaugaggcgcacuuuacugacccggcgucuaucgcugcuaggggcuacauaucgacgcgcguaggaaugggcgaagcagccgccauauuuaugacugcgacucccccaggaacugcagaugccuucccacaaaguaacgcaccuauucaggaugaggaacgugacauacccgaaaggucuuggaacaguggaaaugaauggauuacugauuuugcuggcaaaacaguaugguuugucccaucuaucaaagcaggaaacgauauugcgaauugucuacgaaagaauggcaaaaagguaauacaauuaaguagaaaaacauuugauacagaauaucagaaaacgaaacuaaaugacugggauuucguuguaacaacggauauaucagaaaugggugcaaacuuuaaggccgacaggguaauagauccucguaggugcuuaaaaccagugauuuuaacugacggaccugagagagucauacucgcagggccaaugccagugacggcagcaucggcugcucaaagaagaggaaggguaggccggaauccucaaaaagaaaaugaucaguacauauuuaccggacaacccuuaaauaaugacgaggaucaugcucauuggacagaagcuaaaauguuauuagacaacauuaauacaccugaggguauaauaccagcacucuuugaacccgaaagagagaaaagugcagcgauugauggagaauauagauugaaaggggaaucgcgcaaaacuuucguugagcugaugcgacgaggugauuuacccguuugguuagcacacaaaguggcgucagaagguauaaaauauacggauagaaaauggugcuucgauggacaaagaaauaaucaaauuuuagaagaaaauauggacguagagauuuggaccaaagaaggggagaagaagaaacuacgcccacguuggcuugacgcaagaacguacucggauccucuagcucuaaaagaauuuaaagaauuugccgcugggagaaaaaguaucgcauuagaucuaguuacagagauaggacgggugccuagucaucuugcucaucggacgcgcaacgcucuagacaauuuaguaaugcuucacaccagugaacacggaggcagagcauauaggcacgcaguugaggaacucccggagacaauggaaacacuacuauuacuuggcuuaaugauauuguuaacuggaggugcuaugcuauucuugauuagcggaaaggggauagguaaaacauccauaggucuuaucugcgugauugcuaguucuggaaugcucuggauggcugagauaccccuccaauggaucgcgucagcgauuguacuggaguucuuuaugaugguguuauuaaucccagagcccgaaaaacaacgaacgccucaagauaaccaauuagccuaugucguaauuggaauacucacccuagccgccauaauugcugcaaaugaaaugggucuauuagaaaccacaaaaagagauuuggguaugagcaaagaaccaggaguuguuagcccuaccaguuauuuagacgucgaucuacauccagcgucagcguggacacucuaugcuguagcaacuacgguuauaacaccaauguuacgacacacuauagagaauaguacggcaaauguaucucuagcagcaauagcaaaucaagcugugguauuaaugggacuugauaaaggauggccuauuucuaaaauggauuuaggcgugccauugcuagccuuaggcuguuacucacagguaaauccauuaacauuaacagcggcuguacuacuccuuauaacucauuaugcaaucauuggucccggucuucaggccaaggcgacgcgagaagcacaaaagcgcacagcugcagguauaaugaagaacccgaccgucgacggaaucaugacaauagaccuggauccaguuauauacgacaguaaguucgagaagcagcuaggacaaguaauguugcuaguacugugcgccguacaauuauugcuaaugagaaccucuugggcacuuugcgaagcacugacacuagcaacggguccuaucacaacucuaugggaagguuccccgggaaaguucuggaauaccaccauagccguuucgauggcuaacauuuucagagguucuuauuuagcuggugcaggacuugccuucucaauaaugaaauccgugggaacaggaaagagaggaacagggagucagggugaaacacucggagaaaaauggaagaagaaacuaaaucagcuuagcagaaaagacuuugaucuauauaagaaaucugguauuacugaaguagacagaacagaggcaaaggaggguuuaaaacggggcgagauaacccaucaugcuguguccagaggaucggcgaaauuacaaugguuuguugaaagaaauaugguuauaccggaaggucgcguaaucgacuuaggaugcggucgaggaggauggagcuauuauugcgcgggacucaagaaagucacggaaguuaggggcuauacgaaaggggguccuggccaugaggaaccugucccaaugucaacguauggauggaacauaguuaaacugaugucaggaaaagauguauucuauuugccaccagaaaaaugugacacuuuauuaugcgacauaggggaaucaagccccucaccgacuguugaagaaagcagaaccauaagaguguuaaaaaugguagaacccugguugaagaacaaucaguuuugcauaaaagucuuaaauccuuauaugcccacaguaaucgaacaucuugaaaggcuacaacguaaacacgguggaaugcuaguucgaaaccccuuaagccguaacucuacacacgaaauguacuggauuagcaaugguaccggaaacaucgucgcuaguguuaacaugguaucacgauuacuucugaauagauucaccaugacgcauaggagacccacaaucgaaaaagacguugaucucggggcgggaacucgacacguaaaugcugaaccugagacaccgaauauggauguaauaggagagaggauuaaacgaauaaaagaggaacauaacucaaccuggcacuacgacgaugagaacccauauaaaacaugggcauaucacgggucauaugaaguuaaggcaacggggagugcgucgagcaugauaaacggaguuguaaaacuacugacaaagccaugggaugugguuccaauggucacacagauggcaaugaccgauacuacacccuuuggacagcaacguguuuucaaggaaaagguagacaccaggaccccuagaucaaugccagggaccagaaggguaaugggcauaacagcggaaugguuauggagaacgcugggaaggaauaagaaaccgcguuugugcacuagagaggaauuuacaaagaagguucggaccaaugcagccaugggagcuguuuuuacugaagagaaucagugggacagugcgaaagcggcgguggaagacgaagauuucuggaaacugguggaccgcgaacgcgaacuucacaaacugggaaagugugguucauguguauauaauaugaugggcaaacgggagaagaaacuuggugaguuuggaaaagcaaaaggaucacgagcuauuugguauaugugguuaggcgcccguuauuuagaauuugaagcccuaggauuuuuaaacgaagaucauugguucuccagagaaaauucauauaguggaguagaaggugagggauugcauaagcuagguuacauucucagagacaucaguaaaaucccuggaggagcaauguaugcugacgacacagcuggaugggacacucguauuacugaagaugauuugcauaacgaagaaaagauaacacaacaaauggauccagaacacagacaauuagcaaacgcgauuuucaaauuaaccuaucaaaacaaaguaguaaaaguacaaagacccacaccaacuggaaccguaauggauaucauuucucggaaagaucaacggggaucaggucaaguuggcacuuauggacugaauacuuuuacuaauauggaagcucaacugaucagacaaauggaaggagaagguguguugucgaaggcugaccuugaaaauccucaucuaccugaaaagaaaaucacucagugguuggaaacaaagggaguagagagacugaagcgaauggcuauaagcggagacgauuguguuguuaaaccgauagaugacagguucgcuaacgcauuauuagccuuaaaugauaugggaaagguaagaaaagacauaccacaauggcaaccgaguaaaggauggcacgacuggcaacaggugccauuuugcucucaucacuuccacgaauuaauaaugaaggacggacguaaauugguaguaccuugccgaccacaagaugaacuuauuggcagggcaagaauaagucaaggagcgggcuggucuuugaaagaaacagcaugccuaggcaaagcguacgcacagauguggucauuaauguauuuccaucguagggaccuacggcucgcuagcaaugcgauaugcagugcggucccuguucacugggugccaacgaguagaaccacauggagcauacacgcgcaucaucaauggaugacuacggaagacauguuaaccguuuggaaucgaguguggauagaagacaaccccuggauggaggacaagacaccgguaacaacaugggagaacguacccuacuugggcaagagggaagaccaguggugcggaaguuugauuggucugaccucucgugcuaccugggcucaaaauaucccuacagcuauucaacaaguucguuccuuaauagggaaugaggaguuccuggauuauaugccaucgaugaagcgauuccgcaaagaggaagaaucggagggagcuauaugguag

SEQ ID NO: 23190 - RNA, 9873 nt, Artificial Sequence
  derived and/or modified CDS sequence (opt6) from DENV-3__HM181977__SS-prME
acuagcuugugcuugaugaugauuuuaccggcagcguuagcuuuucauuugacgucaagagacggugaaccacgaaugauagugggcaaaaaugaaagaggaaaaagucuucuuuuuaaaacagcaagcgguauuaauauguguacauuaauugcaauggauuuaggggaaaugugugacgacacuguaacauacaaauguccgcacaucacagaaguugaaccugaagauaucgauuguuggugcaacuugacaaguaccugggucacuuauggaaccugcaaccaagcaggggaacacaggagggacaaaagaaguguggcacuagcuccgcauguggggaugggacuugauacucgaacgcaaacauggaugucugcggaaggugcuuggagacaaguagaaaaaguagagacaugggcauuaagacacccggguuuuacaauauuagcgcucuuuuuagcgcauuauauuggaaccucgcuaacucagaaaguuguaauauucauucuacuuaugcuagugacaccuaguaugacgaugcgauguguaggaguugguaaucgugacuucguugaaggacuuucuggcgcaacauggguagauguugugcuggaacauggaggcugcgugacuacgauggccaaaaauaaaccgacucuugacaucgaauuacagaaaacggaagcaacgcaauuggccacgcuucguaaauuauguauagagggaaaaauaacuaacauaaccaccgauagccgauguccuacucaaggagaggcaacucuaccagaagaacaagaucaaaauuacgucugcaaacacacguauguagaucgcggaugggggaacggauguggcuuauuuggcaaagguucacuuguaaccugcgccaaauuccaauguuuagaaccuauugaggggaaaguuguccaauaugaaaaucuuaaauauacagucaucauaacuguacacacaggugaccagcaucaagugggaaacgagacgcaaggaguaaccgcagaaaucaccccacaagcaagcacuacggaggcuauacuacccgaauauggaacacuuggucuugaaugcucuccccgaacugggcucgauuuuaaugaaaugauauugcuuacuaugaaaaacaaagccuggauggugcaucgccagugguucuuugacuugccauuaccuuggacaucgggcgccacaacggagacgcccacuuggaaucguaaagaauuguuaguaacauuuaaaaacgcucaugcgaagaaacaggaaguagucguacuugguagucaggaaggggccaugcauacugcccuaacaggagccacagaaauacaaaauucagggggaacaaguauuuuugcaggacaucucaaauguagauuaaaaauggacaaacuugaacugaaagguaugucguacgcuauguguaccaacacauucguacuaaagaaagagguaucagagacucaacaugguacuauucuaauaaaaguagaauacaaaggugaggaugucccaugcaaaauuccauuuucuacugaagauggucagggcaaggcccauaauggaaggcugauaacagcgaauccggugguaacaaagaaggaagaaccagugaacaucgaagcggaaccuccguuuggagagucgaauauugucauuggaaucggcgauaaugcacugaagauaaauugguauaagaaaggaucuucuauagguaagauguuugaagccacugcaagaggagcccggagaauggcuauacugggugauacagcaugggacuuugggagcguagggggaguacuaaacagccugggaaagaugguucaucaaauauuuggauccgcauauacagcuuuguuuucaggcgucaguuggguuaugaagaucgggauugguguucuuuuaacauggauaggacuuaacaguaagaauacuagcauguccuuuagcugcauugccaucggaauaauaacucuauaccuuggcgcaguuguucaagcggauaugggcuguguuguaaauuggaaagguaaggagcuuaaaugugguucaggaaucuuugucacaaaugagguacauacuuggacggaacaguauaaauuucaagcagacaguccaaagaggcucgcgacggcuauugcuggcgcuugggaaaacggcgucugcgguauucgaucuacgaccagaauggaaaauuugcuuuggaaacaaaucgcgaaugaauuaaauuacauacuaugggagaauaauauuaaauugaccguaguagugggugacaucauaggaguacuugaacaaggcaagagaacuuugacuccacaaccuaaagaacuaaaauacaguuggaaaacaugggguaaagcuaagauuguaacugcugaaacccaaaacagcaguuucauaauagauggucccaauacuccggaauguccaucgguuucacgugcguggaacguaugggaaguugaggauuaugguuuuggaguuuucacaacgaauaucuggcuaaagcugagagaaguauauacgcaguugugcgaccauagauuaaugagcgcggcagugaaagacgaaagggccguacaugcggacaugggauauuggauagagagccagaaaaacggaaguuggaaacuagaaaaggccagcuuaauugaaguaaagacauguaccuggccuaaaucacauacuuuauggaguaacggcguguuagaaagugauaugauaauuccaaagucacuagcagguccaaucucccaacauaaccacagaccuggguaccauacccagacagcaggaccuuggcaucuuggcaaauuggaacucgauuuuaauuacugcgaggguacuaccguuguuaucacugagaacugcggaacacgagggccuuccuugcgcacaaccacgguaucaggaaaacugauacacgaaugguguugucgaucuugcacuuugccaccucucagauacaugggugaagacggaugcugguaugguauggaaauccgaccaaucucagagaaagaagaaaauaugguuaaaucuuuaguaucagcagggaguggcaaaguugauaauuucacaaugggcgucuugugucuagcuauauuguucgaggaaguuaugcguggcaaguuugggaagaaacauaugaucgcugggguauucuuuacuuuugucuuacuacuaagugggcagaucacguggcgagacauggcucauacuuuaauaaugauaggcagcaacgcuucagaucgcaugggaaugggagugacuuaucuagcuuuaauugcuacauuuaaaauucaaccuuucuuagcauuaggauucuuuuuaagaaaauuaaccagcagagaaaaccuacuuuuagguguuggacuggcaauggcuacgacucuacaacucccagaagacaucgaacagauggcaaacgggauugcucuaggcuuaauggcauuaaaacuuaucacacaauucgaaacguaucaacuauggacugcacuaauaagucuaacgugcaguaacacaauuuuuacucuaacuguugcauggagaaccgccacacuaaucuuagcgggaguuucacuacuaccaguuugccaaucgaguaguaugcgaaaaacagacuggcucccuauggcugucgcagcuaugggaguuccaccauuaccgcuguucauauuuucauuaaaagauacucuuaagcgucgaaguuggccauuaaacgagggagucauggcugugggcuuaguaaguauacuagcuaguucacuauuaaggaaugacguuccuauggcuggaccccuggucgccgguggucuuuuaaucgcauguuauguaauaacuggaaccucagcagaucugacagucgagaaggcagcagacauaacaugggaagaagaggccgaacaaacagguguaucacauaauuuaaugauaacaguggaugacgacggcacuaugagaauaaaagaugacgaaacugaaaauauauugacugugcugcugaagacagcacuguuaauaguauccgggauuuuuccauauagcauaccggcaacacucuugguuuggcacacguggcagaaacaaacacaaagaagcggaguauugugggauguaccaucgcccccggaaacucagaaggccgaacuagaagaaggcguauaucggaucaaacaacaagguauauuugggaaaacgcaaguugguguaggcguacaaaaagagggaguuuuccauacaauguggcacguaacacgcggugcgguacuaacauacaacgggaaaagacuagaaccaaauugggcaagcguaaagaaggauuuaauaucuuauggaggaggauggaggcugucugcacaauggcaaaagggugaagagguccaaguaaucgcagucgaaccaggcaagaacccgaaaaauuuucagacuaugccagggacguuucagacgaccacgggagagauaggagcgauagcccuugacuucaagcccggaaccucuggaaguccgauaauuaaccgagaagggaaggucgugggauuauacggcaacggcguugugacuaaaaacggaggguacgugucuggcauagcacaaacgaacgcagaaccagaugguccaacgcccgaacuugaagaagagauguuuaagaaacgaaaccuaacgauuauggaccuacauccugguucugggaaaacucgaaaguaccucccagcgauugucagagaagcaauuaagcgaagacucagaacucuuauacuugcgccaacucggguagucgcagcagagauggaggaggcucuaaaaggguuaccaauacguuaccaaacuacugcaacuaaaucagagcacacaggacgugagauugucgacuuaaugugccaugcaaccuucacaaugcguuuacuuuccccagugagagucccaaacuacaauuuaauaauaauggacgaggcacacuuuacagauccagcgucuaucgccgcccguggauauauaucaacacguguaggaaugggugaagcugcagcaauauucaugacagcuacaccaccuggaacagccgaugcauuuccccagucgaacgcgcccauucaagacgaggaacgagauauuccagaacguucuuggaauaguggaaaugaauggauaaccgacuuugcaggcaaaacaguaugguuugugccaucaauaaaggcgggaaaugacauagcgaauugccugaggaaaaaugguaagaaaguuauucaauuaucaagaaagacauuugauaccgaauaccagaaaacuaagcuaaacgacugggauuuuguagugacuacagauauuucugaaaugggcgcgaauuucaaagcagauagaguuauugauccuagaaggugucuuaaaccgguaauucuaacagauggucccgaaagaguaauuuuagcagggccaaugccgguaacagcggcaucugcagcacaaagaagaggacguguuggacggaauccacaaaaagaaaaugaucaauauaucuuuacaggacaaccucugaauaaugacgaggaccacgcucauuggacagaagccaaaaugcuacuugacaauaucaauacaccagagggaauuauacccgcuuuauuugagcccgagcgagagaaaucugcagcgauagacggugaguacagacuaaaaggagaaucgcggaagacauucguggaauugaugagacguggcgaucuaccgguaugguuagcccauaaaguugcaagcgaaggaauaaaauauacugaucguaaaugguguuuugacggucaaaggaauaaccaaauccuugaagaaaauauggauguugagaucuggaccaaggagggagagaagaagaaacuaagaccuagauggcuggacgcucgaacauacagcgauccacuagcacugaaagaauuuaaagaguuugcggcuggacgaaaaagcauugcccuagaucuagugacagaaauugguagagugccaagccauuuggcacaucgaacccgcaacgcauuggacaaucuaguaauguugcacacuagcgaacauggugguagagcauaccgacacgcaguugaagaguuaccagaaacaauggagacauuacuucuucuugguuugaugauacuacuaacagguggggcuaugcuguuucuaauuucagguaagggaauagguaaaacaaguauagguuuaauuugcguuauagcaaguagcggaaugcuauggauggcugagauuccgcuccaguggauugcgucugcuauaguuuuagaauuuuucaugaugguauugcuaauuccagaaccugaaaagcaaaggaccccacaagacaaucagcuagcauauguuguuaucgguauucuaacauuagcagccauaauugccgcaaaugaaauggguuuacuagaaacuacaaaaagagacuugggaaugaguaaagaaccaggagucguuagucccacuucauauuuggauguagaccuacaucccgcauccgcguggacguuauaugccguagcaacuacaguaauuacaccgauguuaagacauacaauugaaaauucgacagcaaaugucaguuuagcagcaaucgcaaaucaggcgguaguauuaaugggauuggauaaagguuggccuauuaguaaaauggacuuagguguaccacucuuagcauuaggcuguuauagucaaguaaauccucugaccuuaacagccgcaguacuacuguugauaacgcauuaugcaauuauaggcccaggauuacaggcaaaagcuacgcgcgaagcacaaaaacguacagcugcaggaauuaugaaaaauccaacuguagacgggauaaugacgauagauuuagauccagucaucuaugacagcaaguuugagaaacagcuaggucaagugaugcugcucguacugugugcaguacaacugcucuugaugagaacuucuugggcgcuuugugaagcacucacauuagcaaccgggccgauaacuacauuaugggaagggucaccgggaaaauuuuggaauacaacaauagcaguuucaauggccaauauuuuucgaggcaguuaucuugcuggagccggucuugcuuucucgauaaugaaaaguguugguacaggaaagagaggcacaggcucacagggugaaacuuuaggcgagaaauggaaaaagaaauuaaaccaguuauccagaaaagauuuugauuuguauaagaaaagcggaauaaccgaaguugaccggacagaggcuaaggaagggcuaaaaaggggugaaauaacacaucaugcuguuagcagagggagugcaaaacugcaaugguuuguugaaagaaauaugguaaucccugaaggccgaguaaucgaucuuggauguggccgaggcggauggucauauuauugcgccggauugaaaaagguuaccgaagugcggggcuauacuaaaggaggccccggccaugaggagccaguaccgaugucaacauacggcuggaauauaguaaaacugaugucagggaaagacguauuuuaucuaccgcccgaaaaaugcgacacccugcucugugacaucggggaaucuucgccaaguccaacaguagaggaaucacgaacaauaagaguuuuaaaaaugguagagccguggcucaaaaauaaucaauuuugcauaaagguccuaaauccguacaugccuacaguaauagaacaccuagaaagacuacaacgaaaacacggcgguaugcuaguucguaacccacucuccagaaacucaacccacgaaauguauuggaucucuaauggcaccggcaauauaguggcgucgguaaacaugguaucgcgccuauuauuaaaucguuuuacuaugacucacagacguccgacaauagaaaaagauguagaccucggagccggaacaaggcauguaaaugcagaaccagaaacgccaaacauggauguaauaggagaaaggauaaagagaauaaaagaggaacacaauucaacguggcacuaugaugacgaaaacccuuauaaaaccugggccuaucacggaucauacgaaguuaaagccacgggaagugccagcucuaugauaaacggagucgugaaauugcuaacaaaaccaugggacgucguaccuauggugacccaaauggcuaugacagacacgacgccauuuggacagcaaagaguguucaaagaaaaaguagacacuagaacgccaagaucaaugcccggaacuagaagaguaauggguaucaccgcugaauggcuuuggagaacacuuggaagaaacaagaaacccaggcuuuguacuagagaggaauuuaccaagaaaguaagaaccaaugccgcaaugggcgcagucuuuacagaggaaaaucaaugggauuccgcuaaggcggcuguagaggaugaagauuuuuggaaacuuguggauagagagcgggaauugcacaaacuaggaaaaugcggcuccuguguguacaauaugaugggcaaaagagagaagaaacucggagaguuugguaaagcuaaaggaucgagagcuauuugguauaugugguuaggcgcgcguuaccuggaauuugaggcauugggauuucuaaaugaagaucauugguucucacgcgaaaacagcuauagugggguugagggugaaggauuacacaaacucggauacauauuacgagauaucucaaaaauaccagguggcgcgauguaugccgacgauacugcuggaugggacacccgaaucacagaagacgaucuucauaaugaagaaaagauaacacaacagauggacccagaacaucggcaacuggcaaaugcuauuuucaaguuaacuuaccaaaacaaagugguaaaaguccagaggccuacaccaacugguacggugauggacauaauuucaagaaaagaccaaaggggaaguggucaggucggcacauacggacucaauacauucaccaacauggaagcacaguuaaucagacaaauggaaggagaaggaguacucuccaaggcggauuuagaaaauccucauuuaccggagaagaaaauaacccaaugguuagagacaaaaggaguagaaagacuuaaaagaauggcaauaucuggagacgauugcguaguaaaaccaauagaugacagguuugcaaaugcauuacuugcacucaacgacauggguaaagucaggaaagauauaccccaauggcaaccaucaaagggauggcaugauuggcaacaaguaccauucuguagccaucauuuucaugaauuaauaaugaaagauggucgaaaacuuguaguaccauguaggccacaagaugaacucauuggaagggcuaggauuagucaaggagcagguuggucucucaaagagacugcgugccuagguaaggcuuaugcacagauguggagucuaauguacuuucaucgucgagaucugcgguuagccucuaaugcaauuuguagugcuguaccuguucauuggguaccaacgaguagaacuaccuggucuauacaugcccaucaccaauggaugaccaccgaagacaugcuuacaguuuggaauagaguuuggauagaagacaauccuuggauggaagauaaaacacccgucacuacgugggaaaacgucccuuaucugggaaaaagagaagaucaauggugcggcagccucauaggccuaacgaguagggcuacaugggcacaaaauauaccuacagcaauacagcaaguaaggucacuaaucggcaaugaagaauuuuuagacuacaugccaaguaugaagagauuccguaaggaggaggaaagugagggggcaauaugguaa

SEQ ID NO: 23191 - RNA, 9873 nt, Artificial Sequence
  derived and/or modified CDS sequence (opt6) from DENV-3__HM181978__SS-prME
acuucucucugucugaugaugauauugccugcagcgcucgcuuuucaucuuacaagccgagacggggaacccaggaugauuguaggaaaaaaugaaaggggaaagagccuuuuauucaagacagcaagcggaauaaauauguguacauugauagcuauggauuuaggagagaugugugacgauacugucacauauaaaugcccccauauaacugagguggagccagaagauauugauuguuggugcaaucuaacaaguacuuggguaacauauggcacaugcaaucaagcuggagaacacagacgagauaagaggucaguagcacucgcgccgcacgucggcaugggauuagacacuagaacccaaacguggaugagugcugaaggugcauggcgacaaguugagaaaguagaaacaugggcuuuaagacauccgggguucaccauucucgcauuguuuuuggcucauuacauagguacaucucuuacacagaaaguugucauauucauacuucuuaugcuaguaacgccauccaugacgaugcgaugcguagguguagguaaccgagauuuuguggaaggacuuucaggcgcgacuuggguagacgugguguuagagcauggagguugcgucacuaccauggcgaaaaauaaaccuacauuagauauagaauugcaaaaaacugaagcgacucaacuugcaacucugcgcaaacuuugcauagaggguaaaauaacaaauauaaccacugacagcagguguccuacccaaggugaagcuacacuaccagaagaacaagaucagaauuacguaugcaaacacaccuaugucgauagggguuggggaaacggauguggauuauuuggaaaggggagucuaguaacaugcgcaaaauuccagugccuagaacccauugaagggaaaguaguacaauaugagaauuuaaaauacacaguaauuauaacagugcacacgggggaucagcaucagguaggcaaugagacacaaggggugacggcagaaaucacgccacaagcgucuacaacagaagcaauacuuccggaauaugguacgcucggacuagaauguaguccucgaacuggucucgacuucaaugaaaugaucuugcuaacaaugaaaaauaaggcauggaugguucauagacaaugguuuuuugaucuuccucugccauggacuucuggggcaacaacagaaacaccuacauggaauaggaaagaguuauuagugacuuucaagaaugcacaugcaaaaaaacaagaaguaguuguacuaggcagccaagaaggagcgaugcauacggcccuaacaggugcuacugaaauucagaauagcggaggaacuuccauuuuugcaggacacuugaaaugcaggcuuaaaauggacaaauuggaacuaaaagguaugaguuaugccauguguacaaauacauucguucuuaaaaaagagguuagugaaacccaacacgguaccauccuuauuaaaguggaauauaaaggagaagauguacccugcaagauaccauuuucaacagaagacggucaaggaaaagcccauaaugggcgauuaauaacagcgaauccuguuguuaccaaaaaagaagaaccugucaauaucgaagccgaaccaccuuucggagaaucaaacaucguaauugggaucggagauaacgcacugaagauaaacugguauaaaaaagggucaaguauaggcaagauguucgaagccacagcgcgaggcgcuagacgcauggccaucuuaggagauacagcuugggacuuugguaguguaggaggcguauugaauucacuaggaaagaugguacaccagauauucggaagcgcauacaccgccuuguucaguggcguaagcuggguaaugaaaauaggaauaggcguacugcuaacuuggauuggucugaacagcaagaacacuaguauguccuuuucauguaucgcuaucggaauaaucacccuauaccugggugcuguaguacaagcagacauggggugcguaauaaacuggaaaggcaaggaguugaagugugguagugggauuuuuguaacgaaugagguucacacuuggacagaacaauacaaguuccaagcagacucuccaaaaagguuagcaacugccauugcaggugcaugggaaaacggaguauguggaauuagaagcacgacacgcauggaaaacuuauuauggaaacaaauagcuaacgaacuaaacuacauucucugggagaacaacauuaaauuaacaguuguaguaggagauauuauaggaguauuagaacaaggaaagcgaacacuaacaccacagccgauggaacucaaguauuccuggaaaacaugggggaaagcuaaaauaguaaccgcagaaacacaaaacucgagcuucauaauagacgggccaaacacaccagaguguccgucaguaucacgggcauggaacguaugggaaguggaagacuauggauucggaguuuuuacaacaaauauuuggcuaaaauuacgagaaguauauacgcaauugugcgaucaccgacucaugagcgcagcaguuaaagacgaacgagcuguacacgcagacaugggcuauuggauagaaucacagaagaacggaucuuggaaacuggaaaaggcgagcuugaucgaaguuaagacgugcaccuggccaaaaucucauacuuuauggaguaaugggguccuagagucggauaugauaauccccaaaagccuagcgggaccaauuagccagcacaaccauagaccaggauaccacacacaaacggcaggacccuggcaucucgggaaauuggaauuagauuucaauuauugcgaaggaacaacaguaguuauaacagaaaacuguggaacaaggggcccgucguuaagaacgacaacuguaucuggcaaacugauacaugaauggugcuguaggagcugcacuuuacccccgcuuagauauaugggagaagauggaugcugguacggaauggaaaucaggcccauaucugagaaagaagaaaacauggugaaaucauuagugucagcggggagugguaaaguugacaauuucaccauggguguccuaugucuagcgauccucuuugaagaaguaaugcgugguaaauucggaaagaagcacaugauagccgggguauucuucaccuuuguacuacugcuuaguggccagauaacauggagagauauggcccacacguuaaucaugauaggcucaagugcuucggauagaauggggaugggaguaacauaccuagcuuugauagcaacauucaagauacaaccuuuucuugcauuaggauuuuuccugcgaaaacuaacaagccgagagaaucucuuacuaggagugggguuagcaauggcaacaacuuugcaguugccagaagacauagagcaaauggcaaauggaauugcccuuggguuaauggcacucaaacugauaacucaguucgagacauaccaacuguggacagcucuaaucucguuaacuuguucgaacacaaucuucaccuuaacaguugcauggaggacagcgacacuaauauuagcugguguaucguuauugccaguuugucaaucaagcagcaugcggaaaaccgacuggcuccccauggcaguagcugcuaugggaguuccaccucuaccuuuauuuauuuuuggauugaaagauacacuaaagagacgguccuggccacugaaugaaggcguaauggcggugggccuagugucaauuuuggcaaguaguuuacuaagaaaugauguacccauggccgguccacugguagcaggaggacuacuaauagcauguuaugugaucaccgguacaagugcagaccuuacugucgagaaagcugcagauauaacaugggaagaagaagcugaacaaaccggaguuucucauaaucucaugaucacaguagaugacgacggaacaaugagaauaaaagaugaugaaacugaaaacauuuuaacgguuuuauuaaaaacagcauuguuaauaguaagugguaucuuuccuuacucaaucccagccacguuguuaguauggcacacuuggcaaaagcaaacgcagagauccggaguucuaugggacgugcccucaccuccugaaacccaaaaagcagaacuagaggaaggaguuuaucgcauuaaacagcaaggaauauucggaaaaacacaagugggaguaggaguccagaaggaaggggucuuucacacuauguggcauguaacaaggggagcugugcuaacguacaacggaaaacguuuagaaccaaacugggcguccgucaagaaagaucugauuucuuauggaggagguuggagauuaucagcacaauggcaaaagggagaggaaguucaagucauugcaguagaaccaggaaaaaaucccaaaaacuuucaaacuaugcccggaacguuucagacuacuaccggagaaauuggggcaauagcguuagauuuuaaaccugggacaucaggaagcccaauaauaaauagagaggguaaaguaguuggauuauaugguaacggcguaguuacuaaaaauggcggcuacguuaguggcauagcucagacgaaugcugagccagacgggcccacgccugaacuagaagaggaaauguucaaaaagcgaaaccucacuauaauggacuugcacccgggaagugguaagacuagaaaauauuuacccgcuaucguaagggaagcuauaaaaagaagauuacgaacguuaauauuggcuccgacaagaguagucgcagcugagauggaagaagcauuaaaaggauuaccuauaagauaccagacaacagcgaccaagucggaacauaccggaagggaaauugucgaucugaugugccacgcaacauuuacaaugcgauuauuaaguccuguaagaguuccgaauuauaaucucauuauuauggaugaagcccauuuuacagauccagcaucaaucgcugcacggggauauauaucaacaagggugggcaugggugaggcagccgcaauauuuaugacugcuaccccgcccgggaccgcugacgcauucccgcaaucgaaugcacccauucaagaugaggagcgagauauuccggaaagaucauggaacucagggaaugaauggaucacagacuuugcugggaagacuguuugguuuguucccaguauaaaggcaggaaaugacaucgcgaacugcuuacguaagaacggcaaaaaaguuauacaauugagucgcaaaacauuugacacagaguaucaaaagacgaaauuaaaugauugggauuuuguagucacuacagauauaucagagaugggagcaaauuuuaaagcugacagaguaauugauccccgaagaugcuugaaaccggucauauugacagacggccccgaacgaguaauauuagccggaccuaugccagucacagcggccagugcggcacaacgucgcgggagaguagggcguaauccccagaaggaaaacgaucaauauaucuucacggggcaaccgcuaaauaaugacgaagaccacgcacacuggacugaagcaaagaugcuacuggauaauauuaacacucccgaagggauuauaccagcuuuauuugaaccugaacgugaaaagucagcugcgauugauggugaauaccgucuuaaaggagagaguagaaaaacuuuuguggaacuaaugaggaggggagaucucccaguauggcuagcacauaagguagcuagcgaaggaauaaaguauacugauagaaaaugguguuuugaugggcagcgcaauaaucaaauuuuagaagaaaacauggauguggaaauauggacaaaagaaggagaaaaaaaaaaacuaagaccacguuggcuagaugcucgaacauacucugacccccuagcauuaaaagaauuuaaagaauuugcugcggguaggaaaagcauugcccucgacuugguaaccgaaaucggucgcguuccuucacaucuugcucacaggaccagaaaugcccuagauaauuuggugaugcuucauacuagugaacauggaggcagagcauacaggcacgcgguggaagaacugccagaaacuauggaaacacuauuacugcucggauugaugauacuacugacaggaggagcaauguuguuuuuaauuaguggcaaggguaucggcaaaacaucaauaggcuuaauaugugugaucgccaguucaggaauguuauggauggcagaaauaccccuucaguggaucgccagcgcaaucguacuagaauucuucaugaugguccugcuaauaccagaaccugaaaaacagcgaacuccacaagacaaccaacuugcauacguaguaauagguauauuaacacuugcagcaauuaucgcggcuaacgaaaugggauuauuggaaacgacuaagagagaccugggaauguccaaagaaccuggaguggugucaccgaccuccuaccuagauguugaucuacaccccgcgagcgcguggacucuuuaugcgguagccaccacggucauaacaccuauguuaagacauacgaucgagaauucaaccgccaacgucaguuuagccgcuauugcaaaccaagcggucguacuaaugggcuuagauaagggauggccuauaucuaagauggaucuaggaguaccgcuacuugcauuggguugcuauucacaaguuaacccacuuacacuaacagccgcaguauuauuguugauuacucacuacgccauuauaggaccagguuuacaagcaaaagcgacaagagaggcucaaaaaagaacugcagcagguaucaugaaaaacccgacaguagauggcauaaugacaauagauuuggacccaguuauuuaugauucuaaguuugaaaaacaacucggucaaguuaugcuucuugucuuaugugcaguacaacuauuacuaaugagaacgucaugggcacuuugugaagcacugacucuagcaacaggcccaauuacaacucuuugggaaggcagcccuggaaaauucuggaauacaaccaucgccguaaguauggcaaacauauucagaggguccuacuuggcuggagccggucucgcauuuucuauaaugaaaagcgugggcacaggcaagcgagguacaggcucacagggcgagacauugggcgaaaaauggaaaaaaaaauuaaaucaacuuucccguaaagauuuugauuuauauaaaaagucagggauaaccgaaguagauaggacagaagcuaaggagggauuaaaaagaggagaaaucacccaucaugcaguaucacgcggaucagcaaaguugcaaugguuuguagagaggaacaugguuauuccugagggacgaguaauagauuuaggaugcggccgagggggguggucguauuacugcgcgggguugaaaaaaguaacagagguccggggauacacaaaaggaggcccaggacaugaggaaccuguaccaaugagcacguacggauggaacauuguaaaauuaaugagugggaaagacguguuuuaccuaccaccagaaaaaugugacacacuacuuugugauauaggggagaguaguccaaguccaacaguagaggaaucaagaacgauaagaguacuaaagaugguggaaccauggcuaaaaaacaaccaauucugcauaaagguacugaauccauauaugccuacugugauugaacacuuggaacgauuacaacguaaacacggagguaugcuaguccgaaacccccucucuagaaacagcacucaugaaauguauuggaucagcaacggaacaggaaacaucguagcaucgguaaauaugguaucccguuugcuucuuaaucgauuuacuaugacacaccggaggcccacaauugaaaaagacgucgauuugggugccggaaccagacauguaaacgcggaaccagaaacgccaaacauggauguuauuggcgaacgaaucaaacguaucaaagaagaacauaacaguacauggcauuaugaugacgaaaacccuuacaaaacuugggcauaucacgguagcuaugaaguaaaagcuacaggguccgcaucaucuaugauuaauggagucguaaaguuguuaaccaaacccugggacgugguuccuaugguaacucaaauggcgaugacagacacaacuccauuugggcaacagagggucuucaaagaaaaagucgacacaagaacuccuagaucuaugccgggcacaagacgggucaugggcauaacagcagagugguuauggcgaacauuagggaggaacaaaaagccacgucuauguacacgcgaagaauuuacgaagaaagugaggacaaacgcugcaaugggugcuguauuuacagaggaaaaccaaugggauucagccaaagcagcuguagaagaugaagacuuuuggaaacuaguagacagagaaagagaacuacauaaacugggaaaaugcgggucaugcguuuacaauaugaugggaaaaagagaaaagaaauugggagaauucggcaaggcgaaggguaguagagcgauaugguauauguggcuuggggccagauacuuagaauuugaagcacugggauuccugaaugaggaucacugguuuucgagagagaacuccuacucgggaguugaaggggagggacugcacaaauugggguacauuuuacgggauaucucaaaaaucccaggaggagcaauguaugccgaugauacggcagguugggauacaagaauaaccgaggaugauuuacacaaugaagagaagauaacucaacagauggacccagaacauaggcagcucgcaaacgccauuuuuaaguugacauaucaaaauaaaguagugaaaguucaacggcccacgccaacgggaacuguuauggacauuaucucucgaaaagaucaaaggggaagcgggcaaguuggcacguacggacuaaacacauucacgaauauggaagcucagcucauucgacaaauggaaggcgaaggaguucuaaguaaagcggaccucgagaacccacacuugccugagaaaaagauuacgcaauggcucgaaacuaaaggagucgaacgacuaaagagaauggcaaucagcggagaugauuguguuguaaagccaaucgacgacagguucgcaaaugcccuacuagcucugaaugacauggggaaaguuagaaaagacauaccacaauggcaacccucaaagggcuggcacgacuggcaacagguuccauuuugcagccaccacuuccacgaacuaaucaugaaagauggcagaaaacuaguaguuccauguagaccucaagaugaacugauuggaagggcgcgaauuucacaaggggcgggguggagccucaaagaaacagcgugccuaggcaaagcuuaugcgcaaauguggaguuuaauguauuuccaucgucgggauuuacgacucgccucuaaugcgauaugcucugcaguaccgguccacuggguaccaacuucacgaaccacauggaguauucacgcgcaucaucaguggaugacgacagaagauaugcuaacuguauggaaucggguauggaucgaagacaacccauggauggaggauaaaacuccuguuacaacaugggagaacguacccuaucugggaaaaagagaagaucagugguguggaucauuaaucgguuuaacauccagagcgacuugggcccaaaauauuccaacagcuauccagcaaguacgaucacuaauugguaaugaagaauuccuugauuacaugcccuccaugaaaagauuccgaaaggaagaggaaucagaaggggcaaucugguag

SEQ ID NO: 23192 - RNA, 9873 nt, Artificial Sequence
  derived and/or modified CDS sequence (opt6) from DENV-3__JN183884__SS-prME
acuucguugugucuuaugaugaucuugccagcagcauuggccuuucaccuuacuucuagagacggugaaccgcgaaugauugugggcaaaaaugaacgcgggaagucauuacuauucaaaacugcuucaggaauuaacaugugcacacuaauagcaauggaccucggugaaaugugugacgacacgguaacauacaaauguccacacaucacagaagucgagccggaagacauugacugcugguguaacuuaaccucaacaugggucacauaugggacauguaaccaagccggugaacaucggagagauaaaagaucuguggcauuggcgccccacgucgggaugggucuggacaccagaacacagacguggaugagugcagaaggagcuuggcgacaaguagaaaaaguugaaacaugggcuuuacggcaucccggauucacuauucuagcccucuucuuagcacauuauaucgguaccagucuaacucaaaaagucgugauuuuuauacuacuaaugcuaguaacaccuagcaugaccaugagaugugucggagucgggaacagagauuucguggagggacuuuccggagcaacauggguagacgugguuuuagaacauggaggaugcgugacaacgauggcgaaaaauaaaccaacauuagacaucgaacuacagaaaacagaggcaacgcagcuggccacacuccguaaacugugcauagaagggaaaaucaccaauauuacaaccgauucaagaugcccaacacagggugaagcuacauugcccgaggaacaagaccaaaacuacguauguaaacauacguauguggauagggguuggggaaaugggugcggcuuauuuggaaaggguagccuaguuacuugcgcaaaauuccagugucuagaaccuauagaggggaaaguuguacaauaugaaaaucuaaaauauacagugauaaucacgguucauacaggugaucagcaccaagugggaaacgaaacacaaggaguaacggcagaaauaacaccacaagcaagcacuacagaagccauccucccugaguacgggacccuaggauuagaguguucgcccagaacggguuuagacuuuaaugaaaugauauuguugaaaaugaaaaauaaagcauggaugguccacagacaaugguucuuugacuuaccauuaccauggacgucaggagcaacuacugaaacaccuacauggaaccgaaaagaacuuuuaguuaccuucaaaaacgcucacgcuaagaaacaggagguaguaguacuagggagucaagagggugccaugcauacagcucugacaggcgcaaccgaaauccaaaacucagggggaaccucaauuuuugcugggcacuugaaaugucgacuaaaaauggauaaacuugaauuaaaaggaaugaguuacgcgaugugcacaaacacauuuguacuuaaaaaggaaguaagugagacucaacacgggacuauacuaaucaaaguggaguauaagggugaggacguaccuuguaaaauaccuuucucuacggaggacgggcaaggaaaagcacauaacgggcgucugauuaccgcaaauccuguggugaccaagaaagaagaaccaguaaauauagaggcagaaccgccauucggcgaaaguaauauuguaauuggcauuggagacaaugccuuaaaaaucaauugguauaagaaaggaagcucaauaggcaagauguuugaagcgacugcgagaggugcacguagaauggcuauacuuggcgacacagcgugggauuuuggaucagucggaggcguucuaaacaguuugggaaaaaugguccaccaaauauucggaagcgcuuauacugcacuauuuucuggaguaucuuggguaaugaaaaucgguauaggaguucuauuaaccuggauaggccuaaauagcaaaaauacaucuaugaguuuuagcuguauugcgauagguaucauuacacuauaucuaggcgcaguagugcaagcggauaugggcuguguuauaaacuggaaaggaaaagaacucaaaugugguaguggaauauucgucacuaaugagguacacacuuggacagagcaguauaaauuccaagcugacuccccgaaaagauuagcaaccgcuauagcuggggcuugggaaaacgguguaugcgguauacggagcacuacccggauggaaaaucuguuauggaaacaaauagcgaacgaauugaauuacauacuuugggaaaacaacauaaaguugacaguaguugucggagauauuauaggcguguuagaacaagggaaaagaacacuaacuccacagccaauggaacuaaaauauucauggaaaacaugggggaaagcaaagaucguaacggcggaaacccagaauaguucuuucaucauagauggcccaaacaccccugaaugcccuaguguuucacgggcuuggaauguuugggaaguagaggauuauggguucggaguauuuacuacgaacauauggcuuaaacuuagagaaguuuauacgcaacuuugcgaucaccguuugaugagugcggcaguaaaagaugaaagagcuguacacgcugauaugggauacuggauagaaucucagaaaaacggguccuggaaauuagaaaaggcgucucuaauagagguaaaaacaugcacguggccaaaaagucauacccuauggucaaacggaguucucgaaagugacaugauuauccccaagucucucgcaggacccaucucacaacauaaucaucgcccaggauaucauacucaaacagcagggccauggcaucuagguaaguuagaacuugacuucaacuacugugaaggaacaacggucguaauaacagaaaauuguggcacacguggaccaagucucaggacaacgacaguuuccgguaaauuaauacaugaguggugcugcagaaguuguacacucccuccauugagauauaugggagaagaugguuguugguacggaauggaaauacgaccaauaagcgaaaaagaggaaaacaugguuaaaucgcucgugagcgcuggcagcgguaagguugacaauuucacaaugggagucuugugucuagcaauauuauuugaggaaguaaugaggggaaaauuuggcaagaaacauaugauugcaggaguauucuuuacuuuuguguuauuacuaucaggucagauuaccuggcgagacauggcgcacacucuuauaaugauuggauccaacgcgucagaucgcaugggcaugggugugacguacuuagcauuaauagcaacguucaaaauacaacccuuucuugcgcucggauucuucuuaagaaaauugacgucucgggaaaaucuauuacuggggguaggccuagccauggcaaccacucuacaauuaccagaggauauugaacagauggccaauggaauagcgcucggauuaauggcacuaaagcugauaacacaauuugaaaccuaccaguuauggacugcucuaauauccuugacuugcucaaacaccauauuuacauugacgguagcuuggcguacagcuacacuaauauuagccggugugucauuacuuccgguaugccaaaguucgagcaugaggaaaaccgacuggcuuccgauggcgguagcagcuaugggaguaccuccccuuccauuauuuauauuuggacugaaggauacacuaaagcggaggucauggccacuaaaugaagggguaauggcaguaggauuaguuuccaucuuggcaaguagcuuauugaggaacgacgugccgauggccgguccacucguggcggguggauuacuuauagcauguuacguaauuacagguacaucugccgaucuaacgguugaaaaagcggcugauaucacaugggaagaagaagcagagcaaacugguguaagccauaaucuaaugaucaccguagaugaugaugguacgaugcguauaaaggacgacgagacugagaauaucuuaaccguuuugcugaaaaccgcacuacugauaguaaguggaauuuucccauacucgauaccagccacucuuuuagucuggcauacuuggcaaaagcaaacacagcgaucugguguacuuugggacgugccuaguccaccugaaacgcaaaaagcugaauuagaagagggaguauacagaauaaagcaacaaggaauauucgguaaaacacaaguuggagucgggguacaaaaagagggaguguuucauacaauguggcauguaacgaggggcgcagucuuaaccuacaauggaaaacguuuagaaccuaauugggcauccguuaagaaagauuuaauauccuacggaggcgguuggcgcuugagugcccaauggcagaaaggagaagaagugcaagugauugcugucgaacccggcaaaaauccaaagaauuuucaaaccaugccggguacuuuucagacaacgacaggagaaauaggggcuauagcacuugacuuuaagccaggcacuucuggcaguccaauuauuaaucgggagggaaagguuguugguuuguauggcaauggugugguuacgaaaaacgguggauaugugucaggaaucgcacaaacaaacgcagaacccgacggucccaccccagaacucgaggaagaaauguucaagaaaagaaaucuaacgauuauggaucuucaucccggcuccggaaaaacccguaaauaucuaccugcaauaguaagggaagcaaucaagagacgauuaagaacccuaauuuuagcgccgacaagaguuguggcagcugaaauggaagaggcccuuaagggacuacccauaagauaccaaacaacagcuacuaaaagcgaacauacagguagagaaauaguagauuuaaugugucaugcgacguucaccaugcgauuauuaaguccaguaagaguccccaauuauaaucucaucaucauggaugaagcucacuuuacugacccugcgucaaucgcugcgagagguuauauuagcaccaggguaggaaugggagaggcugcagcuauauucaugacugcgacaccgccuggaacugccgacgcauuuccgcagucgaacgcaccaauucaagacgaagaaagagauauaccagaaagaucauggaacucaggcaaugaguggauaacagacuuugccggaaaaacaguaugguucguaccaucaauaaaggcugggaaugauauugcaaacugccuucgcaaaaacgggaagaagguuauucaacucucucggaaaacauucgacaccgaguaccagaaaacaaagcuaaaugacugggauuucguagugacaacugauauuucagaaaugggugcaaacuucaaagcggaucgaguuauagauccgagacgcuguuuaaagcccguaauacucacggauggcccugagagagucauacuagcagguccuaugcccguaacagcagcaucagcagcucagcgaagaggccgugucggacguaauccgcaaaaagaaaaugaucaauauauauucacuggacaaccuuuaaacaacgaugaggaccacgcucacuggacagaggcaaaaaugcuccuagauaauauaaacacuccagaaggaauaauuccagcacuuuucgagccagaacgugagaaaucggcagcaauagauggagaauacagacuaaaaggagagucuagaaaaaccuuugucgaauuaaugaggaggggugauuuaccaguuuggcuagcgcauaagguagcuucagaaggaauuaaguacaccgaucguaaaugguguuuugauggacaaagaaacaaccagauacuagaggaaaacauggacguugaaauauggacuaaggagggagaaaagaagaaauuacgaccaagaugguuagaugcccgaacauauagugacccacuggcuuuaaaagaguuuaaagaguuugcagcaggaagaaaaucgauugccuuagaucucguuacggaaaucgguagagugccaucgcacuuagcacauagaaccagaaaugcacuggauaauuuaguuauguuacacacaagugagcacggagggagggcguaccgacaugcaguugaagaguuaccagaaaccauggaaacauuacuacucuuagggcuuaugauccuacuaacgggaggugccaugcuuuucuuaauaagcggaaagggaauugggaaaacaucgauagguuuaauaugugucauagcaucaagcgguauguuauggauggccgagaucccgcuucaauggauugcgagcgcuauaguauuggaauuuuucaugaugguacuuuugauuccagaacccgaaaaacaaagaaccccucaggacaaucaauuagcuuaugucguaaucggaauuuuaacuuuagcggcgauaauagcagcaaaugagaugggacuacuagaaacgacaaaaagagaccucggaaugagcaaagagccuggcgugguaagcccuacuuccuaucuggacguugaucuacaccccgcuagugcguggacauuauacgcaguugccacuacuguaauaacuccuaugcuuagacauacaauugaaaauucgacugcuaaugugucucuagccgcaauagcaaaccaagccgucguucuuauggggcuugacaaaggguggccaauaaguaagauggacuuaggugucccuuugcuagcgcuagguugcuacucacaaguuaacccacuaacucugaccgcugcgguucuauuacuaauaacacauuaugcaauaauagguccugggcuccaggcaaaagcgacgcgugaagcacaaaaacggaccgcggcuggcauuaugaagaacccgacuguugacggcauaaugacaauagaucucgauccaguaauauaugauaguaaauuugaaaagcaacuagggcaaguaaugcuuuugguacuuugcgcaguucaauuacuucucaugcgaacgagcugggcacuaugugaagcgcucacccuugcaaccggcccaaucaccacacuuugggagggcucuccaggaaaguuuuggaacacuaccauagcagucaguauggcuaacauauucagaggcucauauuuggcgggugcaggucuugcauuuagcauuaugaaaagugucgguacuggaaaacgcgguacagggucacaaggcgaaacguuaggagaaaaguggaaaaagaaauugaaucaauuaagucgaaaagacuuugauuuauauaagaagaguggcauuacggaaguugauaggaccgaagcuaaagagggucugaaaagaggugaaauaacacaucacgcuguaagccgagggagugcuaaacugcaaugguucguagagaggaauauggucaucccagaaggucgcgugauagauuuaggaugcggaagaggaggguggaguuauuauugcgccggauugaagaaaguuacggagguucgugguuacacaaagggaggaccaggccaugaagaacccgugccaaugagcacguacggauggaacauagucaaacuuaugucagggaaagauguguuuuauuuacccccugaaaagugcgacacacuguuaugugacauaggugagaguaguccuaguccgacgguugaagaaucuagaaccauccgcgucuugaaaaugguagaaccguggcugaaaaacaaucaguuuuguauaaagguucuuaauccauauaugccuacgguuauagagcauuuagaacgucuccagcgaaaacaugggggcaugcuagucagaaauccauuaucaagaaacagcacacacgagauguauuggauuucaaaugggacuggcaacaucguugcgaguguaaauauggugaguagacuacuauugaaucgguuuaccaugacucauagaaggccaacuauugaaaaagacguugaucuaggagcaggaacaagacauguaaacgcagaaccagaaacaccgaauauggauguaauaggagagcggaucaaacgcauaaaagaggaacauaauaguacauggcauuacgacgacgaaaauccuuauaaaacuugggcauaucacgguucauaugaaguaaaagcaacaggcucugcuucaucaaugauaaauggcguaguaaaauuauugacuaaaccgugggauguugucccuauggucacccaaauggcgaugacagacacaaccccauucggucaacaacgugucuuuaaagagaaaguugauacaagaacuccgcgauccaugccaggaacuagaagagucaugggaauaacagcagaaugguuguggcgaacacuggggcgaaauaagaaaccccggcuaugcaccagagaagaguucacaaagaaaguucgcacaaacgcagcaaugggggcaguuuucacugaagaaaaccaaugggauuccgccaaagccgcaguagaagacgaggauuuuuggaaauuagucgauagagaaagagaacuucauaaauuaggaaaaugugguuccugcguuuacaacaugaugggcaaacgcgagaagaaacugggugaguucggcaaagccaaaggcagcagagcaauaugguacauguggcuuggugcaagguaucucgaguucgaagccuugggauuuuugaaugaggaucacugguucaguagggaaaauucuuauucuggaguagaaggagagggauugcauaaacugggauacauccuacgcgacauaucaaaaaucccagguggugcuauguaugccgaugauaccgcugguugggauacaaggauaacagaggacgacuuacauaacgaagagaaaauaacacaacagauggauccagaacauagacaguuggcaaaugccaucuucaaguugacguaccaaaacaagguaguuaagguacaaaggccuacgcccacugggacaguuauggauauaauaaguagaaaggaucaaagggguagcggacaagugggaacuuauggauugaacaccuucacaaacauggaagcccagcuuaucagacaaauggagggugaagggguuuuaucaaaagcagauuuggaaaacccacacuuaccggaaaagaaaauaacgcaaugguuagaaacaaaaggaguagagcgauugaagagaauggcuauuucgggugaugacuguguuguuaagccaauugaugaucgauucgcgaaugcguuacuugcccuaaaugauauggggaaaguaagaaaagauauaccccaguggcaaccguccaaaggcuggcaugacuggcaacaaguaccuuuuugcucgcaccacuuucaugaacuaauuaugaaagacgggagaaaauugguagugccaugcagaccacaggaugaauugauugggagagcccgaauaagccaaggagcaggcuggucuuuaaaagaaacagcgugucucgggaaggcauacgcucaaauguggucacuaauguacuuucauagaagagaucuuagacuagcaucuaacgcaaucuguucagcaguacccgugcacugggucccaacaucaaggacaacuuggucuauucacgcacaucaccaauggaugacuacagaagacaugcugacgguauggaauagaguauggauagaagauaacccauggauggaagacaaaacuccuguaacuacaugggaaaauguaccauaucucgguaagagagaagaucaguggugcggaucccuuauagguuugacuucccgugcgaccugggcgcaaaacauaccaacugcaauucagcaaguacgaucguuaauugguaaugaagaguucuuggauuacaugcccucuaugaagagauuccguaaagaggaagaaucagaaggcgccauuugguag

SEQ ID NO: 23193 - RNA, 9873 nt, Artificial Sequence
  derived and/or modified CDS sequence (opt6) from DENV-3__HQ541785__SS-prME
acuucuuuaugcuuaaugaugaucuuacccgcagcucuagcauuucaccugacaaguagggauggagaaccucggaugauaguaggcaaaaaugaaagaggaaaaagccuauuauuuaaaacggcuucuggaauaaacaugugcacucuuauagcaauggaccuaggagaaaugugcgaugauacaguaacauauaaauguccgcacauuacggaagucgaacccgaagacauagacuguugguguaaucuaacgucuacauggguuacauauggaacuuguaaucaagccggagaacauagaagggauaaaagaucgguagcucuugcgccucacgucggcauggguuuagauaccagaacacaaaccuggaugagugcagaaggggcauggagacaaguagaaaaaguugaaaccugggcacuacgucaccccggauuuacuauauuggcguuauuucuagcccauuauauugguacuucccuaacacaaaaaguaguuauuuuuauauuauuaauguuagugacuccaucuaugaccaugagaugcguuggaguagguaauagggauuuuguugaaggauuaucaggagcuacauggguggacgugguguuagaacacggaggaugcguaacuacaauggccaaaaacaaaccaacauuagauaucgaacuacagaaaacggaagcaacacaauuagcaacccuacgaaaauuaugcauugaaggcaaaauaacaaacauuacuacagauagccguuguccaacacaaggcgaagcaacauuaccugaggaacaagaccaaaauuaugucugcaaacacacauacguugauagaggaugggguaacggaugcgguuuauucggaaaaggcucguuggucacgugugcgaaauuucaaugucuggaaccuauagaagguaaaguggugcaauaugaaaaucuaaaauauacaguaauaaucacagugcacacaggggaucaacaucaaguaggaaaugagacacaaggcguaaccgcggaaauaacaccccaagcuagcaccaccgaagcuauucuaccagaauacggaacacuaggccuagaauguaguccaagaacgggguuggauuuuaaugaaaugauacuuuuaacuaugaaaaacaaagcauggaugguccauagacaaugguucuuugauuugccacugccauggacgaguggggcuacaacggagacaccaacuuggaacaggaaagagcucuuaguaacuuucaaaaacgcacacgccaagaaacaggaggugguaguacucgggagccaagaaggugcaaugcauacugcgcuuacaggggcuaccgaaauucaaaauagugguggaaccuccauauuugcugggcaccuaaaguguaggcucaaaauggauaaauuagagcuaaaaggcaugagcuaugcaaugugcaccaauacguucguccuaaagaaggagguaucagaaacucagcauggaaccauauuaauaaagguugaauauaaaggugaagauguaccaugcaaaauaccuuucuccacagaagacggacaagguaaagcucauaacggcagacuaauaacagcuaauccaguugugacgaagaaagaagaaccagucaacauagaagccgaaccuccuuucggcgaaaguaauauaguaaucggcaucggagacaaugccuugaaaauuaacugguauaagaaaggcaguagcauaggaaagauguuugaagcgaccgcucgaggggccagaagaauggcuaucuuaggggauacugccugggauuucggcagcgugggaggaguucuaaacucucucgggaaaaugguccaccaaauauuuggaucugcauauacggcauuauucucaggugugagcugggugaugaagauagguauagguguucuauugacauggaucggguugaacaguaagaacacuagcaugucauucucaugcauagcgaucggcauaauaacccuguacuuaggggcagucguucaagcagacaugggcuguguaauuaauuggaaggggaaggaacuuaaaugugggucuggcauauucguuacgaaugaagugcauacauggacagagcaauauaaguuccaggcggauucgccgaaaaggcucgcuacagcuauagccggugcaugggaaaauggcgugugcgguauaaggucaacaacccggauggaaaauuuauuauggaaacaaauagcgaacgaacuuaauuauauccugugggaaaauaauauaaaacuaacaguuguggugggagauauaaucggaguauuagagcagggaaaacguacuuugacuccccagccuauggaguugaaguauaguuggaaaacguggggcaaagcgaaaauaguaacagcugagacgcaaaauaguucauuuaucauagauggaccaaacacaccagaauguccgagcgugagccgagcguggaauguaugggaagucgaagacuaugguuuuggaguauuuacaaccaauauaugguugaaauuacgagaggucuacacacaauuaugcgaccacagauuaaugagcgcagcaguuaaggaugaaagagccguacaugcugauaugggguacuggauugaaucucaaaagaaugguaguuggaagcuagaaaaggcuucguuaauagaaguuaagacaugcacuuggccaaaaucacauacucuauggaguaaugggguacuagaaucagacaugauaauacccaaaagccuagcaggcccgauaucucaacauaaccacagaccaggauaucacacgcaaacugcgggacccuggcaucucggaaaacuagaauuagacuuuaauuauugugagggaacgacgguugucaucaccgaaaacugcgguacaagagguccgaguuuaaggacgacaacaguaucagggaaauuaauucacgaaugguguugcaggagcugcacacugccuccacugcguuacaugggagaagaugguuguugguacgguauggaaauacgcccuaucucagaaaaagaagaaaauaugguaaaaaguuuaguuucggcgggcuccggaaaaguagauaacuucacaauggggguuuuauguuuagccauccuauucgaagagguaaugaggggaaaauucggcaagaaacauaugauugcuggaguauuuuucaccuucguauuauuauuaucaggccaaauuacauggagagacauggcacacacccuaauaaugauaggaaguaaugcgagugauaggaugggaaugggggucacuuaucucgcuuuaauugcaacauucaaaauucaaccguucuuagcguuaggguuuuucuugagaaaacucaccucaagggagaauuuguugcugggaguaggucuagcuauggcgacaacucugcagcuacccgaagacaucgaacaaauggcgaacggcauugccuugggucuuauggcccuaaaauuaauaacccaguuugagacuuaccagcuauggacggcuuuaauuucauugaccugcuccaauacaauuuucacacuaacaguggcuuggagaacugcuacauuaauucuagcugggguaagucuuuuaccaguaugccaaaguucaucaaugaggaagacagauuggcuaccaauggcaguagcagccaugggagugcccccacuuccauuauuuauauucucguuaaaagauaccuuaaaaagaagaucauggccacuaaaugaaggggucauggcuguaggacuuguaaguauacuagccagcucacuacuaagaaaugauguuccgauggcgggaccgcuaguggcuggaggacuuuuaauagcuuguuaugugauuacggguacaagugcagauuuaacagucgaaaaggcagcugauauuacuugggaggaagaggccgaacaaaccgguguaagucauaaccuuaugauagccgucgaugaugaugguaccaugagaauaaaagaugaugaaacggagaacauucuaacaguauuacugaaaacagcacuucucauugugaguggcauauuuccauacagcauaccagccaccuugcuagucuggcacacauggcagaaacaaacucagaggucagguguacuuugggacgugccgucuccaccugaaacucagaaagccgaguuagaggaaggaguauauagaauuaaacaacaaggaauuuucgggaaaacacagguaggcguagguguacaaaaagaaggugucuuucauacuauguggcaugucacaagaggggcaguacuaacauacaacggaaaaaggcucgaacccaauugggcuaguguuaagaaagaccugauaagcuaugguggcgguuggcgcuuaucagcucaguggcaaaagggggaagaaguucaggucauagcaguugaaccgggcaagaaccccaaaaacuuucaaacaaugccaggcaccuuccagacaacgacaggagaaauuggggccaucgcucuagauuucaagcccggaacuucugggagcccuauuaucaaccgagaagguaaggugguaggacucuacgguaacggaguggugacuaagaacggugguuauguuagcgggauagcacaaacuaaugccgagcccgauggaccaacaccagaauuagaagaggaaauguuuaagaaacgaaauuugacuauuauggaucuucacccagggucagggaaaacaaggaaguaucuaccugcaauaguaagagaagcgauaaagagaagauuaaggacauuaauacuagcuccaacaagaguuguggcagcagaaauggaagaggcuuuaaaaggauuaccaauuagauaccaaacaacagcaacaaaaagcgaacauacaggacgcgaaaucguugauuuaaugugccaugcgacuuucacaaugaggcuacuaucuccaguuagaguuccuaacuauaauuugauaaucauggacgaagcucauuuuacagauccugcaaguauugccgccagagguuauauuagcacaagaguaggaaugggagaagccgccgcgaucuucaugacugcaacaccacccgguacugcagacgcauucccacaaucaaaugcuccuauacaagaugaagaaagagacaucccugaacgaucguggaacucaggcaaugaauggaucaccgauuuugccgguaagacaguaugguuuguaccuagcauaaaagccggcaaugauauugcuaauugcuuaaggaaaaacgggaagaaagucauucagcuuaguagaaaaacuuuugauacagaauaucagaagacuaaacugaacgauugggacuucguggucacuaccgacaucucugaaaugggggcgaauuuuaaagccgaccgaguaauagacccaagacgaugucuuaagccuguuauucugacggauggcccggaaagaguuauauuagcagguccaaugccaguaaccgcagcauccgccgcacaaagaagagguagaguggggagaaauccgcaaaaagagaaugaccaguauauuuuuacaggccaaccucuuaauaacgacgaagaucacgcgcauuggacggaagcgaaaaugcuauuagacaacaucaacacuccagaaggaauaauuccggcucuauuugagccagaaagagaaaaauccgcugcuauagauggugaauaucgccuaaaaggagaaagccgaaaaaccuuuguugaauugaugcggagaggggauuugcccguauggcuggcacacaagguugcaucggaagggauaaaauacacggaucgcaaauggugcuuugacggacagaggaacaaucagaucuuagaagagaacauggacgucgaaauuuggacuaaagaaggagagaagaagaaacuacgaccacgauggcuagaugcaagaacauacucugacccacuggcacugaaagaguucaaagaguucgcugccggcagaaaaaguauagcccuagaccucguaacugaaauuggacgcgucccgagucauuuagcacauaggacucgaaaugcacuagauaacuuagucauguuacacacaucugaacacggugggcgagcauauagacacgcaguagaagaguugcccgagacaauggaaacguuauugcuacuaggacuuaugauacuucuaacaggaggggcaauguuauuccuaauuagcggaaaagguauagggaaaacaucuaucggcuugauauguguaauuacaucguccggaaugcuauggauggcagaaauuccacuacaauggauagcgucugcaaucguauuagaauuuuucaugaugguccucuugauaccggaaccagagaagcaaaggacuccacaagacaaccaauuagcauauguuguaauaggcauauuaacgcuugccgcaaucauagcggccaacgaaaugggauuacuugaaacaaccaaaagagaucucggaauguccaaagagccaggaguugucaguccaacgaguuauuuagaugucgaucuccacccugcaucugcauggacauuauaugccguugcaacaacggugauuacccccauguuacgucacaccauagagaauaguacagcaaacguuagcuuagcagcaaucgcaaaucaggcggugguacuaauggggcucgauaaagguuggccgauaaguaaaauggaucucggcguaccguuacuagccuugggaugcuauucucaaguaaauccguugaccuuaacagcagcagugcuauuguugauuacgcacuaugcuauuaucggaccgggguugcaggccaaagcgacgagagaagcucagaaaagaacagcagcugguaucaugaagaacccuacaguggacggaauuaugacuauugauuuagauccaguuauauacgacaguaaguucgaaaaacaacuuggacaagucaugcuuuuagugcugugugcuguucaguuguuacucaugaggacuucgugggcuuuaugugaagcacucacucuagcaacaggacccauaacaacuuuaugggaagguagcccagggaaauucuggaauacuacuauugcaguaaguauggcaaauauuuuuagagguaguuauuuagcaggagcaggcuuggccuucagcauaaugaaaaguguaggcaccggcaaacgcgguacagggagucaaggcgagacccuaggagaaaaauggaagaagaaacuaaaucaauuaucucguaaagacuucgaccuuuauaagaaaucaggcauuacugagguagacagaaccgaagcgaaagaagguuuaaaacguggggaaauaacgcaucaugccguaagucgggggagugcaaaacuucaaugguucguugagcgcaauaugguuaucccagaaggacgcguaauagacuuaggaugcgggcgaggcggauggaguuauuauugcgccggccugaagaaaguaaccgaaguaagaggauauacaaaaggagggcccggacaugaagaaccaguuccuaugaguacuuauggauggaacauaguuaaguuaauguccgguaaagaugucuucuauuuaccacccgagaaaugugacacuuugcuaugcgauauuggagagaguucccccucaccaacuguagaagaaaguaggacgauucgcguauuaaagaugguugaaccauggcuaaagaauaaucaguuuuguauuaaaguuuuaaauccuuacaugccuacaguaaucgaacauuuagaaagguuacagcgaaaacauggaggcauguuaguaagaaacccauuauccaggaauagcacacaugaaauguacuggauaaguaacgggacugguaauauaguggcaaguguuaacaugguuucaagacuauuacuuaaucguuucaccaugacgcacagacgcccgacaauagagaaggacguggaucuaggugccggcacgagacauguaaacgcggaacccgaaacgccaaauauggaugucaucggagaacguauaaaacgcaucaaagaagaacauaacucuacauggcacuaugaugacgaaaacccauacaaaacuugggcauaucaugggucauaugaaguaaaggccacagggucggcaucaaguaugauuaacggaguaguuaaacuuuugacuaaaccaugggacguaguuccuaugguaacgcaaauggcaaugacagacacuacgccauuuggccaacagagaguguuuaaagaaaaggucgauacaagaaccccgagauccaugccugggaccagaagaguuaugggcauaacggcugaauggcuguggagaacacuuggaagaaacaaaaagccgagauuauguacccgcgaagaguucacgaagaaaguacguacuaaugcggcaaugggugcaguauuuacagaagaaaaucaaugggacagcgcuaaagcugcaguagaagaugaagauuucuggaaacuuguggaccgcgagcgagagcuacauaagcugggaaaauguggaagcuguguauauaacaugauggggaaacgagaaaagaagcuaggagaauuuggaaaggccaaggggucaagagccauuugguauauguggcucggugccagauacuuagaguucgaagcucucggauuccuaaacgaagaucacugguuuucacgugaaaacucauacucaggaguugaaggagaaggccuccauaaacuaggauacauacuuagagacauaagcaaaauuccaggaggagcaauguacgcagaugacaccgcuggaugggauacacgaauaaccgaagacgaccuacauaaugaggagaaaauaacacagcaaauggauccagaacacaggcaauuggcuaaugccauauucaaacucaccuaucaaaauaaaguaguuaaaguacaacgcccaacgccaaccgguacaguuauggacauaauuucaaggaaagaucaaagagguucaggucagguaggaacauauggcuugaacacauucaccaacauggaagcacaacucauaaggcaaauggaaggugaaggagugcuaaguaaagcugauuuagaaaauccucaucuaccagagaaaaagaucacacaauggcuagaaacaaaagguguagaacgucuuaaaagaauggccauaucaggugacgauuguguuguaaaaccaauugaugacagauucgccaaugcauuacuagcacuaaacgauauggguaagguccggaaagauauaccgcaauggcaaccaagcaaaggcuggcacgauuggcaacagguaccauucuguucccaucacuuucacgaacuaauaaugaaagaugguaggaaauuaguaguaccaugccgaccacaagacgagcuaaucgggagagcaagaauaagucaaggagccgguuggagucuaaaggaaacugcuuguuugggaaaagcauacgcgcagauguggucauuaauguauuuccaucgaagagaccuaagguuggcgagcaaugcaauauguucggcuguuccaguccacugggugcccacaagucgaacgacauggucuauacaugcgcaccaccaauggaugacgacagacgauaugcucacggucuggaacagggucuggauagaagauaacccauggauggaagacaaaacaccuguaaccacuugggagaacguuccuuauuuaggaaagagagaagaucaaugguguggcucauuaauagguuuaacuagccgggcuacuugggcucagaauauucccacagcaauccaacaaguuaggaguuuaauuggaaaugaagaguuccuagacuauaugccaagcaugaagagauuuaggaaagaggaagaaucugaaggugcaauaugguaa

SEQ ID NO: 23194 - RNA, 9873 nt, Artificial Sequence
  derived and/or modified CDS sequence (opt6) from DENV-3__HM181975__SS-prME
acaagcuuauguuuaaugaugauccuuccagcagcguuagcauuucauuuaacgaguagagacggagaaccuagaaugauaguaggaaaaaaugaaagaggaaagucgcuuuuauucaaaacagcauccgguauuaacaugugcacuuugaucgcaauggaucuaggagaaaugugcgacgauacagugacauacaaguguccccacauaacagagguagaaccagaagacaucgauugcuggugcaaccucacgucuaccugggucacauauggcacuugcaaucaagcuggcgaacauagacgugauaaaagaagcgucgcucuugcaccgcacguuggaaugggauuagauaccaggacacaaacauggaugagcgccgaaggagcuuggaggcaagucgaaaagguagagacaugggcucuccgacauccaggauuuacuauucuugccuuauucuuagcgcauuacaucgguacaucauuaacacaaaaagucguaaucuuuguauuauuaaugcucgugacuccuucuaugacaaugagguguguuggaguagggaauagagauuuuguagaaggacuauccggugccaccuggguugauguaguccuugaacacggcggaugugugacaaccauggccaaaaauaaaccaacgcuggacaucgaauuacagaaaacugaggcaacucaacuugccacuuugagaaagcuuuguauagaaggcaaaauaacaaauaucacgacagauaguagguguccaacucaaggcgaagccacacucccagaggagcaggaucagaauuauguuuguaagcacacuuaugucgaccgagguugggggaauggauguggacuauuuggaaaaggauccuuggucacuugugcuaaauuccaauguuuagagccuauugaaggaaaaguaguacaacaugaaaauuuaaaguauacgguuaucauuaccguacacacgggugaucaacaccaggucggaaaugagacgcaagguguuacugcggaaauaacaccacaagcuaguacgacugaggccauucuaccugaguaugguacacuaggacucgaguguuccccgcgcacaggacuugauuuuaacgaaaugauauugcuaaccaugaagaauaaagcuuggaugguucaucgacaaugguuuuucgacuugccauuaccguggaccucaggugcaaccacagaaaccccaacauggaacagaaaagaacuccuaguaacauucaagaaugcacacgcaaaaaagcaagagguagugguucuaggaagccaagagggagccaugcauacagcacugacuggggcuaccgaaauacaaaauucaggaggaacaucgaucuuugccggacaucucaaaugcagacugaagauggauaaacucgaauugaaaggaaugaguuacgccauguguaccaacaccuucguguuaaagaaagaaguaagugaaacucaacauggaaccauacuuauuaaaguugaauacaaaggagaagauguaccauguaaaauuccauucucaacagaagacggccaagguaaggcucacaauggccgacucauaacggcuaauccaguuguuacaaaaaaagaggaaccgguaaacauagaagcggagcccccuuucggagaaagcaauauagugauaggaauuggugauaacgcauugaagauaaauugguauaagaaggggucaucaauaggaaaaauguuugaggcaaccgcuaggggagccagaaggauggcaaucuuaggcgauacagcaugggacuuugggucuguuggaggcguacuuaacucgcuugguaaaaugguucaucagauauuuggguccgcuuacacagcccuuuuuucagggguuagcugggucaugaaaauuggcauaggaguccucuuaacguggaucggucuaaacuccaaaaacacgagcaugucuuuuaguuguauugcaaucgggauaauaacauuauaucuaggggcgguaguucaggcagacaugggguguguaaucaacuggaaaggaaaagaauuaaaaugcgguuccggaauauucguaacuaacgaagugcacacauggacagaacaguacaaauuucaagcagauaguccuaaaagacuagcuacagccauagcgggagcaugggaaaauggcgugugugguauaagaucuacaacgagaauggaaaauuugcucuggaaacaaauugcgaaugaauuaaacuauauacuaugggaaaacaauauaaaacuuaccguaguagucggugauauuauaggcguauuggagcaagguaaaaggacauuaacaccgcaaccuauggaauuaaaguauaguuggaagacaugggguaaagcaaaaauagucacagcagagacgcaaaauucauccuuuauuauagacggcccaaacacaccugaauguccaagcgucucuagagcauggaauguuugggaaguagaagacuacggguuuggagucuuuacaaccaauauuuggcugaaauugagggaagucuacacucagcuaugcgaucauagauugaugucagcagcuguaaaggacgagagagccguacaugcagauauggguuauuggauugagucacaaaaaaauggaucguggaaacucgagaaagcuagccuaauagaagucaaaacuuguacguggccaaaaucccauacacuauggucaaauggaguguuagaaagcgauaugauuauuccaaaaucacuagccgguccgauaucucaacacaaucauaggccaggauaccacacccaaaccgccggaccauggcaccuaggaaaauuggagcuagauuucaacuauugugaagggacgaccguaguaauuacugagaacugcgguaccagaggacccagucuacgcacaacuacgguuuccgguaaauuaauucaugaaugguguugucguagcuguacacucccuccacuacgcuauaugggcgaagauggcuguugguaugguauggaaauacgaccaauaagcgagaaggaggagaauauggucaagucgcuaguuucagcuggaagugguaaaguagauaauuuuacuauggggguccuauguuuagcaauacuuuuugaagaagugaugaggggaaaauuuggaaaaaaacauaugaucgcuggagucuuuuucacguuuguuuuacuguuaagcggacaaaucaccuggagggacauggcucauacucuaauaaugauagguucgaacgcaucugacaggaugggaaugggggucacauaccuagcgcuaauagcaacauucaagauccaaccauuccuagcacuaggguuuuuuuuaagaaaacuaacaucgagagaaaacuuacuauuaggaguggggcuagccauggcaacgacucugcaauugccggaagauaucgaacagauggcaaauggaaucgcuuuaggccucauggcucucaaacuuauuacacaauucgaaauuuaccaacuuuggaccgcauuaauuucccucacaugcucgaacacgauuuuuacauugaccguagcauggcgaacggcuacccuaauuuuggcuggaguaucauuguuaccaaugugccagucgaguaguaugcgcaaaaccgauugguuaccuauggcaguggcggcaaugggagucccaccauuaccacuguuuauauucucauuaaaggacacauuaaaaagaaggucuuggccccugaaugaagggguaauggcaguagguuugguaucaauuuuagcuuccucauuacuucgcaacgauguacccauggcaggcccacuuguugccggaggauuacugauugcgugcuacgugauaacagguacauccgccgacuuaaccguugaaaaggcggccgacauuacaugggaagaagaagcugaacaaacagggguaagucauaaucuaaugauaacaguugacgacgauggaaccaugagaaucaaagaugacgagacugaaaauauccuuacagugcuauuaaaaacugcucuucuaauaguaagcggaauauuuccauacaguauaccggcaaccuuacuaguguggcauaccuggcagaaacaaacgcaaaggucggguguauugugggauguacccaguccccccgaaacucaaaaagcagaguuagaagaagggguauacagaauaaagcaacagggaauuuucgguaaaacacagguaggaguaggaguacaaaaagaaggcguauuucauacaauguggcacgugacgcgaggagcuguacuuacauauaauggcaaaagacuagagccuaacugggcaucagucaaaaaagaccuaaucucauacggugguggguggagauuaucagcucaauggcaaaagggugaagaaguucaagugauugcaguagaaccagguaaaaacccuaaaaauuuccaaaccaugccagguacuuuccagacaacaacuggggaaauaggagcuauugcacuugacuucaaacccgggacaaguggaucgccuauaaucaauagagaagggaaaguugugggauuauacggaaacgggguaguaacuaaaaaugguggauaugugagugguauagcccaaacaaacgcagagccagacgguccaacaccagaauuggaggaagaaauguucaaaaagcguaaucuaacaauuauggacuuacacccaggcucagguaaaacacgaaaguaccuuccagcgauuguucgagaagcaauaaaaagaagacuuagaacgcuuauucuugcucccacccgagugguagcagcagaaauggaagaagccuuaaagggauuaccuauucgauaucaaacgacagcuacaaagagugaacauaccggaagagaaauugucgauuuaaugugucaugcaacauucacuaugagguuauugucccccguucguguaccaaacuauaaucuuauaauaauggacgaagcucauuuuacagauccugcgucuauagcugccaggggauauaucagcacuagggucggaaugggagaggcagcagcaauauucaugaccgcaacuccacccggcacagccgaugcguuuccccaaaguaacgcaccaauacaagaugaagaaagagauauaccggaacguaguuggaauaguggaaacgaguggauaacggacuucgcuggcaaaacgguaugguuuguacccuccauaaaagcgggaaaugacauugcgaauugucuacgaaaaaauggaaagaaagugauacagcugagccgaaagacauucgacacugaauaucaaaaaacaaaacuuaacgacugggacuuugucgugacuacagacauaucagaaaugggagcuaacuuuaaggcugauagaguuauugauccacguagaugucugaagccugugauccugacagauggucccgagagaguuauuuuagccgguccaaugccaguaacagccgcauccgcggcucaaagacgagggcgcguuggcagaaacccacagaaggaaaaugaucaguauauuuuuacaggucaacccuuaaauaacgaugaggaccaugcacacuggacugaagcaaaaauguuauuagacaauauuaauacuccagaagguauaauaccggcacuauuugaaccagaaagagaaaaaagugcagcaauagauggugaguauagauuaaaaggcgaaucacgcaaaaccuucgucgaacuuaugagaagaggagaucuaccagucuggcuagcacacaaaguugcgucggagggaauaaaauacacagaccgaaaaugguguuuugacggacaacguaauaaccaaauccuagaggaaaauauggacguagaaaucuggacaaaagaaggugagaaaaagaaguuaagaccuagaugguuggaugcuagaacuuauucagaccccuuagcccugaaagaauuuaaggaguucgccgcuggccguaaaucuauagcguuagacuuaguaacugaaauaggucgugucccaucucaucuugcucaucgaacaagaaaugcucucgauaaccuugugauguugcauacaagcgagcauggcgggagagcguaucggcaugcuguagaagagcugcccgaaacuauggaaacccugcuacuuuuagguuugaugauucuccugacgggaggagcgaugcuuuuuuuaauaucaggaaaaggaauagguaagacaucaauaggacucauuugcguaauagcuucauccggaaugcuuuggauggcagagaucccacuacaauggauagcuucagcaauaguucuagaguucuucaugaugguccuacuuauaccagaaccggaaaaacaaagaacuccacaagauaaucaauuagccuauguaguuaucggcaucuuaacauuggcagcaauaauagcagcaaaugagaugggccucuuggaaacaacaaaacgcgaucugggcaugucuaaagaacccggcgucguuucgccgacaaguuauuuagacgucgacuugcauccagcaagcgcauggacgcuauacgcuguagcgacuacugugaucacgccaaugcuaaggcauacaauugaaaauucaacugcaaacgugucccuugcugcaauagcaaaucaagcuguaguacuaaugggacuagauaaaggauggccaauuagcaaaauggaccuagggguaccguugcuggcucugggcuguuauagucaaguaaauccccuaacucuaacugcggcaguuuuguuauuaauaacgcauuaugcaauuaucggaccaggucuacaagcaaaggcuacucgagaagcgcagaagcgaacagcagcugggauuaugaaaaauccaacaguugauggaauaaugacaauagaucuggacccugugauauacgacaguaaguucgagaaacaauuaggacaaguaaugcucuuaguucuauguguaguacaauuauuauuaaugaggacaagcugggcacugugugaagcguuaaccuuggcaacaggaccgauuacaacuuuaugggaagguagucccggcaaauuuuggaacacuacuaucgcagugucuauggcuaacauauuccgaggcuccuaucuagccggcgcgggccuggcguuuuccauaaugaaaucaguuggaaccgguaaaagggggacuggaucccaaggagagacguugggugaaaaauggaagaaaaaacuuaaucaacuaagcagaaaggauuucgaucuauauaaaaagaguggcauaacggagguagacagaaccgaagcuaaagaaggauuaaaacgaggagaaauaacacaucacgcuguaaguagagguuccgccaaauuacaaugguucguggaaaggaauauggugauccccgaaggaaggguaaucgaucuugguugcggaaggggcgguuggucauauuacugugcaggucuaaagaaaguaacagagguuagagguuauacuaaagguggacccggccacgaagagccaguaccuauguccaccuauggauggaauauaguuaaacuuaugaguggcaaagauguauuuuacuuaccuccugaaaagugcgacacacuacuuugugauauuggugaaucaagcccaucuccgacaguugaagaaucaaggaccaucaggguucuaaaaaugguugaaccaugguuaaaaaacaaccaauuuuguauaaaagugcuaaacccuuauaugcccacaguuaucgagcacuuggaacggcuucagaggaaacacggaggaaugcuaguacgcaacccccuuucccgcaacagcacucacgaaauguauuggauaucuaauggcacggguaacaucguagcuucuguaaauaugguaaguagacuucuuuuaaauagauucacaaugauucacagaaggccuacaauagaaaaagacgucgauuuaggcgcugguacucgucaugugaaugcagagccugagacaccaaauauggacguaauaggugagcgaauaaagagaauaaaggaagagcauaauucuacauggcacuaugacgacgagaauccguacaaaacaugggcauaccacgguagcuaugaaguuaaagcgacggguucagcaucuucgaugauaaauggagugguaaagcuuuugacuaaacccugggauguaguacccauggugacccaaauggcaaugaccgacaccacaccuuucgggcaacaacgaguuuuuaaggagaaaguugauacacgaacaccaagauccaugccugguacuagacgaguaauggguauuacagcagaauggcuauggagaacucuuggccggaauaaaaaaccuagacuauguacuagagaagaauuuacuaagaaaguaaggacuaaugccgcaaugggcgcgguguucacugaagagaaccaaugggauagugccaaagcugcaguagaggaugaagacuuuuggaaacucguagaccgagaacgcgaauugcacaaguuagguaaguguggcaguugcguuuauaauaugauggggaaaagagaaaagaaauuaggggaauuugggaaagccaaagguagccgagccauaugguauauguggcugggugccagauacuuggaauuugaggcacuaggcuuuuuaaacgaagaucauugguuuuccagagaaaacaguuacucagguguugaaggggagggacuacauaagcuuggauauauacuuagagacauuaguaaaaucccaggaggggcaauguacgcagaugauacggccggaugggacacccguauuacggaagaugacuuacacaaugaagaaaaaauaacacagcaaauggaucccgaacauaggcaacuugcgaaugccauuuuuaaacuaacuuaucaaaacaaaguagugaaaguucaacgcccgacaccuacagguacgguaauggacauuauaucccgaaaagaucaaagaggauccggacaaguuggaacauauggacucaauacuuuuacuaacauggaagcacaauugauccgccaaauggaaggagaagguguucuaagcaaagcggaucuugagaauccacacuuaccugaaaaaaaaaucacucaaugguuagaaacaaagggaguggaaagguuaaaacguauggccauaucuggagacgacugcgucgucaagccaauugacgaucguuucgccaaugcauuauuagcccucaaugauaugggaaaagucagaaaggacauuccacaauggcagccgucaaaaggauggcacgacuggcagcagguuccuuuuuguucacaucacuuucaugaacuuaucaugaaagauggccggaaacuagucguuccauguaggccacaagaugaacuaauaggucgggcgcgcauaucucaaggggcaggauggucauuaaaagaaacggccuguuuaggaaaagcuuaugcacagauguggucccuaauguauuuccauagacgagaccuccguuuagccucaaacgcaaucugcagcgcuguaccaguacauuggguacccacuucuagaacaacauggucaauacaugcccaucaucaauggaugacgacugaggacaugcucacaguauggaauagaguguggauagaagauaacccuuggauggaagacaaaacacccguuacaacaugggaaaacgugccguaccuagggaagagagaagaucaauggugugguuccuuaauuggguuaacgagucgugcuacaugggcccagaauauuccuacagcaauacagcaagugcgaagcuuaaucgguaacgaagaauuucuggauuauaugcccucaaugaaacgauucagaaaagaggaggagagugaaggggcuauaugguga

SEQ ID NO: 23195 - RNA, 9873 nt, Artificial Sequence
  derived and/or modified CDS sequence (opt6) from DENV-3__HM631864__SS-prME
acgagcuuaugucucaugaugauauugccugcugcacucgcauuucaucuaacaagucgagauggagaacccagaaugaucguagguaaaaacgaaaggggaaaaucacuucuuuuuaaaacagcaaguggaauaaauauguguacccuaauagcaauggaucugggugaaaugugugacgacacaguaaccuauaaauguccacacauuacggaaguugaaccugaagacaucgacuguugguguaaucuaaccucaacuugggugacauacggaacguguaaucaagccggcgaacauagaagggauaaaagaaguguugcauuagcuccacaugucggaaugggauuggauacuaggacgcaaacauggaugagugcggaaggcgcauggcgacaagucgaaaaaguggaaacgugggccuuaaggcacccggguuuuacgaucuuggcacuauuuuuagcacacuacauagguacaucccucacgcaaaaaguugugaucuuuauuuuauugauguuagugacaccguccaugacuaugcguugcgugggaguaggaaauagagauuuugucgaaggauugaguggggccacuuggguagacguaguacuagaacauggagggugugucacgacaauggccaaaaauaaaccuacucuugacauagaauuacagaaaacagaagcaacacaacuugccacacuuaggaaacuuuguauugaagggaaaauuacaaauauaacuacggauagucguuguccaacccaaggggaagcaaccuuacccgaagaacaagaccaaaauuaugucuguaaacauaccuauguugacagaggaugggggaauggauguggucuauuuggaaaagguucacuuguuaccugugcuaaauuucaaugccuggaaccaauagaaggaaaaguaguucaauacgaaaaccugaaauacacgguaauaauaacaguccauacuggagaucaacaucaagugggaaaugaaacacaaggagugacagcugaaauaacgccccaagcaucaacuacagaagcuauauuaccagaauacgguacgcugggguuggaauguucgccuagaaccgguuuagauuuuaacgaaaugauuuugcuuacaaugaaaaauaaagcauggauggugcauagacaaugguucuuugaccuaccauuaccuuggacaucgggagcgacuacugagaccccaacauggaaucguaaagaauugcuuguuacauuuaaaaacgcucacgccaagaaacaagaaguagugguucuaggaucccaagagggagccaugcauacagcucuuacaggggcaacagaaauccaaaacucaggaggaacuucaauauucgcaggucacuuaaaaugcaggcuaaaaauggacaagcucgaauugaaaggaaugucguacgcuaugugcaccaauaccuucguacucaagaaagagguaagugagacgcaacaugguacuauacuaaucaaaguagaguauaaaggagaagauguuccaugcaaaauaccuuucucaacagaagaugggcaaggcaaagcccauaauggacgguugauaacagcaaacccaguaguuacuaagaaagaagaaccugugaacauugaagcggaaccaccauuuggagaaucaaauauugucauugggauuggugacaaugcccuaaaaauaaacugguauaaaaagggauccucaauagggaaaauguuugaagcaacagcacguggugcgagaaggauggcaauuuuaggugauacggcaugggauuucggaucaguaggagguguauuaaacucgcuagguaaaauggugcaucagauauuugguuccgcuuacaccgcuuuauuuucugguguuuccuggguaaugaaaauugguaucgguguauugcugacauggauaggacuuaacucuaaaaauaccucaauguccuucagcuguaucgcaaucggaauuauaacacuauaucuuggugcgguugugcaagcagacauggggugugucauaaauuggaaaggaaaagaacugaaaugcgggucuggaauauuugucaccaaugaaguacacacguggacagaacaauauaaauuccaggcagauucacccaagcgccuagcaacugcuauagcaggagcgugggaaaaugggguuuguggaauccgcuccacuacaagaauggaaaaccuauuauggaaacaaauagcaaaugaacucaauuacaucuuaugggagaauaauauaaaauuaacaguuguaguaggagauauaauaggaguucuagaacagggaaaacggacuuugacaccccaaccuauggaacuaaaauauaguuggaaaacuuggggcaaagcgaaaauuguaacggcugaaacacagaacaguucuuucaucauagauggaccgaauaccccagaauguccaagugugucuagagcguggaauguaugggaaguagaagacuacggcuucggcguguucacaacuaauauuugguuaaaacuacgagagguuuacacucaacugugcgaucauagauuaaugucagcagcgguuaaggacgagaaagcaguccaugcagauaugggguauuggauugaaagccagaagaacggaaguuggaaauuagagaaagccucucuaauagaaguaaagacauguacauggcccaaaucacauacauuauggucaaauggcguuuuagaaagugacaugauaaucccaaaaucucucgccggaccaauaagucaacacaaucacagaccaggguaucauacgcagacagcaggaccguggcaucucggcaagcucgaauuggacuuuaacuauugcgaaggaacaacgguaguuauuaccgaaaacugcggcacaagagguccuucacuacguacuaccaccgugucaggaaaauuaauacaugaauggugcuguagaucgugcacucuacccccacuccgauauaugggggaggaugguuguugguacgggauggaaaucagaccaauaagcgagaaggaagaaaauauggugaaaagucucguuuccgccggaucugguaagguugauaauaguacaaugggagucuuauguuuggcaauuuuguucgaagaagucaugcgugggaaauuugguaagaaacauaugauagccggcguguucuuuacauucguguugcucuuaaguggccaaauuacauggcgcgauauggcucauacauuaauaaugauagggucaaaugcaucugauaggaugggcaugggagugaccuaccucgcacugauagcgacguucaagauucaaccguuccuugcgcuagguuucuuccuacgaaaacuaacaaguagagaaaauuuacuucuagggguuggucuggcuauggcaacuacauugcaacuuccugaagauauugagcagauggcuaaugggauagcccucggauugauggcuuugaaacuaauaacucaguucgagacauaccaacuauggacugcgcuuauuucacuuacuuguucaaacacaauuuucacacuuacuguagcuuggcgaaccgcaacguugauacuugcuggcguuagcuuauuaccaguaugucagucaucgaguaugagaaaaacagauuggcuuccaauggcuguagcagcgaugggcgugccuccguugccguuguuuaucuuuucauuaaaggauacacuuaagaggcgaaguuggccguuaaaugaaggcgugauggcagucggacucguuucuauacuagccucaucacugcugcguaaugacguuccuauggcagggccccuaguagcuggaggcuuacuuaucgcguguuacguaauaacagguacaucugcagaucuuaccguggaaaaagcugcagauauuaccugggaggaagaagcugaacaaacgggugucucacauaacuugaugauugcugucgaugaugacggcacaaugaggauaaaagaugaugaaacugaaaacauucuaacuguucuccucaagaccgcauuauuaauugugagcggcauuuuuccauauuccauuccggcaacccuuuugguuuggcauacguggcaaaaacaaacgcaaagaucugguguauuaugggacgucccaucacccccugaaacccaaaaagcagaauuggaggaggguguauauagaauuaagcaacaagguauuuuuggcaaaacccaagugggugucgggguacaaaaggagggaguuuuucacaccauguggcaugucacgcguggagcagucuugacauauaaugggaaaaggcuugaaccaaauugggcuuccguuaagaaagaucugaucaguuaugggggugguuggcgacuaagugcucaauggcaaaaaggagaagaaguucaaguuaucgcagucgaaccgggcaaaaauccaaagaacuuccagacaaugccugggacuuuccagacaacuacgggugaaauaggugcgauugcgcuagauuuuaaaccagguacaaguggaaguccaauuauuaauagggaggggaagguugugggacuauauggcaauggaguaguuacaaagaauggaggguacguaagcgguauagcgcaaacaaaugcagaaccagauggaccaaccccugagcuggaggaagaaauguuuaaaaagaggaaucuuacaauaauggauuuacacccuggcucgggcaagaccagaaaauacuugccagccaucgucagagaggcuauuaagagacgacugagaacccucauauuagcucccaccaggguaguggcagcagagauggaagaagcauuaaaaggguugcccaucagauaucaaacaacugcgacuaaaucugaacacacuggucgggaaauuguugaucucaugugccaugcuacuuucaccaugagauuauugucgccgguacgagucccgaauuacaaccuuauaauaauggaugaagcacacuuuaccgauccagcaucaaucgcggcucgaggcuacaucucaacaagaguagguaugggagaagccgcugcaauauuuaugacagccacgccaccugggaccgcugaugccuucccucaaagcaacgcacccauucaagacgaggaacgcgacauaccagaacguucguggaacucggggaacgaauggauuacugacuucgcaggaaaaacuguuugguuugucccaucaauaaaagcagggaaugacauugcaaacugucucaggaaaaaugguaagaaagucauacaauuaucaagaaagaccuuugauacugaauaccagaaaacaaagcuaaacgauugggauuuuguagucacaacggauauaagugaaaugggugcaaauuucaaagcagaccgcguuauugauccacgucgaugucuaaaaccuguaauacuaacagacgggccugaaagagucauacuugcuggaccaaugcccguuacggcagcgagcgcugcucagcggcggggcagggugggaagaaauccucaaaaagaaaaugaucaauauauauucacaggccaaccacuaaauaaugacgaagaucaugcacauuggacggaagcaaaaaugcuccuagacaauauuaauacaccagagggaauuauaccggcacuauuugagccggaaagagaaaaaucggcggccauugauggugaauaccgguuaaagggagaaagucgaaaaacauuuguugaauuaaugagaagaggugauuuacccgucugguuagcacauaaagucgccucagaaggaaucaaguauaccgaucgaaagugguguuuugauggucaacguaauaaucaaauuuuagaagaaaauauggauguagaaauauggacgaaagagggagagaagaagaaacuccgaccaaggugguuagacgcuagaacauauuccgauccgcuagcucuuaaggaguucaaggaguucgccgcgggaagaaaaucgauagcauuagacuuaguaacugaaauaggacgagugccuucgcaucucgcgcacagaacuaggaaugcguuggauaaucucguuaugcuucauacuucagaacauggagguagggcuuauagacaugcaguggaagaacuaccugaaacuauggagacacuucuuuuguugggacucaugauucuacuaacuggaggagcuaugcuauuuuugauaagcggaaaagggauaggaaagacauccauaggacuuauauguguaaucgcuucaucugggaugcuauggauggcggaaaucccauuacaauggauagcaagcgccauaguccuagaauuuuucaugaugguuuuauugauaccggaaccagaaaagcaacgcacaccucaagacaaccaauuagcauacgucguuauuggaauacucacauuagccgcagugauugcagcuaaugaaauggggcuauuagagacuacaaagagagauuugggcaugucaaaagaaccgggggucguaaguccaacuucauaucuggacgucgaucuacaccccgcuagugcauggaccuuauaugcaguggcuacaacgguaauaacacccaugcuuaggcacacaauugaaaacucaacggcuaaugucucuuuagcagccaucgcaaaccaagcuguggugcugaugggacuagauaaaggauggccaauaucaaagauggaucuaggagucccgcugcucgcucuaggguguuauagucagguuaauccuuuaacguuaaccgcagcuguccuauugcuaauuacccacuaugcgauuauaggcccgggcuugcaagcuaaagcaacucgagaagcccaaaaacgaacagcagcaggaauaaugaagaacccaacuguggacggaauaaugacuauagacuuagauccaguuaucuacgacagcaaguuugaaaagcagcucggucagguaaugcuacuuguccuuugcgcuguucaacuauugcuuaugagaaccuccugggcuuuaugcgaggcauuaacauuagcgaccggaccuauaacaacuuuaugggagggcaguccagguaaguuuuggaacacaacaauugccgucucaauggcgaauaucuuucgaggaaguuaucucgccggagcuggacucgccuuuaguauuaugaaaucaguaggaaccgguaaaagagguaccggaucacaaggcgaaacauuaggagaaaaauggaagaagaaauuaaaccaacuuaguaggaaagacuucgauuuauacaagaaaucuggaaucaccgaagucgauaggacagaagcuaaagagggacuaaaacguggagagaucacccaucaugcagugagccgagguucagcaaaauugcaaugguuuguggagagaaauaugguaauaccggagggaagaguaauagacuuagguuguggucguggaggauggucauauuacugugcuggccuaaagaagguuacagagguuagaggauauacaaaaggaggcccaggacacgaagaaccugugccaaugagcacauaugguuggaacauagucaaauuaaugucagguaaagacguauuuuaucuaccaccagaaaaaugcgauacgcuuuugugcgacauaggagaaucgagcccuaguccuacaguagaagaaucgcggacgaucagagucuuaaagaugguagaacccuggcucaaaaacaaccaguuuuguaucaagguccuaaauccauauaugccgacugucauagaacacuuggaaagauuacagcggaagcauggaggcaugcucgugaggaauccucucuccagaaauaguacgcaugagauguauuggaucucgaacgguaccggcaacauuguugcuuccguaaauaugguaucucguuuguugcuuaacagguucacaaugacccauagaagaccaacgauugaaaaagacguagauuuaggagcuggaacgaggcauguaaaugcagagccugagacucccaacauggacguuauuggagagagaauuaaaagaauaaaagaagaacauaacucgacauggcacuacgaugaugagaacccauauaagacaugggcauaucacggcucuuaugaggugaaagcaacagguagugcuagcaguaugaucaaugguguaguuaaguuauuaaccaaaccuugggauguagucccaaugguaacgcaaauggcaaugacagacacaacgccuuuuggucaacaacgcguauuuaaagaaaaagucgacacaagaacaccaaggucaaugccagguacacgucgaguuaugggaauuacugcagagugguuauggcguacucuagggaggaauaagaaaccacgacuuuguacaagagaagaguucaccaagaaaguacguaccaacgcagcuaugggagccguauuuaccgaggagaaccaaugggacucggccaaagcugcuguagaagaugaagauuuuuggaaacuuguggaucgcgaaagggaauuacacaaacuggguaagugcggcucuuguguauauaacaugaugggaaaacgcgaaaagaagcugggagaauuugggaaagccaagggguccagagcaauaugguauauguggcuuggagcuagauacuuagaguucgaggcacucggauuuuuaaaugaagaccauugguuuagcagagaaaauaguuauaguggcgucgaaggggaagguuugcauaaacucggauauauauugcgagacaucaguaaaauaccuggaggggcaauguaugcggacgacacagcaggaugggacacgaggaucacagaggaugacuugcacaacgaggagaaaauuacacaacaaauggacccagagcauaggcaguuagccaaugcaauauuuaaacucacuuaccaaaauaaagucguaaaggugcaacgaccaacgccaacaggaaccguaauggacauaaucaguagaaaagaucagaggggaucaggacaaguaggaacauauggcuuaaauacguucacgaauauggaagcucaauuaauuagacaaauggagggcgaaggagugcuaaguaaggcugauuuggaaaacccacaccuuccggagaaaaagauaacacaguggcuagagaccaaaggcguugaaagacugaaaagaauggcuauuucaggggacgauugcguuguaaaaccuauagaugauagauucgcuaaugcacuacuagcacuuaacgacauggguaaaguacgaaaggauauaccucaguggcaacccucuaaaggcuggcaugacuggcaacaaguuccauuuuguagucaucacuuccaugaacuaauuaugaaggaugguagaaaguuagugguaccuugucgaccucaggaugagcugauagguagggcuaggauuagucaaggagcuggcuggucgcucaaagaaacggcaugccugggcaaagccuaugcgcaaauguggagucuaauguauuuucaccgccgugauuugagauuagcaagcaaugccaucuguucagccguaccaguacauuggguacccacaaguagaacaacauggaguauacaugcucaucaucaguggaugacaacugaugacauguuaacaguauggaauaggguauggaucgaggauaacccauggauggaggauaaaacuccaguaacuacuugggaaaauguaccuuaccugggaaagagagaagaccaauggugugguucauuaauaggguuaacauccagagcgacgugggcucaaaacaucccaacagcaauccagcaaguucggagccuuauuggcaaugaagaguucuuagauuauaugccaagcaugaagcguuuucgaaaagaagaagaaagcgaaggagccaucugguga

SEQ ID NO: 23196 - RNA, 9873 nt, Artificial Sequence
  derived and/or modified CDS sequence (opt6) from DENV-3__HM631859__SS-prME
accagucuuugcuugaugaugauacuuccugcagcacuggcguuucaccuuacaucaagagauggagaaccgcgcaugauagucgguaaaaaugaacgagguaaaucgcuacuguuuaaaacggcuucuggaauaaauauguguacguuaauugcgauggacuuaggggaaaugugugaugauaccguuacauacaaauguccucauauaacagaaguugagccagaagacauagauuguugguguaacuuaacaagcacaugggucacauaugguacauguaaccaagcaggagaacaucgucgagauaaacguagcguggcgcuugcuccucaugugggaaugggacuggauacccggacccaaacuuggauguccgcggagggggcauggcgccaagucgagaaagucgaaacaugggcacuacgacaucccgguuuuacaauacucgcauuauuucuagcacauuacauaggaaccucguuaacgcaaaaaguggugaucuuuaucuuguugaugcuugucacuccgaguaugacaaugcguuguguugguguaggaaaccgggauuucguugaaggacuaaguggagcaacauggguggaugugguacuggaacacggagggugcguuaccaccauggccaaaaauaaacccacauuggauauagaacuccagaaaacugaagccacacaacuugcuacucuuagaaaacuuuguauagaaggaaaaauuacgaauauuacaacugacagcagauguccuacucaaggagaagcuacccuuccugaagaacaagaccaaaauuacguguguaaacauacauauguggaccgagguuggggaaauggauguggguuguucgggaaagggaguuuaguuacuugugccaaauuccaaugucuagaaccuauagaaggcaaaguuguacaacaugaaaaccuaaaauauaccguuauuauaacgguacauacaggggaucaacaccaaguaggaaacgaaacgcagggaguaacugcugagauaacuccacaggcuucaaccacugaagccauuuuaccggaauauggcacauuaggacuggaguguucuccacgcacaggccucgauuucaaugaaaugauauugcuaacuaugaaaaacaaagcauggaugguucaucgccaaugguucuuugaucuuccguuaccguggacaaguggugcaaccacugagacuccuacauggaacagaaaagaauuauuagucacauuuaaaaaugcucaugcuaagaaacaggagguuguaguuuuaggcagucaagaaggggcaaugcauaccgcucuaacuggagcaacggagauccaaaauucuggugggacaaguauauuugcaggacacuugaaaugccgucugaaaauggauaaauuagaauuaaaaggaauguccuacgcuauguguacaaacacguuuguguuaaagaaagaagucagugaaacacaacauggaacaauuuuaauuaaaguagaauauaaaggagaagauguuccuuguaaaauuccuuucucaacagaagacggucaaggcaaagcccauaacggcagguugauaacagcgaauccgguaguuacuaagaaagaagaaccagugaacauagaagcugaaccaccuuuuggcgaaucaaauauaguuauuggaauuggcgacaaugcauuaaagauuaacugguacaagaaggguagcuccaucggaaaaauguuugaagcuacugccaggggcgcaagaagaauggcgauacuaggggacacugcgugggauuucgguucaguuggugguguauuaaauucguuaggcaaaaugguucaucaaauauucgguagugcauauacagcauuauucaguggagucucauggguuaugaaaauuggcauuggaguccucuuaaccuggauuggacugaacuccaaaaacacuucuaugucuuuuaguuguauugcaauaggaaucauuacgcucuauuuaggagcgguaguucaggcggauaugggaugcguaauuaauuggaagggcaaagaacuuaaguguggaagcggcauauucgugacgaaugaaguacacacauggacagaacaguacaaguuccaagcagauucaccuaaaaggcuugcaaccgcuaucgccggugcuugggagaauggcguuugugggauacguucaaccacucguauggagaacuuauuauggaaacaaauagcaaacgagcuaaacuacauauuaugggagaauaauauaaaguuaaccguaguggucggcgauaucauuggagugcucgagcaaggcaagcgcacacugacuccccaaccuauggaauuaaaguacaguuggaagacaugggggaaagcaaaaauaguaacugcugagacccaaaauucaucguucauaauagacggacccaauacaccggaaugcccaucgguaucuagagcuuggaaugugugggagguugaagacuauggguuugggguauucacuaccaauauauggcuuaaauuaagagagguauacacucaacuuugugaccacagacuaaugagugcugcggucaaagaugaacgugcugugcacgcggacaugggauacuggauagagucacaaaagaacggaucuuggaaacuagaaaaagccucacuuauagaaguuaagacaugcacauggccaaagagccacacacuguggucgaaugguguccuugaaucagauaugauaauaccaaaauccuuagcaggcccaauuucgcaacauaaucauagaccgggcuaucauacucagacugccggcccuuggcaucuaggaaaauuagaauuagauuucaacuacugugaaggcacaacagucguaauuacagagaauuguggaacgagggguccuucucuucguacuacuacuguuucggguaaacuuauacaugaauggugcuguagaucuuguacacucccgccacuaagauauaugggagaggauggguguugguaugggauggagauaagaccaauaucugaaaaagaagaaaauauggugaaaucucucguauccgcagguucaggaaagguagauaacuucacuauggguguguugugccuagcaauuuuauuugaagaagucaugagaggcaaauuuggcaagaaacauaugauagcugguguauucuuuacauucgucuuacuauuaaguggacaaaucacuuggagagacauggcacacaccuuaauaaugauugguaguaaugcaagcgaccguaugggaaugggugucaccuaccuagcuuuaauugcuacauucaaaauacaacccuuuuuagcauuaggcuucuuucuucguaaauugacaucuagagagaaucuuuuauuaggugucggguuggcuauggcaaccacccuacagcuaccagaagacauugagcaaauggcaaacgguauugcacugggauugauggcacugaaguugauaacgcaauuugagauauaccaacucuggacagcacuaauaagccuuacuuguucaaacaccauauuuacuuuaacaguugccuggaggacggcaaccuuaauucuagcggggguaucuuuacugccuaugugccaaucguccagcaugagaaaaacagacuggcucccaauggcaguugcagcuaugggaguaccaccuuugccauuauuuauauucaguuuaaaagauacauuaaaacgaagaaguuggccccuuaacgaaggaguaauggcaguaggucuaguaucgauuuuggcaucauccuuacuaagaaaugauguaccaauggcggguccuuuaguggcuggaggguuauuaauagcgugcuauguuaucacaggaaccagugcagaccuaacuguggaaaaggcggcugauaucacaugggaagaggaagcagaacaaacaggugugucacacaaccuuaugauuacuguugacgacgacgguacuaugcguauuaaagaugaugaaaccgaaaauauucuuacaguauuacuuaaaacagcacuccuuauagugagcgguauauuuccauauucgauaccggcaacgcuauuaguauggcauaccuggcaaaaacaaacucagagaucagggguacuuugggaugucccuaguccaccggaaacgcaaaaggcagaauuagaagaagggguguaccgaauuaaacagcaggggaucuucggaaaaacacaggugggcguaggaguacaaaaagaaggaguuuuucacaccauguggcacguuacgaggggagcuguucuuacauauaacggaaaacgauuagagccgaauugggcaaguguaaagaaggaucuaauuucauaugguggagguuggcgucuuucugcacaauggcaaaaaggagaagaaguucagguaauugcuguugagccugguaaaaauccuaagaacuuccagacaaugccuggaacguuucaaacaacaacaggugagauuggugccauagcccucgauuuuaaaccggguacgagcggaucaccaauuauuaauagagaaggaaaaguuguaggguuauauggcaaugguguagucacgaagaauggaggauauguguccgguauagcccaaacaaaugcagaacccgauggaccaacaccagaacuagaagaggaaauguuuaagaaacgaaauuuaacaauaauggaccuacaccccgggucagguaaaaccagaaaauaccuaccagcuauaguuagagaggcaauaaaacguagacuuaggacucugauacuugcgccgacaaggguugucgcagcugaaauggaggaggcuuuaaaggguuuaccaauaagauaucaaacaacugcaacaaagagugaacauaccgguagggaaauaguggaccugaugugucacgcaacuuuuacuaugagacuuuuaucuccugugagagucccuaacuauaacuuaauaauuauggacgaagcgcauuuuacugauccagcaucuaucgcagcgagaggauacauaaguacucgugugggcaugggugaagcggccgcgauauuuaugacugccacacccccugggacagccgacgcauuuccucaauccaaugcaccuauucaagaugaagaacgcgauauacccgagcgaucuuggaacucuggaaacgaguggauaaccgacuuugcggguaaaacagugugguuuguucccucgauaaaagccgguaaugacauugccaauuguuuaaggaaaaacggcaagaagguaauucaauuaucaaggaagaccuucgauacugaguaucagaaaaccaaacuaaaugacugggacuuuguaguuacuacagauauaagcgaaaugggagcuaauuuuaaagcugaucgaguuauagauccuaggagauguuuaaaaccaguaauauuaacggacggucccgagcguguaauacuagcagggccuaugccaguaaccgcagcuagcgcugcacaacguaggggacgaguaggcagaaauccccaaaaagagaaugaccaguacauuuuuacugggcaaccucuaaauaacgaugaagaccacgcacauuggacagaggcaaaaauguuauuagacaauaucaacacacccgagggcauaauaccagcauuauuugaacccgagcgggagaaaagcgcugcuaucgacggggaauaccgacuuaaaggcgaaaguagaaaaacauuuguagaauuaaugagaaggggagaucucccaguaugguuggcacacaagguagcaagugaaggaauuaaauauacugaucguaaauggugcuucgauggacaacgaaauaaucagauucuugaagaaaacauggauguugaaauuuggacgaaagagggggagaagaagaaacuaaggccgagaugguuggacgcacgcacauauagcgauccacuagcuuuaaaggaguucaaagaauuugcggcaggaaggaagucuaucgcuuuagauuuagugacugaaauagggcgcguaccaucacaccuagcacacagaacuagaaaugcauuggacaauuuaguuaugcuacauaccucagaacauggcggcagagcauaccgacaugcuguagaggaauuaccagaaacaauggaaacauuauuguuacucgguuugaugaucuuacuuacuggaggagcgauguuauucuuaauaaguggaaaggggauuggcaaaacuucaaucggucuuaucugcguuauagcgucuagugguauguuguggauggcagaaaucccucuccaauggauagcaucggcaauuguacuagaguucuuuaugaugguauuauuaaucccagaaccggaaaaacaaaggacaccucaagacaaccaacuagcauacguugucaucgguauacugacucuugccgcaauaauagccgcuaacgaaauggguuuauuggaaaccacgaaaagagaucuaggaauguccaaggaaccaggaguggugucccccacuucauauuuagacguggacuugcacccugccagcgcuuggaccuuauaugccguagccacgacaguaauaaccccaauguugcgacauaccaucgagaacaguaccgcgaauguuagccuagccgcgauugcuaaucaagcugucguauuaaugggucuggauaaaggguggccuaucaguaaaauggaucuugggguaccccuguuggcucuaggauguuauucacaagucaauccacuaacucuaacugcugcgguacuucuucuaauaacacauuaugcuaucauuggaccaggacugcaagcaaaagcaacacgagaagcccagaaaaggacugcagcuggcauaaugaaaaauccgaccguggauggaaucaugacaaucgaucuggauccagucauauaugacagcaaguuugaaaaacaacuaggucaaguaaugcuguuaguacuaugcguuguacaacuccuauugaugcggacuagcugggccuugugcgaagcccuaacauuagccacuggcccuauaacuacauuaugggaaggaucaccaggaaaauucuggaauacaacuauagcagucaguauggcaaauaucuuucgagggucguacuuagcgggggccggucuggccuucucaaucaugaaaucugucggaacugguaaaagagggaccgguucacaaggagaaaccuuaggagaaaaauggaagaagaaacuuaaucagcuaagcagaaaagauuucgaccuauauaagaaaucuggcauuacugaaguugacagaaccgaggcaaaagaaggauuaaaacgaggugaaauuacacaccaugccguaucuagagguucugccaaauuacaaugguucguggagcgaaauauggugauacccgaaggaagaguaaucgauuuaggaugcggucgugggggcuggaguuacuauugcgccggucuaaagaaagugacagaaguacggggguauaccaaaggcgggcccggucacgaagaaccggugcccaugagcacauacggguggaauaucguaaagcugaugaguggaaaagauguauuuuauuugccuccagaaaaaugcgauacacuuuuaugcgauauaggcgaaagcucgccuucaccaaccguugaagagucgagaacuaucagagucuuaaagaugguagaaccuuggcuaaagaauaaucaauuuugcauuaaaguacuaaacccuuacaugccuacuguuauugagcaccuugaaagguuacaaagaaaacaugguggaaugcuaguuaggaauccauugaguagaaacuccacgcacgagauguacuggaucucaaacggaaccggaaacaucguggccaguguaaauaugguaucaagacuauuguuaaauagauucacaaugacacaucgaaggccgacgauagaaaaagauguagacuuaggcgcaggcacacgccauguaaaugcagaacccgagacgcccaauauggauguaauaggagaaaggauaaaaagaauaaaagaggaacauaacucuacauggcauuaugaugacgaaaauccauacaagacaugggcauaucacgguucauaugagguaaaggcuacuggaucggcaucgagcaugauaaauggaguaguuaaacuacuuaccaaaccuugggauguugucccuaugguuacgcaaauggcuaugacagauacaacuccuuucggacaacaaagaguauuuaaggaaaagguugauacaagaacaccuagaucaaugccagguacuagaagaguaaugggaauuacggcugaaugguuauggagaacacuagguagaaauaagaaaccucgguugugcacucgagaggaauuuacuaagaaagugagaacuaacgcugcaaugggugcgguauuuacagaagagaaucaaugggauagugcuaaagcagccguugaagaugaagauuuuuggcgauuaguugaccgggaaagagaauuacacaaacuagguaaaugcgggaguugugucuacaacaugaugggcaaaagagagaagaaauuaggagaguucggaaaagcuaaagguucuagggcgauaugguauaugugguugggcgcuagauaccuagaauuugaggcuuuaggauuccucaaugaagaucauugguucaguagagaaaauucauauucagguguugaaggagagggccuacacaaauuaggauauauuuuacgcgacauuagcaaaauaccgggaggagccauguaugcugacgauaccgcaggaugggacacccggauaacagaagacgaccuacacaaugaggagaaaauuacgcaacaaauggauccagaacaccgacagcuggcaaacgcaauauuuaagcuaacauaccagaauaagguaguaaagguucaacgaccuacaccuacuggcacaguuauggauauaauaucaagaaaagaucaacgaggcucgggccaaguuggaaccuauggauuaaacacguuuacaaauauggaagcacaauugauaaggcaaauggaaggagaaggaguacugucaaaagcugaccuugaaaauccacaccuucccgagaagaagauaacacagugguuagaaacgaaaggaguagaaagauuaaaacgaauggcgauaucaggagacgauugcguuguaaaaccaauagacgaccgauuugcaaaugcacuauuagcauuaaacgacaugggaaaggugcgcaaggauauaccacaguggcagcccucaaagggguggcacgauuggcaacagguuccuuuuugcucacaucacuuucacgaacuaauaaugaaggauggccggaagcuaguaguacccugucgaccccaagacgaauuaauuggucgugcccgaauaucgcaaggggcggguuggagucuaaaggaaaccgcuuguuuaggaaaggcuuaugcacaaauguggucccucauguacuuccauagacgggaucugaggcuagcuaguaaugcaauuugcucggcaguacccguucacuggguuccgacauccagaacaacuuggagcauccaugcacaucaccaauggaugacuacggaagacaugcuuaccguauggaauagaguauggauugaagacaacccuuggauggaggacaagacaccuguaacuaccugggagaauguaccauauuuagguaaaagggaagaccaauggugugguucccuuaucggccuaacaagcagagcgacgugggcacaaaauauaccaacagcaauucaacagguuagaucauuaauagguaacgaagaauuucuagacuacaugccuaguaugaagagauuccggaaggaggaagagagugaaggagccauaugguaa

SEQ ID NO: 23197 - RNA, 9870 nt, Artificial Sequence
  derived and/or modified CDS sequence (opt6) from DENV-3__HM631856__SS-prME
accucacucugccugaugaugauauugccagcugcacucgcauuucaccuuacaucacgagacggcgaaccacggaugauugugggcaaaaaugaacgaggaaaaucguuacuguucaaaacagcaucaggaauuaauaugugcacgcucauagcaauggauuuaggagaaaugugugaugauacagucacuuacaaauguccacacauaacugaaguggaacccgaagauaucgacuguuggugcaauuuaacauccaccuggguuacguacggaacauguaaccaagcgggugaacauaggcgggacaaaagaucaguugcacuugccccucaugucggaaugggauuagacacuagaacacaaacuuggaugagcgcugaaggagcuuggaggcaaguugaaaaaguugagaccugggcacuccgacauccgggauucaccauucucgcacuguucuuagcacacuauauaggaaccucacucacucaaaagguaguaauauucaucuuguuaaugcucgucaccccgucgaugacaaugcgcugcgucggcguaggaaacagagauuuuguugaaggauuaaguggggcuacaugggucgacgugguucuugaacauggcgguuguguaacuacaauggcgaaaaauaagccuacucuggacauagagcuacaaaagacagaggcuacacaacuagccacacuacgcaaacucuguaucgaagguaaaaucacaaauauuacaacagacaguaggugcccaacccagggggaggccacauugccugaagagcaagaccaaaauuacguauguaaacacacuuauguagauaggggcuggggcaacgggugcggacuauuugguaaagguucacuagucacgugcgccaaauuccagugucuggaaccaauagaaggaaaaguaguucaauacgaaaaccuaaaauauacaguaaucauaacaguacauacaggugaccaacaccaaguuggaaaugaaacccaagguguaacugcagagauuacaccccaagcgagcacuacagaagcaauucucccggaguacggaaccuuaggauuggaauguaguccucgaacaggucuggacuuuaaugaaaugauucuguuaacuaugaaaaauaaggcauggaugguucauagacagugguucuucgaccugccccugccuuggacguccggagcuacaaccgaaaccccaacguggaauaggaaagaguugcuagucaccuuuaaaaacgcacaugcaaaaaaacaggaagugguuguacuugguagucaagaaggcgcgaugcauacggcauuaacgggggcaacagagauccagaauucuggaggaaccagcauauuugcgggucaucuaaaaugcagacuaaaaauggauaaacucgaauuaaaagguaugaguuacgcuauguguacgaauacguuugugcuaaagaaagaaguaagcgagacacaacacgguacgauauuaauaaaaguugaguauaaaggagaagaugugcccuguaagauaccuuuuagcacagaagauggacagggaaaagcccacaacggaaggcuaauuacagcuaacccagugguaacaaaaaaagaagaaccuguaaacauagaggcagaaccuccauucggcgaaaguaauauugugauaggaauaggcgacaaugccuugaaaaucaacugguauaagaaggggagcucaauaggaaagauguucgaagccacagcuaggggggcuagaagaauggcgauacugggugauacagcgugggacuucgguagcgucggugggguguugaauucacuagguaaaaugguccaucaaauuuuuggaucagcuuauacugcacuguuuagcggaguguccuggguaaugaaaauugguaucgggguauuguuaaccuggauaggccugaauaguaaaaauacaucaaugagcuuuucuugcauugccauugggauuaucacacucuaccuaggugcaguaguacaagcagauaugggaugcgucguuaacuggaaagguaaggaacucaagugugggucugggauuuuuguaacaaaugaaguccauacuuggacggaacaauauaaguuucaggcugacuccccaaaaagguuagcaaccgccauagcaggagcgugggaaaacggcguaugcggcauaagaucuacgacacgaauggaaaacuuguuauggaaacaaauugcuaacgaauuaaacuacauacugugggaaaacaauauaaagcugacaguagucguaggggacauuauagguguccuagaacaaggaaaacgaacacuaacgccccagccaaaggaguuaaaauauaguuggaaaacguggggcaaggccaaaauaguuacagccgagacacaaaauagcuccuucaucauagauggcccaaauacuccagaguguccaucuguuaguagagcuuggaaugucugggagguagaggauuacggguuugguguauuuacaacuaacauuugguuaaagcuacgugaaguauauacacaacuuugugaccaucguuuaaugucagcagccguaaaggacgaaagagcaguacaugcagacaugggauauuggauagaaucacagaagaaugguucauggaaacucgaaaaagcuagccugaucgaaguaaaaacauguacauggccgaagagucauaccuuauggagcaauggaguucuugaaucggacaugaucaucccgaaaaguuuagcuggaccaauaucacaacauaaucaucgacccggcuaccacacgcaaacggcaggaccguggcauuuaggaaaacuagaauuagacuucaauuauugugaaggaacaacgguuguaauaacagaaaauugcgguacuagaggaccaucacugaggaccacuacuguuaguggaaaauuaauacaugaaugguguuguagaucuuguacuuuaccuccacuaagguacaugggagaagaugguuguugguacggcauggaaauaagaccaauaagugaaaaagaggagaacaugguuaagagucuaguuagugcugguucagggaaagucgauaacuucaccauggggguccuauguuuagcgauucuuuucgaggaaguaaugcgggguaaauuuggaaaaaaacauaugauugcugggguuuuuuucacuuuuguucuucuacucagcggacaaauuacuuggcgagacauggcucacacauuaauuaugauagggagcaacgcaagcgaucgaaugggaaugggcguaaccuacuuggcauugauagccacuuuuaagauucagccguuucuugcacuggguuuuuuucuucgcaaacuaacaagcagagaaaacuuacuauuaggcguaggacuugccauggcgacgacccuucaauuacccgaagauaucgagcagauggcgaacggcauagcauuaggauuaauggcgcuaaaacuuauaacucaauucgaaacuuaucaacuauggacugcacugauaucccugacguguucaaauacaauuuuuaccuuaacuguugcguggcggacugcgacccuuauacuggccggcgucaguuuauuaccugucugccaaaguuccaguaugagaaaaacugacugguuacccauggcaguagcggcuaugggagucccaccccucccucuauuuauuuucucacuaaaagacacccuaaaaaggagaucguggccacuuaacgaagguguaauggcaguagggcuuguaagcauccuagcuucaucuuuacuucguaaugaugugccaauggcaggaccauugguggcagggggguuauuaaucgcauguuacgugauuacggguacuagugcagauuuaacgguagaaaaagccgcagacauuacaugggaagaggaagcagaacaaacgggaguuucucauaaccuaaugaucacaguagacgacgacgggacaaugaggauuaaagacgaugaaaccgaaaacauucuuacuguacuuuuaaaaacagcauuauuaaucguuagcgguaucuuuccguauaguauuccugcaaccuuauuaguguggcacacguggcaaaagcagacacagagaucuggcguauugugggaugucccuucuccaccugagacucaaaaggcagaacuugaagaaggagucuaucgaaucaaacaacaaggaaucuucgguaaaacacaaguuggaguaggcguacaaaaagaaggcguauuccauaccauguggcaugucacaaggggggcaguucuaaccuacaauggaaaaagauuagaaccuaauugggcaagcgucaagaaggaccuaauuucuuaugguggagguuggcgucuaucugcacaguggcaaaaaggcgaagaaguacaaguuaucgcagucgaaccaggaaaaaaccccaaaaauuuccaaacaaugcccggaacauuucaaacaaccacgggagaaaucggugcaauagcucuugacuuuaaaccugguacuucaggcucacccauuauaaacagggaagguaaagucguuggacuauauggaaauggagucguuaccaagaacggaggauacgucuccgggauagcccaaacaaaugcagaaccugaugguccgacuccagaauuagaagaggagauguuucggaaacguaaccuaacgauaauggauuuacacccagguucaggaaagacaaggaaauauuuaccagcuauuguaagagaagcaauaaaaaggcguuuacggacuuugauucuugcgccuacaagaguuguugcagccgaaauggaagaagcauuaaagggucucccgauaagguaucaaacgacagccacuaaauccgaacacacugguagagaaauaguggauuuaaugugucaugcaaccuucacgaugagguuguuaucaccaguaagaguaccaaacuacaaucuaauaauaauggacgaagcacacuucacagacccagcaucaaucgcggcaagagguuauauuaguacuagaguuggcaugggagaagcagccgcaauauuuaugacagcaacgccaccaggcacugcagaugcauuuccccaauccaacgcucccauacaggaugaggaaagagauauuccggaaaggaguuggaacagcggaaacgaauggaucacggauuuugcagguaaaaccgucugguucguaccgucaauaaaagcaggaaaugacauugccaauugucucagaaaaaaugguaagaaagucauccagcugucucgaaagacauuugauaccgaguaccaaaaaacgaagcuaaaugacugggauuucguugucaccacggauauaucugaaaugggcgcgaacuuuaaagcugacagaguuauugauccaaggcguugccuaaaaccaguaauauugaccgacgggccagaaagagugauuuuagcugggcccaugccugucacagccgcuucugcugcccaaaggcggggacgcguaggacgaaacccgcaaaaagagaaugaucaauacauuuucacaggacaaccgcucaacaaugacgaagaccaugcacacuggacugaggcaaaaauguuacuagacaauauuaacacucccgaaggaauaauuccagcgcuuuuugaaccagaacgggaaaagucugcagccauugauggugaauauagacucaaaggggaaaguagaaaaacauuuguagaauuaaugcguagaggagauuugccaguguggcuagcacauaaaguagccagugaaggaauaaaguauaccgacagaaagugguguuucgauggacagagaaauaaucaaauccuagaagagaacauggauguggaaauauggacuaaagaaggugagaagaaaaaacuucguccuagauggcucgaugcgagaacuuauagugacccguuagcgcuaaaggaauuuaaagaauuugcugccgggagaaaaucaauugcacuugaucucguuaccgagauagggcgaguuccaucacaccuagcacaccggacgcguaaugcacuagauaauuuaguaaugcuacacacaucagagcaugggggccgagcauaccgucaugcgguugaagaauugcccgaaacgauggagaccuuacugcuucuaggcuuaaugauccuacucacuggaggagccaugcuauuucucauaaguggcaaagguaucggaaaaacauccaucggauuaauauguguuauugcaagcucgggaauguuguggauggccgaaaucccgcuccaauggaucgcaagugcaauaguuuuagaauucuuuaugaugguauuacuaaucccagaaccagaaaaacaaaggacaccacaagacaaccaauuggccuacguuguaauaggcauuuuaacauuggccgcaauuauugcggcgaacgaaaugggacuccuugaaacuacaaaaagagaccugggaaugaguaaagaaccaggugucguaucaccaacaagcuaccuagaugucgauuugcaucccgccagugcuuggacccuuuacgcggucgcaacaacagucauuacaccaaugcugagacauacaauagaaaacucgacagccaauguaaguuuagcggcaauagcaaaccaagcgguuguucuuaugggacucgauaaaggauggccaauuucuaaaauggaucuuggagucccauuacuagcauuaggcugcuauagccaaguaaacccucuuacauugacggcagccguacuccuauuaaucacacacuacgcuauaauagguccuggguuacaagcaaaagcaacaagagaagcgcaaaaaagaacagcagcuggaauaaugaaaaaccccacagucgacggcauuaugacuaucgaucucgacccaguuauauacgacucuaaguucgagaagcaacuaggccaaguaaugcuguuggucuugugugcggugcaacugcuauuaaugcgaacuaguugggcauugugcgaagcccuaacucuggcaacuggccccauaacaacauuaugggagggaaguccagguaaauuuuggaacacgacgauugcugucucaauggcaaacauuuuucgaggauccuaccuggcuggagcgggucuugccuucucaauaaugaaaucuguaggaaccggcaaaagagguacaggcucucaaggcgagacuuugggagaaaaauggaagaaaaaacugaaucaacuuagucgaaaggauuuugaccuuuacaagaaaucaggcaucacagaagucgauagaacagaggccaaagaaggacuuaaacgcggcgaaaucacucaucaugcuguuagccgaggaucagcuaagcuucagugguucgucgaacgaaacaugguaauaccugaaggaaggguaauagauuuagguuguggcagaggaggaugguccuauuacugugcaggguuaaaaaaagugacggaaguuagaggguauacgaaagggggacccggacacgaagagccagugccaaugaguacguauggauggaacauaguaaagcuaaugagugguaaggaugucuucuaccugccgccagaaaaaugugacacacuacucugcgauauaggugaaaguucuccguccccaacgguggaagaaucuagaaccauucgcguuuuaaaaaugguggaaccauggcuaaagaauaaucaauuuugcauaaaaguucugaauccauauaugccaacggugauugagcacuuggaacgucuccaacgaaagcacgguggcaugcuuguucgcaauccguuaucuagaaacucaacucacgaaauguauuggauuaguaacgguacagguaauauaguagccucggucaacaugguaucccgucugcuacucaauagauuuacuaugacacaucgacguccaacuauugagaaggacguugacuugggagcuggcacaagacacgucaaugcagaacccgagaccccaaauauggacguaauaggagaacggauaaagcgaauaaaagaagaacauaacaguacuuggcacuaugaugaugaaaacccguauaaaaccugggccuaccaugggucauaugaaguuaaagccaccggcagugccucaaguaugauuaacggcgugguaaaguuacugacuaaaccaugggauguugucccaaugguuacacaaauggcuaugacagauacaacaccauuuggacaacaaaggguauucaaagagaaaguggauacaagaacacccagaucuaugccagguacccguagaguuauggguauuacagccgagugguuauggagaacauuaggacgaaauaaaccucgguuaugcacaagagaggaguuuaccaaaaaaguacgaacgaaugcggcuaugggggcuguuuucacagaagaaaaccaaugggauucggccaaagcugcaguagaagacgaagauuucuggaaauuaguugaucgagaaagggagcuucacaaauugggaaaauguggcagcugcguguauaauaugauggggaagcgagagaaaaaacuaggcgaauucgggaaagccaaaggauccagagcgauuugguacaugugguuaggagcuagauauuuagaguucgaagcacuagguuucuuaaaugaagaucauugguuuagcagagaaaacaguuacuccggaguagagggcgaaggucugcauaaacuugguuauauccuacgagacauuucaaagauacccggcggagcuauguaugccgacgauacggcaggaugggacacgaggauuacugaagaugacuugcacaaugaagaaaagauaacccagcaaauggauccugaacauagacaacuagcuaaugcaauauucaaguuaacauaucaaaauaagguuguuaagguucaaagacccacaccaacaggaacaguuauggauauuauuucaaggaaagaucaacgaggaucagggcagguaggaacuuaugggcucaauacauucacaaauauggaagcacaguuaauaagacaaauggagggagaaggaguacucaguaaagccgaucuagaaaacccccauuuacccgaaaaaaagauaacucaaugguuggaaacuaaagguguugaaagacuuaaacgaauggcgauaagcggugacgauugcguuguuaaacccaucgaugauagauuugcaaaugcacuuuuagccuugaaugacauggguaaggucagaaaggauauaccacaauggcagccgucaaaaggauggcaugauuggcagcaaguacccuuuuguagucaccauuuccaugagcucauuaugaaagauggucguaaauuagucguucccuguagaccgcaagacgaauuaaucggaagggcuagaauaucccaaggagcgggcuggaguuuaaaagaaacagcaugucuagguaaagcguaugcacaaauguggucuuuaauguauuuccaccgacgcgauuuacgucuagcaaguaaugcgaucuguucagcuguucccguacacugggugccgacuaguagaacaacuuggaguauacacgcucaccaucaauggaugaccacggaagacaugcugacaguuuggaauagaguauggauugaagacaauccguggauggaagacaagacaccaguaacgacuugggaaaacguaccguauuuaggaaaaagagaagaucaguggugcggaaguuugauaggucuaaccucacgugcuacaugggcgcaaaauauaccaacagcuauccaacaaguccgcucccucauugguaaugaagaauuccuugauuauaugccuaguaugaaacgcuuuagaaaagaggaagaguccgaaggugcuauaugguaa

SEQ ID NO: 23198 - RNA, 9873 nt, Artificial Sequence
  derived and/or modified CDS sequence (opt6) from DENV-3__HM756276__SS-prME
acuagcuuauguuuaaugaugauauuaccggcugcucuugcauuucaccugacaucaagggacggugagccuagaaugauuguuggcaaaaacgaaagggggaaaaguuuacucuuuaaaacagcaaguggaaucaauaugugcacacuuauugcuauggaccugggugaaaugugugacgacacaguaacauauaaaugcccgcauaucacggaaguagaaccugaagauauagacuguuggugcaauuuaacaucaacuugggucacuuaugguacguguaaccaagcuggagaacacagacgagauaaacgaucaguggcauuagcgccccacguagguaugggauuagauacuagaacacaaaccuggaugucagcagaaggagcauggagacaaguugaaaaaguugagaccugggcacuaagacacccuggauuuaccauccuggcgcuauuucuagcacacuauauugguacgagucugacacagaaaguugucaucuucauucucuugauguugguaacaccuucaaugacaaugagauguguuggaguaggaaauagggauuucguggaagguuuauccggcgccacguggguagauguugugcuugagcaugguggcuguguaacaacuauggccaaaaauaaaccaaccuuagacauugaauuacagaaaacugaggcaacacaauuagcuacccuucgaaaacugugcauagagggaaaaauaacaaauauaacaacggauucaagguguccaacucaaggugaggcuacacuaccugaagaacaagaucaaaacuauguaugcaaacauacuuacguagaucggggaugggguaacggcuguggucuauuuggaaaagggucacuggucacaugugcaaaauuucaaugccucgagcccauagaggggaaagugguucaauacgagaauuuaaaauacacuguuaucauaaccguacacacaggagaccagcaucaaguaggaaacgaaacacagggagugacagccgaaauuacaccccaggcaucaacgacggaggcuauuuuaccugaguacgguacccuaggcuuagaauguucuccuaggaccgggcuagauuucaaugaaaugauacuauuaacgaugaaaaauaaagcguggaugguacaccgucaaugguucuuugacuuaccccuaccguggacaagcggugcuacgacugagacaccgacauggaauagaaaagaguuguuagucacuuuuaaaaaugcgcacgccaagaaacaagaaguggugguacucggaucacaggagggugccaugcacacagcuuuaaccggcgcuacggagauacaaaacagcggagggacuucaauuuucgcugggcaucuaaaauguagacuuaagauggacaaauuagagcuuaaaggaaugucauacgccauguguacaaauacauuuguacugaagaaagaaguuagcgagacccaacaugguacgauuuuaauaaaagucgaauauaagggugaagauguaccauguaaaauaccuuuuaguacggaggaugggcaaggaaaagcacacaaugguagacucauaaccgcaaacccgguuguuaccaaaaaggaggaaccagucaauauugaagcagaacccccauucggagaaucuaacauuguuauugggauaggagacaaugcacucaaaauaaauugguacaaaaaggggucuucaauugggaagauguucgaagcuacagcuaggggagcccgaagaauggcaauacuaggggauacugcgugggacuucgguucaguaggcggaguccuaaacagcuugggcaaaauggugcaucaaauuuuuggauccgccuauacagcauuauucuccgguguaaguugggucaugaaaauaggaaucggggugcuuuuaacauggaucggauugaauaguaaaaacacuucgaugucuuuuucaugcauagcuaucggcauaauaacauuauaccugggggccguaguacaagcagauaugggauguguuguaaauuggaagggaaaagaacuaaaaugcggcucaggaauuuuuguaacaaaugaaguacacaccuggaccgaacaguauaaguuccaagccgacuccccaaaacguuuagcaacugcuauugcuggagcuugggaaaaugguguuugugggauaagguccacgacccgaauggaaaacuuacuauggaagcaaauagcaaaugaacuuaacuauaucuuaugggaaaacaacauuaaacuuacgguagucguaggagacauuauuggaguccuagaacaagguaagagaacguuaacaccucaaccuauggaauuaaaauauucauggaagacauggggaaaggcuaaaauugugacagccgaaacccaaaacucaucauuuaucauugacggaccgaauacaccggaaugcccuagcgucucgagagcauggaauguaugggagguagaagauuauggauuugguguuuucacaacuaauauauggcuaaaauugagagaagucuacacucagcugugcgaccaccgccugaugagcgcagcggugaaagacgaaagagccguacaugcggacaugggcuauuggauugagucucaaaagaacgguucauggaaauuagaaaaagcgucgcugauugagguaaaaacaugcacauggccgaaaucacacaccuuauggaguaacgguguuuuggaaucagauaugauaauucccaaaucucuggcaggcccuauaucgcaacacaaucauaggccuggauaucauacccagacggccgguccuuggcaucuaggaaaacuagagcuagacuuuaauuauugcgaaggcaccacaguugugaucacagaaaauugugggacacgaggaccaucguuacgaacuacuacaguguccgguaaacuuauacacgaaugguguuguagguccugcacauugccuccgcugagauauaugggcgaggacggaugcugguacggaauggaaauuagaccuauuucagaaaaagaggaaaacauggugaagucauugguuucugccggaucagguaaaguggauaacuucacaauggguguuuuaugucuggcaauucuauucgaagaaguaaugaggggaaaauuuggcaagaaacauaugauagccgguguauucuuuacauuuguacuucuacuuaguggucaaauaacguggcgcgauauggcacacacauuaauaaugauaggaaguaacgcuagugauaggaugggcaugggaguuacauauuuagcacuuauagcuacuuucaagauccaaccauuuuuagcacuuggauucuuucuuagaaaacucaccuccagagaaaaucuccuauuaggaguuggacuugcgauggcaacuacccuacaacuuccagaggauauagagcaaauggcuaauggaaucgcgcuggggcugauggcacucaaguuaauaacucaguuugaaacauaucaacuauggaccgcuuuaaucucucucacaugcucgaauacaauauucacucuaacuguagcauggcgaacagccacauuaauacuugcagggguaagccuguuaccugucugucagagcucuagcaugaggaagacagauuggcucccaauggcugucgccgcaaugggaguucccccacuaccauuauucauauucagcuugaaagauacccuaaaacggagaucauggccuuuaaaugaaggcgugauggcaguaggucuaguaaguauacuagccaguucccuacuaagaaaugauguaccaauggccggccccuugguagcuggaggacuccuuauugcuuguuacguaauuacuggcacaagugcggacuugacaguagaaaaagcggcugacaucacuugggaggaggaagcggaacaaacaggaguaagucauaaccuuaugauuacuguugaugacgacggaacuaugagaauuaaggaugaugagacugagaacauauugaccguuuugcuaaaaacugcauuacuaauaguuagcggaauuuuuccauauucgauaccugcaacacuguugguuuggcacacauggcaaaagcaaacucaacguucagguguauuaugggacguaccuucacccccugaaacucaaaaggccgaauuagaggaagggguauaucgaaucaaacagcagggaauauuuggaaaaacacaagucggaguaggcguucaaaaggagggaguauuucauacaauguggcauguuacaaggggcgcaguauuaacguauaacgggaaacgauuggagccaaacugggcauccgucaagaaagaucugauuaguuacggaggcggguggagguuaucagcgcaauggcaaaagggugaagaaguucaggugauagcgguugaaccuggcaaaaauccuaagaauuuccaaacuaugcccggcacauuucaaacaacaaccggugaaauaggagcuauugcauuagacuuuaaaccugguacgucaggauccccaauaauaaaucgagagggaaaaguugucggacuguacggaaauggaguuguaaccaaaaacggcggauaugugucgggaauagcacaaacuaaugcggaaccagacggaccuaccccagaauuagaggaagagauguuuaaaaagcgaaaucugaccauaauggaccuacauccuggaagcgguaagacgcggaaauaucuuccugcaaucgugcgugaagcuauaaaacgacgacuacgaacacugaucuuagccccgaccagagucguagcagcugaaauggaggaagcucucaaagggcugccuauaagguaucagacaaccgcuacaaaaagugaacauacagggagagaaauuguugaucuuaugugucaugcuacauucacaaugagacugcuuucgcccgugagagugccaaacuauaaucuaaucauuauggaugaagcucacuucacggaucccgcaucaauugcggcacgggguuauauuagcacaagaguagggaugggagaagcagcugccauuuuuaugacugcaaccccaccagguacagcagaugcauucccccaaaguaacgcgccaauacaagacgaagaaagagacauuccggaaaggagcuggaacucagggaaugaauggauaacggauuucgccgggaaaacgguaugguuugucccaucaauaaaagccggaaaugacauugcgaauugcuuaaggaagaacgguaaaaagguaauacaacugaguagaaagacguucgauacagaauaucaaaagacaaaacugaaugacugggacuucguaguuacgacagauauaagugaaaugggggccaauuuuaaagcggaccggguaauugauccaagacgcuguuuaaaacccgugaucuuaacugauggcccugagcgugucauuuuagcgggcccaaugccaguaaccgccgcuucagcagcucaaagacguggcagaguaggccgaaauccacaaaaggaaaaugaucaauacauuuuuacaggacaaccacuuaauaacgaugaggaccaugcgcauuggacagaagcaaaaaugcuacuugacaauauaaacacacccgaggguaucauuccugccuuauuugaaccggagcgugaaaaauccgcagcuauagauggggaauaccggcucaaaggggaaucccgcaaaacuuuuguugaacuuaugagaagaggcgacuuaccggugugguuagcucauaaaguagccagcgaagggauuaaauacacagaccguaaaugguguuucgacggucaacguaacaaccagauccuggaagagaauauggacguugaaauauggacaaaagaaggugaaaagaagaaacuaagaccuagauggcuggaugcaagaacauauucugauccguuggcuuuaaaagaguucaaggaguucgcggcaggacgaaaaucuauugcuuuagaccugguaacugaaaucgguagagucccgagccaucuagcacaccgaacaagaaacgcucuagauaaucuaguuauguuacacaccucagagcacgguggcagagcuuauagacaugcaguggaggaacuuccagaaacaauggaaacccuacuuuuacuuggucuuaugauuuugcuaacuggaggugccauguuguuccuuauaucaggcaaagguauuggaaagacgaguauuggauugauuuguguaauagcuucaucuggaaugcuauggauggcagaaaucccgcuacaguggauagccucagcaaucgucuuagaauuuuucaugauggugcuauugauaccagaaccugagaagcaacgaacaccacaagacaaucaacuagcauaugucguaaucgggauauuaacauuagcugcuaucaucgcagcuaaugaaaugggacugcuugaaacuacaaaacgggauuuaggaaugagcaaggagccuggaguuguuucucccacaagcuacuuagacguggacuuacauccagcaucagcauggacacuuuaugcuguagcgacuacaguaauaacaccaauguuacggcauacaaucgaaaauucgacugcuaauguaucacucgcagcuauugccaaccaggcugugguacuaaugggucuugauaaagguuggcccauaaguaaaauggauuuaggcguuccucuauuggcauuaggaugcuacucacaagucaauccuuuaacccuaacugcugcaguguuauuauugauaacacauuaugcuaucauagggccuggcuuacaagcgaaggcuacacgugaagcacagaaaagaacugcugcgggcaucaugaaaaauccuacggucgauggaauaaugaccauugacuuagauccaguuauauaugacucgaaauuugaaaaacaguugggucagguuaugcuauuaguauuaugcgcuguacaauuacuucucaugaggacgagcugggccuuaugcgaggccuuaacauuagcaacagguccaaucacuacucuaugggaggguaguccagguaaauuuuggaacacaacaaucgccguaucaauggcuaacauauuucgcggauccuauuuagcuggcgcgggauuagcauuuucaauaaugaaaucaguuggaaccggcaaacgggggacgggcucucaaggugaaacauuaggagaaaaauggaagaagaaauugaaucaacuaucaagaaaggauuucgaucuauacaagaaaagcggaauuacagaaguugauagaacagaggcaaaggagggacuaaagagaggugaaauuacgcaucaugcgguaucccgagggucagcaaaauuacaaugguuuguggagagaaacaugguaauaccugaggggagaguaauugauuugggcuguggacgcgguggauggagcuauuacugcgccggacugaaaaagguaacagagguuaggggcuauacaaaagggggacccggacacgaggaaccgguaccuaugucaacguacggauggaauauagucaaguuaaugagcggaaaggacguauucuaccuuccaccggagaaaugcgauacccuauuaugugacauaggagaaaguaguccaucucccacaguagaagaaucacgaacaauaagaguguuaaaaauggucgaacccugguuaaagaauaaucaauuuuguauaaaaguguuaaauccauauaugccaacaguaaucgagcaccuugaaaggcuacagaggaaacauggagguaugcuuguccgaaacccacucaguagaaauaguacacaugaaauguauuggauaucaaacggcacuggcaauauagucgccucuguaaauaugguguccagguuguuacuuaaccgguucacaaugacacacagacgacccacaaucgaaaaagauguagacuuaggggccgggacccgccaugugaaugcggagcccgagacucccaauauggauguuauuggagagcgcauaaagagaauuaaggaagaacacaauucuacauggcacuaugaugaugaaaauccauauaaaaccugggcuuaccacgguuccuaugaggugaaagcaacaggaucugcuucaagcaugaucaacggugugguuaaauuacuaacuaaaccaugggaugucguaccgaugguaacccaaauggcaaugacagacacuaccccauucggacaacaacgagucuuuaaagagaagguggacacaagaacaccucguagcaugccaggaacgcguagagugaugggcauaaccgccgaauggcuguggaggacauuaggucgaaauaagaaaccacgguuauguacacgagaagaauuuacuaagaaagucagaaccaacgcagcaaugggugcaguauuuacagaagaaaaucaaugggauucagcaaaagcagcgguagaagaugaggauuuuuggaagcuaguagaccgagagagggagcuccacaaguugggaaaaugcggaaguuguguauauaauaugaugggcaaaagggagaagaaacucggggaauuuggaaaggcaaaagguaguagggcgauaugguauaugugguugggggcaagguacuuagaguuugaagcccuaggauuccuaaaugaagaccauugguuuagucgugaaaacucuuacaguggcguugaaggugaaggacuucauaaguuggguuauauacuucgagacauaucaaaaauaccagguggggcaauguacgccgaugauacggcagguugggacacaagaaucacagaagaugauuugcauaacgaagagaaaauuacucaacaaauggacccggaacaccgacaacuagcgaaugcaauauuuaaguuaaccuaccagaauaaaguuguaaaaguccaaaggccaaccccaacaggaacagugauggacauaaucagcaggaaagaucagcgaggaaguggacaaguggggacguaugguuugaauacauuuacuaacauggaagcacaauugauucgacagauggagggagaagguguauuaagcaaagcggaccuggaaaauccccauuugcccgagaagaaaauaacacaaugguuagaaaccaaaggcgucgaacgucuaaagagaauggcgaucaguggugaugauugcguaguaaaaccgauugaugauagauuugcaaaugcguugcucgcauuaaaugacauggguaaagugagaaaagauauuccacaauggcaacccaguaaagguuggcaugauuggcagcaaguaccuuucuguagucaccauuuucaugaauugaucaugaaagauggucgcaaacucguagugccauguagaccacaagacgaguugauaggucgagcacguauuucgcaaggagccggguggucuuuaaaagagaccgcuugcuugggaaaggcuuaugcccaaauguggucacuaauguacuuucauagacgagacuuacgauuagcaaguaaugcaauaugcucagcgguaccaguucauuggguaccuaccagucguacgacauggucaauucaugcacaucaucaauggaugacaacggaagacauguugaccguauggaauagggucuggauagaggauaauccguggauggaggacaaaaccccaguaaccacuugggagaauguaccuuaccugggaaaacgggaagaccaaugguguggcucccuuauaggauuaacaagucgggccacaugggcccaaaacauaccaacugcaauccaacaagugagaucguugauugguaacgaggaauuucucgauuauaugccuucaaugaagagguucaggaaagaagaagaaagugaaggagcaauuugguaa

SEQ ID NO: 23199 - RNA, 9873 nt, Artificial Sequence
  derived and/or modified CDS sequence (opt6) from DENV-3__HM756279__SS-prME
acgucauuaugccuuaugaugauccuaccugcagcuuuggcauuucacuugacuuccagagacggugaacccagaaugauaguagguaaaaacgaacgaggaaaaucacuguuauuuaaaacagccagcgguauaaauauguguacgcuaauagcuauggaucuaggggaaaugugcgacgacacaguaaccuauaaaugcccgcauaucacugaaguggaaccugaagacaucgauuguugguguaacuuaaccucaacauggguuacauaugguacauguaaucaagccggcgaacauagaagagacaaaaggagcguggcguuagccccacaugucgggaugggccucgacacuagaacccaaacguggauguccgcugaaggggcauggagacaaguagaaaaaguggaaacaugggcuuuacgucauccaggcuucaccauacucgcacuauuucuagcucacuacaucggcacaagccuaacccaaaaagucguuaucuucauauuauuaaugcuugugacuccuagcaugacaaugaggugcguugggguuggaaaccgagauuucguagaagguuuaucuggagcaacauggguagauguagugcuagaacauggaggauguguaacaacgauggcgaaaaacaaaccaacuuuagauauugaacugcagaaaacugaagcaacucaauuagcgacacuaagaaaacuauguauagaaggaaaaauaacuaacaucacaacugacagcagauguccaacucaaggagaagcaacccugccagaagaacaagaucaaaacuacguauguaaacauacguauguugaccgaggcugggggaacggauguggacucuucggaaaaggcucgcuagugacgugcgcuaaauuucagugccucgaaccuauagaagguaaaguaguucaauaugaaaaccuaaaauauacaguaaucauaaccguacauacgggggaccaacaucagguaggcaaugaaacucaaggaguaaccgcugaaaucacaccacaagccagcaccaccgaggcaauucuccccgaauacggcaccuuaggccuagaaugcucacccagaacuggucuagacuucaacgaaaugauuuugcuaacaaugaaaaacaaagcguggaugguccauagacaaugguucuucgacuugccacuuccuuggacuucaggagcaaccacugaaacuccaacuuggaauagaaaagaauugcuagucacauuuaaaaaugcccacgcgaaaaagcaggagguagugguccuagguagucaagagggcgcaaugcauacagcuuuaacgggugcgacagaaauacagaacagcgguggaacauccaucuuugcuggacaucuaaaaugucgauugaaaauggauaaacuagaauugaagggaaugucuuacgcuaugugcacuaacacuuucgucuuaaagaaagaaguaucagaaacacaacauggaacgaucuuaauuaaaguagaguauaaaggcgaagauguaccaugcaaaaucccuuucucuacugaagauggccaaggaaaagcucauaaugggcgguugauuacggcaaaccccguuguaacgaagaaagaggaaccaguaaauauagaagcugaaccgccauuuggggaaucaaacacgguuauagguaucggagacaaugcacuaaagauuaauugguacaaaaaggguucgaguauuggcaaaauguuugaagcgacagcacguggagcccgacggauggcaauucuaggugauacagcaugggacuucgguaguguuggagggguacuuaauagcuuaggcaaaaugguccaucagauuuuuggaucagcauauaccgcauuauucagcggagucucaugggucaugaaaauaggcauaggcguacuuuugacauggauugggcuaaacagcaagaacacuucuaugagcuucaguuguauagcaauaggaauuaucacgcuguauuuaggagcagucgugcaagcagauauggguugcguaaucaacuggaaagguaaagaauugaaaugcggauccgguauauucgucacaaacgaaguucacacuuggacggagcaauauaaauuucaagcggauagccccaaacgucuugcuacagcaauugccggagcaugggagaauggcgucuguggaaucagaagcaccaccagaauggaaaacuuguuauggaagcaaauagcgaaugaacuuaauuauauacucugggaaaacaacaucaaguuaacaguugugguaggugauauuauaggaguacuugagcaagguaaaaggacauugaccccacaaccgauggaacuuaaauauucguggaaaaccugggggaaagcuaagauaguaacagcggagacccaaaacucaaguuucauaauugaugguccaaauacaccugaaugcccaucuguuucaagagcauggaacgugugggaaguggaagacuauggauuugguguauucaccacaaauauuuggcuaaagcuccgcgaaguauacacccaacugugugaccauagauuaaugucagcagcuguaaaggacgaaagggcuguucaugcugacaugggcuauuggauagagucccagaaaaauggcucauggaaauuagaaaaggcuucguuaaucgaagugaaaacaugcacauggccgaaaucucauacacuuuggaguaauggcguucuugaaucagauaugaucauacccaaaaguuuagcggguccuaucagccaacauaaccacaggccuggauaucauacacaaacagcaggaccauggcacuugggaaaacuugaguuggauuuuaauuauugcgaaggaacaacuguaguaauaacagaaaacugugguacaagaggaccaucgcuaaggacaaccacagugagugggaaguuaauucaugagugguguugcagaaguuguacacugccaccguugcgguauaugggcgaagauggcuguugguacgguauggagauuagaccaauuagcgaaaaagaagaaaauaugguaaagagcuuggucucagcugguagcggaaaaguggauaacuuuacaaugggaguguuauguuuagcgauacuuuuugaagaagucaugagaggcaaguucggcaagaaacauaugauagcggggguauucuuuaccuuuguguuacuucugucaggccaaauuacauggcgggauauggcgcauacgcuaaucaugauuggaucgaaugcgucugacagaauggggaugggaguuacguaccuagcccuaauagcgacuuuuaaaauacaacccuuucuggcacucggcuuuuuccuaaggaaacuaacuucuagagaaaauuuauuauuagguguggguuuagcaauggccacaacccuccaauuaccugaggacauagaacagauggcgaacgggauugcucuuggucuaauggcguuaaaacuuauaacucaauucgagaccuaucaguuauggacugcucugauauccuuaacaugcucaaauacuauauuuacucuuaccguagcauggagaacagcgacauuaauacuagcaggagugagccuacuaccaguaugucaaucaagcucuaugagaaaaaccgacugguuaccuauggccguugcagcaaugggaguaccaccuuuaccucucuuuauauuuggacuuaaagacacauuaaaacgaagguccuggccacuaaaugagggaguuauggcaguaggacuugucaguauucuagccucuagccuauuacgaaaugauguuccgauggcaggaccgcuagucgcugggggcuuacuaauugcaugcuacgugauuacagguaccucggcagauuugacgguggagaaagcugcagauauuacaugggaagaagaagcugaacaaacaggugugagucauaaccuuaugauaacuguagaugacgacgggacaaugagaaucaaagacgaugaaacugaaaauauucuuacgguuuuacuuaaaacggcgcuuuugauagucagugggauuuucccguauaguaucccggcaacucuguuaguauggcacacguggcagaaacaaacgcaacgauccggaguguugugggauguuccaucuccaccugaaacucaaaaagcugaauuagaagaaggcguuuacagaauaaagcaacaggguaacuucugggaaacccaaguaggaguaggggugcaaaaagaaggugucuuucacaccauguggcaugucacgagaggcgcuguccuuacuuauaauggaaaaagacuagagccaaacugggcaagcguuaagaaagacuuaauaucguacggaggcggguggcgccugagugcacaauggcagaaaggugaagagguacaaguuauugcaguagagcccggcaaaaaccccaaaaauuuccaaacaaugcccgggacuuuucaaaccaccacaggcgagauuggggcaaucgcucuggacuuuaagccagggacaagugggaguccaaucauaaaucgagagggaaaaguuguuggccuuuauggcaacggagucguuaccaaaaauggaggguauguaagcggcauagcucagacuaaugcggagcccgacggaccaacacccgaacuagaagaagaaauguucaagaaacgaaauuuaacaauaauggacuuacacccaggcagcggaaagacaagaaaguauuuacccgcaauagugcgggaagcaauaaaaagaagacuuagaacacuuauacuagcucccacgaggguuguagccgcggaaauggaagaagcguugaaaggacucccaauccgauaccaaacaacugccacgaaaagcgaacacacagguagagaaaucgucgauuuaaugugccacgcaacauuuaccaugcgcuuacuuagccccgugagagugccuaauuauaaccucauaauuauggaugaggcucacuucaccgaucccgcuagcauagcggcaagagguuauauuuccacgaggguaggcaugggugaagcugcggcaauauuuaugacagcaacgccgccuggcacagcugacgcguuuccgcaaaguaacgcgccuauacaagaugaggagcgggacauucccgaaagaaguuggaacucuggcaaugaguggauaacagauuucgcugguaaaacaguuugguuugucccgucuauuaaggccgguaaugacauagcuaacugccuuaggaaaaacggcaaaaagguaauacaauuaucuagaaaaacuuuugauacggaguaucagaaaacuaaacuuaacgauugggacuucgucguaacaacggacauaucggagaugggagcaaauuucaaagcugaucgaguuauagacccacguagauguuuaaaacccguuauucugacagacgguccggagagagugauacuagccggaccaaugccgguaaccgcagcgucagcugcacaacguagaggacgagucgguagaaacccgcaaaaagaaaaugaucaauacauauucacaggccaaccccuuaauaaugaugaagaccaugcccacuggaccgaagcaaaaaugcucuuggacaauauaaauacgccugagggaauaauacccgcauuauucgaacccgaaagggagaaaagcgcagccauugauggggaauauagacuuaagggcgaaucuagaaaaacauuuguagaacuuaugagacguggagaucuuacaguguggcuagcacauaagguugcauccgaaggaauuaaguacacagaccguaaauggugcuuugacggacagcguaauaaucaaauauuagaagaaaauauggauguugaaauauggacuaaagaaggcgagaaaaagaaacuaagaccacguugguuggacgcaaggacuuauagugacccacuggcgcucaaagaguuuaaagaauuugcagcaggaaggaaaucaauugcauuagaccucgucacugagauugggagggugccuucacaucuugcccaucgcaccaggaaugcauuagauaauuuaguuauguuacacacaagugaacacggcggcagagcauauagacaugcgguugaagaauugccggaaacaauggaaaccuuguuauuauuaggacugaugaucuuguuaacgggaggggcuaugcuuuuccuuaucucagguaagggaauugggaaaacaucuauaggacuuauuuguguaauagcaaguucggggauguuauggauggcggaaauaccauuacaauggauagcaucugccauuguacuagaauuuuucaugaugguacuacugauaccagaacccgaaaagcagagaacaccacaggauaaucaacuggcuuauguaguuauaggaauauuaacucuagcagcuaucauugcggcgaaugagaugggacuucuagaaacuacaaagcgugaucucggaaugaguaaagaacccggugucgugaguccaacuuccuacuuagauguugaucuacaucccgcgagugcauggacucuguacgcaguagcuacaacuguuauuacaccaaugcuaaggcacacaauagagaacucaaccgcaaaugucagccuugcggcgaucgccaaucaagcagugguacugaugggacuggacaaagguuggccaauuuccaaaauggacuuagguguacccuuacucgcuuuaggcugcuacagccagguaaacccacuaacgcugacugcugcuguguuacuauuaauaacucauuaugccauuauuggacccggucuacaagcaaaagcuaccagagaggcucagaaaagaacagcugcugguauaaugaaaaaucccacaguggaugggauuaugacuauagacuuagacccgguuaucuacgacucaaaauuugaaaaacaacuaggccaggugaugcucuuaguacuaugugcgguucaacugcuuuugaugagaacaucaugggcucucugugaagcccucacuuuggcaacaggaccuaucacaacuuuaugggagggaucuccaggaaaauuuuggaacacuacaauagccguaucaauggcaaauaucuuuagaggaucguaucuagccggugcaggauuagcuuuuaguauuaugaaaucgguuggaaccggaaagcgagggacuggaucgcaaggcgaaacccuaggagaaaaauggaagaagaaacugaaccaauugaguagaaaagauuuugaccucuacaagaaaucagguauaaccgaaguggaucgcaccgaagcuaaagaaggacuaaaaagaggugaaauaacgcaccaugccguuucaagggguagugccaaacuacaaugguuuguggaacguaauauggugauccccgagggaagaguaauagaucugggcugcgggcgagggggcuggaguuacuacugugcuggauuaaagaaaguuaccgaaguacggggguacaccaaagggggaccaggacacgaagaacccguucccaugucgaccuauggguggaacauuguaaaacuaaugucuggaaaggauguuuucuaucuacccccggaaaaaugcgauacacuacuuugcgacauaggugaaagcucaccuucuccaacagucgaagaaucccgaacuauacgaguauuaaaaaugguugaaccguggcucaaaaauaaucaauucugcauaaaagugcuuaaccccuacaugcccacgguaauugaacacuuggaacggcuccaaagaaaacauggaggcaugcuagucagaaacccuuuaucccgaaauuccacucaugagauguauuggauuucuaauggaaccggaaacauagucgcuucagucaauauggucucaagacuucuacuuaaccguuucaccaugacgcauaggcgcccaacaauugaaaaagacguagacuuaggugcuggaacgagacacguuaaugccgagccagagaccccuaacauggacguaauuggagaacgaauuaaaagaaucaaagaagaacauaauuccacauggcauuaugacgacgaaaauccuuacaagacgugggcuuaucacggaucuuaugaaguaaaagcaaccggaucagcgucgucuaugauuaauggaguaguaaaacuacuaacaaaaccaugggauguuguaccaaugguaacacagauggcuaugaccgauacaacaccuuucggucaacaaagaguauuuaaagaaaaaguagauacgagaacaccaagauccaugccuggcacacgaagaguuaugggaauaaccgcagaaugguuauggcguaccuuagguagaaauaagaaaccaagacuuuguacaagagaggaauuuacuaagaaaguuagaaccaaugcagccaugggcgccgucuuuacagaagagaaccaaugggacucagcaaaagcggccguggaagaugaagauuuuuggaagcuaguagaucgagaaagggaauuacacaaacuuggaaagugcggcaguuguguauauaacaugauggguaagcgagagaagaaacucggagaguucgguaaagcaaaagguucgcgcgcaauuugguauaugugguuaggggccagauaucuugaguuugaagccuuggguuuucugaaugaagaccacugguucucuagagagaauaguuauagugguguagaaggugaagguuuacauaaauuaggcuauauacuucgagauaucaguaaaauuccaggaggggcuauguaugccgacgacacagcugguugggauacacgaauaacagaagaugauuugcauaaugaagagaaaauuacacaacagauggauccagaacacaggcaacucgcgaaugcgaucuucaaacucaccuaccaaaacaaagugguaaaaguacagcggccuacgccaacaggcacaguaauggacauaauaucccgaaaggaucaacgugggucaggacaagucggcacuuacggacucaauacauuuacuaauauggaggcgcaacuaauuagacaaauggaaggcgagggugugcuaucuaaagccgaucuagagaacccccaucuucccgagaagaaaauaacccaaugguuagaaacgaaagguguagaaagauuaaagcgaauggcaauuaguggagaugacugcgugguaaaaccaaucgaugauagauucgcuaaugcucuacucgccuugaacgacaugggaaagguacgaaaagacauuccgcaauggcaaccaaguaaagguuggcacgauuggcaacagguaccuuucugcagccaccacuuccacgaauugauaaugaaagaugggagaaaacucguuguaccgugucgaccacaagaugaacuaauaggcagagcacgaauaucacaaggugcgggguggucuuuaaaggagacggcgugcuugggaaaggcguaugcccaaauguggucccuuauguacuuucacagaagagaucuacgucuggcaucuaaugcaaucuguucagcagucccaguccacuggguaccaacgaguagaaccacauggucuauacaugcucaucaccaauggaugacaacugaggauauguugacaguauggaacagagucuggauagaagacaauccuuggauggaagacaagacgccagugacaacaugggaaaacguaccuuacuugggaaaaagggaagaccagugguguggaucacucauaggucuaacaucuagggcuacuugggcucaaaacauaccaacagcaauccaacagguucguuccuuaauagggaacgaagaguucuuagauuauaugccaucgaugaagcgauuccgaaaagaagaggaaucagaaggagcaauuugguaa

SEQ ID NO: 23200 - RNA, 9873 nt, Artificial Sequence
  derived and/or modified CDS sequence (opt6) from DENV-3__HQ891025__SS-prME
accagcuuauguuuaaugaugauuuuaccagccgcccuagcuuuucauuugacaucgagggacggggaaccacguaugaucguaggcaaaaaugaaagaggaaaaagccuuuuauuuaaaacagcaucugggauuaauauguguacucuaauugcuauggacuuaggugaaaugugugaugauacugugacguauaaauguccgcacaucacugaaguagaaccugaagacauugacugcuggugcaauuuaaccucgacauggguaacauauggaacaugcaaucaagcgggugaacacagaagggauaaacggaguguggcacuggcaccucacgugggcauggggcucgacacuagaacucaaacauggaugagcgcugaaggcgcauggagacagguugaaaaagucgaaacgugggcccuuagacauccuggauuuacaauccucgcacuauuuuuggcucauuauauugguacaagccuuacucaaaaaguaguaaucuucauacugcuaaugcuaguuacuccaucaaugaccaugagaugcgucggaguaggaaaucgagacuucguggagggucucucaggugcuacauggguagauguaguuuuagaacauggcgguugcguuacaacaauggcuaaaaauaaaccaacucuugacaucgagcuacagaaaacagaggcaacacaacuagcaacguugaggaaacuuuguauugaaggaaaaauaacaaauauaaccacggauagucgauguccaacucaaggcgaggcgacauuaccagaggaacaagaccaaaacuauguauguaaacacacuuacguugacaggggauggggaaauggauguggccuauucggcaaaggaucucuugucacuugugcaaaauuccaguguuuagaaccaauugagggaaaaguuguucaguacgagaauuugaaauauacaguaauaauuaccguacacacuggagaucaacaccaaguagggaaugagacacaagggguaacagcagaaauaacaccgcaagcguccaccacggaagccauucuuccagaauaugguacacuuggacuggagugcucccccagaacuggucucgacuuuaaugaaaugauucuccuaacgaugaaaaauaaagccuggaugguacaucgucagugguuuuucgaccugcccuuaccguggacuucuggggccacaaccgaaacgccaacuuggaauagaaaagaguuauuaguuacauucaaaaaugcacacgcuaagaaacaagaaguuguuguguuggguucacaggaaggagcuaugcacacagcauugaccggagccacagaaauucaaaauuccggggguaccaguauuuuugccggccaucucaaaugccgccuaaaaauggacaaacuagaacuaaaaggcaugucguaugcuaugugcaccaacacuuuuguucuaaagaaagagguauccgaaacucagcacggaacaauacuuauaaaaguagaauauaaaggugaagacgugccuuguaaaauuccguucaguacugaggacggccaggguaaagcacauaauggacgcuugauuacagcuaauccagugguaaccaagaaagaggaaccuguuaacauagaagcagaaccgccuuuuggcgaaagcaauaucguaauagguaucggagauaacgcauugaaaauuaacugguacaagaaaggaucaucuauuggaaaaauguuugaagcuacagcaagaggggcacgucgaauggcuauccugggagacacagcaugggauuuuggaucaguaggaggggugcuaaacucacucggaaaaaugguucaucaaaucuuugguagcgcguauaccgcguuguuuucuggaguauccuggguuaugaaaauagggauagggguucuacuaaccuggauaggauuaaauucgaaaaacaccagcaugagcuucagcugcaucgcuauugguauaauaacucucuaucuuggagcuguugugcaagcagauaugggaugcgucauaaacuggaaaggcaaagagcugaaauguggaagcggaaucuuuguuacaaaugaaguccacacuuggaccgaacaauauaaauuccaggcagauucccccaaaagacuugcuaccgcaaucgcaggagcaugggaaaacggaguaugugguauaagauccaccacuaggauggagaaccuacuguggaaacaaauagccaaugaacuaaauuauauacucugggaaaacaacauaaaauugacagucguaguaggagauauuauaggaguccuggagcaagguaaaagaacuuuaacaccacagccuauggaacuuaaauauucauggaaaacuuggggaaaagccaaaaucguaacagcugaaacucaaaauuccucauuuauaauagacgguccaaacacaccggaauguccaaguguaucgcgggcuuggaacguuugggaaguagaggauuauggauuuggaguauuuacuaccaauauauggcucaaacugcgugaaguauacacacaacucugcgaucacagauuaaugucggccgccguaaaggacgaaagggcaguacacgcagauaugggauacuggauugaaagucagaaaaauggaaguuggaaauuagaaaaggcaucucuuauugaaguuaagacauguacguggccgaaaagccauacgcucuggucaaaugguguauuggaaucagacaugaucauuccgaaaucguuagcuggcccaaucucacaacauaaucauagacccggguaucacacacagacagccgggccauggcaucuagguaaacuugaguuagauuucaauuauugugaagguacaacagucguaaucaccgaaaacugcggaacccgggguccaucacuuagaaccaccacagugucaggaaaguuaauacaugagugguguugccgcucuugcacauugccuccucugagauauaugggggaggacgguugcugguacggaauggagauaagacccaucucagaaaaggaggaaaauaugguaaaaaguuuagugagugcagggaguggaaaaguagacaauuuuacgaugggagucuugugucuugcaauuuuauucgaagaaguuaugcgaggaaaauuuggcaagaaacacaugauagcgggaguauuuuucaccuuuguacuauuguuaaguggacaaauuacguggagagauauggcgcacacgcuaauaaugaucggaucaaacgccucugauaggaugggaaugggcguaacuuaucuagcgcuuaucgcuacuuucaaaauacagccguucuuagcguugggcuucuuucugaggaaauuaacaucaagagaaaacuuauuacuuggagugggcuuggcgauggcaacuacccuacaacuaccugaagauauagaacaaauggcaaaugggaucgcauuaggauuaauggcauuaaaauuaauaacucaauuugaaacauaccaacucuggaccgcauuaauaucauuaacuuguaguaacacaauuuuuacucuuacagucgccuggcgaacagccacauugauucuagcuggaguaaguuuauugccuguaugucaauccuccucaaugcgaaaaaccgauuggcuaccaauggcaguggccgccaugggcguaccuccuuugccguuauucaucuucgguuugaaggauacauuaaagagacgcaguuggccccugaaugaaggcguuauggcaguuggauuagucaguauucuggcaucuucacuauugagaaaugauguuccuauggcagguccccuagucgcugggggcuuauuaaucgcauguuacguaauuacaggcacaucggcugaccuaacaguugagaaggcggcagacauaaccugggaggaggaagcagagcaaaccggcguaagucacaauuugaugauaaccguggaugaugaugguaccaugcguauuaaagaugaugaaacggagaacauauuaacaguguuauuaaaaaccgcccucuuaauuguuucaggcauuuucccauacagcauacccgcaaccuugcuagucuggcauacguggcaaaaacaaacgcaaaggucagggguccuaugggacguuccaaguccgccagaaacccagaaggcagagcuugaggagggaguuuaccgaauaaaacagcaggggaucuucggcaaaacacagguuggaguaggaguucagaaagaaggaguauuccauacaauguggcaugugacccguggcgcaguauuaacguacaaugguaaaagauuggaacccaauugggccucagugaagaaagaucuaaucucuuauggggguggauggagauuaucagcccaauggcagaaaggagaggagguucaaguaauugcaguugaaccugggaaaaacccuaaaaauuuccaaacaaugccugggaccuuucagaccacuacaggugaaaucggugcuauagcacuggacuuuaaaccagguacaucugguucaccaauuauaaacagagaagguaaaguagugggauuauaugggaaugguguaguaacuaagaacggggguuacgugucuggaauugcacaaacaaaugcagaaccggauggaccaacucccgaacucgaagaagaaauguuuaagaaacguaaucuuacuauuauggaucuacauccagggucaggcaagacuagaaaauacuuaccggcuauugucagagaagcaauuaaaagacgucuacguacccucauacucgcaccaacaagggugguagcagcagaaauggaagaagcauuaaagggcuuaccaauaagauaccaaacaacagcgacuaaaucagaacauaccggccgugaaauaguggacuuaaugugccacgcaacauuuacuaugagauuacuuucaccuguaagaguuccuaacuacaacuuaaucaucauggacgaggcgcacuuuaccgauccugcuucgauugcagcacgaggguacauuucuaccaggguggggaugggagaagcggcugccauauuuaugacagcuacaccuccuggaacagcagacgcuuuuccacagucgaaugcuccaauucaagacgaggaaagggauauaccagagagaucauggaacucaggcaacgaauggauaaccgauuuugcagguaaaacuguuugguucguacccucaauaaaggcagguaacgacauugcaaauugucuucggaaaaacggcaaaaagguaauacaauuaucacguaaaaccuucgacacugaauaccagaaaacaaaauuaaaugacugggacuuugugguaacuacagacauaagugaaaugggagcgaauuuuaaggcagaucgugucauugacccaagaagaugucucaaaccaguaauuuuaacggacggaccggaaagagugauccuagcagggccuaugccugugacugcugcaagugcugcacaaagacgaggacgcguuggcagaaauccccaaaaagaaaaugaucaauauauuuucacaggucaaccguuaaauaaugaugaagaucaugcgcacuggacggaagcuaaaaugcuauuagauaauauaaauacaccagaagguauaauaccagcauuauuugaaccagaacgggaaaaaucagcggcaauagacggcgaguauaggcuaaaaggagaaagucgaaaaacguucguugagcuaaugcgucgaggagaccuuccggucuggcuagcccauaaagucgcaagcgaaggcauaaaguacacagaucgaaagugguguuucgaugggcagagaaauaaccagaucuuagaagagaacauggauguagagauauggacaaaggagggugagaagaagaaacugcgaccacgaugguuagacgccaggacguacuccgacccacuagccuuaaaagaguucaaagaguuugcagcagguagaaaaaguaucgcccuugacuuaguaaccgaaauaggaagaguccccagucaucuugcucaucgaacccgaaacgccuuagauaaucuaguaauguuacauacguccgaacauggcggucgagcguaccgucacgcgguggaagaauuaccugaaacaauggaaacucuucuguuacuagguuuaaugauucuauuaacaggaggugcuaugcuauucuuaauauccgguaaaggaauaggaaaaacgucgauuggauuaauauguguuauagcuucuucaggaauguuauggauggcagaaauaccccuccaauggauagcuucggcuauaguacuugaauuuuucaugaugguacuccucauuccugagccugaaaagcagcggacaccacaggauaaucagcuagcguaugugguuauuggaauacugacuuuagcagcuaucauugcagcgaaugaaaugggcuuacuagaaacgacaaaaagagacuuaggaaugucaaaagaaccuggggugguaaguccaaccucuuaucuugaugucgauuuacauccugccucugcuuggacacuguacgcaguggcaaccacagucauaacucccaugcuaaggcauacaaucgagaacagcacggcuaacguuucauuggcagcaauagcaaaccaagcagugguccugaugggucucgauaaaggauggccgauuagcaagauggaccuagguguuccauuguuagcucuugguuguuacucucaagucaacccauugacacuuacggccgcgguacugcuuuugaucacacacuaugcaauaauaggaccaggauuacaagcgaaagcgacgcgcgaagcccagaaacgcacagcggcugguauuaugaaaaacccaacaguggacggcauuaugacuauagaccuagauccugugauuuacgacucaaaauuugaaaaacaauuggggcaaguaauguuacugguacuaugcgcaguacagcuauuacuuaugcgaaccaguugggcguuaugugaagcucuaacuuuagcuacaggaccuauuacuacgcucugggagggaucaccaggaaaauucuggaauacaacuauagcaguaaguauggcuaacauauucagagguagcuauuuagccggagcagggcuugcauucuccauaaugaaauccguugguacaggaaagagggguacuggaucacaaggggaaacgcuaggugaaaaauggaagaagaaacugaaucaauuaucaagaaaagauuuugaucuuuacaagaaauccggaauuaccgaaguggacaggacugaggcaaaagagggccugaaacggggugagauaacccaccaugcgguaaguaggggaagcgcaaaauuacagugguuuguagaaagaaauaugguuauaccagaagguagagucauagaccucggguguggaagagguggguggucuuauuacugugcugggcuaaagaaagucacugaagucagagguuauacuaaaggugguccaggucaugaagaaccaguuccuaugaguacauaugguuggaacauuguuaaacucaugucaggaaaagaugucuuuuacuuaccgccugagaagugugauacucuguuaugugauaucggcgaaucuagucccucaccaacgguagaagagaguaggacaauacgaguucucaagaugguggaaccguggcucaaaaauaaccaauucugcauaaaaguacuaaacccuuacaugccaacuguaauagaacauuuagagaggcuacaaaggaaacacgguggaauguuggugcgcaacccgcucucaagaaauucaacacaugaaauguauuggauuucuaauggaacugguaauauaguagcuaguguaaauaugguguccagacucuugcuaaauagauuuacaaugacgcacagacgaccuacuaucgagaaggauguagauuugggagcgggaacuagacauguuaaugccgagccugaaacuccaaacauggauguaauaggcgagcgcauuaagaggauuaaagaggagcacaauucgaccuggcauuacgaugacgaaaauccguauaaaacaugggcauaccacggaagcuaugagguuaaagcgacaggcucugcaucuucaaugauuaauggagugguaaaacugcugacaaagccaugggauguagugcccauggugacacaaauggccaugaccgacacaacucccuuugggcaacaaagagucuuuaaggaaaagguagauacuagaacgccaaggucuaugcccggaaccagaagagugauggguauuacugcugaauggcuuuggagaacgcuuggucgaaauaagaaaccucgucuauguacacgugaggaauuuacaaagaagguaaggacuaaugcagcaaugggagcggucuucaccgaggaaaaucagugggauuccgcaaaagcugcaguugaggaugaagacuuuuggaagcuaguagacagagagagagaacuucacaaguuggguaaguguggaagcuguguauauaacaugaugggaaaaagagagaagaaacucggagaguuugggaaagcuaagggaucaagagcuauuugguacauguggcugggggcccguuacuuggaguucgaagcccuaggcuuccuuaaugaagaucacugguucagcagagaaaauucauacaguggaguagagggagaaggacuacacaaacucggauauauauuacgagauauuucaaaaauaccaggaggagccauguaugccgacgauacagcaggaugggauacucgcaucacugaagaugacuuacacaaugaagagaagauuacucaacaaauggacccagaacacagacaauuggcaaaugccaucuucaaacuaacauaucagaacaagguaguaaaagugcaaaggccaacuccaacuggaacagugauggauauaauaagucgaaaagaccaacgggggagcggucagguuggaacuuauggacuuaauacauuuacaaauauggaggcucaauuaauaaggcaaauggagggggaagggguauuaucaaaggcugacuuagaaaauccacaccucccggagaagaaaauuacgcaaugguuagaaacaaaagggguagagaggcuaaaacguauggcuauaaguggagacgauuguguuguuaaaccaauugaugacagauuugcgaacgcacuucuagcgcuuaaugauaugggcaagguccgaaaggauauaccucaguggcaaccuucgaaagguuggcacgacuggcaacagguuccauucuguucgcaucauuuccaugaauugauuaugaaagauggaagaaaguugguaguuccaugccguccacaggaugaauuaauaggaagggcaaggauaucacaaggagcugguuggucauuaaaagaaaccgcaugcuuggggaaggccuacgcacaaauguggagccugaugaacuuucaucguagagaccuacgauuggccucaaaugcgauuuguagugcugugccaguccauuggguaccaacaucaagaacaacuuggucgauucaugcucaucaucaauggaugacaacagaagacaugcuuacaguauggaaccggguauggauagaggauaaucccuggauggaagauaaaacgccugugacuaccugggagaaugucccguaucucggaaaacgagaagaucaauggugcggaucucuuauaggccuuacaagcagagcuacaugggcacagaacauaccuacagcaauacagcaaguaagaucucuuaucgguaaugaagaauuucucgauuacaugcccaguaugaagagauucagaaaggaagaggaaagugaaggggcuauaugguaa

SEQ ID NO: 23201 - RNA, 9873 nt, Artificial Sequence
  derived and/or modified CDS sequence (opt6) from DENV-3__HQ705617__SS-prME
acgagccuuugucuaaugaugauuuuaccagcggcuuuggcauuccauuuaacuucgagggacggagaaccccgaaugaucguaggcaaaaaugaacgagguaaaucguuacuguucaaaacagcaagcgguauaaauauguguacauuaauugcuauggauuuaggagaaaugugugacgauacaguaacauauaaaugcccacauauuacggaaguugagccagaagacauugauuguuggugcaauuuaacgagcacaugggucacauaugguacuuguaaucaagccggcgaacauaggcgugacaaaagaucaguagcuuuggccccucauguuggaaugggcuuggauacaagaacccaaacauggaugagcgcggaaggggcauggcggcaaguugaaaaaguagaaacuugggcacuacgucaucccggauuuaccauauuagcuuuguuuuuggcacauuacauaggaacuucucucacucaaaaaguaguuauuuuuauauuacugaugcuggucacacccaguaugacgaugagaugcguaggagucggcaaccgagacuuuguagaaggacucaguggagcuacauggguggacgugguacuugaacauggaggauguguaaccacaauggccaaaaauaaaccuacucuugauauugagcuccagaaaacagaggcaacccaacuagcaacacuaagaaaacuuugcauugagggaaaaauaacaaauauuacaacugauaguagauguccaacacaaggcgaggcaacauuaccagaggaacaggaucaaaauuauguaugcaaacacaccuacguagaccgaggauggggaaauggcuguggcuuauuuggcaaaggcagccuugucaccugugcaaaguuucagugucuggaacccauagaagguaaagucguccaauacgaaaaccuaaaauacaccguaauuauaacaguucacacaggggaccaacaccaaguggguaacgaaacucaagggguuacggcggagauuaccccacaagccucaacgacagaagcgaucuuaccugaguauggcacauuaggccuagaguguucuccaagaacuggucucgacuuuaaugaaaugauuuuacugacaaugaaaaauaaagcauggaugguacauagacaaugguucuucgauuuaccacugccauggacaaguggagccaccacagaaacuccaacguggaaucgcaaagaacuauuaguaacuuuuaaaaaugcucaugccaaaaagcaagaaguaguaguacuaggcucacaggaaggagcaaugcauacugcauuaacaggugcgacagaaauucaaaacucaggggguacaaguauauucgcagggcaccugaaaugucgauuaaagauggacaaacuagaacugaagggaaugucauacgcuaugugcacuaauacauuuguauuaaagaaagaagucagcgaaacacaacauggaacuauacucauuaaaguugaauauaaaggcgaagacguucccuguaaaauaccauuuucaacagaagacggucaagguaaagcacacaacggaagauuaauaacugcuaacccaguuguaacuaagaaagaagaaccuguuaauauagaagcagagccaccauucggggaguccaacauagugauaggaauaggcgauaacgcuuuaaaaauuaauugguauaagaaaggaaguagcauaggcaaaauguucgaagcuacggcuaggggcgcuagaagaauggccauacuaggugauacugcgugggauuuugguucggucggagggguucucaauucuuuaggaaaaauggugcaucaaauauucgguucagcuuauacagccuuauucucugggguuucuugggugaugaaaauugguauaggaguucuccuuaccuggauagguuuaaacucuaagaacaccucgaugaguuucucuugcauugcaauaggaauaauaacccuuuauuuaggcgcgguaguccaagccgauauggggugcgugauaaacuggaagggaaaggaacuuaaauguggaaguggaauuuuuguaaccaaugagguccauacuuggaccgagcaauacaaauuucaagccgauucuccaaaaaggcuagcuacugcaaucgcgggcgccugggaaaauggaguaugugguauacguagcacaacccggauggagaauuuguuauggaaacagauugccaaugagcuuaacuauauucuaugggaaaauaauaucaaacuaacuguaguagucggggauaucaucggcguauuagaacaaggaaaaagaacauugacuccucaaccgauggaacuaaaauauagcuggaagacauggggaaaagcuaaaauagugacagcagaaacacaaaacuccagcuuuauaauagauggaccaaauacaccggaauguccaagcgucagucgcgcauggaaugugugggaaguagaagacuacggauuugguguauucacaacuaacauaugguugaaacuaagagaaguauacacacaacugugugaucaucgauuaaugagugcagcuguaaaagaugaacgcgccguccacgcugauauggguuauuggauagaaucccaaaagaacggauccuggaaguuggaaaaagcaucccugauugaagucaaaacaugcacguggccaaaaucucauacuuuauggagcaacggaguacuagagucagacaugauaauacccaagucacuagcgggccccauuucacaacauaaccacagacccggauaucauacacaaacugcagguccguggcauuuagguaaacucgaacuagauuucaauuauugugaagguaccacaguaguaauuaccgaaaauugcggaaccagaggaccaucacugcguacuacuaccguaucggggaaguuaauucacgaaugguguuguagaagcugcaccuuaccgccucuacgauauaugggcgaagauggauguugguacggaauggaaauacguccaauaucagaaaaggaagaaaauauggugaagucacuuguaucugcagggucggggaaagucgacaauuucaccauggguguauuaugccuagccauucucuucgaagaaguuaugaggggaaaauuugggaaaaagcauaugauugccgguguauucuuuacauuuguacuacuauuaucuggacaaauaacguggcgagauauggcccauaccuuaauuaugauagguaguaaugcauccgaucgcaugggcaugggaguuacguaucuggcauuaaucgcaaccuuucguauucagccguuccucgcauuagguuucuucuuaaggaaauuaacuucacgggagaacuuacugcuaggggucggauuggccauggcuacgacauuacaacuuccagaagauaucgaacagauggcaaaugggauagcucuaggccuaauggcacugaaauuaauaacccaauuugagacauaucaauuguggacagcguuaauaucuuuaaccuguucaaauacaauuuucacauugacuguugcuuggagaacugcaacgcuaaucuuagcgggggucagucuucugccagugugucagaguaguaguaugcgcaagacugauugguuaccaauggccgucgcugcuaugggcguaccaccucucccucucuuuauauuuggauuaaaagauacgcuuaaacgacgaagcuggccauuaaaugaagggguuauggcugugggauuaguuucgauccuugcguccucucuacuacguaaugacgugcccauggcaggacccuugguugccggaggucugcucaucgcuugcuacgugauaacuggaaccagcgcagaccuuacuguugaaaaggcagccgauauaacaugggaggaagaagcggaacagaccggaguaagucauaaccuaaugauaaccguugaugaugauggcaccaugcgcaucaaagacgacgagacggaaaauauauuaacaguuuuauugaaaacagcguuauuaauugugucaggcauuuuuccuuacucaauucccgcaacucuacucguguggcacacuuggcaaaaacagacucagagaucagguguuuuaugggaugucccgagcccacccgaaacacaaaaagcagaacucgaagaaggaguauaucgaaucaagcaacaagggauuuuugguaaaacgcaggucggagucggcguucaaaaagagggagucuuccacacuauguggcauguuacaagaggggcuguccuuaccuauaacgguaagaggcuagaaccaaacugggcaucagucaagaaagaccugauuucauacggaggcggauggcguuuaucggcacaauggcaaaaaggagaagaaguucaaguaauagcaguagaaccggguaagaauccaaagaauuuccagacaaugccggggacuuuucagacgacaacaggagaaauaggagcaauagcauuagauuuuaaaccaggcacgucagggagcccuauuauaaacagagaaggcaaagugguugggcuuuaugggaacggagugguuaccaaaaauggaggcuauguaagcggaaucgcacagacgaaugccgagcccgaugggccaacucccgaacuggaagaggaaauguucaaaaagagaaaucuaacuauaauggaccugcauccaggcuccggaaaaacaaggaaauaucugcccgcaauuguucgcgaagcaauaaaacgacgccuacggacguuaauacucgcuccaaccaggguaguagcagcagagauggaagaagcucuuaaaggauugccgauaagauaccagacaacagcuacaaaaucagagcacacagguagagagauaguggaucuaaugugccaugccacguuuacgaugagauuacuuucacccguaagaguccccaacuacaacuuaauaauuauggaugaagcccacuuuacugacccugcaucaauagccgccagaggauauauauccacucgaguaggaaugggugaagcagcagcaauuuuuaugacagcaacaccaccaggcacugcugaugcguucccgcaaucaaacgcaccaauacaagacgaagagagggauauaccugaaagaucauggaauagcggcaaugaauggauaacagauuuugcuggaaaaacggucugguucgucccaucaauaaaagcaggcaaugauauagcuaacugccuucgaaagaaugggaagaaagucauucaacuuaguagaaaaacauucgacacugaauaucagaaaacaaaacuaaaugauugggacuuuguuguaacaacagacauaucggagaugggggcaaacuucaaagcggacagaguaaucgauccaagacgauguuuaaaaccuguaauauuaacagaugggccggaaaggguaauacuggccgggcccaugccugucacagcggcuagcgccgcccaaagacguggaagaguuggcagaaacccccaaaaagaaaacgaccaguauauuuuuacaggucagcccuugaauaaugaugaggaccacgcgcacuggacagaggccaaaauguugcuggauaauauuaauacacccgaggguauaauaccagcccuuuuugaaccugaacgcgaaaagagcgcugcuauugauggagaauauaggcugaaaggcgaaucaagaaaaacauucguugaauuaaugagacgaggagaucuacccguguggcucgcccacaaaguggcaagcgaggguauaaaauacacggauagaaaaugguguuuugauggucaacggaauaaucaaauauuagaagaaaacauggauguugagauauggacuaaagaaggagagaagaagaaauugaggccacgcuggcuagaugcaaggacauacagugacccauuggcuuuaaaagaauuuaaagaauuugcugccggaagaaaaucuauagcacuagauuugguuacugagaucggaagggugccuucacaucuugcucacagaacacguaacgcauuagauaaucugguuaugcuucauaccucagaacauggcggacgagcguaucgacaugcaguugaagaauuaccggaaacaauggaaacgcuccuuuuauuggguuugaugauauuauugacgggaggcgccauguuauuuuuaauuuccgggaaaggaaucggcaaaacaagcauaggccuaauuugcguuauagcuucuagcggaauguuguggauggcagagaucccauuacaauggauugcgucugcuaucguacuagaauuuuucaugaugguccuucuuauaccagaaccagaaaagcagagaaccccacaagacaaucaacuugcauacguaguaauagguauuuuaacccuugcagcuauaauugccgcgaacgaaaugggacuacuagaaaccacuaaacgcgaucuuggaaugaguaaagagccaggcguaguguccccgaccagcuaccuagauguagaccuacauccagcaagugccuggacacuauacgcugucgcaacaaccgucauuacaccaaugcucagacauacaauugaaaacucaacugcaaacguaucauuggcugccauagcaaaucaagcagucguccuaaugggcuuagacaaagguuggcccaucagcaagauggacuuaggagugccauuguuagcucucggauguuauucacaagucaauccgcugacauuaacugcugcggugcuccuacugauaacucauuacgcgauuauugguccagguuuacaggcaaaagcaacaagggaagcucagaaaaggacagcggcaggaauuaugaaaaacccaaccguagaugguauaaugacaauugaccuagacccaguuaucuaugauucaaaauucgaaaagcaguuagggcagguaaugcuauuaguacuaugugcaguacaauuacugcucaugcguacuucgugggcauugugugaggcucuaacgcuugcaacagggcccauaacgacuuugugggagggcuccccagguaaauuuuggaacacgacuauagcugucucaauggcuaauaucuucagaggguccuaucuggcaggcgcgggauuagcauuuucuauaaugaagagugucgguacggggaaacgaggaacagguucacagggcgaaacgcuuggagaaaaguggaaaaagaaacuuaaucaacuuagccguaaagacuuugaccuauacaagaaaaguggaauaacugaaguagaucgcacugaggcgaaggaagguuugaaaagaggcgaaauaacccaucaugcaguaaguaggggaucugcaaaacuucagugguuugucgaacgcaauaugguuauaccagaaggccggguuauugacuuagguugcgguaggggaggauggucuuauuauugcgcaggacuaaagaaaguaacagagguacgcggauacacaaaagguggaccaggacaugaagaacccgucccuauguccacauauggguggaacauagugaaacuaaugagcggcaaagacgucuuuuaucuaccaccagaaaaaugugauacauuauugugugacaucggcgagucuucuccgucacccaccguagaggaaucgaggacaauaaggguuuuaaaaaugguugaaccauggcuuaaaaacaaccaauuuuguaucaaaguacuuaacccauacaugccgacgguaauagagcaucuagaacgauugcaaagaaaacauggcggcaugcuggugcgaaacccguuaagucgaaauucgacacaugaaauguauuggauaucgaaugguacagguaacauagucgcgagcguaaauauggugaguagacucuugcuuaacagauuuaccaugacccaucgacguccaacgauagaaaaagauguugaccugggagcaggaaccagacacgugaaugcagaacccgagacuccuaauauggacguaauaggggaacguauuaaaaggauaaaagaggaacacaauucaacauggcauuaugacgacgagaacccuuacaagacaugggcauaucauggcucauaugaaguaaaagcuacugguucugcgucuaguaugauaaauggaguugucaaauuguugacaaagccaugggacguaguacccauggucacacaaauggcuaugacagacacaacaccuuucggucaacaaagaguauuuaaagaaaaagucgauacucguaccccacgaucaaugcccggcacacggagaguaauggguaucacagccgaguggcuauggagaacauugggacggaacaaaaagccacgauuauguaccagggaagaguuuacgaaaaagguucgaacgaacgcagcaaugggugcuguuuuuacagaagaaaaucaaugggacucggcuaaagcagcaguagaagaugaagacuuuuggaaauuaguggacagagaacgggaacuccacaagcugggaaaguguggaucgugcguguauaauaugauggguaaaagggagaaaaagcuaggagaguuugguaaagccaaagggucacgagcgauuugguauauguggcucggagcccguuauuuagaauuugaggcuuugggguuucuuaacgaagaucacugguuuucaagggaaaauaguuacucugguguggagggugaagggcuucacaaguuaggcuauaucuugagagauaucaguaaaauaccagggggagcuauguacgcggaugacacagcaggaugggauacuagaauuacugaagaugaccuccauaacgaagagaaaauaacgcaacaaauggacccagaacauaggcaacuagcaaaugcuaucuucaaauugacguaucaaaacaaaguagugaaaguacaacgacccacgccuacagguaccguuauggauauaauaaguagaaaagaucagcgcggaucgggccaaguaggcacauauggauuaaacacuuucacaaacauggaagcacaauugauccggcagauggagggagaaggggugcuaucaaaagcagauuuggaaaacccacaccuuccagagaagaaaauaacucaaugguuagagacgaaaggcguggaacgucuaaaaagaauggcaauaucaggugacgauugcgucguuaagcccauugacgauagauuugcgaaugcccuauuagcuuuaaaugauaugggcaaaguaagaaaggauaucccucaauggcaaccuaguaaaggguggcaugacuggcaacaagucccauuuuguucucaccauuuccacgagcuaauuaugaaagacggaagaaaacucguagucccaugucgaccucaggacgaauuaauaggacgggcacgcauaucacaaggcgccggauggagucugaaggagacugcgugccuggguaaagcauacgcgcaaauguggucgcuaauguauuuucaucgacgugaucuacguuuagcuucuaaugcgauauguagugcaguucccguucauuggguaccgacaagcaggacaacuuggucaauucaugcacaucaccaauggaugaccacugaagauaugcucacaguguggaaccguguauggaucgaagauaaccccuggauggaggauaaaacacccguuacaacuugggagaauguaccguauuuaggaaaaagagaagaucaaugguguggaucauugaucggcuuaaccucccgggcgacgugggcacagaauauaccaacggcuauucaacaaguuagaagccuuauaggaaaugaagaauuucuagauuauaugcccaguaugaaaagauuccggaaagaagaggaauccgaaggagcaauuugguag

SEQ ID NO: 23202 - RNA, 9873 nt, Artificial Sequence
  derived and/or modified CDS sequence (opt6) from DENV-3__HQ705619__SS-prME
acuucauugugucucaugaugauauuaccagcugcacuagcguuucauuuaacuucucgggacggagaaccaagaaugaucgucgggaaaaacgaaagaggaaaaucauuguuauuuaaaacugcaucgggaaucaauauguguacucucauagcaauggaucuuggugaaaugugcgaugauacuguaacuuacaaauguccucauaucaccgaagucgaaccugaagauaucgacuguugguguaaucuaacguccaccugggugacauaugguacuuguaaccaagcaggagaacauaggagagacaaacgaucgguugcauuggcaccgcauguagguauggggcuugauacacgaacacaaacauggaugucagcagaaggggcauggagacaaguagaaaaaguagaaacuugggcauuaaggcauccaggauuuacaauacucgcucucuuucuugcucacuacauaggaaccuccuugacgcaaaaagucguuauauuuauccuccuuaugcuaguuacucccaguaugacaaugagauguguuggugugggcaacagagauuucguugaaggauuaagcggugcgacguggguagacguaguucuugaacacgguggauguguaaccacaauggcuaaaaauaaacccacacuagauauagaauuacagaaaaccgaagcaacucaauuggcuacguuaaggaaacuaugcaucgaagggaaaauaaccaauauuacgacagauucacgauguccuacucaaggggaagccacauuaccugaagaacaagaccaaaauuauguauguaaacauacuuacguagauagagguugggggaacgggugcgguuuguuuggcaaaggaucccuagucacaugcgcaaaauuucaaugucuagagccuauagaggggaaaguagugcaauaugaaaaucucaaauacacagucauaauaaccguacacacaggagaccagcaccagguagggaaugaaacucaaggaguuacagcagaaaucacaccacaagcauccacgaccgaagcuauauuacccgaauauggaacacucggguuagaguguaguccgagaaccggacuagacuuuaaugagaugauacuguugacuaugaaaaacaaagccuggaugguccaucgucagugguucuuugauuuaccucucccuuggacauccggagcaaccaccgaaacgcuuacauggaaucggaaagaacuguuaguaacauuuaaaaacgcacaugccaagaaacaagaaguaguagugcuugggucgcaagaaggugcaaugcacacugcauuaacgggcgcuacggaaauacagaauagcgggggaacgucaauauuugcuggccaccuuaaauguagacuaaaaauggauaaauuagaacuuaaagguaugucauacgccauguguaccaauacauucguauuaaagaaagaaguaagugaaacacagcauggaacuauuuuaauuaaaguagaauacaaaggcgaagauguuccuugcaaaauaccguuuucuacagaagacggacaaggaaaagcacacaauggacgcuuaaucacugccaaccccguaguuacgaagaaggaggaacccguaaacauagaagcagaacccccauuuggagaaucuaacaucgugauaggcauaggagauaacgcauuaaagauaaauugguacaagaaaggcucgagcauuggaaaaauguucgaagcaacagcaagaggugcuagaaggauggcgauacuaggagacacagcuugggauuuugguagcgugggaggcguucuaaacucucuagguaaaaugguccaccagaucuuugggagcgcuuauacagcacucuucucgggagucucauggguuaugaaaauaggcauagguguucugcuaacguggauaggacuaaauucuaaaaacacaucaaugagcuucucgugcauugcuauaggaauaauuacguuguauuugggagcugugguacaggcagauauggggugcguaauuaacuggaaagguaaggaguugaaguguggcucugguaucuuuguaaccaacgaaguacauacuuggacagaacaguauaaguuucaagcagauucaccgaaaaggcuagcuacagccauagccggugcuugggaaaauggcgugugugggauccguaguacaacucguauggaaaaccuacucuggaaacaaauugcuaaugaauugaacuacauauuaugggaaaacaacaucaaacuuacagucguuguuggcgacauuaucggaguguuggaacaagggaaaagaacacucacuccacaaccuauggaacugaaauacuccuggaagacaugggguaaggcaaaaauagucacugcugaaacacaaaauuccucuuucaucauugacgggccgaauaccccagaaugcccaaguguaucccgagcguggaacguuugggaaguagaagauuauggauuuggugucuucacaacaaacauaugguuaaaauugagagaaguauauacgcaauugugugaccaucgcuugaugagugcugccguuaaagacgaacgagcuguacaugccgauaugggguauuggauagagagucagaaaaaugguaguuggaagcuagaaaaggcgaguuuaauagagguaaaaaccuguacauggccuaaaucgcacacauuauggucaaauggaguacucgagucagauaugauuauaccaaaaaguuuggccggaccgauaucucagcauaaucacagaccaggauaucauacacaaacugcagggccauggcaccuagguaaauuagaacucgauuuuaauuacugcgaaggaacgacaguagucauaacagaaaacugcggaacaagaggaccaaguuuacguacgacuacgguuuccgggaaacuaauacacgaauggugcugccgaagcugcacgcugccuccauugagauacaugggcgaagaugguuguugguauggaauggaaaucaggccaauuuccgaaaaagaagaaaauauggucaaaucgcuaguaagcgcagggagcgguaaaguagauaauuuuacuaugggcgucuuaugucucgcaauacucuucgaagagguaaugagaggaaaauuugguaagaaacauaugauagcaggcguauucuuuacuuuuguguuacuccuaaguggucagauaaccuggcgagauauggcucauacgcuaauaaugauuggaucuaaugccagugauagaauggggaugggagugacguaucuagcccuuauagccacguucaagauacaaccuuuucuagcacuaggauucuuucuacgaaaauuaacaagcagagaaaaucuguugcuaggagucggucuagcuauggcgacaacacuacaacuuccagaggauauagaacaaauggcaaaugggauagcacuagggcuaauggcuuuaaaauuaauuacucaauuugagacauaccaacuauggacggcauugauuagucuaaccugcucgaauaccauauuuacucuuacaguagcauggcguacagccacauuaauccuugcugguguaagucucuugccugugugucagaguucauccaugcgcaaaaccgacugguugccuauggcaguggcggccaugggaguaccgccuuugccauuguuuauuuuuggguugaaagauacacucaaacggagaagcuggccacucaaugaagguguaauggcagucgggcuaguuaguaucuuagcgagcaguuuauuaagaaaugacguacccauggcagggcccuuaguugcagggggccuauuaauagcauguuaugucauaacaggaacuucagcugauuugacaguugaaaaagcugccgacauuacgugggaagaggaagcugagcaaacggguguuagccacaauuuaaugauuacaguagacgacgaugguacuaugcgaauaaaagacgacgaaacugaaaacauuuuaacaguucuccuaaagacagcauuauuaaucguaucagguaucuucccauauucaauacccgcgacauuauugguuuggcauaccuggcaaaagcaaacacaaagaucaggaguauuaugggacguaccgaguccaccugagacucagaaagcagaacuagaagagggcguuuaccgcauaaaacaacaaggaauuuucggaaaaacacaagucggugucggaguucaaaaagaagguguauuccacacgauguggcacguaacaagaggagcaguccuaacguauaaugguaagagauuggaaccgaauugggcgagugucaaaaaggauuuaauuagcuacggcggaggcuggcgauuaucugcacaauggcagaaaggagaagagguacaagucaucgcagucgaaccuggcaaaaaucccaaaaauuuucagacuaugccugggacauuucaaacgacaacaggugaaauaggugcuauagccuuggauuucaagccagguacaucuggcucaccaauaauaaauagggaagguaaagucguuggauuauacggaaauggagucguaacgaaaaaugggggauacguaucugguauugcacagacuaacgcugagccggaugguccuacacccgaguuagaagaggaaauguucaagaaacgaaaucuaacuaucauggaucuccauccuggcagcgggaaaacccguaaauauuuaccagcuauaguaagagaagccauuaaacguagguugagaacccuaauacuugcgccaacgagaguaguagcagcugaaauggaagaggcuuuaaaagguuuaccaauacgauaucaaacuaccgcaacgaaaagugagcacacaggaagagaaauaguagaccugaugugucaugcaacguucacgaugcguuuacugucacccguaagaguaccgaauuacaaucuaauaauaauggaugaggcacacuuuacugauccugcaagcaucgccgcgcgaggguauaucucgacucgaguugggaugggugaagcugcugcaaucuuuaugacagcaacgccaccuggaacagcagaugcuuuuccucaaagcaacgcucccauucaagacgaggaaagagauauaccugagagaagcuggaacuccggaaacgaguggauaacagacuucgcagguaaaaccguaugguuuguuccuaguauaaaagcgggcaacgacaucgcuaauugucugcguaagaacggaaagaaaguuauucaauugaguagaaaaacauuugauaccgaauaucagaaaacuaaauugaaugauugggauuucgugguuaccacagacaucucagagaugggagcuaacuucaaagcagacagagugauagauccacgucgaugcuuaaaacccgugaucuuaacagauggaccagagagaguuauuuuagcuggaccaaugccagucacugcugcuagcgcagcacagaggagagggcgaguugguaggaauccacaaaaagaaaaugaccaguauauauuuacuggccagcccuuaaauaaugaugaggaccacgcccauuggacagaggcgaaaauguuacuugacaauauaaauacaccggaagggaucauuccggcauuauuugaaccagaacgagaaaaguccgccgcuauagacggagaauauagauugaaaggagaaagucguaaaacauuuguugaacuaaugaggagaggagaucuaccaguaugguuagcccauaaagucgcaucggaaggcauaaaauauacugaccgaaaaugguguuuugauggccaaaggaauaaccaaaucuuggaagaaaauauggacguggaaauuuggacuaaagaaggugagaaaaagaaauuacgaccuagguggcuugaugcgcgaacuuacucugauccuuuagcccuaaaagaguucaaagaguuugcggccggacggaaaagcauugcacuagauuuaguaacggagauaggacgaguaccgucacaucuagcccauagaacaagaaaugcucuggauaaccuagucauguuacacaccucugaacauggugggagggcuuaucggcaugcuguugaggagcucccagaaacaauggaaacguuauuacuuuuaggucuuaugauacugcuaacagggggagccaugcuauucuuaauuucaggcaaagguauuggaaaaacgucaauaggguuaaucugugugauagcaucaucggguauguuauggauggcagaaaucccucuacaauggauagcgagcgcgauaguauuagaguucuuuaugauggugcugcucauccccgaaccugaaaaacaaagaacaccacaagauaaccaacuagcuuaugucguuaucggaauuuuaacauuagcagcgauaauagcagcaaaugaaaugggauuacuagaaacuacaaaaagagaucuagggaugagcaaagagccugguguuguuagcccaacgaguuauuuagacgucgacuuacaucccgccuccgcauggacucucuacgcaguggcgacaacaguaauuacaccaaugcugcgacauacgauagaaaauagcacugccaacguuagcuuagcagcgaucgccaaucaagcuguaguuuuaaugggucuggauaaggguuggccaauaucaaagauggaccuagguguaccucuacuugcccuuggauguuauucacaagugaauccucuuacgcuaacagcugccguauuacugcuaaucacacauuacgccauaaucggcccaggucuucaagcuaaagcgaccagggaagcucaaaaacgaacagcagccgguaucaugaaaaacccaacaguagaugggauaaugacuauagacuuggaucccgugauuuaugauucaaaguuugagaaacaacuaggccagguaaugcuauugguuuuaugugcaguucaacuuuuauuaaugcgaacuagcugggcucuaugcgaagcgcuuacguuggccacuggaccgauaacaaccuugugggaagggucaccugggaaguuuuggaacacuaccaucgcugugucuauggcaaauauauucagaggaaguuaucucgcaggcgccggcuuagcauucaguauuaugaagaguguaggcacuggaaaaagaggaacagguucgcagggugagacacucggagagaaauggaaaaagaaauugaaucagcucucuaggaaagauuuugaucuuuauaagaaaagcggaauaacagagguagacagaacggaagcuaaggaagggcuaaaacguggugaaauuacccaccaugcuguuagcagagggagcgcuaaacuacagugguucguagaaagaaacaugguaauuccagagggucgaguaaucgauuuaggauguggcagaggaggcuggucauauuauugcgcaggacucaagaaaguuacagaaguuagaggcuacacaaaagggggaccuggacaugaagaaccugucccaauguccacuuauggcuggaacauugugaaacuaaugucuggaaaggaugucuuuuaccuaccuccggaaaagugugauacuuuauuaugugacauaggugaaucgagcccuucgccaacggucgaggagaguaggacaauaagaguuuugaaaauggucgaaccuuggcuaaagaauaaucaauuuuguaucaaaguacuaaauccguauaugccaacgguaaucgaacacuuagaacgacuacaaagaaaacacgguggcauguugguaagaaauccgcugagcagaaauucgacgcaugaaauguacuggaucuccaauggaacaggaaacauaguugcaucagucaauaugguuucacggcugcugcuaaacagguuuaccaugacacaucgcaggccaaccauagaaaaagacguggaucuaggagcgggcacucgucacgucaaugcagaacccgaaacgccaaauauggauguaauuggagaaagaauaaaaagaauaaaagaggagcacaauucgacauggcauuacgaugaugaaaacccauacaaaacuugggcauaucacgggaguuacgaagugaaagcaacgggaagugcaagcagcaugaucaacggaguaguuaaacuauugacgaaacccugggauguagugcccaugguaacucaaauggcaaugacagauaccaccccauuuggucagcaaagaguauuuaaggaaaaaguagacacuagaacgccucguucgaugcccggaaccaggagaguaauggggauaaccgcagaaugguuauggcgaacuuugggccgaaauaagaaaccuagacuauguacaagagaggaauuuacaaagaagguuaggacaaacgcagcaaugggugcgguuuuuacagaagaaaaucaaugggauucagcuaaagcugccgucgaggaugaggacuuuuggaagcuagucgaccgugaaagagaauuacauaaguuaggcaaauguggcucaugugucuauaauaugauggguaagagggagaagaaacuaggcgaauuugggaaagcaaaaggaucaagagcgaucugguacaugugguugggugcacgauaucuggaauuugaagcgcugggguuuuuaaaugaagaucauugguuuucaagagaaaacaguuacucggguguugaaggugaagguuugcauaaacuagguuauauccuaagagacauaucaaaaauaccugguggcgccauguacgcugacgacacagcuggcugggacacccgaauaacggaagaugacuuacacaaugaggagaagauaacccaacagauggauccggagcaccgucaacuagcaaaugcaauuuuuaaauugacuuaucagaacaagguaguuaaaguccagagaccaacaccgacuggaaccguuauggacauaauuucgcguaaagaucaaagagguucuggacagguaggaaccuacgguuuaaauaccuucacgaacauggaggcccaacuaauucgacagauggagggagaaggggucuugagcaaggcggacuuagaaaacccccaucuuccugagaagaaaauuacacaaugguuagaaacuaaaggaguagaaaggcuaaaaagaauggccauuagcggugaugauugcguaguaaaaccuaucgacgaccgcuuugcuaacgccuuauuagcauugaacgauaugggaaaaguacguaaagacauaccccaauggcaaccuuccaaaggcuggcaugauuggcaacagguacccuuuuguucacaccacuuucaugaacuaauuaugaaagacggaagaaagcuaguuguuccaugucguccgcaagacgaauuaauaggucgagcacgcauaagucaaggcgcaggcuggucuuugaaagaaacugcuugcuuagggaaagcauaugcgcagaugugguccuuaauguacuuccacaggcgugaccuaagacuagcgucgaaugcuauaugcagugcaguaccuguacauuggguuccgacauccaggacgacuuggucaauucacgcacaccaucaauggaugacuacagaagacauguuaaccgucuggaauagagucuggauagaagauaauccuuggauggaggauaaaacaccuguaacaacaugggagaauguaccauacuuagguaagagagaggaccaguggugcgggucacuaaucgguuuaacaaguagggcuacaugggcacagaacauacccacggcaauacaacaaguaagaucauugauaggcaacgaagaguuucuugacuauaugcccagcaugaaacgcuuuaggaaagaggaagaauccgaaggagcuauaugguga

SEQ ID NO: 23203 - RNA, 9873 nt, Artificial Sequence
  derived and/or modified CDS sequence (opt6) from DENV-3__HQ705620__SS-prME
acaucucuauguuuaaugaugauccuuccugccgcuuuagcauuucaucugacgucccgagacggagaaccuaggaugauaguugguaaaaaugagagagguaaaucauuauuguuuaaaacugcaagugguauaaacauguguacacuaauagcuauggauuuaggagaaaugugugacgacaccguuacauacaaaugcccucauauaacggaaguagaacccgaagauauugacuguuggugcaaucuaacuucuacauggguaacauacgggaccuguaaucaagcgggcgagcauaggagagacaaacgaucggucgcacuggcaccucauguaggaauggggcuggauacccgaacacaaacguggaugagugcagagggagccuggagacaagucgaaaaaguagagacuugggcucuacgacauccuggauuuacaauacuugcauuauuucuugcccauuauauagggacaucauuaacucagaaaguuguuauuuucauccuauuaauguuaguuacgccauccaugacuaugagauguguaggaguugguaacagagauuucguagaaggucuauccggagccacaugggucgacgugguauuagaacauggaggauguguuacaaccauggcuaaaaauaaaccgacacuagauauagagcuacagaaaacugaggccacgcaacuagcuaccuuaagaaaauuaugcauugaagguaaaauuacgaacauaacaacugauucucguugcccgacccaaggcgaggcuacccuaccagaagaacaagaccaaaauuaugucuguaaacacacuuacguagacagaggauggggcaacggauguggccuauuuggcaaaggcucucuaguaacaugcgcgaaauuucaaugcuuagaaccgauagaaggaaaagucguacaacacgagaaccugaaauacaccgucauuauuacaguacacacuggggaucagcaucaagucggaaacgagacacaagguguaaccgcggagauaacaccgcaagcaucuacuaccgaagcaauucuuccagaguaugggacguuaggacuugaauguucgccucgaacaggccuagauuuuaaugaaaugauacuacuuacaaugaaaaauaaggcuuggaugguucaccgucaaugguucuuugaccuuccacuaccauggacgucuggagccaccacagaaacuccaacauggaauagaaaagaacugcucguaaccuuuaaaaaugcacaugcuaagaaacaagaaguaguaguccucgguagucaggaaggcgccaugcauacagccuuaaccggagcuacugagauacagaauagcggagggacuuccaucuucgcgggacauuugaaaugucgacuuaaaauggauaaauuggagcugaaaggcaugucuuaugcgaugugcacaaacacauuuguguugaagaaagaggugagugagacccaacacggaacaauauuaauuaaaguagaauauaaaggugaagacguaccauguaaaauaccguucucgaccgaggauggccagggaaaagcacauaauggaagguuaauuaccgcaaacccuguagucaccaagaaagaggaaccaguuaauauagaagcagaaccacccuucggggaaaguaauaucguaauagggaucggugauaacgccuuaaaaaucaauugguacaagaaaggaagcagcauagggaaaauguucgaagcuacagcgcgcggugcuagaagaauggcaauucuaggcgauacugccugggacuucgguucuguugguggcguuuuaaacucauuaggaaaaaugguacaccaaauauuuggaucagccuacacagcccuauucagcgggguauccugggugaugaaaaucgggauaggugucuuauuaacguggguugguuuaaacucgaaaaacaccucaaugucauucucauguaucgcuauaggcauaauaacacucuaucuuggugcgguuguucaagcggauaugggcugugugauaaauuggaaagggaaagaacuuaaauguggcucagguauauucguaacuaacgagguccauacauggacugaacaauauaaauuccaagcugauaguccaaaaagguuggcaacugcuauugcgggggcaugggaaaauggaguuugcggcauucgaucuaccacacgcauggaaaaccuacuauggaaacaaauagcuaaugagcuuaauuauauccuuugggaaaacaacauaaaacuaacagucguuguaggcgauaucauagguguacuggaacaagggaaaagaacauuaacgccacaaccaauggaauuaaaauacucauggaaaaccuggggaaaagcgaaaauuguaaccgcagaaacacaaaauuccaguuuuauuaucgaugggccuaauacgccagagugcccuucaguuagucgagcguggaauguuugggaaguggaggauuauggcuuugguguuuucacaaccaauauuuggcucaaacuacgcgaaguguauacacaauuaugugaucauagauugaugucagcagcgguaaaagaugaaagagcuguacaugccgacaugggguauuggauugaaagucagaaaaauggaucguggaaacuugaaaaagcaucauuaauugaaguuaaaaccuguacauggccaaaaagccacacuuuguggaguaacgggguauuagaaucagauaugauuauuccaaaaagucucgcuggcccaaucucucaacacaaucauagaccugguuaccauacucaaaccgccgguccauggcaucuagggaaauuggaacuugacuuuaacuauugcgaaggaacuacaguaguaauaacugaaaauugugguacgagaggacccucucuaagaacaacaacgguuucagggaaacuuauacaugaaugguguugcagauccugcaccuuaccaccuuuaagguauaugggugaagacgguuguugguauggaauggaaauuagacccauaagcgagaaagaagagaauaugguaaagucuuugguauccgcggggagugggaaagucgauaacuuuacaauggggguucuuugcuuggcgauauuauuugaagaaguuaugcggggaaaauuuggcaagaaacauaugauagccggaguauucuuuacguuuguguuacuauuauccggccaaauaaccuggagagauauggcacauacccucaucaugaucgguucuaaugcaagcgaucgcauggggaugggcgucacguauuuagcauuaauagcaacauuuaagauacaaccuuuucuugcacuuggauucuuucuucggcgauuaacaucaagggaaaaucuccuacuuggggucggucucgcaauggcuaccacauuacaacuuccugaggauauagagcaaauggccaaugguauugcacugggacuuauggcgcuuaaauuaauaacucaauuugaaacguaucaguuauggacugcacuuaucagcuugaccuguagcaacacuauauuuacucuaacaguagccuggcgaacagcaacccucauacucgcaggaguaucacuccugccugucugucaaucaaguagcaugaggaaaacggauugguuacccauggcgguagccgcaaugggaguaccaccccuucccuuguucauuuuuagccuaaaagacacuuuaaaacgaagaucauggccacuaaacgaaggagugauggcaguuggucuagucucuauacuagcaucaagccuauuacggaaugauguacccauggcaggaccauuaguagcugguggacuauugauugcuuguuaugugauaacggggaccagcgcugacuugacggucgaaaaggccgcugauaucaccugggaagaagaagcugagcagacagguguuucacacaacuuaaugauaacaguugacgacgacggcacgaugcguaucaaagaugaugagacagagaauauauugacaguucuacugaagacggcucuccucauagucuccgguauauuuccguauucuauaccggcaacacuauuaguauggcauacauggcagaaacaaacacaaaggucuggaguccucugggaugugccaagcccacccgaaacgcagaaagccgaauuggaagaagguguuuauaggauuaaacaacaaggcaucuucggaaagacccaagugggggucgguguacaaaaggaaggagucuuccauaccauguggcauguaacgcguggagcuguuuuaacuuauaaugguaaaagauuggagccuaauugggccagugucaagaaagaccuuauaaguuauggaggaggauggcgccuuucagcccaguggcaaaagggugaggaagugcaaguaauagcugucgaaccgggcaaaaaccccaaaaacuuucaaaccaugccuggaacuuuucaaacaacgaccggagaaaucggagcaauagcacuagauuuuaaaccgggaacaucuggaagcccgaucauaaaccgggaagguaaagugguaggauuauacggcaauggggugguuacuaaaaauggugguuacguaucaggaauugcucagacuaaugcagaaccagacggaccaacaccugagcuagaagaagaaauguuuaagaaaagaaacuuaacgauuauggaucuucacccugguucgggaaaaacaaggaaauacuuaccagcaauagucagagaagcaauaaagcgcagacucagaacccuaauauuggccccgacaagaguaguagcagccgaaauggaagaagcacuuaagggccugcccauuagguaucaaacuacggcaacgaaaucugaacauacgggcagagaaauaguugaucuuaugugucacgcaacuuuuacuaugagacuauugucuccuguuagaguuccaaauuauaaccuuaucauaauggacgaggcacacuuuacagauccagccucuaucgcggcucgggguuauaucucaacaaggguuggaaugggagaagcagccgcaauauucaugacugcaacaccacccggcacagcugacgcauucccccaaucaaaugcaccaauacaagacgaagaacgugauauaccagagaggucauggaacagcgguaaugaauggauaacggauuuugcggguaaaacuguaugguucguaccgucuauaaaagcuggaaaugacauagcuaauuguuuaaggaaaaauggcaagaaaguaauucagcuaucgcggaagaccuuugacacugaauaucagaaaacaaaguuaaaugauugggauuuuguagugaccacggauauuucugagaugggagcgaauuuuaaagcagaccguguuauagacccacggaggugccuaaagccagugauauuaacagaugggccagaaagaguuauacuggcuggcccaaugccaguuacggcugcgucagcugcgcaacguagaggccgcgugggacgcaauccacaaaaagagaaugaccaauauauauucacuggucaaccauuaaacaaugaugaagaccaugcucacuggacagaggcaaaaauguuacuagauaauauuaacaccccugaagggauaauaccagcacucuuugaacccgaacgagagaaaagcgccgcgauagacggggaguaucgacuuaaaggugaaucgagaaaaacuuuugucgagcuaaugaggcgcggggaucucccaguuuggcuggcacacaagguugcuuccgaagguauaaaguauaccgauagaaaauggugcuucgauggccaaaggaacaaucaaauacuugaagaaaauauggauguugagaucuggacaaaagagggagagaagaagaaauugcgaccucguugguuagacgcuagaacuuauucagacccccucgcacuaaaagaauuuaaagaauuugcggcagggagaaaaaguauugcucuggacuuaguaacggaaauaggcaggguaccaucucaccucgcacacagaacuagaaaugcauuagacaaccuaguuaugcuucacacuagcgaacauggugguagagcauaucgacaugcuguggaagaauugccggagacaauggagaccuuacuauuauugggccugaugauacuuuuaacaggcggugccauguuguuccuuauuagcggcaaagguauaggcaaaacaagcauaggauuaaucugcgugauagcuucaucagguauguuguggauggcagaaaucccacuucaauggauagccucagcuauaguucuggaguucuuuaugaugguccuccucauaccugaacccgaaaaacagagaacaccacaagauaaucaauuagcauaugucguaaucggaauauugacuuuagcggcaauaauagcagcaaacgaaaugggacuauuggaaaccacaaaacgugauuuggguaugucaaaagaaccuggaguaguaucuccaacaucauaucucgauguagaucuacacccugccagugcuuggacuuuauaugcugucgcaaccacgguaauaacgccuaugcuacgucacacgauugaaaauucaaccgcaaauguaagccucgcugcaaucgcuaaucaagcuguaguccuuaugggacuugauaaagguuggccaauuucgaaaauggaccuaggggucccgcuucucgcacuaggauguuauucucaaguuaauccacuaacauugacagccgcaguacuacuuuuaauaacgcacuaugcaaucauugggccuggccuccaagcaaaagcuacuagggaagcacagaaaagaacagccgccggaauaaugaaaaacccgaccguggacggcauuaugacaaucgaucuagauccugugaucuacgauucaaaauucgaaaaacaacuaggacaaguuaugcuguuaguacugugcgcuguucaacuucuacuaaugcguacaaguugggcauuaugcgaagcguuaacgcucgcgacaggucccaucacaacucugugggaagguucaccagguaaauucuggaacacuacuauagccguuucuauggccaacauuuuccgggguaguuaucucgccggugcuggauuagcauuuucuauaaugaaaucaguagguaccgggaaacgugguacaggaagucaaggcgagaccuuaggagaaaaauggaaacgaaaauuaaaccaauuaucucgaaaggacuuugaccuuuacaagaaaucagguauaaccgaaguagauagaacagaagcgaaagagggcuuaaaaaggggcgaaaucacacaccaugcugugucaagaggaagcgcgaaguuacaaugguuuguggaaagaaauauggucauacccgaaggcagaguaaucgacuuaggcuguggcagaggaggguggucuuauuacugcgcaggacucaagaaaguaaccgaaguaaggggcuauacgaagggaggaccaggccaugaagaaccuguaccuaugucgacauacggguggaauauuguuaagcuaaugagcggaaaagauguuuucuaucuaccuccagagaaaugcgauacuuuauuaugcgacauaggagaaagcuccccuucgccaacaguugaagagucacguacuauccggguucuuaaaaugguagaaccuugguugaaaaauaaccaauucugcauuaagguacuaaacccauauaugccuacgguaauagaacaccuagaaaggcuucaaagaaaacauggagggaugcuaguaaggaauccgcuuaguagaaauuccacacacgaaauguacuggauuucaaacggaacaggaaacauaguggccucuguuaacaugguaagucguuugcuauuaaauagguucacaaugacacacagaagaccaaccauugagaaagauguagauuuaggagcaggaacgagacaugucaaugcagaaccagaaacuccuaacauggacgucauaggcgagaggauuaaacgcauuaaagaagaacauaauucuacuuggcauuaugacgaugaaaauccauauaaaacaugggccuaucaugguucuuacgaggucaaagcgaccggaucagcgagcaguaugauaaauggugucgucaaauuguuaaccaaaccuugggacgugguacccauggugacacagauggcaaugaccgauacaacucccuuuggacaacaaagggucuuuaaagaaaaaguugacacucgaacaccuagaagcaugcccggaacacgucgaguuaugggcauuaccgccgaaugguuauggagaacuuuaggacgaaauaagaaaccaagauuauguaccagagaagaguucacuaagaaaguaaggacaaaugccgcaaugggggcaguauuuacugaagaaaaucagugggauucggccaaagcagcggucgaggaugaagauuuuuggaaguuaguugacagagaaagagaauugcauaaauuaggaaaaugugguucaugcguauacaacaugaugggaaaaagggagaagaaacuaggugaguuuggaaaagcaaagggcucaagagccaucugguauaugugguuaggugcgagguaucuagaauuugaggccuuagguuuucuuaaugaggaccacugguuuucacgcgaaaauucguacucaggaguagaaggggaaggacuucauaaguuaggguauauauuacgugauauaagcaaaaucccgggaggagccauguaugccgaugauacugcaggaugggacacacguauuaccgaagacgacuuacauaacgaggagaaaauuacacagcaaauggauccugagcauagacaacuugccaaugcaauauuuaaacugacauaucagaauaaagucguaaagguucagcgaccgacuccgaccgggacgguuauggauauaauuagccgaaaagaucagcguggaucgggucaaguuggaacguacggacuaaauacauuuacaaauauggaagcucaauugauuagacaaauggaaggagaggggguguuaagcaaagcagacuuagaaaacccacaucuacccgagaagaaaauuacucaauggcuagagacuaaggggguagagcgacuaaaacggauggccauaagcggugaugauugcgugguuaaaccaauugaugacagauucgcaaacgcacuucuagcacuuaaugauauggguaagguacgaaaggauauuccccaauggcaaccaucaaaaggauggcaugauuggcagcaaguuccauuuuguagccaccacuuccacgaacuaauaaugaaagauggacgcaaauuaguagugccgugcagaccacaagaugagcucaucgggagagcaagaauaucacaaggagcugguuggagucuuaaggagacugcuugccucgggaaagcauaugcccagaugugguccuuaauguacuuucacagaagggauuuaagauuggcaagcaaugccauuugcagugcaguuccugugcauuggguuccaaccucucgaacuacauggucuauccaugcacaccaucaauggaugacaacugaggauauguuaacaguauggaauagaguuuggauagaggauaacccauggauggaagauaaaacaccuguuaccacaugggaaaacguaccauacuuagguaaacgagaagaccaauggugcggaucacuaauaggucugaccucucgggcaacaugggcccaaaauauuccgacggcaauucagcaagucagaagccucauaggaaacgaggaguucuuagauuacaugccuucaaugaagagauucaggaaagaagaggaaucagagggcgcuaucugguaa

SEQ ID NO: 23204 - RNA, 9873 nt, Artificial Sequence
  derived and/or modified CDS sequence (opt6) from DENV-3__HQ705621__SS-prME
acgagcuuauguuugaugaugauacucccagcugcguuggcuuuucauuuaacaucucgugauggcgagccgcgaaugauaguaggcaagaaugagcgaggaaagucucuucuauuuaaaacugccagcggaauuaacauguguacacuaauugcaauggacuuaggggaaaugugcgacgauacuguuacuuauaaguguccacauauuacagagguugagcccgaggauauugacuguugguguaauuuaaccaguacauggguaacauauggaacauguaaucaagcuggagaacaucggcgcgauaaacggagcguagcauuagcuccacacguagguaugggauuagacacacggacgcaaacauggaugucagcagaaggcgcauggcgccaaguagaaaaaguagagacaugggcauuacgacacccaggcuuuacaauuuuagcacuuuuccuagcacacuauauaggaaccucgcuaacccaaaaggucgugauuuucauauugcuaauguugguaaccccaaguaugacaaugcgaugcgugggaguagggaaccgagauuuuguugaagggcuaucuggcgcaacuuggguggacguuguacuagaacauggagguugcgucacgaccauggcgaaaaacaagccaacacucgacauugaacuacaaaaaaccgaagccacacaacuagcaacccugagaaaauuguguaucgaagguaagauuacuaauauuaccacugauucuagauguccaacacagggggaagcaacccugccagaagagcaagaucagaacuauguguguaaacacacauacguagacagagguuggggcaauggauguggauuguuuggaaaaggaucguuaguuacaugcgccaaauuucagugcuuagaaccgaucgaagguaaggucguacaacaugaaaacuuaaaguacaccguaauuauaacggugcauacuggcgaucaacaucaaguuggaaaugaaacccaggggguaacugcagaaauaacgccucaagcuagcacaacggaagcaaucuugccagaguacggcacgcuaggacuagaaugcucuccacgcacaggccuugauuucaaugagaugauauuauuaacuaugaagaacaaagcuuggaugguacacaggcaaugguucuuugauuuaccauuaccguggacaaguggagcaacaacagagaccccaaccuggaauaggaaagaauuacucgucacguucaaaaacgcacaugcgaaaaaacaagaagucgugguuuuaggaucucaagaaggcgcaaugcacacugcucuaacgggggccaccgaaauacaaaauagcgggggcacaucaauauuugcagggcaucuaaaaugccgccugaaaauggacaaacuugaauuaaaagguaugucauaugcuauguguacaaauacauuuguauugaagaaggaagugucugaaacccagcacgguaccauacuaauuaaaguagaguacaaaggagaagacgugccuugcaaaaucccauuuucuaccgaagauggacaaggaaaagcacauaauggccggcugaucacggcaaauccuguaguaacgaaaaaagaagagccaguaaacaucgaagcagaaccgccuuuuggggaaagcaauauugucauaggaauuggcgauaaugcacugaaaaucaacugguacaagaaagguagcucaauaggaaaaauguuugaggcuacugcaagaggcgccagaaggauggcaauacuaggagauacugcaugggacuucgguucagucggagggguuuuaaacaguuuaggaaaaaugguucaccagaucuucgggucagcauacacagcacuuuucaguggcguaaguuggguaaugaaaauaggaauaggaguacuucuuacguggaucggacucaauaguaaaaacacaagcaugaguuucucauguauugcaauagguauaauaacguuguaccuaggagccgugguucaagcagacauggggugcguuauaaauuggaaaggcaaagaacugaaauguggaagcggcauauuuguuacaaacgaaguacauacuuggacggaacaauauaaauuucaagcagauaguccgaaaaggcucgccacagcgauagcgggagcuugggaaaaugguguaugugggauacgaucuaccacaaggauggaaaaccuccuuuggaaacaaauugcuaaugaauuaaauuauauauuaugggaaaacaacauaaaacuaacaguagucguaggagauauuauagguguacuugaacaagguaaaagaacacuuaccccacagccuauggaacuaaaauacagcuggaaaacuugggguaaagcaaagauagucacagcugagacacaaaacucgaguuucauuauagauggaccaaacacacccgagugucccagcguuucuagggcuuggaauguaugggaaguagaggauuauggauuuggcguauucaccacaaacaucuggcuuaaacucagggaaguuuacacgcaacuuugcgaucauagacuuaugagcgcagcaguaaaagaugaacgugcaguacacgcagauauggguuacuggaucgaaagucaaaaaaacgggaguuggaaacuagaaaaagccuccuuaauugaagugaaaacaugcacuuggccaaaaucacacacauuauggucaaauggaguccuagagagugauaugauuauaccaaagagucucgccggcccuauaagccaacacaaucauaggccagguuaccacacccaaacugcggguccuuggcauuuaggcaaauuagaacuagauuuuaacuauugugaagguacuaccguagucauuacggagaauugcgggacuagaggaccuagcuuaagaacaacaacaguuucgggaaaguuaauacaugagugguguuguaggucuuguacacuuccaccucuuagguauaugggggaggacggcuguugguaugguauggagauacgcccuauaucagaaaaggaagaaaauaugguuaaaagucuaguaagugcuggaagcggcaaagucgacaacuuuacaauggggguauuaugucuagcgauucucuucgaagagguuaugagagggaaauuugguaaaaaacauaugauagcagguguauucuucacauucguacuacugcucagcggccaaauuaccuggcgcgacauggcacauacgcuaauaaugauaggaagcaaugcaucagaccgaaugggcaugggagugacauacuuggcucuaauugccacauuuaagauccagccuuuccuagcacuuggguuuuuuuuaagaaaacuaacaucgcgugaaaaucuguuauugggaguagguuuagcaauggcaaccaccuugcaacucccggaagacauagaacaaauggcaaauggaaucgcucuaggucucauggcacuuaaacucauaacucaguucgagauauaccaguuauggacagcauuaauaagucucacaugcucuaauacuauauuuacacuaaccguugccuggcgaaccgcgacucuuauacuugcggguguaucauuacuacccaugugucaaaguucaagcaugcguaaaacagauugguuaccaauggcagucgccgcaaugggaguaccgcccuuaccucuauuuauauuuagccucaaagacacgcuuaaaagaagaaguuggccucuaaaugaaggaguaauggcagugggacuagucagcauucuugcaagcucguuauugagaaacgauguaccuauggcaggaccgcuaguagcugggggucuacuaauagccuguuauguuaucaccggaacuuccgcggauuuaaccguggaaaaagcagcagauauuacaugggaagaagaagcugaacaaacaggaguuucccacaaccuaaugauaacgguugacgacgacggaacgaugcguaucaaagaugacgagacagaaaauauuuugacuguauuguuaaagacagcauuacugauuguuucaggaauauuuccuuauucuauaccugcaacgcuuuuaguguggcauaccuggcaaaaacaaacccaaagguccggaguauuaugggauguuccaaguccuccugagacacaaaaagcagagcuagaagagggaguauaucgaaucaagcaacaagggauuuuugggaagacacaaguuggcgugggaguacaaaaagaaggaguauuccacacuauguggcauguaacaagaggugcuguccuuacauauaauggcaagaggcucgaaccaaacugggcaucuguaaaaaaagauuuaaucucguacggcgguggauggagacuauccgcgcaauggcaaaaaggggaagaaguacaggugauugcaguagagccagggaagaauccuaagaacuuucaaacuaugccuggaacauuccaaaccaccaccggagaaauuggugcuauagcucuggauuucaaaccggguacuagcggcagcccaauuauaaacagagagggaaaaguagugggauuauaugguaaugguguagugaccaaaaaugggggauaugucucagguaucgcucaaaccaacgcugagccggaugguccuacaccugaacucgaagaagagauguucaaaaagagaaaccuaacuauaauggaccuacauccaggcuccggcaagacacgcaaauaucuaccagcgauaguaagagaagccauaaaacgaagauuaagaacauuaauacucgcccccacccgagucguagcggcggaaauggaggaagcacuaaaaggauugccuauacguuaucagacaacagcuacaaagucagaacauacaggccgggaaauuguggacuuaaugugccaugcuacauucacaaugagauuacuuucgccugucagaguacccaauuauaaccuuauaauuauggaugaggcacauuucacugauccugcaucaauugcugcaagaggguacaucucgacaaggguaggcaugggagaagcugccgcaauauucaugacagcuacacccccgggaacagcagaugcuuuuccccaaucaaacgcgccaauccaagacgaagaaagagacauuccagagagaucuuggaacuccggaaaugaauggauaacugacuuugcugguaaaaccguaugguuuguacccucuauaaaagcuggaaacgacauagcaaauuguuuacgaaaaaacggcaaaaaaguaauacaacuaagucgaaaaacauuugacacagaguaucaaaaaacuaaacucaacgauugggauuucguugucacaacggauauaucagaaaugggagcuaauuucaaagcggaucgcguuauagacccccgucguugccucaaaccaguaauauugacagacgguccagaaagaguaauuuuggccggaccuaugccugucacagccgcaucagcugcacagcgccgcggaagaguggggcguaauccccagaaagaaaacgaucaauacaucuucacggggcaaccauuaaacaacgaugaagaccacgcacacuggacggaagcgaaaauguuacuggauaauauuaauacuccagaggggauuauaccagcccuauuugagccagaaagagaaaaaucugccgcuauagacggcgaauaccgauuaaagggagagagccgaaaaacauucguagaauugaugagaagaggggaucuaccagucugguuagcacauaaaguagccucagaagguauuaaauacaccgacagaaaaugguguuuugacggccagagaaauaaucagaucuuggaggaaaauauggauguagaaauauggacuaaagaaggagagaaaaaaaaauuaaggccuagauggcuagaugcaagaacguauagugauccacuggcacugaaagaguucaaagaauuugcugcuggcaggaaauccauugcauuggaucuaguaaccgaaauaggaaggguaccaagucaucuagcucauagaacaagaaacgcacuagauaaucuuguaaugcuucauacgucagaacauggaggcagagccuacaggcaugcaguagaggaauugcccgaaacaauggaaacacuacuucuauugggcuuaaugauacuacuaacuggcggugcuaugcuuuuuuuaauaucaggaaagggaauaggaaaaacaucaaucgguuugauuuguguaaucgcaucaagcgggaugcuuuggauggcggagauaccauugcaauggauagcuagcgcaauuguucuugaauucuucaugauggugcuauuaauuccggaacccgaaaagcagcgaacaccucaagauaaccaguuagcauauguugucaucggaauccucacccuugcagcuauaauugcugcaaacgaaaugggauuauuagagacuacuaagcgcgauuugggaaugucgaaagaaccaggaguaguuucuccaacaaguuaccuagauguagaccugcauccagcuucagcauggacuuuauaugcagucgcaacaacuguaauuacucccaugcuuagacauaccauagagaacucuacugcaaaugugucucuagcagcaauagcaaaucaagcuguaguccuaauggguuuagauaagggauggccaauuucgaaaauggaucucggcguaccacugcuagcauuaggaugcuacucccaagucaacccccuaacauugacggcugcgguguuauuacuuauaacacauuaugcuauuauuggacccggucuacaagcuaaagcuacuagggaggcucaaaagcguaccgcugccggaauaaugaaaaauccaacgguagacggcauuaugacaauugaccuggacccugugauuuaugacucaaaauuugagaaacaguugggacaagugaugcugcugguuuuaugcgucguucagcuccuacucaugagaacaucuugggcuuugugugaagcacucacucuagcgaccgggcccauaacgaccuugugggaggggagcccaggaaaauuuuggaacacuacuauagcaguauccauggcaaauauauucagaggauccuaucuagcaggggcggguuuagcguucucuauaaugaaguccguugggacagggaagagaggaacagguagccaaggugagacacugggugaaaaguggaaaaaaaaguuaaaccaacucucacggaaagauuucgauuuauacaaaaaaucagggauaacugaggucgauagaacagaagccaaagaaggucuaaagcgcggagaaauaacucaccacgcgguaucucgcggcuccgcaaaacuacaaugguucguggaaagaaacaugguaauaccugaagggcgugucaucgaucuugggugugguagaggaggauggucguacuacugugcaggccuaaagaaaguuacagaaguucgaggcuauaccaaaggaggcccaggacacgaagaaccugugccgaugucuacuuacgguuggaacauaguaaaacuuauguccgguaaggauguauuuuaucugccaccagaaaagugcgauacguuauuaugugauauaggugaaagcucaccaagucccacaguagaagaaucaagaacgauccggguauuaaaaaugguagaaccuuggcuuaaaaauaaccaguuuuguaucaaagugcuaaauccauauaugccaaccgucaucgagcauuuagaacgguuacaaagaaaacacggugguauguugguuaggaacccucucagcagaaauagcacacaugagauguacuggauaucaaacggaacugggaauauaguagccagcguaaauaugguaucccgucuucuuuuaaauagauucacgaugacacacagaagaccuacuauagaaaaagauguagaucugggggcuggcacacgccauguuaaugcugagccagaaaccccaaauauggauguaauaggagaacguauuaagagaauaaaagaggaacacaacucgaccuggcaccacgacgaugaaaacccuuacaaaacaugggcauaucacggaucauacgaggugaaagcaacuggcagugcaucauccaugauaaauggcguuguuaagcugcuaacuaaacccugggauguugugccaaugguaacacagauggcuaugacagauacaacacccuuuggacaacaaagaguuuucaaggaaaagguugauacuagaacgccuagauccaugccaggcacgcguagaguaauggguauaaccgcugaaugguuguggagaacuuuagguaggaacaaaaagccgcgccuaugcacuagagaagaguucacgaaaaaaguccgcaccaaugccgcuaugggugcuguguucaccgaagagaaucagugggacucugcuaaagcugcuguagaagacgaagacuuuuggaaguuaguagauagagaacgugagcuccacaaauuagguaaaugcgguuccugcguauauaacaugauggggaaaagggaaaagaaacucggagaauucggaaaagccaaaggaagcagagccaucugguauauguggcuuggugcacgcuaccuugaguucgaagcucucggauuccugaaugaagaucacugguuuaguagggagaauaguuauucugggguagaaggagaaggauugcauaaauuagguuacauacucagagacaucaguaaaauuccggguggagcaauguaugcagaugauacagcuggaugggauacgcguaucaccgaagacgacuugcacaaugaggaaaaaauuacacaacaaauggacccugaacaucgacaguuggccaaugcaauauuuaaacuaacuuaucaaaacaaaguagugaaggugcaacgaccaacacccacuggcacaguaauggauauuaucagcaggaaggaccaaagggguucaggucaaguuggaacuuauggcuugaauaccuucacaaauauggaggcccagcuaauccgccaaauggaaggagaagggguacuuucgaaagcagauuuagagaauccacaucucccggaaaaaaagauuacccaauggcuggagaccaaagguguggagcgcuuaaaacguauggcaauuagcggggaugauugugucguaaaaccaaucgaugacagauuugcgaacgcgcuacuagcguugaaugauauggggaagguuagaaaagacaucccucaauggcaaccuucgaaagguuggcaugacuggcagcaagucccguuuugcucucaucauuuucacgaacuaauaaugaaagacgggcgaaaacuaguuguuccaugucgaccccaagacgagcuaauugggcgggcaaggauaagucaaggugcaggaugguccuugaaagaaacugcaugccuaggaaaagcauaugcccaaauguggaguuugauguauuuucacagaagagaccuucgcuuagcuucuaacgcuauauguucugcaguaccugugcauuggguaccuacauccagaacuacauggagcauacaugcacaucaccaguggaugacuacggaagacauguuaacaguuuggaacagaguauggauagaagauaacccauggauggaggauaaaacgccggucacaaccugggaaaauguaccauauuuagggaaacgagaagaccaguggugcgguucucugaucggucuaacuucuagggcaacaugggcucaaaauauuccaacugccauacagcaaguuaggaguuuaauagguaaugaggaauuuuuagacuauaugccgucgaugaaacgcuuccguaaagaagaggagagugaaggugcaauaugguaa

SEQ ID NO: 23205 - RNA, 9873 nt, Artificial Sequence
  derived and/or modified CDS sequence (opt6) from DENV-3__HQ671176__SS-prME
acaucuuuauguuugaugaugauacuucccgcagcuuuggcauuucaccuuacaagcagagauggugaaccacgaaugauaguugguaaaaacgaaagaggaaaaucucuucucuuuaaaacggcuucuggaauuaacaugugcacauugauagcaauggacuuaggagaaaugugugacgacacaguaacguacaaauguccucauauuacagaaguggaaccagaagauaucgauugcuggugcaaccuaacaagcaccuggguaacauauggaacuugcaaucaagccggugaacacagaagagauaaaaggucuguggcccucgcaccucauguggguaugggauuagacacaaggacacaaacauggaugucggcugagggugcguggagacagguggaaaaagucgaaacgugggccuugcgacaccccggauucacaaucuuagcauuauuucuagcucauuacauaggcacgucacugacucaaaaaguaguaauauucauauuauuaaugcuaguaacuccaaguaugaccaugagauguguuggagugggaaacagggauuuuguagagggucuaucuggagcuacauggguugauguagucuuagaacauggagggugcguaacuaccauggccaaaaauaaacccacauuagacauagaauuacagaaaaccgaagccacccaacuggcaacgcuuagaaaacuguguauagaagguaaaauuaccaauauaacgacggacucacgaugcccaacacagggcgaggccacucucccagaagaacaagaucaaaacuaugucuguaaacacacauaugucgaucgggguugggguaacgggugcggacuguucggcaaagguuccuuaguuacuugugcaaaauuccagugucucgaaccaauagagggcaaaguugugcagcacgaaaaucuaaaauauacaguaaucauaacugugcacacaggugaccagcaccaaguuggcaaugaaacccaaggggucacagcagaaauaaccccgcaggcgucaacuaccgaggcuauauugcccgaguacggaacccucggcuuagaaugcucgccaaggacuggacucgacuuuaacgaaaugauacuccuaaccaugaaaaauaaagcauggaugguucacagacaaugguucuuugaccuaccucuaccauggacuucuggugccacgacggagacaccuacguggaacagaaaagaacuacugguuacauuuaaaaacgcucaugccaagaaacaagaaguuguaguucuaggaucacaagaaggcgcgaugcacacggcucuaacuggcgcgaccgaaauacaaaauucugggggaacaagcauuuuugcuggccauuuaaaaugucgguuaaaaauggauaaauuagaauuaaaaggaaugagcuaugcuauguguacaaauacuuuuguguugaagaaagaaguaucugaaacacaacauggaaccauacuaauaaaaguugaauacaaaggagaagauguaccguguaaaauaccuuucucaaccgaagauggucaaggaaaagcacacaauggucgauugauuacugcaaauccuguagucacgaagaaagaagaaccgguaaauauagaagcugaaccgccguuuggugaaaguaacauuguaaucgggauaggcgauaaugcccuaaaaauuaauugguauaagaaagggucuucuauaggaaaaauguuugaagcgacugccagaggagcccgaagaauggcaauauuaggagauacagcgugggauuuugguuccguuggcggaguuuuaaacaguuuagguaaaaugguacaucagauuuuuggcucggcauauacagcacucuuuucgggcguaucguggguaaugaaaauugggauagguguucuacugacauggauaggcuuaaacaguaaaaauacaucaaugagcuuuucaugcaucgcaaucggcauaauaacucuauacuuaggcgccguuguccaggccgauaugggaugcguaauaaacuggaagggcaaggaacugaaaugcgguucuggcauauuuguuaccaacgaaguccauacauggaccgaacaguauaaauuccaagccgauucuccaaaaagguuagcgacagcuauugcgggugcaugggaaaacggaguuugugguauacguaguacuaccagaauggaaaauuuauuauggaaacaaauagcaaaugaguuaaauuauauacuaugggaaaauaacauuaagcuaacaguagucguaggagauaucauuggaguucuagagcaaggcaaaagaacauuaacuccucaaccgauggagcuuaaauacucuuggaagaccugggggaaagccaagauaguuacagcagaaacccaaaacagcucuuuuauaauagacggcccgaacacgccggaauguccaagcguaucgagggcauggaauguaugggaaguggaagauuauggcuuuggaguauucacgacaaacauaugguuaaaacuaagagaaguauauacacaauuaugugaccaccggcuaaugucagcagcaguuaaagaugaaagagccguccaugcagauaugggcuacuggaucgaaagucagaaaaauggaaguuggaaacuagaaaaagcaagucucauagaaguuaagacaugcacuuggccuaaaagucauacacucuggagcaauggaguauuagagucagauaugauuauuccuaaaucacuggcaggcccuaucucacaacauaaucaucgcccaggguaucauacccaaacugcugggccuuggcaccuaggaaaauuagagcuugacuuuaauuacugcgagggaacuaccguaguaaucacugaaaacugugggacacgcggcccuagcuuaagaacgacaacaguuaguggaaaguuaauucacgaauggugcugucgaaguuguacuuuacccccacuucguuauaugggggaagacgguuguugguauggaauggaaauccgaccaauaagugaaaaggaagaaaacauggucaagucgcucguaucugcggggucuggcaaaguagauaacuuuaccaugggaguucuaugucuggcaauuuuauuugaagaaguaaugcgaggaaaauucgggaagaaacacaugauagcaggagucuucuucacauucguauuacucuuaagcggacaaauuacuuggagagacauggcacauacuuuaauuaugauugguaguaacgcaucagauagaaugggaaugggcguuacauacuuagcauuaauagcgacauuuaaaauucaaccauuuuuagcguuaggauucuuucucagaaaacuuacaagucgcgaaaaccuccuguuagguguugguuuggcuauggcaacaacauuacaauugccggaggacauugaacagauggcaaacgggauagcacuuggucuaauggcauuaaaacugauuacacaguuugaaaucuaucaacuuuggacggcacugauuucguuaacuugcucuaacacaauuuuuacgcuaacuguagcguggagaacagcuacacuuauuuuggcgggaguuagcuuguugccaaugugucagucaaguaguaugcgaaaaacagacuggcuaccaauggcaguggcugcuauggguguuccaccacuaccacuauuuauauuuagccuaaaagacacccuuaaaagacguucauggccacugaaugaaggaguaauggcaguuggguugguuaguauacuagcuucgagccuacuuagaaaugaugugcccauggcaggaccauugguagcagggggcuugcucauagcauguuacguaauaacagguacuucagcggacuugacuguagagaaagcggcagauaucacaugggaggaagaagcagaacaaacagguguaagucacaaucugaugauaacugucgaugacgaugguacuaugcguauuaaagaugaugagacugaaaacauucucaccgugcuacuaaaaacugcacuacugauuguuucagguauauuuccguauagcauaccggcaacacuuuuaguauggcacacuuggcaaaaacaaacccaacgguccggaguacuaugggacguaccuaguccaccagagacacaaaaagcagaauuagaagaaggaguguauagaaucaaacaacagggaauuuucggaaaaacucaaguagguguaggggugcagaaagaagguguauuucauacuauguggcacguuacacgaggcgcagucuugacauauaacgguaaaaggcuugaacccaauugggccagcgucaagaaagacuuaauaucuuauggugguggauggagacuuagcgcacaauggcaaaaaggugaagagguacaagugauugcuguagaaccagguaaaaacccuaagaacuuucaaacuaugccaggaacguuucaaacgacuacaggcgagauuggagcaauagcguuagauuuuaagcccgguacauccggaucuccaauuauuaaccgugaagguaaaguaguagggcuuuacggaaacggcguaguaaccaagaacggaggguauguaucagguauagcgcaaacuaacgcagaaccagauggaccaacuccagaacuugaagaagaaauguucaagaaaagaaaucugacuauaauggauuuacauccaggcucagguaaaacccggaaguaucuucccgcaauugucagggaggcaauaaaaagaagauuaagaacauugauacuugcgccuacaagaguuguagccgcugaaauggaggaggcacuaaaaggucuuccaauucgcuaucaaacaacagccacuaaaucggaacauacuggacgugaaauaguagaucuuaugugucacgccaccuuuacaaugagacucuugucgccaguaagaguuccaaacuacaauuugauuguaauggaugaagcacauuuuaccgauccggcaucaauagccgcuaggggguauauaaguacgagggugggaaugggagaagcagcagcaauuuuuaugacagcaacacccccuggcacugccgacgccuuuccccaaaguaacgcuccaauacaagacgaagaacgggacauaccagaacguuccuggaauagcggaaaugaauggauaacagauuuugcaggaaaaacuguuugguuuguaccguccauaaaggcaggcaacgauauagcaaacugccuccguaaaaacggcaagaaaguuauucaauugagccguaaaacguuugacaccgaguaucagaaaaccaaacuaaaugacugggacuucguaguuacaacugauauaucagaaaugggagcaaauuucaaggcugauaggguaauagacccucgcagauguuuaaagccagucauucuuacagauggaccagaacgagugauauuagcugguccaaugccaguuacggcagcuagugcagcucaaagacguggcagagugggacguaacccacaaaaggaaaaugaucaguauauauucaccggucaaccguugaauaaugaugaagaucaugcacacuggacagaagcaaagauguuauuggauaauauaaacacacccgagggaauaauaccagccuuguucgagccagaaagagaaaaaucagcagcuauagauggugaguaccgauugaaaggagaaucacgcaaaacauuuguugaguuaaugagaaggggugaucuccccgucuggcuagcgcauaagguagccuccgagggaauaaaauacacagaccgaaaaugguguuuugacggccagagaaauaaucaaauacuagaagaaaacauggauguagagaucuggacaaaagagggagagaagaagaaauuacgaccgagauggcuugacgcgaggacguacagugauccacuggcacuaaaagaauuuaaggaguucgcggccggucgcaaaagcauagcuuuggauuugguuacagaaauaggacgaguaccuucgcaucuggcacaucguacacgaaaugcacuagauaacuuaguaauguuacacaccucugaacacggaggaagggccuaccgucacgccgucgaagaguuacccgaaacuauggaaacauuauuauuguuaggucugaugauacuacuaaccggaggagcgauguuauuucuuauauccggaaaggggauaggaaagacaucaauaggguuaauauguguaauugcaucuaguggcauguuauggauggcagaaauaccucuacaguggauagcaucagcgaucguacuugaguucuuuaugauggucuuauugauuccagaaccggaaaagcaaagaacaccacaggauaaccaguuagccuacguuguaauaggaaucuuaacacuugcggcuauaauugcagcaaaugaaaugggauugcuagaaaccacuaaaagggaccuagggaugagcaaagaaccuggcguagugucuccuacaagcuacuuagacgucgauuugcaucccgcaucggcauggacucuauacgcgguugcgacaacaguuauaacgccaaugcugaggcauacuauagagaacaguacugcgaaugucagcuuagcagcaauugccaaccaagcaguuguacuaaugggcuuagauaaaggguggcccauaucuaaaauggaccugggaguaccccuuuuagcauuaggauguuacucacaaguuaacccguuaacacuuacggcagcaguauuguugcuaauaacacacuacgcuauuauagguccuggcuuacaggcaaaagcuacgcgugaagcucagaaaaggacagccgcagggauaaugaaaaauccaacuguggacggaauaaugacuauagacuuagauccuguuauuuacgacagcaaguucgaaaaacaacuaggacagguuaugcuauuaguguugugugcuguccaacuccuauuaaugcgaacgucaugggcauuaugcgaagcguugaccuuagcgacggggccuauuaccacauugugggaaggaucaccagguaaauuuuggaauacuacaauagcugugucaauggcaaauauauuccggggaucguaucuugcaggagcaggacuagcuuucuccauaaugaaaucuguaggaacaggaaaacguggcacagguagccagggagaaacauuaggcgaaaaguggaagaagaaacucaaucaacuaucacggaaagacuuugauuuguauaagaaaagcgguauaacugaagucgaccgcaccgaagccaaagaaggucugaaacgcggcgaaauaacucaccaugcagugucacgugggucugcaaaauuacagugguuuguagaaagaaauauggucaucccggaagggagggugauagacuugggcugcggaagaggcggguggucguacuauugugccggguugaaaaagguaacggagguacgaggcuacacgaaagguggaccaggacaugaggagccggucccaauguccacuuauggguggaauaucguuaaacuaaugagcgguaaggacguauuuuacuuaccgccugagaagugugauacacuauuaugcgauauaggcgaaagcagcccuaguccuaccguagaagaauccaggacaauacgcgugcugaaaaugguugaacccugguuaaagaauaaucaauuuugcauaaaaguccuaaacccuuauaugcccacagucauugaacaucuagaacgacuccagaggaaacauggcgguaugcugguaaggaacccauugagccgaaauaguacacaugaaauguauuggaucagcaauggaacgggaaauauaguggcaagugucaauaugguaucaagacuguuauugaaucgauuuaccaugacccaucgacgaccaacuauagaaaaagauguagaccuaggcgccggaacacggcaugucaacgcugaacccgaaacaccaaacauggacguaauuggagaaagaauaaaacgaauaaaggaagaacauaauucgacauggcauuaugaugacgaaaaucccuauaaaaccugggcguaccauggaucguaugaaguuaaggcgacuggaagcgcaucguccaugauaaaugguguuguuaaacucuuaacuaaaccaugggacgugguaccgaugguaacacagauggcuaugaccgauacaacaccuuuugggcagcagagaguauuuaaagaaaaaguggacaccaggacaccccgcucgaugccugguacuagaagaguaauggggauuacagcggaauggcuuuggcgaacuuuggggaggaacaaaaagcccagauuauguacacgcgaagaguuuacgaaaaaggugagaacgaaugcggcuaugggugccgucuuuacagaagaaaaccaaugggauagugcuaaggcagcugucgaggaugaagacuuuuggaaacuuguagaccgagaacgugaguugcacaaacuagguaaaugcgguuccuguguauacaauaugauggguaaacgagagaagaaauuaggggaauuugggaaagcuaagggaaguagagcgauaugguauauguggcuaggagcacgauacuuagaguucgaggcccuaggauuccuuaaugaggaccauugguuuagccgugaaaauaguuacagugguguggaaggugaaggacuacauaaauuagguuauauucuaagggauauaucgaaaauaccaggcggcgccauguaugcagacgacacugccggcugggauaccagaauaacggaggacgauuuacacaaugaagagaaaauaacgcaacaaauggauccagagcauagacaacuagcuaacgcgauauuuaaauuaacauaccaaaacaaagucgucaaaguacagagacccacgccaacagguacgguaauggauauaauuaguagaaaagaccaacgcggcagugggcagguagguacguacggccucaauacuuuuacuaauauggaagcucaacuaauccgucaaauggaaggugaagguguauuaagcaaggcagauuuagaaaacccucaucucccugagaagaaaauaacucaguggcuagaaaccaaaggaguggagagauugaaaaggauggcaauaucaggugacgacugcgucguaaagccaauugacgaucgauucgcaaacgcuuuacuagcccugaaugauauggguaagguaagaaaggauauaccucaauggcaaccaucaaaaggcuggcaugacuggcaacaaguucccuucugcucgcaccauuuucacgaacuaaucaugaaagauggccguaagcuaguugucccuugcagaccacaagacgaauugaucgggagagcaagaauuucgcagggagccggguggucgcucaaagaaacggcuugucucgggaaagcauacgcacaaauguggagucuaauguacuuucacagacgagauuuacggcuggcuucuaacgccauuugcucagcaguuccaguccacugggucccuacaucaagaacaacuuggucuauccaugcccaccaucaauggaugacgacugaagauaugcuuacuguauggaauaggguuuggauagaggauaauccuuggauggaagauaaaacaccaguaacuaccugggaaaaugucccuuaucuagguaagcgagaagaucaguggugugguuccuuaauugggcuaacauccagggccacgugggcacaaaauaucccgacugcaauccaacaaguaaggagccugauaggaaaugaagaauuuuuggacuacaugccaaguaugaaaagauuuagaaaagaagaggaauccgaaggagcgauaugguaa

SEQ ID NO: 23206 - RNA, 9873 nt, Artificial Sequence
  derived and/or modified CDS sequence (opt6) from DENV-3__HQ705609__SS-prME
acgaguuugugcuuaaugaugauauuacccgcagcacuugcauuccaucuaacaagucgggacggagaaccucgaaugaucguagggaaaaaugaaagagguaaaagccuacuauuuaaaaccgcaagcggaauaaacaugugcacccuuauagcgauggaccuaggcgagaugugcgacgacacaguuacuuauaaauguccacacaucacggaaguugaaccggaagauauagauuguuggugcaauuuaacaucaacguggguaaccuaugggacuugcaaccaagcuggagaacaucggagagauaaacgcaguguugcacucgcaccacacgugggaaugggacuagauacaagaacgcaaaccuggaugagugcggaaggcgcauggcgacaaguugaaaaaguagaaacuugggcauuacgucauccgggguucacaauacuugcgcuauuucuugcgcauuauauuggaacuucucuaacucaaaaagugguaaucuucauccuacuaaugcuaguaacacccaguaugacaaugcgauguguaggggugggaaauagagauuucgucgaaggauugucuggugcaacauggguagauguagugcuagaacacggcggcugcguaaccaccauggccaaaaauaaaccaacccuagauauagaacuacagaaaaccgaagcgacgcaauuggcgacucugaggaaauuaugcauagaaggaaaaauuacuaacauaacuacggacucucgaugcccuacacaaggagaagcuacucuucccgaagaacaagaucaaaacuauguaugcaaacauacauauguggaucguggcugggguaauggauguggacuguucgggaaaggaagccucguaaccugugcgaaauuccaaugcuuggaaccaauagaaggaaaaguaguccaauacgaaaaucuaaaauacaccguuauaaucacaguacacacgggggaccaacaucaagucgggaaugaaacucaagggguuacugcugaaauuacaccucaggcuucgacaacagaagcuauucuuccugaguauggcacacuaggacucgaauguagccccagaacgggucuugauuuuaaugaaaugauccuauugacaaugaaaaauaaagccuggaugguccaucggcaaugguuuuucgaucugccgcugccguggacaucaggugcaacuacggagacaccaaccuggaauagaaaagaacuauuagucacuuuuaaaaacgcacacgccaagaaacaagaaguagugguauuaggaucacaagagggugcgaugcacacagcguuaacaggugcaacugaaauacaaaacucgggagggaccucaauuuuugcaggacaucuuaaauguagacucaaaauggauaaauuggaacuaaaaggaaugagcuaugcaaugugcacaaacacuuuuguucuaaagaaagaaguaagugaaacacaacaugguacaauauugauaaaaguagaauauaaaggagaagauguuccgugcaaaauccccuucucaacugaagauggacaagggaaagcacacaauggacgucugauaacagcgaacccaguuguuacuaagaaagaggaaccgguuaauauagaagcugaaccuccuuuuggggaaucaaauaucgucauaggcaucggcgauaaugcuuuaaaaauaaacugguacaagaaaggcucaucgauaggaaaaauguuugaagccacagcacguggcgcucgacgaauggcuauucuuggugauaccgcaugggacuuugggucgguaggaggaguauuaaacucacuagguaaaaugguacaucaaauuuuugggagcgcauauacagcccuuuucucaggaguuucauggguuaugaaaaucgggauuggaguacuuuuaaccuggauuggucuaaauuccaaaaauacguccaugucuuuuucgugcauagcaauaggaauaauaacccucuaucugggagcaguaguacaggcagacauggguugcguuguaaauuggaaagguaaggaacuaaagugcgguagugguauauuuguaaccaaugaaguucauacauggacugaacaauacaaauuccaagcugauucuccuaagcgauuagcaacagccauagcaggagcuugggaaaacggaguuuguggaauccgauccacaaccagaauggaaaauuuacuguggaaacaaauagcuaacgaacucaauuauauccuaugggaaaacaacauaaaacucacgguaguagucggagacauuauugggguucuugaacaaggcaaaagaacauuaacaccacaaccaaaagaacuuaaguacaguuggaaaaccuggggaaaagcaaaaauagucacagcagaaacacaaaauagcucauuuaucaucgaugguccaaauacuccagaauguccaucaguguccagagcauggaauguaugggaaguugaagacuauggauucggcgucuucacuacaaacauuugguuaaaguuaagagaaguauauacucagcuaugcgaccauagacugaugagcgcugcugugaaggaugaaagggcagugcacgccgacaugggguauuggauugaaagucagaaaaaugguaguuggaaauuagaaaaagccagcuuaauagagguuaagaccugcacauggccuaaaucacacacauuauggucaaacgggguauuggaaucagacaugauuauaccaaaaucuuuagcaggaccaauaucacaacacaaucauagaccggguuaucauacacaaaccgcggggccuuggcaccuugguaaauuagaauuagauuucaauuauugcgaagguacaacaguugugauuacugaaaacuguggaacaagaggucccagucuaagaacaacgacagugucagggaaacuaauucacgagugguguuguagaaguuguacauugccgccucugagauauaugggcgaagacgguuguugguaugggauggaaauacgccccauuagugaaaaagaagagaauauggucaaaucauuaguuucagcaggaucgggaaaaguugauaauuuuacuauggggguccuaugccuugcuauacuuuuugaggaagucaugaggggcaaguucggcaagaaacacaugauagcuggaguauucuuuacuuucguucuuuuauugucuggucaaauaacuuggcgagauauggcccauacacugauaaugauagguucaaaugcgucugaccgaaugggaauggguguuacuuaucuagcccuaauagcuacauuuaaaauacaacccuuccucgcacuuggauucuuuuugagaaaacugacaaguagagaaaauuuguuacuuggagugggucuagcuauggcaacuacuuugcaacucccugaagauauugaacaaauggcaaauggcauagcauugggccucauggccuuaaaacugauaacgcaauuugagacauaucaauuguggacugcccucaucuccuuaaccuguucaaauaccauauuuacauuaaccguugcauggcgaacagcuacgcucauauuagcugguguuagcuuacuuccagucugccaaaguaguucaaugagaaaaacggacugguuaccuauggcuguagcugcuauggguguuccuccguuaccacuauuuauuuucaguuuaaaagauacauuaaaaaggaggucuuggcccuugaaugaaggaguaauggccguaggcuuggugucuauucuugcaaguuccuuauuaaggaacgaugugccaauggcggguccccuaguagcaggaggacuguugauugccuguuacguuauaacggggaccagugcugacuuaacuguagaaaaagcagcggauauaacaugggaagaggaagcugaacaaacaggcgucucacacaauuuaaugauuaccguggacgaugaugggacuaugcggauaaaagaugacgaaacugaaaacauacuaacuguacuccuuaaaacggcacuacuuaucguaagugggauauuuccguauuccauaccagcaacacuauugguauggcauacauggcaaaaacaaacgcaaagauccggggucuuaugggacgucccaucaccacccgaaacacaaaaagcugaacuugaagaaggcguuuauagaauuaaacagcagggcauauucgggaagacgcaaguaggaguaggaguucaaaaagagggaguauuucauaccauguggcacguaacaagaggugcaguauuaacuuacaauggaaaacggcuagaaccuaauugggcgucagucaagaaagaucucauaagcuacggcggaggauggagacuuagcgcccaauggcagaagggugaagaaguccaaguaauugcaguagaacccgguaaaaauccgaaaaauuuucagacgaugccuggcacauuucaaacuaccacaggcgaaauaggagccauagcacuugacuuuaaaccgggcaccuccgggucuccuauaauaaacagagagggaaagguaguaggucuuuacgguaauggggucguaacuaaaaaugguggguacguaaguggaaucgcucaaaccaaugcagaacccgauggacccacgcccgaguuagaggaagaaauguucaagaaacggaaccucacgauuauggacuuacaccccggcagcggaaagacaagaaaguacuuaccggcgauugugagagaagcuauaaaaaggagauuaagaacacuaauucuagcucccacacgggucguugcagcagaaauggaagaagcucuuaaagggcuaccaauuagauaucagacuacugcaaccaaaagugaacacaccgggcgugaaauagucgauuuaaugugccaugcgacguuuaccaugcgauuauuaucgccaguccgaguaccgaauuacaacuuaauuauaauggaugaggcacauuuuacggauccugccucaauugccgcacgaggguauaucaguacacguguuggaaugggcgaggcagcggccauauuuaugacugccacuccuccagguaccgcugaugccuucccccaaagcaaugccccaauacaggaugaggaacgagauaucccggaacgaaguuggaacucugguaaugaauggaucacagacuuugcggguaaaaccguuugguucgugccuagcauuaaggcaggaaaugacaucgcuaauuguuuacguaaaaacggcaagaaaguaauccaauuaucacgaaaaacuuucgauaccgaauaucagaaaacuaaauugaacgacugggacuuugucguuacgacagauaucucagaaaugggagcaaacuuuaaagcugaccgaguuauugauccaagacgcugccugaagccagucauacugaccgacggacccgaaaggguaauccuugcagguccaaugccuguuacugcugccagugcggcgcaacgaagagggcgugucggccgcaacccacaaaaagagaacgaucaguauaucuucacaggucagccucucaacaaugacgaagaucaugcccauuggacugaagcuaaaaugcuauuagauaauauuaacacaccugaagguauaauuccggcguuauuugagccagaaagggaaaaaucagcggccauagacggagaguaccgccuaaaaggagaaaguagaaagaccuuugucgaacuuaugcgaagaggugaucuaccaguauggcucgcacacaaagucgcaucagagggaauuaaauacacggacagaaagugguguuucgacggucaaagaaauaaccaaauucuagaggaaaacauggauguagagaucuggacuaaagaaggcgaaaagaagaaauuaagaccccgauggcuagacgcuagaacuuacagugacccacuagcucugaaagaauuuaaagaguucgcggcaggaaggaaaucuauugcacuagauuuagugacagagauuggccgaguaccaucccaccuagcacaccguacaagaaaugcccuagauaaccuaguuaugcuucauacgagugaacauggaggcagagcauauaggcacgccguggaggaauugcccgaaacgauggaaacuuuauuacuguuaggacuaaugauauuacuuaccgggggugcaauguuauuucuuauaucgggaaaagggauagggaagacaucgauaggacuaaucugugugauugccaguucaggcaugcuauggauggccgaaauaccauuacaauggaucgccucugcaauaguacuggaguucuuuaugaugguucuacuuauaccggaaccagagaaacagagaacgccccaagauaaccaacuggcauacgugguuauaggcauuuuaacacuggcagcaaucauagcugcaaacgagaugggucuacuggaaacaacuaagagagaucuggguaugaguaaagagccgggaguaguaagcccuacuucauaccucgauguggaucuucauccugcaucagcauggacuuuguaugcugucgcgaccacugugauuacuccuauguugagacacacuauagaaaauucgacagcgaauguuucucucgccgcaauagcaaaccaagcugucguucugauggggcucgauaaaggguggccaaucaguaagauggaccuugguguaccacucuuagcacuaggcugcuacucccaaguaaaucccuugacacucacggcagcuguucuacuuuugauaacucauuacgcaaucauugggccgggacugcaagcuaaagccacaagagaggcucagaagagaacggcugcaggcauuaugaaaaacccuacaguugacggaauaaugaccauagaccuggaccccguuauauaugacucuaaguuugaaaaacaacuaggucaaguaaugcuacucguacugugugcuguacaguuauugcuaaugcguacaaguugggccuugugugaagcccugacauuagcuacaggaccuaucacuacauuaugggaagguaguccaggcaaauuuuggaacaccacaauugcgguaucaauggcaaauaucuuuagagguucuuauuuggcaggggcggggcuagcuuuuaguaucaugaaguccguuggaacugguaaaagaggaaccggaucucaaggagagacacuuggugaaaaauggaaaaagaaacugaaccaacuaucaagaaaggacuuugauuuguauaaaaagucugguauaacugaaguggaccgcacugaggcaaaagaggguuuaaaaagaggugaaaucacacaucaugcaguuaguagaggcagugcaaaauuacaaugguuuguugagagaaauauggucauaccagaaggacgaguaauugauuuaggcuguggaaggggugguuggucguauuauugugcuggccucaagaaaguuaccgagguaaggggauauacuaaaggugguccugggcaugaagaaccaguaccgaugagcacauauggauggaauauaguaaaacuuaugucggguaaggacguauucuacuugcccccugaaaaaugugauacacugcuuugugauaucggagaaagcaguccgagcccaauagucgaagaaucaagaacaauaagaguucuuaagaugguagaaccguggcucaaaaauaaccaauucugcauuaaaguuuugaacccuuacaugccgacuguaauagaacauuuagaaaggcugcaacguaagcauggaggaauguugguacguaauccgcugagucgcaauucaacucaugagauguauuggauuucaaacggaacugggaauauuguggcaucugugaacaugguuucacgauuacucuugaauagauucaccaugacacaucgacgcccaacaauagagaaagacgucgaucuaggagcaggaacucgucacgugaaugcagagccugaaacaccgaacauggauguuauaggagaacguauaaaacguauaaaagaagaacacaacucaacauggcauuaugacgacgaaaauccauacaagacaugggccuaucauggaucauaugaagucaaagccacaggaagcgcaucuaguaugauuaauggugugguuaaguuauuaacgaaacccugggacguaguccccaugguuacacagauggcuaugacugacacaacuccguuuggacagcaacgaguauuuagagaaaagguagauacacgcacuccuagaucgaugcccggaacacggcgggucauggguauaacagcagaguggcuauggaggacguuggggagaaauaagaaaccuagacuguguacgagagaggaauuuaccaagaaaguucguacuaaugccgccaugggugcgguauuuacugaggagaaccagugggauagcgcgaaagcggcuguugaagaugaagauuucuggaaauugguagauagagaacgugaauuacacaaacuugguaaauguggcucauguguuuauaacaugauggggaaaagagagaagaaacuaggagaguucggaaaagcaaaggggagcagagcgauaugguacauguggcuaggcgcaagguaccuagaauuugaggcacuaggauuucucaaugaagaccauugguuuucgagagaaaacaguuauucagguguugagggagaaggcuugcauaaauuagguuacauccugagggauauuaguaaaauaccagguggggcgauguaugcggacgacacagcuggcugggauacucgaauaacugaggacgauuuacacaaugaagaaaagauaacacaacaaauggacccagagcaccgucaacucgcaaacgccauauuuaaacugacguaucaaaauaaaguagucaaaguucaaagaccgacuccaacaggaacaguaauggauaucauaucucggaaagaucaaagaggcagcggccaagugggcacuuauggguuaaauaccuuuacaaacauggaggcacaauuaauucgacaaauggagggcgagggcguacuuaguaaggccgaccuggaaaauccacaucuaccugagaagaaaauaacgcaaugguuggaaaccaaaggugucgaacgucugaaacggauggccauuucaggagacgauuguguaguaaaaccaauagacgaucgguucgcuaacgcacuacuagcuuugaacgacauggguaaagucaggaaggacauaccccaguggcaaccaaguaaaggauggcaugauuggcaacaagugccuuucuguucacaccacuuucaugagcugauuaugaaagauggacgaaagcuaguuguuccaugucgaccucaagaugaauugauaggccgagccaggauuucacagggagcgggauggaguuugaaagaaacagcgugccuaggaaaggcauaugcccagauguggucucuaauguauuuucauagaagggacuuaagacuagcuucgaacgcaaucuguucagccguaccuguccauugggucccgaccagcaggacuaccuggucgauucaugcccaucaccaauggaugacuacugaggacaugcuaacuguuuggaaucgagucuggauugaagauaauccauggauggaggacaaaacaccagucacgacgugggaaaaugucccguacuuagggaaacgugaagaucagugguguggaagucuuauaggauuaacaucaagagcaacuugggcacaaaauauaccaacagcaauccaacaaguaagaagucuaauaggcaaugaagaauuuuuggauuauaugccgucaaugaaacgcuuccgaaaagaggaagagagcgaaggagcuauuugguaa

SEQ ID NO: 23207 - RNA, 9873 nt, Artificial Sequence
  derived and/or modified CDS sequence (opt6) from DENV-3__HQ705610__SS-prME
acaagucuaugccuuaugaugauucuaccugcugcucuagcauuucaccuuacuagcagagacggagaaccacggaugauuguaggcaaaaaugaaaggggcaaaagccuguuguuuaaaacugcaucgggcauuaacauguguacauuaaucgcaauggacuuaggagaaaugugugaugacaccgugacauacaaauguccucauauaacagaaguagaaccagaagauauagacugcugguguaaucuaacaaguacuuggguaacguacggaaccuguaaucaagcaggagaacacagaagagauaaaaggaguguagcauuagcuccacacguaggaaugggcuuagacacuaggacacaaacguggaugucugcagaaggagcauggagacaagucgaaaaaguagaaaccugggcucuccgccacccagguuuuacuauauuagcccuauuccuagcccauuacaucgguaccucacuaacucaaaaaguaguuaucuuuauauugcuaaugcuuguaacuccaaguaugaccaugaggugcguagguguagguaauagagauuuuguggaagggcuaaguggugcuacaugggucgauguuguacuagaacauggaggauguguuacaacaauggccaaaaauaaaccaacacuagacauagaacugcagaaaacggaagcgacccaacuugcgacucuccguaaauuauguauagaaggaaaaauaacaaauauaacaacugauagccgaugcccuacucaaggagaggcuacacuuccugaggaacaagaucaaaauuauguaugcaaacauacuuauguagaccgaggaugggggaauggcuguggacucuuuggaaaaggaucuuuagugacaugugcgaaauuccaaugccuugaaccaaucgaagggaaaguugugcaauaugagaaucuuaaauacaccgugauuauaacgguucauaccggugaucaacaucaaguaggaaacgaaacccaaggaguuaccgccgagauuacaccacaggcuucuacgacagaagcaauacucccugaauacgggaccuuagggcuagagugcaguccucguacaggcuuagauuucaacgaaaugauucuuuuaaccaugaaaaacaaagcauggaugguccauagacaaugguucuuugaccugcccuuaccauggaccuccggagcaacaacugaaacaccuaccuggaaccgaaaagaacuuuuggugacauuuaaaaacgcacacgccaagaaacaagaaguagucguguugggaucgcaggagggugcaaugcauacagcacucacaggagccaccgaaauacaaaauucugguggaacuucgauauuugcuggacacuugaaaugcagguugaaaauggauaaacucgaacuaaaaggaaugucuuaugccaugugcacuaauacauuuguacucaagaaagaaguaucagaaacucagcacggaacaauauugauuaaaguggaauacaaaggugaggaugugccuuguaaaauuccauucucgacugaagauggacaagguaaggcacauaauggacgacugauaacagccaaccccgugguaacuaagaaggaagaaccaguaaacauagaggcggaacccccauuuggggagucuaacauagucauugguauuggugauaaugcacuaaaaaucaacugguauaagaaaggaagcagcauuggaaagauguuugaagcuacggcacguggugcacgucgaauggcaauacucggggauacagcaugggauuuuggcaguguaggagguguucucaacaguuuagggaaaaugguucaccaaauauucggaucugcauauacugcauuauuuucuggagucucuuggguuaugaagaucgguauaggaguguuacuaacguggauuggauuaaauaguaaaaacacuagcaugucguuuagcugcauagcaaucggaauaauaacacuuuaucuuggggcaguuguccaagcagacauggguuguguaauaaacuggaaggguaaagaguuaaaaugugggucaggaauuuuuguaacaaaugaagugcauacauggacagagcaguauaaauuucaagcggacucgccaaaaagacucgcuacugccauagcuggggcaugggagaauggaguaugugggaucagaagcaccacuagaauggagaauuuguuguggaagcaaauugcaaaugaacuuaauuacauccuaugggaaaacaauaucaaauugaccguaguaguaggagacauaauaggaguucuggaacagggaaaaagaacacuaacaccucaaccgauggagcuuaaauauucguggaagacgugggggaaagcgaaaauaguuacagcugagacgcaaaauucaucuuuuauaauugacgguccaaauacuccggaauguccuagcgugucacgagcauggaauguaugggaaguagaggauuacggauuuggaguauuuacaacuaauauaugguuaaaauuacgugaaguauacacacaacucugugaucaucgacuaaugucugcagccgucaaggaugagagagcugugcaugcggauaugggauacuggauagagucgcagaaaaaugguaguuggaaauuagagaaggcuucuuuaaucgaaguuaaaacuugcaccuggccgaagucacauacgaucuggucaaauggugugcuagaaagcgauaugauaauucccaaaagucuugcagguccaauaagucaacacaaucauagacccggauaucauacacaaaccgccgggccuuggcacuuagguaaacucgagcuagauuucaauuauugcgaagguacuacuguaguaauaacagagaacugcggcacuagagguccaucauugcgaacuaccacaguaucaggaaaacugauucacgagugguguugccgaaguuguacacuacccccucugagauacaugggagaagacgguugcugguaugggauggaaauccgcccaauaucagagaaggaagagaauauggucaaaagccuaguaucagcgggcagcggcaagguagauaauuuuacuaugggugugcuaugucuugcaauacuauuugaagaaguaaugcgaggaaaauucggcaagaaacauaugauagcaggagucuuccuaacauucguucugcuucuaucggggcaaauaacguggaaagacauggcgcacacauugauaaugauuggcucuaacgcuucugaccguauggguaugggaguaacuuauuuagcucucauagcaacauucaaaauccaaccuuuucuagcucucggauucuucuugcgaaagcugacaaguagagaaaauuuauuauuaggaguuggguuagcaauggccacgacuuuacaauuaccugaagauauagaacaaauggccaaugguaucgcauugggccucauggcauuaaaauugauaacacaauuugaaacguaucaauuauggaccgcccucauaucccuaaccugcucaaauacaauaaguacucuaacaguugcuuggcgaaccgcaacuuuaauuuuagcaggaguuucccuacuacccgucugccaaucaaguaguaugcggaagaccgauuggcucccuauggcgguagcugcgaugggcgucccaccccugccuuuguuuauauuuagcuugaaagauacacucaaaagacggaguuggccgcuaaacgaaggaguaauggccguaggauuaguaucuauucucgccucaucuuuacuccgcaacgaugugccgauggcugguccuuugguugcaggcggauuauugauagcaugcuauguaaucacgggaacaucggcugauuuaacaguugaaaaggccgccgacaucaccugggaggaagaagcagaacaaacgggagucagucauaaucuuaugauuacgguagaugacgacgggacaaugcgaauaaaagaugaugaaacagaaaauauacuuacaguacucuuaaagacagcauugcugauagugagugguaucuuucccuauagcauaccugccacucuccuagucuggcauacauggcagaaacaaacacaaagauccgguguauugugggacguccccucaccucccgaaacgcaaaaggcagaacuugaggaaggcgucuacagaauaaaacaacaagggauauuuggaaaaacacaggugggagucggaguucaaaaagaaggagucuuccauaccauguggcaugucacaaggggugcaguguuaacauacaaugguaaacgguuagagcccaacugggccucugucaagaaagaccugaucuccuauggaggaggcuggaggcugagcgcccaguggcaaaagggggaagaaguucagguaauagcaguugaaccugguaaaaaccccaaaaauuuccagacaaugccaggaaccuuucaaacaacuacaggagaaauuggcgcgauagcucuagauuuuaaaccuggcacaucaggaucgccuauaauuaaucgagagggcaaagucguaggauuauacggaaauggaguagugacaaagaauggcggauauguuuccgggauugcccaaacaaaugcugaaccagaugggcccacgccagaguuagaagaagaaauguuuaagaaaagaaaccuaaccauaauggacuugcaucccggaucuggaaagacaagaaaguaucugccugcgauaguccgagaagccauuaaaagacgccuucgaacucuuauauuagcuccaacgagaguaguagcagcagaaauggaggaggcuuugaaaggguuacccauuagguaucaaacgacggcaacaaaaagcgaacauacgggcagagaaauaguagauuuaaugugccacgcaacuuuuacuaugcgacuuuuaucaccagucagggugccuaacuauaacuuaauaauuauggaugaagcccauuucacagauccagccaguaucgcagccagagguuauauuaguacaaggguagguaugggagaagcugcggcuaucuuuaugacugcuacaccaccgggcacagcagacgcauuuccccagucaaacgcuccaauccaagaugaagaaagagacauaccugaacgcucguggaauagcgguaaugaguggaucaccgacuucgcuggaaaaaccgucugguuugucccgucgauaaaggcuggcaacgauauagccaauugccugcgaaagaauggcaaaaagguaauacaauugaguagaaaaacuuuugauacagaauaccagaaaacuaaacuaaacgauugggacuuuguagucacaacugauauaucggaaaugggagcaaacuuuaaagcugauagagucaucgauccgcgacgaugcuuaaaaccaguaauucucacugacgguccugaaaggguaaucuuagcaggcccaaugccaguuacagcggcuagugcagcgcaaagaagagggagggugggccguaacccacaaaaagagaaugaucaauacauauuuacugggcaaccucugaacaaugaugaggaucacgcacauuggacugaagccaagaugcuuuuagacaauauaaacacgcccgaaggaauaaucccugcccuuuuugagccagaacgugaaaaauccgcggcgauugacggugaguauagauuaaaaggagagucccgaaagacguuuguugaacuaaugcgacgaggcgaucuaccaguaugguuagcacacaaaguagcgucggaaggcauuaaguauacugauagaaaaugguguuuugacgggcaacgaaauaaccaaauucuggaagaaaauauggacguagaaauauggacgaaggaaggagagaagaagaaauugcgaccaagguggcucgacgcuagaacauacucggacccauuagcuuuaaaagaauuuaaagaauuugccgcgggucggaagucaaucgcacucgaucuaguaaccgaaauuggacgaguacccagucaccuugcccauagaacuagaaaugcgcuggacaauuuaguuaugcuacauacaucagaacacggaggcagagcguaccgacacgcuguggaagaauugcccgaaacuauggaaacacuauuacuacuaggguuaaugauuuuacucacaggcggagcaaugcuauuccuaauaagcgguaaagguauagggaaaacaaguaucggguuaauaugugucauagcaucgaguggaauguuguggauggccgaaauaccgcuacaauggauugcguccgcuauagucuuggaguucuuuaugaugguccuuuuaauaccugaaccggaaaaacagaggaccccacaagacaaccaauuggcguauguaguaauuggaauacugacuuuagcagccauuauagcugcaaacgaaaugggacuucuugaaacaacgaagagagauuuagguaugagcaaggagccuggaguagugucucccacaaguuaucuggauguagacuuacacccagcaucugccuggacgcuauacgcaguagcuacuacaguaauaacgccaaugcucagacauacgaucgaaaacaguacagcgaacguaucacuagccgcuaucgcuaaucaagcuguuguacugaugggacucgauaaggguuggccuauaaguaagauggacuuaggagucccccuucuugcccuaggauguuacucgcaagugaauccauugacacuuacugcugcaguucucuuauuaauaacacauuacgcaaucauaggcccagggcuacaagcuaaagcaacgagagaagcacagaaaagaacggcagcaggaauaaugaagaaccccaccguagacgguauaaugacuaucgauuuagauccaguaaucuaugacuccaaguuugagaagcaacucggucaaguaauguuauuaguguuguguguuguccaauuacuucuuaugagaacgucuugggcucuaugugaggcauuaacauuagcuacaggcccaaucaccacacuaugggaaggcucuccugggaaauucuggaacacgacgauugcagugucgauggccaacaucuuccgaggaucauauuuagcgggugcaggauuggccuucagcauuaugaaaucagucggcacgggcaaaagaggcacagguucacaaggagaaacguuaggagaaaaauggaagaagaaauuaaaccaacuaucacgaaaagauuucgaucucuauaagaaaagcggaauuaccgaagucgaccgaacagaagcuaaagagggcuuaaagcggggcgaaaucacgcaucaugcaguuucucguggaucugcuaaacuacaaugguuuguagaacguaauaugguuaucccggaaggacguguaauagaucuaggaugcggcagaggaggaugguccuacuauugugccggucuaaagaaagugacggagguucggggguacacaaaagguggaccuggacacgaagaaccuguaccuaugucaacauacggauggaauauaguaaaauuaaugagugguaaagacguauuuuaucugccuccagaaaaaugugauacuuuacucugugauauuggagagucgaguccaaguccaaccguugaagaauccagaacaauacggguauuaaaaaugguugagccuugguuaaagaacaaccaguuuuguauuaaaguguuaaauccguacaugccaacagugauagaacacuuagaaaggcuacagcguaaacauggagggauguuaguuagaaauccauuaucacgaaauuccacccaugagauguacuggauauccaacggcacggguaauaucguagcuaguguaaacauggucagucgauuacuacucaauagauuuacaaugacacaucgaagaccaacaauugaaaaagacguagaucugggugcaggaacucggcacguuaacgccgaaccugagacacccaauauggacguaauuggugaaagaaucaaacgaauaaaagaagaacacaauucaacguggcauuaugacgaugaaaacccauacaaaaccugggcuuaucacggcucuuacgaagucaaagcaacuggaucggcgagcucuaugauaaacggagucgucaaauugcuaacaaagccaugggacguaguaccaauggugacucaaauggcuaugacugauacuacuccguuuggacaacaacguguguucaaagaaaagguugauacuagaaccccaagaucgaugccgggaacccgacgaguuauggggauaaccgccgagugguuauggcgaacacucgggcgcaauaagaaaccacggcuuuguacacgagaagaguuuacuaagaaaguuagaacaaacgcagcaaugggugcgguuuucacggaagagaaccagugggauucggcaaaagcugcgguagaagacgaagauuuuuggaaauugguugauagagaacgcgaacuucauaaauuaggcaaauguggguccugcguauauaauaugaugggcaaacgggagaagaaauuaggagaauuuggcaaagcaaaaggcucuagggcaauuugguauaugugguugggugcacgcuauuuagaauuugaagcacucgguuuucuaaacgaggaccauugguuuucaagagaaaacucuuacaguggaguagaaggagaagguuuacacaagcuaggauacauauuaagggacauauccaagauuccgggaggggcuauguaugcagacgacacugcuggaugggacacgcgaauaacagaagacgaucugcauaacgaagagaaaauaacacaacagauggauccugaacauaggcaacuagcaaaugcaauauuuaaacuuacauaccaaaauaaaguugugaaaguacaaagaccuacaccgacagggacaguaauggacauuauuucccggaaagaucaaagagguaguggacaaguaggaacauacggacugaauacauuuaccaauauggaagcacaauugauccgccaaauggagggagagggagugcuaucgaaagccgaccuagagaauccccaucuaccagagaagaaaauuacucaauggcuugaaacaaaagggguugaaagacucaaacgaauggcuauuucgggagaugauugcgugguaaaacccauagaugacagauuugcgaaugcacugcucgcucuaaaugauaugggaaaggugcgaaaagauauaccccaauggcagccaucuaaggguuggcaugacuggcaacaaguaccauuuugcucucaucauuuucacgaguuaauaaugaaagauggccguaaacugguaguaccuugucgcccgcaggaugaauugauugggagggcccgaaucagccaaggcgcaggauggucgcugaaagaaacugccugucuuggaaaagcauacgcgcaaauguggucacuaauguauuuucaccgaagggacuugagguuagccucaaaugcaauauguucggcagugccuguacauuggguuccaacaaguaggaccacauggagcauucacgcgcaucaccaguggaugacuacagaagauauguuaacagucuggaaucggguuuggaucgaagauaaucccuggauggaagauaaaacaccaguaacuacgugggaaaacguaccauacuugggaaagcgagaagaucaaugguguggaucauuaauagggcugacgucacgagccacgugggcucaaaauauucccacagcuauacagcaaguaagaucucuaauugguaacgaagaguuccuagacuacaugccaaguaugaaacgauucaggaaagaggaagaaucugagggcgcaaucugguaa

SEQ ID NO: 23208 - RNA, 9873 nt, Artificial Sequence
  derived and/or modified CDS sequence (opt6) from DENV-3__HQ705611__SS-prME
acaucauuaugucuaaugaugauucuaccugcagcacuggcauuucauuuaacaaguagagauggugaaccaagaaugaucguuggcaaaaaugaaagggguaaaucccuacucuuuaaaacagcaagugguauuaauauguguacuuuaauagcaauggacuuaggagaaaugugugacgacacaguuaccuacaaauguccgcauauuacagaaguagaaccagaagacaucgauuguugguguaaccuaacaaguacauggguuacuuaugggacauguaaccaagccggagaacaucgaagggacaaacguaguguugcgcuugcuccgcacguaggaaugggguuagacacaagaacccaaacuuggaugucugccgaaggagcguggcgucaaguagaaaaaguggaaacaugggccuuacgucauccaggguuuacuauucucgcacuauucuuagcccauuauauagguacuucucucacacaaaaaguaguaauauuuauccuauuaaugcuaguuaccccgagcaugacaaugcgguguguugggguaggaaaccgagauuuuguagaaggccucucaggagccacuuggguagauguaguauuagaacacggcggauguguuaccacaauggccaaaaauaaaccaacauuagauaucgaacuccagaaaacugaagcuacacaauuagcuacgcucagaaaauuauguauagaagguaaaauuacaaacaucacaacugauaguagguguccuacccaaggugaagcuacacuaccugaagaacaagaucaaaauuacgucugcaaacacaccuauguagacagggguuggggaaaugguuguggacuuuuugguaaagguagucuaguaacaugugcaaaauuucaauguuuagaaccgaucgaagguaaaguaguacaauaugaaaaccucaaauauacuguaauuaucaccguacacacaggagaccaacaccaaguuggcaacgaaacccaaggaguaacggcagaaauaacgccacaagcauccacaacagaggccaucuuaccagaauauggaacucuaggccuagaaugcucaccuaggacuggacuugauuuuaaugagaugauacuucuaaccaugaaaaauaaagcauggaugguccauaggcaaugguucuuugauuuaccguuaccauggacaagcggugcuaccacugagacaccaacauggaauagaaaagagcuacuuguaacauucaaaaacgcacaugcaaagaaacaagaaguaguagugcuaggcagucaagaaggagcuaugcauacagcucuuaccggagcuacagaaauccaaaacucugguggaacuucuauauuugcuggacauuuaaaauguagguuaaaaauggacaaacuggaacugaaaggaaugucuuaugcaauguguacgaauacuuucguacuaaagaaagaaguaagugaaacucaacacggaacaauacugaucaaaguagaguacaaaggagaagacgugccuugcaaaaucccauuuaguacggaggaugggcaagguaaagcacauaacgggagacuuauaacggcuaauccaguaguuaccaagaaagaggagccaguaaacauagaggcagaaccaccguucggcgaguccaauauaguuauaggcaucggagauaaugcacuaaaaauaaauugguauaagaaaggaaguagcauaggcaaaauguucgaagcaacugcgagaggagcucggagaauggccauacuaggugauacggcgugggauuucggaucggucgggggaguguuaaauagccucggaaaaauggugcaucaaaucuuugguucagccuacacggcucuauucucugguguuucauggguaaugaagaucggaauuggaguauugcuaacauggauaggccuaaauagcaaaaauacaaguaugaguuuuucuugcauugcuaucggcauuaucacgcuauacuuaggagcaguaguccaagcugauaugggaugcguaauuaacuggaaaggcaaagaacugaaauguggaagcggaauauucgugacgaaugagguccauaccuggaccgagcaauauaaguuucaagccgauagcccuaaaaggcuugccacagcaauagcaggcgcuugggaaaacggugugugcggaauuagaaguacuacuagaauggaaaaccuauuauggaaacagauagcaaacgaacuaaauuacaucuuaugggagaacaacauaaaacuaacugucguaguaggugauaucaucggugugcuagaacaggguaaacgaacauugacaccacaaccuauggaauugaaauacucauggaagacgugggguaaggccaagauagucacggcugaaacacaaaauucuaguuucauaauugacgguccaaauacgccagaaugcccaaguguuuccagagcuuggaauguuugggaaguagaggauuauggguuugggguuuuuacaacuaacauaugguuaaaauugagggaagucuacacacagcuaugugaucacagacucaugucagcugcaguaaaggacgaaagagcaguacaugcggauaugggauacuggauugaaucucagaaaaaugggucuuggaaacucgaaaaagcuagccuaauagaagugaaaacuuguacauggccuaaaucacacacccuauggucgaacggggugcuugaauccgauaugaucauuccaaaauccuuagcuggaccuauuucccagcauaaucaucggcccggcuaucacacacagacugcaggcccuuggcaucuaggcaaguuagaguuagauuuuaauuacugugaaggcacaacuguaguuauaacggaaaauugugggacuaggggaccgagccuccgaacgacgaccguaucaggaaaauugauacacgaauggugcuguagaucgugcacucuucccccacuccgguauaugggggaagacggauguugguaugggauggaaauaaggcccauaucugaaaaggaagaaaacaugguaaaaucgcuagugagugcaggcucaggcaagguugauaacuuuaccauggggguguuaugcuuagccaucuuauucgaggaaguaaugcguggcaaguuugggaagaaacauaugauugcaggagucuucuuuacguucguguuauuacuaaguggacagauaacuuggagggauauggcucauacacuaauaaugaucggaucaaaugcuagcgauaggaugggaauggguguaacauaccuugcuuuaauugcgacuuucaaaauacagccguuucuagcccuaggauuuuucuuaagaaaauuaacaucgagagagaacuuguuauuagguguagguuuagccauggcgacuacccuacaauuaccagaagacauugagcaaauggcaaauggaauugcauugggccuuauggcauuaaaacuaauaacgcaauucgaaacauaccaacucuggacagcgcuuaucagcuuaacaugcucgaauacuaucuucaccuuaacaguagcauggagaaccgcaacccucauacucgcuggugucucguuguuacccgucugucaguccuccaguaugagaaaaacugauuggcuaccaauggcuguggcugcaaugggagugccaccauugccacucuuuauauuuggacuaaaagacacgcugaaaagacguaguuggccacucaaugaaggaguaauggcgguaggcuugguaagcauucuggcgucaucuuuauuaaggaaugacguccccauggcuggaccuuugguugcaggaggacuccuaauugcauguuacgucaucacaggcacaucagcugauuuaaccguggaaaaagcagcagacauaacaugggaagaagaagccgagcagacaggcgugucccauaaccuaaugaucacgguagacgaugauggaacgaugcguauaaaagacgaugagacugaaaauauacuaacaguauuauuaaaaacagcucugcuuauagugaguggaaucuuuccauauaguauaccugcgacacuccugguguggcauacuuggcaaaaacaaacccaaagaagcggaguacuuugggauguuccaaguccaccggaaacacagaaggcagaauuagaggaagggguuuacaggauuaaacagcagggaauauuugguaaaacacaaguaggcgucggaguacaaaaagagggaguuuuucacacuauguggcaugugacacgaggagcaguucugacauacaauggaaagagauuggagccaaauugggcaagcgucaagaaagacuuaauaucauacggaggaggauggagacuaucugcacaguggcaaaaaggagaagaaguacaaguuauagcuguugaaccaggaaagaaucccaaaaauuuccaaaccaugccgggcacuuuucagacaacgacaggagaaauaggagcuauagcguuagacuuuaagcccggcacaucagguucaccaauaaucaauagagagggcaaaguugucggacucuacgguaacgggguaguaaccaagaaugguggauacguuucugguauugcacagacaaaugcagaaccggacggaccgaccccagagcuagaagaggaaauguucaaaaagagaaaucuuacaaucauggaccugcaccccggcaguggaaaaacgcgaaaauaucuuccugcuauaguuagggaggcgaucaaaagaagacuaagaacgcucauacuagcacccacacgaguaguugcugcagagauggaagaagcucuaaaggguuuaccaaucagguaccaaacaacagcaacaaaaucagaacacaccggucgagagauuguagauuugaugugccacgcaacauuuacaaugagauuauuaaguccugucagagugccaaacuauaacuuaauaaucauggacgaagcacacuucacagacccugcaaguauagcugccagggguuauauaucaacuagaguaggaaugggagaggcagcggcaauauucaugaccgcuacaccgccaggaaccgcagaugccuuuccucaaagcaacgccccaauacaagacgaagaaagagacauaccugagagaagcuggaacucugggaaugaauggauuacugauuucgcaggaaaaaccguaugguuuguaccuagcauaaaagccgguaaugauaucgcaaacugcuuacggaaaaauggaaagaaggucauccaguuaucgcguaaaacauucgacaccgaauaucagaaaacgaaguugaaugacugggauuuuguugucacgacagauauaucagagaugggugcaaauuuuaaagcagaucgagugauugacccaagaagaugucucaaaccgguuauuuuaacugauggaccugaaaggguaauauuagcaggcccaaugcccgucacggcagcaagcgcggcucagagacgaggucguguggguagaaauccucaaaaggagaaugaccaguauauauucaccgggcaaccacuaaacaaugaugaggaucaugcucauuggaccgaagcgaaaauguuauuagauaauauuaacacacccgaaggaauaaucccggcauuguucgagccggaaagagagaaaagugccgcuauugauggcgaauacagacuaaagggagaaagucguaaaaccuuuguugaacuaaugcgaagaggggaucuucccguauggcucgcacacaaaguggcgucagagggcauuaaauacacggacagaaaauggugcuucgacggucagagaaauaaucaaauauuagaagaaaauauggacguagaaauuuggaccaaagagggagagaagaagaaacuccgaccucguuggcuggaugcgagaaccuacagcgauccucuagcacuaaaagaguuuaaagaguuugcugcggggaggaaaucuauugcacuggaccucguuacagaaauuggacgagucccuucccacuuagcgcacagaacuaggaacgcacuagacaaccuagugauguuacacacgagugagcauggagguagagcuuacagacaugccguagaggaacuccccgaaacgauggaaacgcuauuacuacuaggucucaugauucuacuuaccggaggcgcgaugcuauuccuuaucagugguaaagguaucggaaaaacaucaauaggguuaauaugugucauagcuucaagcggcaugcuauggauggcagaaauaccguuacaauggauagcaucagcuaucguucuagaguucuuuaugaugguuuuacuuauccccgaacccgaaaagcaacgaacaccacaagauaaucaauuagcauacguuguaaucggcauacuaacuuuagcagcgaucauugcagccaacgaaaugggauugcuagagacgacgaaaagagacuuaggaaugaguaaagaaccaggcguaguaaguccuacuucauaccucgauguagaccuccacccagccucugcauggacccuuuaugcgguagcuaccacaguuaucacacccaugcuaagacacacaauagaaaauucuaccgcaaacguuucauuggccgcgauugcuaaccaagcagucguucuaauggguuuagauaaagguuggccuauaucaaagauggaucuuggaguucccuuacuugcauuagguuguuauagucaagucaacccguuaacucuuacugcagcgguauuauuauuaauuacccauuaugcuauaauaggccccggacuccaggcaaaagcuacacgagaagcucaaaagcgaacagcagccggaauaaugaaaaacccaacggucgacggaauaaugacaauugauuuagauccuguuauuuaugauucaaaauucgagaaacaacucgggcagguuaugcucuuaguauuaugugccguacaacuuuuauuaaugagaacaucuugggcgcuaugcgaagcacucacacuggcaacagguccaauuaccacccuuugggaagguucuccuggcaaauucuggaauaccacuauagcagugucuauggcaaauauauuuagggguagcuauuuggcuggagccggccuagccuuuaguauaaugaaaagcguggggacaggaaaaaggggaacgggcucacagggagaaacacugggagaaaaguggaagaagaaauuaaaucaauuaagucgcaaagauuuugaucuauacaagaaauccggaauaacagaaguagauagaacugaagcaaaagagggauugaagaggggagaaauaacacaucacgccguuagccgcggcuccgcgaaacuccagugguuuguagaaagaaacaugguaauacccgaaggccgaguaauagaccuugggugcggucgcggaggguggucuuauuacugcgcaggccugaagaaagugacugagguacgaggauauacaaagggcggaccgggucaugaagaaccgguaccaauguccaccuacggguggaauauuguaaagcuaaugagcgggaaagauguuuucuaucuuccgccggaaaaaugcgacacacuauuaugugacauuggcgaaagcucuccaucuccaacagucgaagaaucgagaacaauucguguauuaaaaaugguggaaccuuggcuaaagaacaaucaauuuugcauuaaaguacuaaauccauauaugcccacuguuauagaacauuuagaacgacuucaaaggaagcacggagggaugcuagugcgcaaccccuuaagucgaaacaguacucaugaaauguacuggauaaguaaugguacaggaaacauaguagcaucagucaauaugguuuccagguuacuccucaaccgcuucacaaugacgcauaggcgacccacaauagaaaaagacguggaccucggggcuggaaccaggcauguuaacgcugaaccagagacaccgaauauggaugugauaggagaaagaaucaagaaaauaaaggaagaacauaauagcaccuggcacuaugaugacgagaauccuuacaaaacgugggccuaccaugggucauaugaagucaaagcaaccggaucugccagcagcaugaucaauggcguaguaaaacuucuaacaaaacccugggauguuguacccaugguaacucagauggcaaugacugacacaacgccauuuggacaacagagaguuuuuaaggaaaaggucgauaccaggacuccucgaucaaugccgggcacuagaaggguuaugggaauuacagccgaaugguuauggcgcacacuagguagaaauaagaaaccuagguuauguacaagggaagaauuuaccaagaaaguacggaccaaugcugcaaugggggcaguauuuacagaagaaaaucagugggauagcgcuaaagccgcuguagaagaugaggacuuuuggaaauuagucgaccgcgaaagagaauuacacaaguuagggaaauguggcucuuguguauacaauaugaugggaaaacgggagaagaaauuaggugaauuugguaaagcuaaagguaguagggcaauaugguauaugugguuaggcgcuagauaccuugaauuugaggcuuugggauuccuaaacgaggaccauugguucucacgagaaaauuccuauuccggaguagaaggugaagggcuucauaaauuagguuauauacuuagggauauaucuaaaaucccaggaggggcaauguacgcugacgacacugccgguugggauacgcgaauaaccgaagacgauuuacauaacgaagagaaaauaacacagcaaauggauccagaacauagacaacucgcgaaugcgauauucaagcugacauaucaaaauaaaguaguaaagguucaacgaccuacacccacaggaaccguuauggacauaauaucccgaaaagaccaacgagguuccggacaaguaggaaccuacggccugaauaccuucacuaauauggaggcacaauugauccgucaaauggagggagaaggaguuuuaaguaaagcagauuuagaaaauccucaucuaccagagaagaaaauaacgcaauggcuagaaacaaaagggguugaaagauugaaacggauggcaaucuccggugacgauugcguuguaaaacccaucgaugauagguuugcuaacgcuuuacuagcgcuaaaugauaugggaaaaguaaggaaagauauaccccaguggcaaccgagcaaaggauggcaugauuggcaacagguaccauuuuguagccaucauuuucacgagcuaauaaugaaggacggacgcaagcuagugguaccauguaggccacaggacgaauuaaucgguagagcccgaauuagccagggugcaggauggucacuuaaagagacagcauguuuaggaaaagccuacgcucagauguggagccuuauguauuuucauagaagagaccuccgguuagcaagcaaugcuauaugcuccgcuguucccguacacuggguacccacaucucgaacaacauggagcauccacgcacaccaucaguggaugacgacugaagauauguugacagucuggaauaggguauggauagaagauaauccguggauggaggacaaaaccccagucacuacaugggagaauguaccauaucuggggaagcgagaagaucaguggugugggagucucauuggacugacaagccgggcuacaugggcccagaauauaccuacugcaauacagcaagugagguccuuaauuggaaacgaagaauuucuagacuauaugccaagcaugaagagauuuaggaaagaagaagagucugaaggagcuauaugguga

SEQ ID NO: 23209 - RNA, 9873 nt, Artificial Sequence
  derived and/or modified CDS sequence (opt6) from DENV-3__HQ705612__SS-prME
acaagucuauguuuaaugaugaucuugccugcugcauuagcguuucaccuaacaucaagagauggagaaccacgaaugaucguugguaaaaaugagaggggaaaaagucuacuauucaaaacugcaagcgguauaaacauguguacuuuaauugcgauggacuuaggagaaaugugugaugacacggugacauacaaaugcccacacauaacagagguggaaccagaagauauagauugcuggugcaauuugacaucuacaugggugaccuaugggaccugcaaccaggcaggggagcacagacgcgauaaacgaucaguugcauuagcaccgcauguuggaaugggauuagauacaagaacacaaacguggaugagugccgagggugcuuggcgucaaguagaaaaaguugagaccugggcuuuaagacauccaggauuuacuauauuagcucuguuuuuagcgcacuauaucgggaccagcuuaacucaaaaaguaguaauuuucauacuucuaauguugguaacccccaguaugaccaugagaugugugggcgugggcaacagagauuuuguggaaggauuaucaggugcaacauggguagauguaguuuuagaacauggugguugcguaacuacaauggccaaaaauaaaccaaccuuagauauagaguuacagaaaacagaagcgacucaacuagcuacucuucgaaaacuaugcauugaggggaaaauaaccaacauaaccaccgauaguagaugccccacucaaggagaagcaacuuugcccgaggaacaagaccaaaacuacguuugcaaacauacauacguggauagaggaugggggaacggguguggccuguucgguaaaggaagucuaguuacgugcgcgaaauuucaauguuuagaaccgauagaaggaaagguagugcaauacgagaaccucaaauacacuguuauuaucacuguacauacgggugaccaacaccaaguuggaaaugaaacacaaggaguuacagcagagauuacgccccaagcuaguacgacagaagcaauacuuccagaauaugguacuuuaggacuagaauguagcccgcgaacuggacuggauuucaacgaaaugauauuacuaaccaugaaaaauaaagcguggaugguucaucgacaaugguucuuugaccuuccucuacccuggacuucuggugcaacuacggaaacaccgacuuggaauagaaaagaguuauuggugacuuuuaaaaaugcucaugcgaagaaacaagaagucguaguauuaggaucacaggaaggagcuaugcacacugccuuaacaggggcuaccgaaauacaaaacaguggcggaacaucaauauucgcagggcaucucaaaugccgacuuaagauggauaaauuagaacucaaaggaaugagcuacgcuaugugcacgaacacguucgugcuaaagaaagaaguuuccgagacccagcacggaaccauuuuaauaaaaguagaguauaaaggggaagauguaccaugcaaaauuccuuuuagcacagaggacggccaaggaaaggcacauaauggucgccuaauaaccgcaaauccgguagugaccaagaaagaagaaccagucaacauagaagcugaaccuccauuuggggaaucaaacauugugauuggaaucggagauaaugccuuaaagauaaauugguacaaaaagggaucuaguauaggaaagauguuugaagccacugcacgaggagcacguagaauggcaauauuaggagauacagcuugggauuucggauccguaggagggguauuaaacucacuugguaagaugguccaucaaauuuuuggaagcgccuauaccgcguuauucagcgggguuucauggguaaugaaaauagguauugguguacuacuaaccuggauaggucugaacaguaaaaacacaucuaugucguucuccugcauagcgaucgggauuauaacguuauaucuaggagccgucguucaagcagacaugggaugcguaauaaacuggaaaggaaaagaacucaaaugcggcucuggaauuuuuguuaccaaugaaguucacacuuggacagaacaauauaaauuccaagcugauucgccaaagcgccuagcgacggcaaucgccggugccugggaaaaugggguuugugguaucaggucaacuacaagaauggaaaacuuauuguggaagcaaauugcuaacgaacuuaauuacauauuaugggagaauaauaucaaacuuaccguuguagugggugacauuauaggagugcucgaacagggcaaacgaacgcuaacgccacaacccauggaauugaaauacuccuggaaaaccugggguaaagcgaaaauaguaacagcagaaacccaaaauucgaguuuuaucauugauggaccaaacacgcccgaaugcccgucaguaucaagagcuuggaauguaugggaaguagaggauuauggauucgggguauuuaccacaaauauuuggcuaaaacucagagaaguauacacucaacuaugugaucauaggcuuaugucugcagcugucaaggaugagagagcaguacaugcagauauggguuacuggauagaaucucagaaaaaugggucguggaaacuagagaaagccagucuaauagaagucaaaacauguacauggccaaaaagccauacgcucuggucuaauggggucuuagagagcgauaugauaauaccuaaaucauuggcuggaccaauuagucaacauaaccaccgcccgggcuaucacacacaaaccgcaggaccauggcaccucggaaaacuugaauuagauuuuaacuacugcgaagguacaacagugguaauaacggaaaauugcggaacaagaggaccuaguuuacgaacaacgacuguuucaggcaaauugauacacgaaugguguuguagauccugcacauugccaccacuaagguauaugggagaggacggauguugguauggaauggagauuagaccaauuagugaaaaagaagaaaauauggugaaaucuuuaguaucugcaggcucagguaaaguagauaauuuuaccaugggaguucuaugccucgcaauccuuuucgaggaaguuaugagaggaaaauucggcaagaaacacaugauagccggggucuucuuuacauucguacugcuuuuaaguggacagauuaccuggagggacauggcccacacccugaucaugauaggaucuaaugcaucagauagaaugggaaugggaguaacguacuuagcgcuaauugcgaccuuuaaaauacagccauuccucgcuuuaggcuuuuuccuuagaaaguuaaccagucgagaaaaucuauugcucggggugggguuagccauggcgacuacucuccaguuaccagaagauauagaacaaauggccaacggaauagcucuuggauuaauggcucuuaagcugauaacccaauuugaaacauaccaauuauggacugcucuuauuagccucacgugcaguaacacaauuuuuacgcuuacaguagcguggaggacugcuacccuuaucuuggcaggcguaagucuguuaccaguuugccaaucaagcucuaugagaaaaacagacuggcuucccauggccguagcagcgauggggguaccgccauuaccauuguuuauauucggacuaaaagauacucuaaaaaggcgaucuuggccccucaaugagggcguuauggcgguaggguuaguuuccauacuggcgucaucauuguuaaggaacgauguaccaauggcaggaccccuaguagcugguggucuucuuauagccuguuaugucauaacugguaccagugcggacuuaacaguagaaaaagcagcagacacaacaugggaagaagaagcagagcaaacugguguaucacacaaucuaaugaucacgguggaugacgacggaacaaugcguauaaaggaugacgaaacggagaauauucucacgguuuuacuaaagacagcacuuuugaucguaaguggcauauuuccauacaguauacccgcgacacuccuaguuuggcauacuuggcaaaagcaaacacaaagaucugggguccugugggauguuccgucaccaccugagacucagaaggcugaauuagaggaagguguuuacaggauaaaacaacagggaauauucgguaaaacacaagugggaguuggaguacaaaaggaaggugucuuucauacaauguggcauguuaccagaggagcagugcuaacucauaaugguaaacgacuugaaccaaacugggcgucuguaaagaaagauuuaauuucauauggaggaggauggagguuaagugcgcaguggcaaaaaggagaagaaguccaaguuauugcugucgaaccagguaaaaaucccaaaaauuuucaaacaaugccagggacauuucaaaccaccacgggugaaaucggcgccauagcacucgauuuuaaacccggaacgucugguaguccuauaauaaauagagagggcaaagucguaggucuguaugguaauggaguuguuaccaaaaauggaggguaugucagcgguauagcacaaacuaacgcugaaccagaugguccaacaccagaacuggaagaagaaauguuuaaaaagcgaaaccuuacgauaauggaucuacauccuggaucaggaaaaacgcguaaauacuuaccggcgauaguucgagaagcuauaaaacggcgacuaagaaccuuaauacuggcaccuacgaggguaguagcagccgaaauggaagaagcucuaaaaggacuaccaauacgauaccaaacgacugcaacuaaaucagaacauacuggaagggaaauaguggaucucaugugccacgcuacauucacaaugagacuucugucaccugucagagugccaaauuauaaccuuauuauaauggacgaagcacauuucacagauccagcuucgauugcggccagagguuauauaagcacccggguaggaaugggugaagcagcugcaaucuuuaugacagcaacuccuccggguacggcagacgcuuuuccccaaaguaacgcaccaauacaggacgaagaacgagauauaccggaacgaucuuggaauagugggaacgaauggauaacagauuucgcagguaaaacuguuugguucguaccaaguauuaaagcaggaaacgacauagcaaacugccuacguaaaaacgguaaaaagguuauacaauugagcagaaaaaccuucgacacagaauaccagaaaacgaaguuaaacgacugggauuuugucgugacuacggauauuucagaaaugggggcaaacuuuaaagcggaccgagugauagauccaagaaggugucuuaagccgguuauucucacagacgguccagaacgaguaauauuggcagggccaaugccaguaacugccgcaucagcagcucaacgacguggacgagugggacgcaacccacaaaaagaaaaugaucaauacauuuuuaccggccaaccacugaacaaugaugaagaucaugcccacuggacugaagcaaaaauguuacuggauaauauaaauacucccgaaggaauaauucccgcgcuauuugaaccugaaagagaaaaaucggccgcuauagacggcgaauauagacugaagggagagagucgcaaaaccuucguggaguuaaugaggcgaggugaucuuccuguauggcuagcgcacaaaguagcuagugaaggcauaaaauauacagaccguaagugguguuucgauggacaaagaaacaaucagauuuuagaagaaaauauggacguugagauuuggacaaaggaaggcgagaagaagaaacuucggccaagauggcuagacgcccguacuuacagcgacccgcucgccuuaaaagaauuuaaggaauuugccgcaggacgaaaaaguauagcauuggacuuagugacagaaauagguaggguaccgagucauuuggcucacaggacaaggaaugcccuugauaacuugguuauguugcacacgagugaacauggugggagagcuuauagacacgcaguugaagaacucccagaaacgauggaaacucuacuucuauuaggguuaaugauauugcuaacugggggagcaaugcuauuucuaauaucuggcaaaggaaucggcaaaacgaguauaggccuaauuugcgucaucgcaucaucaggcauguuauggauggcagagauaccccuacaauggauagcaagugcaauuguacuagaguucuuuaugaugguauuauuaaucccagaaccagaaaagcaacgaacuccacaggauaaucaauuagcguacgucguuauugguaucuuaacccuugcugccauaauagcggcgaacgaaaugggauuacuggaaacgacgaaaagagacuuagguaugucgaaagaaccagguguggucuccccuacaagcuaucuugacguugauuugcacccagcauccgcuuggacacuguacgcagucgccacaacgguaauuaccccaaugcuucgucauaccauugaaaauucgacagcuaauguaucacuggcugcuaucgcuaaccaagcuguuguauugaugggguuggacaaggguuggccaaucucuaaaauggauuuaggaguaccacuucucgcacuaggguguuauucucaggucaauccauuaacacuaacagcagcagucuuacuauuaauuacacauuaugcaaucaucggaccaggccuacaggcaaaggcaacacgagaagcccaaaaacggacagccgcagguaucaugaaaaacccaacuguugacggaauuaugacuauagaccuagauccagucauuuaugauaguaaauucgaaaaacaacugggacaaguuauguuauuaguguuaugcgcaguacaacuucuccuuaugagaacauccugggcauuaugugaagcacuuacauuagccacugggccaauuacgacacuaugggaaggaucgccuggcaaauucuggaacacaacaauagcuguaucuauggcuaauauuuuccgagguucuuauuuagcaggcgcuggacucgcauuuagcauaaugaaaucaguagguacaggaaaacgaggaacggguucacaaggugaaacauuaggagaaaaguggaaaaagaaacuaaaucaguugaguagaaaagauuuugaucuuuacaagaaaucagguauuacugaaguagauagaacggaagcaaaagaaggacugaaacgaggagaaauuacgcaccaugcugucucuagggguucugccaaacugcaaugguuuguagaaagaaauauggucauuccugagggacgaguuauagaucuaggaugugguagaggaggcuggagcuauuacugcgcaggacuuaagaaaguuacagaaguaagagguuauacuaaaggaggacccggacaugaagaaccaguuccaaugucaacauaugguuggaacauagucaaacuaaugucaggcaaagauguauuuuauuugcccccagaaaagugcgacacucugcugugugacauaggagagucuaguccgucaccgacagucgaagaaucaaggacuauaagaguucugaaaaugguggagccauggcucaagaauaaccaguuuuguauuaaaguauuaaacccauauaugccuacagucauugaacauuuggaacgacuucagagaaaacacggaggcaugcuaguacguaacccauugucccgaaauucgacgcacgagauguauuggauuaguaauggcacagggaacauuguagcaucugucaauaugguuucaagacuucuccuaaauagguucacuaugacacauagacgaccaacaaucgagaaagacgucgauuugggagcaggcacacgacauguaaaugcggagcccgaaacgccaaauauggaugugauuggagaaagaauuaagagaauuaaagaggagcauaauucaacauggcauuacgaugacgagaauccguacaaaacgugggcguaccauggaaguuacgaggugaaagccacaggaagugcaucgaguaugauuaacgggguugucaaacuauuaacaaaaccaugggacguuguaccaaugguuacgcaaauggcaaugacugauaccacaccauuuggucagcaacggguauuuaaagaaaagguagacacaagaaccccacgcagcaugccaggaacccguaggguaauggggaucacagccgaauggcuuuggagaacucuaggacgaaauaagaaaccacgguuauguacaagagaagaauuuaccaagaaagucagaacaaacgccgcaaugggugcaguguucacggaggaaaaccaaugggauucugcuaaggcagcagucgaagacgaggauuuuuggaaauuagucgaccgugaacgagaacuacacaaguuagguaagugugguuccugcguuuauaauaugaugggaaaacgagagaagaaacuuggggaauuuggaaaagcuaaaggcucaagagcaaucugguauauguggcuuggcgcgagauauuuagaauuugaagcgcuaggauucuuaaacgaggaccacugguucagcagagaaaauucguauucggggguagaaggugagggacuacauaaacuuggcuacauucuaagagauauuucuaaaauacccggcggcgccauguaugccgaugauaccgcgggaugggauacaagaauaacugaagaugaucugcacaacgaagagaaaauuacacagcaaauggacccggaacauaggcaauuggcgaaugcaauuuucaaacuaaccuaccaaaauaagguugugaaagugcaaagaccuacuccaacuggaacagucauggauauuauuucacgaaaagaucaaagaggcucaggacaaguaggaacuuauggcuuaaauacguucacaaacauggaagcucaacucaucaggcagauggagggcgagggaguucuaucaaaagccgacuuagaaaacccacacuuaccagagaagaaaauuacccaauggcuagagacaaagggaguagagagauuaaagaggauggcgauaaguggcgaugauuguguagugaaacccauagacgacagauuugccaacgcccuauuagcucuuaacgauauggggaaaguucgaaaagacauuccacaauggcagcccaguaaaggauggcacgauuggcaacagguaccauuuuguucccaccauuuccaugaguugaucaugaaagauggaagaaaacuugugguuccauguagaccacaagacgaguuaauagguagagcgagaaucucccaaggagcaggguggaguuuaaaggaaacugcgugccuugguaaagcguaugcacaaauguggucccuaauguauuuucaucgcagagaucuaaggcuagcaaguaaugccauaugcucagcaguacccguucacuggguccccacuucucguacaacauggaguauacaugcucaucaucaguggaugacgacggaagacaugcuuaccguuuggaaucguguuuggaucgaagacaacccuuggauggaagacaagacgccuguaacaaccugggaaaacguaccauacuuagguaagcgggaagaucaaugguguggaucauuaauaggguuaacuagcagagccacgugggcucaaaauauucccacggcaauucagcaaguacgaucauuaauaggaaaugaagaauuucuagacuauaugccuucuaugaagcgauuucgaaaagaggaagaaagcgaaggggcuauaugguag

SEQ ID NO: 23210 - RNA, 9873 nt, Artificial Sequence
  derived and/or modified CDS sequence (opt6) from DENV-3__HQ705613__SS-prME
accagccuaugccuuaugaugauacuacccgcagcacuagcauuucaucuuacuucgagagauggagaaccacgaaugauugucgggaaaaaugaacggggcaaaucgcuuuuguucaaaaccgcaucugggauuaacaugugcaccuuaauugcaauggauuuaggagaaaugugugacgauaccguaacuuacaaauguccgcauaucaccgaaguggaacccgaagacauagacuguugguguaauuuaacuucaacuugggucacauauggaaccuguaaccaagcgggugaacauagacgcgacaaaaggucaguugcacuggcuccccacguagguauggguuuggauacccgaacacaaaccuggaugagugcagaaggugcauggagacagguagaaaaaguagaaacgugggcccuacgacauccagguuucaccauauuggcacucuuuuuagcacauuauauaggcacaagccuaacucaaaaaguagucaucuuuauucuauugauguugguuacucccucgaugacuaugagaugcgucgguguugguaaccgugauuuuguugaaggacuaucuggugcaaccuggguugauguuguucuggaacacggaggaugcgucacaacaauggcuaaaaauaaaccaacacuggacaucgaauuacagaaaacugaagcgacucaacuagccacauugcgaaaauuaugcauugagggcaaaauaacaaacauuacaaccgacucgagauguccgacgcagggugaagcaacccuaccggaagaacaggaccaaaacuacguguguaaacauacauauguagaucgugguuggggcaacgguugcggccuuuuuggaaaagguagccuuguaacaugugccaaauuccaaugucuagaaccuauugaaggcaaaguaguccaguacgagaaccugaaauacacaguaauaauaaccguacauacuggagaccagcaccaaguagggaaugaaacgcaagggguaacagcagaaauuacaccacaagcauccacaacugaagcaauuuuacccgaguacggcacacucggacuggaauguagcccccgaacaggauuagauuucaacgaaaugauauuacuaaccaugaaaaacaaggcuuggaugguccauagacagugguuuuucgauuuaccacuaccguggacaucgggagcuaccacugaaaccccuaccuggaauagaaaagaauuauuagugacuuuuaaaaacgcacacgcuaagaaacaagagguagucguauuagggucccaagaaggagcaaugcauacugcccuaaccggagcaacagaaauucaaaauagugggggaacaagcauauucgccggacaccuaaaaugucgcuugaaaauggacaaacuagaacuuaaagguaugucuuaugcuauguguacaaacacuuucgugcuuaagaaagaaguuagcgaaacacaacacgguacgaucuuaauuaaaguagaauacaaaggagaggacguaccguguaaaauucccuuuucaacagaagacggacagggaaaagcccacaauggcagacugaucacggccaaucccgucguaacaaagaaagaagaaccagugaacaucgaggccgagccaccauuuggugaaagcaacauugucauuggaauaggugacaaugccuuaaaaaucaacugguauaagaaagguucgucgauagguaaaauguucgaagcaaccgcaagaggggccagacguauggcaauuuugggugacacagccugggauuucggguccgucggaggaguauuaaacagucuaggcaaaaugguucaucagauauuugggagcgcguacacagccuuauuuagcggagucucauggguuaugaaaauaggaauaggaguuuuacucacauggauaggucucaauuccaaaaacacuagcaugaguuuuaguugcauagcaauugguauuauaacccuauauuuaggugcgguaguacaagcagacaugggcuguguuaucaacuggaaagggaaagaacucaaaugcggcaguggaaucuuuguuacgaaugaaguucacacuuggacagagcaauauaaauuucaagcugacaguccaaaacgacuugcgacagcaauugcaggagcaugggaaaacggggucugugguauacguucuacgacacguauggaaaacuugcuauggaaacaaauugccaaugaacuuaauuacauuuuaugggagaacaauauuaaacuaacagugguaguuggagauauuauagguguauuagaacaagguaaaagaacauugacuccacaacccauggaacuuaaauacucauggaaaacaugggggaaagcuaaaauuguaaccgccgagacacaaaauaguaguuucauaaucgauggaccuaauaccccagaauguccgaguguaucuagagcauggaauguuugggaagucgaagauuauggauuugggguauuuacaaccaacauaugguuaaaacuuagagaaguauauacacaacuuugcgaucacagacuuaugucagcagcgguuaaagaugaacgugcaguccaugcagauaugggauauuggauugaaucacagaaaaauggcagcuggaaacuugagaaagcgucccucauagaaguaaagacauguacuuggccaaaaagucacaccuuauggucaaacgguguucucgaaagugauaugaucauacccaaaaguuuagcagguccaauuagccaacauaaucauagaccaggauaucauacccaaaccgcugguccuuggcaucuuggaaagcuagaguuagacuuuaauuauugcgaagguacgaccguuguaauuacggagaauugugggacacggggaccaucguuaaggacuacgaccguaucuggaaaacuuauacacgaaugguguugcagaagcugcacgcuacccccuuuacgguauaugggagaagacgguugcugguacggaauggaaauucgcccaaucucggaaaaggaggaaaacauggugaaaagucucgucucagcgggcaguggaaagguugauaacuuuacaaugggagugcugugucucgcuauacuuuuugaagaaguuaugagaggaaaauuuggcaagaaacacaugauugcaggaguuuucuuuacuuuugugcuccuauuaucggggcaaauaacauggcgagauauggcacauacacuaauaaugauaggaucuaaugcauccgacagaaugggcaugggcguaacauaucuugcauuaaucgcaaccuucaaaauacagccauucuuagcacuagguuucuuucuaagaaaauuaacaucuagagaaaaccucuuacuaggcgugggguuagcuauggcgacgacacuucaguuaccggaagacauugagcaaauggcaaauggcauugcucuuggauuaauggccuuaaaacuaauaacgcaauucgagacauaccagcucuggaccgcacuuauaucccucacauguagcaacacuauauuuacgcuaaccguagcauggagaaccgcuacacuuaucuuagccggagucagucuucuuccuguaugucaaaguagcucgaugagaaagacagacuggcucccuauggcaguagcugcaaugggcgugccaccguuaccucuauucauauuuggacucaaagacacccuaaagaggagaucauggccccuaaaugaaggaguuauggcagugggucucguaagcauuuuagcaucaucguuacuaagaaacgacgucccuauggcugguccucuaguugccgguggacugcuuauagcauguuacgugauuaccggaacaucugcagacuugacagucgaaaaagcugccgacauuacuugggaagaagaagcggaacaaacgggugucucccauaaucuaaugauaaccguagacgaugacgguacgaugcggauaaaagacgaugagacagaaaacauuuuaacaguacuuuugaaaacggcucucuugauugucucaggcauauuuccauauaguauuccagccacauuauuaguuuggcauacauggcaaaaacaaacccaaagauccgguguccuuugggauguaccaaguccaccugaaacucaaaaggcugagcuugaagaagguguauauagaauuaaacaacaaggaauauuuggcaaaacccaaguugguguggggguacaaaaggaaggaguuuuucauacaauguggcauguuacaagaggcgcagugcucacguauaacgggaaaagacuagaaccuaacugggcaucaguuaaaaaggaccuaauuucguacgggggagguuggagacuuucugcacaauggcagaagggagaggaaguccagguaauagcaguagaaccuggaaagaacccuaaaaauuaucaaacaaugccaggcacuuuccaaacuacaacuggugaaauaggagcaauagcucuagacuuuaaaccugggacaaguggauccccaauaauaaaucgcgaagggaaagucgucggauuauacggaaacggcgucguuacaaagaacggcggcuacguaucaggcauugcccaaacuaacgcagaaccagacgggccaacuccggaauuagaagaagaaauguucaagaaacguaacuuaaccauuauggaccugcauccgggcaguggaaaaacgagaaaguaucuaccagcaauaguuagagaggcaauuaagcgacgauuacguacucuuauauuagcuccaacacgaguuguagcagcagaaauggaagaagcccugaaagggcucccuauucguuaccaaacgacagccacaaaaucugagcauacuggucgcgaaauuguagaucuaaugugucacgcuaccuuuacaacgcgccuguugucaccugugcgggucccaaauuacaaucugauuauuauggacgaagcacacuucaccgacccggccaguauugcggcgaggggauauauuucgacgaggguuggaaugggcgaggcagcugccauuuucaugacugcaacuccuccagguacugcagaugcguuuccacaaucgaacgcaccuauucaggaugaagaacgagauauucccgagagaucauggaauagcgggaaugaauggaucacagauuuugcaggaaaaacaguuugguuuguuccauccauaaaagccggaaacgauauagcaaauuguuuacguaaaaacgggaagaaagucauacaacuaucuagaaaaacauuugauacggaauaucagaaaaccaaacuaaaugacugggacuucguuguuaccaccgauauauccgaaaugggugcuaauuuuaaagcggaccgagucaucgauccaaggcgaugucuaaaaccaguuauucuaacagaugguccagaacgaguaauuuuggcuggaccaaugccuguuacagcagcuucagccgcacaaagaagagguagaguaggacgcaacccccaaaaggaaaacgaucaauauaucuucacagggcaaccccuaaauaaugaugaagaucaugcccacuggacugaagcgaaaauguuacuugauaauauaaacacaccagaagguaucauaccagcuuuauuugaaccugagagggagaaaagugcagcuauagacggagaauacagguuaaaaggagagagucguaagacuuuuguagaauuaaugaggagaggugaccuaccugucuggcucgcucacaaaguagcuucagaagggauuaaauauacagauaggaagugguguuucgauggacagcgcaauaaccagauacuagaagaaaauauggauguggaaauauggacaaaagaaggcgagaagaagaaacuacgcccuagauggcuggaugcgcgaacauauucugacccauuagcacuaaaagaguucaaagaguuugccgcuggcaggaagucgaucgcacuggaccuaguaacagagauaggacgcguaccuagucaucucgcucacagaacaagaaacgccuuagacaauuugguuaugcugcacacuagcgaacauggaggcagggccuauagacacgccgucgaagaacuaccagaaacuauggagacacuacuacuucuagguuuaaugauuuugcuuacugguggagcgaugcuauuccuuauaucgggaaaaggaauaggcaaaacaucuauaggccugauauguguuaucgcaucuaguggaaugcuauggauggcagaaauaccacuacaauggauugcuucagcuauaguauuagaguucuucaugaugguguuacugauaccagagccggaaaaacaaagaacaccccaagacaaucaguuggcauacguaguuauaggaaucuuaacauuagccgcaauaauugcugcaaacgaaaugggacuccuagaaacuacuaaaagggauuuagguauguccaaagaaccaggaguugucaguccaacaaguuacuuagauguugacuugcacccagcgucugccuggacauuauacgcgguagccacgacaguaauuacgccaauguugcgucauacaauagaaaauucaacagcuaacguuagucuggcugcaauagcuaaucaagcaguaguauuaaugggauuagauaagggguggccuauaagcaaaauggaccuugggguaccccuauuggcgcuggguugcuauucucaaguaaaucccuugacauugacugcagcaguacuauuauugaucacgcacuacgcaauaauaggucccggcuuacaagccaaagccaccagagaagcacaaaagagaacagcggcagggauaaugaagaacccuacaguugacgggauaaugacaauugaccuagauccagugauauaugacaguaaauucgaaaaacaacuuggccaaguuaugcugcuagugcuuugcgcaguucaauugcuuuugaugagaaccucgugggcacuaugcgaagcguuaacgcuagcuacugguccaauuacuacucuaugggaagguuccccggggaaauucuggaacacaacaauugccguaucuauggccaauauauucagggggucauauuuagccggcgcuggacuugcauucucaaucaugaaaaguguugguacagguaaaagagguaccgguagucaaggugaaacgcuaggagaaaaauggaagaagaaacuaaaucaacucucuagaaaagauuuugaucuauauaagaaaucuggaauuacugaaguggaucgcacagaagcuaaggaaggacuaaaaagaggcgagaucacccaccacgccguaagcagagguuccgcaaaacugcaaugguucguagaaagaaauaugguuauaccagaaggccgagugauagaucuuggcuguggucgagguggaugguccuauuacugugcggguuuaaagaaaguaacagagguacgaggguacacaaaaggaggacccggucaugaagaaccagugccaaugaguaccuauggguggaacauugucaaacucaugagugguaaagacgucuuuuauuugcccccugaaaaaugugauacauuacuuugugauauaggggaaucaucgccaucuccuacuguugaagaaucacgaacuauucgaguauuaaaaaugguugaaccguggcucaagaauaaucaauuuuguauaaaaguccuuaauccuuacaugccaaccguuauagaacauuuagagcgucuucagagaaaacaugguggcaugcucguaaggaacccauuaucgagaaacucuacacacgaaauguacuggauuucaaauggaacugggaauauaguagcaucagucaauaugguauccagacuauuacuaaaucgauuuacaaugacacaucgcaggccaacuauagaaaaagacguagauuugggagcugguacacgacauguuaaugcugaaccagagacaccaaauauggacguaaucggugaaagaaucaagagaaucaaagaggaacauaacucgacauggcacuacgaugaugaaaacccuuauaaaacuugggcuuaucacggaaguuaugagguaaaagcuacagguucggcuucuaguaugaucaauggaguaguuaaauuacuuacaaaacccugggacgucguaccaauggucacccagauggccaugacggacacaacgcccuuuggccaacagagaguguuuaaggaaaaaguagacacccgaacaccuagaaguaugcccggcacgagaagggucaugggaauaacggccgaaugguuguggaggacuuugggccgaaauaagaaaccacgccuuuguaccagagaagaguucacuaagaaaguuagaaccaaugcggcaaugggagcaguguucacagaggaaaaucaaugggauagugcuaaagcagcuguugaggacgaagacuuuuggaagcucgucgaucgugaacgcgaacugcacaaacuugguaaauguggaaguugcguauauaauaugaugggaaaaagagagaagaaauuaggggaguucgggaaggcuaagggcucaagggccauaugguauaugugguuaggugcucgauauuuagaguucgaagcauuaggauuuuuaaaugaagaccauugguuuucaagagaaaauucguauucagguguugaaggcgaaggacuucacaaauuaggcuauauacuacgcgauauuucaaaaauuccaggaggcgcgauguaugcagaugacacagcaggaugggauacgagaauuaccgaagaugacuugcacaaugaagagaaaaucacccaacaaauggauccggaacauaggcagcuugcaaaugcaauuuucaaacuaacuuaccaaaacaaaguuguaaaaguacagcguccuacccccacaggcacuguuauggacauaauaucacgaaaagaccaacgaggaagcggacaagugggaaccuacggauuaaauacuuuuaccaauauggaagcccaauuaauccgacaaauggaaggugagggagugcuaaguaaagcagaucuagagaacccucaccuaccggagaagaaaauuacucaaugguuggagacaaaagguguggaacgucuuaaaaggauggcuaucucaggugacgauuguguaguaaaaccaaucgacgauagguuugcaaacgcacugcuggcucuaaacgauaugggaaaaguacgaaaagauauaccacaauggcagccaucaaaaggcuggcacgauuggcaacaaguucccuucuguucccaucauuuccacgagcuuauuaugaaggacggaagaaaacucguaguaccuugcagaccacaagaugaauugauuggucgagccagaaucucacaaggagccgguuggagccuaaaagaaacagcaugucuaggcaaagcguaugcgcaaauguggucacucauguauuuucacagacgcgaccuacgauuagcaucuaacgcgauauguucugcugucccuguucauugggucccuaccucuaggacuacauggucgauacaugcccaucaucaauggaugacaacagaggacaugcuaacgguauggaacagaguauggauugaagauaauccauggauggaggauaagacgccuguaacaacuugggagaacgugccauaccuaggaaaacgagaagaccagugguguggaucauugauaggauuaacuuccagagcuacaugggcacaaaauauaccuacugcuauucaacaaguaaggucauugauaggaaacgaggaguuucuagauuauaugccauccaugaagagguuuagaaaggaagaggaaucugaaggagcuauaugguaa

SEQ ID NO: 23211 - RNA, 9873 nt, Artificial Sequence
  derived and/or modified CDS sequence (opt6) from DENV-3__HQ705615__SS-prME
acaaguuuauguuuaaugaugauauuaccggcugcucuugcuuuucaucuuacgucuagagauggugaaccuaggaugauaguagggaaaaaugaacgcggaaaaaguuuauuauuuaaaaccgcuucaggaauuaauaugugcacgcuuauagcuauggacuuaggagaaaugugcgacgauacuguuacguacaaaugcccccauauaacggaaguggaaccagaagacauagacugcuggugcaacuuaacuucaacauggguuacauauggaacaugcaaucaagcaggagaacaccgaagagauaaacguucuguagcucuagcaccacacgugggaaugggauuagacacccgcacacaaacauggaugucagcugaaggagcuuggcgccaaguagaaaaaguagaaacgugggcuuuaaggcacccuggauuuaccauccuugcacucuuucuggcucacuauauugggacuucuuugacucaaaaagugguuauuuuuauauuacuuauguuaguuacuccuucaaugacuaugcgaugugucggaguagguaacagggauuuuguagaaggauuaaguggagcaacuuggguagacguaguuuuagaacauggggguugugucacuacgauggccaaaaauaaaccuacuuuagauauagaauugcagaaaacugaagcaacacaacuugcaacauuaagaaaauuauguauagaaggaaaaauuacuaauauaacaaccgacaguaggugcccgacacaaggggaagcgacuuuaccugaggaacaagaccaaaauuacguuuguaaacacacguacgucgaucgaggaugggguaauggcugcggauuauucgguaaagggucguuaguuacuugcgccaaauuucaauguuuagaaccaauugaaggcaaaguaguacaauaugagaauuuaaaauacaccguaauuauuacaguacacacuggcgaccagcaucaaguaggaaacgaaacacaggguguaacagcugagaucaccccacaagcaucuacgacagaagcaauacuuccagaauacggaacacuaggacucgaauguucaccgagaacaggauuagacuuuaacgaaaugauauuacuuacgaugaaaaacaaagccuggaugguacacagacaaugguucuucgaucuaccccuuccguggacguccggagcaacgacugaaaccccuacuuggaauagaaaagaacuccuagucacguuuaaaaaugcacaugcuaagaaacaagaagucguuguucuaggaucacaagaaggagcuaugcacacugcuuuaaccggagcuacggagauacaaaauaguggagguacuuccauauucgccggacauuugaaauguagauuaaaaauggauaaauuggaguugaaagguaugucauaugccauguguaccaacacauucguacuaaagaaagaagugagcgaaacccaacacggaacuauucucauaaaaguugaauacaaaggagaagaugucccaugcaaaauuccauucuccacugaggauggucaagguaaagcacauaauggaagacuaauuacggccaauccugugguuacuaagaaagaagaaccugugaacauugaagcggagccacccuuuggagaaaguaauauaguaauaggaauaggagacaacgcccuuaaaauuaacugguacaaaaagggcucgucgauaggcaaaauguucgaagcaaccgcccguggugcccgaagaauggcgauauugggagauacugcaugggauuucggaagcguuggaggaguucuaaauucgcucgguaaaaugguacaucaaauuuuuggaucagcauacacagcucuuuucucgggaguaucauggguaaugaagauuggaauuggaguauuacugacauggaucggacuaaauucaaagaacacaucuaugucguucucuuguauugcuauagggaucauaacucuauaccugggagccguaguucaagcggauaugggaugugugaucaauuggaaagggaaagaauuaaaaugugguucgggaaucuucguuacuaaugaaguacauacauggaccgaacaauacaaauuucaggcugacucaccuaaaagauuagcuaccgcaaucgcaggagccugggaaaauggcguuugcggaauccggagcacuacaaggauggagaauuuguuauggaaacagauugcgaaugaacucaauuacauauuaugggaaaauaauauaaaacuuacuguuguuguaggagauauaauaggggugcuggaacaagguaaaaggacacuaaccccacaaccaauggaauugaaauauagcuggaaaacauggggcaaggcuaaaauaguaacagcagaaacgcaaaacagcuccuuuaucauagacggaccaaacacaccggaaugcccuucuguaucuagggcauggaacguaugggagguagaagacuauggauuugggguuuuuacaacaaauauuugguugaaauuaagagagguauauacucaacuaugugaccaccgccugaugucagccgcaguaaaggacgaaagagcaguacaugccgacaugggauacuggauugaaucccagaaaaaugguaguuggaaacuagagaaagcaaguuuaauagagguaaagacguguacauggccaaagagccacacccuuuggucaaacggagugcucgaaucggauaugauaaucccgaaaucauuggccggaccuaucagccaacacaaucacagaccagguuaucauacucaaacugccggcccauggcacuuagggaaacuugaacuagauuuuaauuacugcgaagggaccacaguggucauaacugaaaauuguggaacuagaggacccagcuuacguacaacgacuguuaguggcaaguuaauccacgaaugguguugucggucuugcacucuuccaccuuuacguuauaugggagaagacggcuguugguacggcauggaaaucagaccuaucagcgaaaaagaggagaacaugguaaaaagccugguguccgcgggaagugguaaaguugauaauuuuacaaugggcguucuaugucuagcgauccuuuuugaagaaguuaugagaggaaaauucggcaagaaacauaugauagcuggggucuucuuuacauucguauuauugcugaguggucaaauaacuuggcgagauauggcacacacccuaaucaugaucgguucaaaugcuucggaccgaaugggaaugggagucacuuaucuggcucuaauagcaacauucaaaauccagccauuucuagcuuuaggauucuuucuaagaaaacuaacuucuagagaaaaccuacucuuaggugugggauuggcuauggcuacaaccuuacaacucccugaagauauagaacagauggccaaugguauagccuuaggcuugauggcuuuaaaauuaauuacacaguuugaaaccuaucaacuguggacggcuuuaauaucccuaacuuguucaaauacgauauucacacucacgguugcuuggcgcacagcgacgcuaauauuagccgguguaucgcuccugccgguaugccaaucaucaaguaugcgaaagaccgauuggcuaccuauggcaguugcggcuaugggcgugccaccauugccauuauuuauauucagucugaaggacacauuaaaaaggaggucguggccacugaacgagggugugauggcgguugguuuggugucgauacuggcgagcucgcuuuuacgaaaugauguuccaauggcuggaccuuuaguugccggcgggcuucuaauagcguguuauguaauaacggggacgucggccgaccuaacagucgaaaaagcugcagauauaaccugggaggaggaagcggaacaaacaggcguaucccauaauuuaaugauagcugucgaugaugauggaacaaugaggauaaaagaugaugaaacugagaauauuuuaacuguacuacuuaaaacagcacuccugauaguuuccggcauauuuccauauucaauuccugcaacucuuuuaguauggcacacauggcaaaagcaaacccaaagaucuggagugcuaugggaugugccaucgccaccggaaacacaaaaggcggaacucgaagaaggagucuaucgaauaaaacagcaagguauauuuggaaagacccaaguaggcguaggaguccagaaagaagguguauuucauacaauguggcauguaacccgaggggcaguacuaacguauaacgguaagaggcuagaaccuaauugggcaucagucaagaaagaucucauuagcuacgggggugguuggagauuaucugcacaauggcaaaagggugaggaggugcaagugauagcuguagaaccaggcaaaaaccccaaaaauuuucaaaccaugcccggaacauuucagacaacuacaggagaaauuggugcgaucgcauuagauuucaaaccuggaacaagugguaguccaauaauuaaucgagaggguaaaguaguggggcuauacggaaauggaguaguuacgaaaaauggcgguuauguuuccgguauagcacagaccaacgcugaacccgacgguccaacucccgaacucgaggaggaaauguuuaaaaagcguaaccuaacaauuauggaucuccaucccggaucagguaaaacucgaaaguaucuaccagcuaucgugagggaagccauuaaacguagacuaagaacauuaauauuagcuccuacgaggguugucgccgcugaaauggaagaagcguugaagggacuaccaaucagauaucaaacuacugccacgaaaagcgaacacaccgggagagagauaguggaccugaugugucaugcaacauuuacuaugcgucuacuuucgcccgucagaguacccaacuauaaccucauuauaauggaugaagcacacuuuacagauccagcaucaauagccgcacgcggauacauuuccacucgagucggaaugggagaggcugcagcaauuuucaugaccgcaacuccgccugggacagccgacgccuuuccacagaguaacgcaccaauacaggaugaggaaagagacauuccagaaagaaguuggaacucugguaacgaguggauaaccgacuucgcaggaaaaaccgucugguuuguccccaguauaaaagcaggaaacgauauugcgaauugucuuaggaaaaauggcaagaaaguuauucaacugagccggaaaacuuuugauacagaauaccagaaaacuaaauugaaugauugggauuucguaguaacaacugacaucucagagaugggagcgaacuuuaaagccgauagaguaauagaucccagaagaugucuuaaacccguaauccuaacugauggacccgaaagagucauacucgccgggcccaugccaguuacagccgccagugcagcgcagagaaggggaagaguugguagaaauccacaaaaagaaaacgaccaauauauuuuuacgggucagccacuaaacaaugaugaagaucaugcacacuggacagaagcuaagauguuauuggauaacauaaauaccccggaagguaucauaccugcacuuuuugaaccggaaagggagaaaagcgcagcaauagacggugaauauagguuaaaaggcgaaaguagaaagacguuuguagaauuaaugcgucgaggcgaucucccggucuggcuagcgcauaagguugcaagugaagguauaaaauacacagaucgaaaaugguguuuugacggucaacgaaauaaucagauauuagaggaaaauauggauguagaaauauggaccaaggagggugagaagaagaaacuucgaccaagaugguuggacgcgagaaccuauagcgauccauuagcacuaaaagaauuuaaagaauuugcagcaggaagaaagagcauugcacuagaccuaguuacugaaaucgggagaguaccuucgcaccuagcccaucguacucgaaaugcauuggacaaccuaguaauguuacauacaucugaacauggcggaagggccuaucggcaugccguagaagaguuaccagaaacuauggaaacacuacuguuacuuggauuaaugauccuacuaaccgguggagcuauguuauuccuaauuuccggaaagggcaucgguaaaaccucaauagguuuaauuugugugaucacuucaaguggcauguuauggauggcagaaauaccucugcaguggauagcguccgccauuguucuugaguucuuuaugaugguauugcuaauaccagaaccugaaaagcagcguacaccccaggacaaucaauuagcauaugugguaauaggaauacuaacgcuagccgcaauuaucgcggcgaaugaaaugggucuccuagaaaccaccaaaagggauuuagguaugagcaaagaaccggguguagugagcccaacgucauauuuggauguagaccugcacccagcaagugcguggacacuauaugcaguagcaacaacuguuaucaccccgaugcuucggcauacuauagaaaacucaacagcaaacguaagccuagcggcaauagcgaaucaagcggucguacuuaugggacuagauaaaggauggccuauaaguaagauggacuugggagucccuuuauuagcauuaggauguuauagccagguaaauccucugacuuuaacggcagcuguccuucucuuaauuacucauuaugcgaucauaggacccggacuucaagcuaaagccacaagagaagcucaaaaacgaaccgccgccggaauuaugaaaaauccaaccgucgacgggauuaugacaauugauuuagauccagugauuuaugacuccaaauuugaaaagcaauuaggacaaguuauguuauuaguuuuaugugcaguacaacuccuucucaugcguacuucaugggcgcuaugcgaggcuuuaacccuugcaacaggaccuauuacaacuuugugggaagggucaccaggcaaguuuuggaauacuacaauagccguaaguauggcaaacauauuuagaggaucguacuuggcgggcgcaggauuagcguuuaguaucaugaagaguguaggaaccggcaaaagaggaacagggagucaaggagaaaccuugggugagaaauggaagaagaaacuaaaucaauugucaagaaaagauuuugacuuauauaagaaauccgggauaacugagguagacagaacagaagcaaaagaaggccuuaaaagaggugagaucacgcaccacgcgguaucgcgggguucugcuaaacuucagugguuuguggaaaggaacaugguuauaccugaagguagaguuauugaucuaggcugugguagaggcggauggaguuaccauugcgcgggucucaagaaaguaacugagguucggggcuacaccaaaggaggacccggacaugaagaaccaguuccuaugaguacuuauggguggaauauuguuaaguuaaugucgggcaaggauguauucuaucucccaccagagaagugcgauacacuuuuaugugacauuggagagucaucucccagcccaacagucgaagagucucguacaauucgaguauuaaaaaugguagaaccaugguuaaagaauaaucaauuuugcauaaagguacuuaacccauauaugcccacggugauagaacauuuagagagacugcagagaaaacacggcggcaugcuagucaggaacccucuuucacgcaauucuacacacgaaauguacuggaucucgaacgggaccgguaacauugucgcaucaguaaauauggucagcagacuccuucucaauagauuuaccaugacgcauagacgaccaacaaucgaaaaagacguagacuuaggagcuggaacucgccacguuaacgcagagccugaaacuccuaacauggauguuauaggugaacggaucaaacguauuaaagaggaacacaauucaacuuggcauuacgaugaugaaaacccauacaaaacaugggccuaccacggcaguuaugaaguaaaggcaaccggcagugcuucgagcaugauaaauggcguuguaaaacugcuuacuaaaccaugggauguuguacccaugguuacucaaauggcaaugacugauacuaccccauucggacaacagagaguuuuuaaagaaaaagucgauacacgaacaccuagaucaaugccugguacucggcgaguuauggguauaacagcagaauggcucuggagaacacuuggcaggaauaagaaaccccgccugugcacaagggaagaauuuaccaagaaagugcgaaccaacgcggcaaugggagcaguguucaccgaagaaaaucaaugggauagcgcaaaagcggcuguagaggacgaagauuucuggaaacuuguagacagggagcgagaauuacauaaacucggaaaaugcggaucauguguguacaacaugauggguaagcgugagaagaaacuaggugaauuuggaaaagcaaagggaagcagggcgauaugguacaugugguuaggagcccguuaucuagaguucgaagcucuuggauuucuaaaugaagaucauugguucucacgagaaaacagcuauucagguguagagggagaaggucuucauaaauuagguuauauacuaagagacauaucaaaaauuccgggcggcgcaauguacgcugacgauacagcgggaugggacacaagaauaacugaagacgaccuucacaaugaagagaaaauaacccaacaaauggacccggagcaccgccaacuggcaaaugcaauuuucaaauugacauaucagaacaaaguaguuaagguucaaaggccaacgccgacuggaacgguaauggauauaaucucaagaaaagaucagagagguagcggacaagucggaaccuauggacuaaauacuuuuacuaacauggaagcucagcuuauccgucaaauggaaggagaggguguacuuucuaaagccgauuuagaaaacccacaucuuccagagaagaaaauaacucaguggcuagaaacaaagggagucgaacgcuuaaaacguauggcuauaaguggugacgacuguguaguaaaacccauugaugaucgauuugcaaaugcauugcucgcgcuaaacgacaugggaaaggugcgaaaagacauaccacaauggcaaccaaguaaaggcuggcacgauuggcagcaagucccuuucuguucgcaucauuuucacgaauuaauuaugaaagauggccggaaauuagucguacccugcaggccucaggaugaacuuaucgguagagcuaggaucagccagggagcuggguggagucucaaagaaacugcaugucuaggaaaggcuuaugcucaaauguggucacucauguacuuucaccgaagagaucuuagauuggcaaguaaugcgauauguucagcaguacccguacacuggguucccacuagccguacaacuugguccauccaugcgcaucaucaauggaugacgacugacgauauguuaacaguguggaacagaguuuggauagaagacaauccauggauggaagacaaaacacccgugacgacaugggaaaacguaccauaucuaggaaagagagaggaccaauggugcgguucacuuauuggguuaacguccagagcuacuugggcacaaaacaucccuacagcaauacaacaaguaagauccuuaauuggaaacgaggaguucuuagauuauaugcccucgaugaaacgauuuaggaaagaagaagaauccgagggagcaauaugguag

SEQ ID NO: 23212 - RNA, 9873 nt, Artificial Sequence
  derived and/or modified CDS sequence (opt6) from DENV-3__JF920398__SS-prME
acaucucuaugucuaaugaugaucuuaccagcagcuuuagcauuccaucugaccuccagagacggagaaccacgcaugauaguagggaaaaaugaacguggaaaaucguuacuauucaaaacugcuucuggaauaaauauguguacacuaauugcgauggaccugggggaaaugugcgacgauaccguaacguauaaaugcccgcauauaaccgaaguagaaccugaagacaucgacuguuggugcaaucugacaucaacuuggguaaccuauggaacuuguaaucaagcuggagaacaccguagagacaaaagaagcguggcauuagcaccgcacgugggaaugggucuugauacuagaacgcaaacuuggaugucugcagaaggggcguggcgacaaguagaaaaaguagaaacuugggcuuugcggcauccggguuuuaccauacuggcucuauuccuggcccacuauauuggaacaagucucacccaaaaaguaguuauauuuauuuuacucaugcuaguuacuccaucaaugacuaugcgaugcguuggaguaggaaauagagauuuugucgaaggacuaaguggagcaacauggguugauguaguauuggaacacggagguuguguaacuaccauggcgaaaaauaaaccgacuuuagacauugaauuacagaaaacugaagcgacacaguuagcgacguugagaaaacucugcauagaaggaaaaaucacgaacauuacuaccgacucaagauguccgacacaaggggaagcaacucuaccugaagaacaagaccaaaacuacguaugcaaacacacuuauguagauagaggauggggaaacggcuguggucuguucgguaaagguucauuagugacaugcgcuaaauuccagugcuuagaaccuaucgaaggaaaaguuguacaguaugaaaauuuaaaauauacaguuaucauaacaguacauacuggugaccaacaccaaguuggaaaugaaacccaaggaguaacggcggaaauaaccccacaagcaucaacuacagaagcuauauugccagaauacggaacucuaggacuggaauguagcccgagaacaggacuagauuucaaugaaaugauacuucuaacuaugaaaaauaaagcauggaugguucauagacagugguucuuugauuuaccucugccauggacauccggugcuacuacugagacgccaacguggaaucguaaagaauuguuaguaacuuuuaaaaacgcucaugcaaagaaacaagaagugguaguauuaggaucacaagaaggugccaugcauacugcuuuaacuggggccacagagauacaaaacucagguggaacaucaauuuuugcuggacaccucaaaugccgacuaaaaauggauaaacuagaacuaaaagggauguccuacgcaauguguacgaauacguucguacuaaagaaagaagucucugagacacaacaugggacgauacuaauaaaaguugaauauaaaggagaggauguaccauguaaaauccccuucuccaccgaagauggacaaggaaaagcacauaacgguagauuaauaacggcaaacccuguaguaacgaagaaagaagaaccaguaaauauugaagcggagccgccauuuggugaguccaacauuguaauagggaucggggacaaugcauuaaaaauaaacugguacaagaaaggcagcuccauaggaaaaauguucgaagcaacugccagaggugcgaggcguauggcaauuuuaggcgauacugcgugggacuucgguagcgucggcgggguacugaauagccuaggcaaaaugguucaccaaauauucgguucggcauauacagcucuauucucggguguaagcuggguaaugaaaauugguauaggaguuuuacuaaccuggauuggcuuaaauucuaaaaauacauccauguccuucagcugcauugcaauaggaauaauuacccuauacuugggcgccguagugcaagcugauaugggguguguuauaaauuggaaagggaaagaacugaaauguggaagugggauauuuguaacgaacgaaguccacacuuggaccgagcaauauaaauuccaagcagauaguccaaaaagacuugcaaccgcaauugcuggagcuugggaaaacgggguaugcggcauacguuccacuaccaggauggagaaucuguuauggaaacaaaucgccaaugaauugaacuacauccuuugggaaaauaacaucaaacugacaguaguaguuggagauauuauuggcgugcuagaacaaggaaaaagaacucucacaccacagccaauggagcuaaaauacagcuggaaaaccugggggaaagccaaaaucguaacggccgagacacaaaacucuucuuucaucauagauggucccaacacgcccgaguguccgaguguuucgcgugcuuggaauguaugggaagucgaggauuauggcuucgguguauucacaacaaauauaugguuaaaauuacgagaaguauacacacaauugugcgaccaccgucuaaugucagcagcuguuaaagacgaaagagcaguucaugcugauaugggcuauuggaucgagucccagaaaaauggcucauggaaacucgaaaaagcaucacuuaucgaagucaagacguguacauggcccaaaagucacacaauauggaguaacgguguauuagaaagugacaugauaaucccuaagucacucgcaggaccaaucucacagcacaaccauagaccagguuaucacacacagacugcuggcccauggcaccugggcaaauuagaauuggacuucaauuacugugagggcacuacaguggucaucacugaaaauugcgguacccgagguccaucauuaagaacuaccacagucaguggaaaacucauucaugaauggugcuguagaaguuguacuuuaccaccgcuucgauauaugggagaggauggauguugguacgguauggaaauacguccuauaucagagaaagaggaaaauaugguaaaaagucugguaucugcuggaucagguaagguagauaauuuuaccaugggcguucuaugccucgcaauacuguuugaagaagucaugcgaggcaaauuuggcaagaaacauaugauagcaggagucuuuuugaccuucguauuguuacuaaguggacagauaacauggcgcgauauggcacauacacugauuaugaucggaucgaaugcgucagaccguauggggaugggagucacuuauuuggcauuaauugcaacauucaaaauacaacccuuucuugcccuaggauucuuccuacgaaaacugacgagcagagagaacuuacuguuagguguuggcuuagcaauggcuacaacuuuacaacugccugaggacaucgaacaaauggcgaaugguaucgcguuagggcuuauggcguuaaaauuaauaacgcaauuugaaacauaucaacuuuggacagcuuugauuagccugacuugcuccaauacaauauucacacuaacaguagcauggaggaccgcaacuuuaauucuugcaggagugagccuauuaccugucugucaaaguucaagcaugagaaaaaccgacuggcuaccgauggcaguagcggcaaugggaguuccuccgcuuccacuuuuuaucuucucgcucaaggacacccucaaaagacgaucguggcccuuaaaugaaggagugauggccgugggcuuaguaaguauuuuagcuucuagcuuacugcggaaugauguaccgauggcggguccccuaguagccgguggacuacuuauugcguguuaugugaucacgggaacuucagcagauuuaaccguagagaaggcagccgauauaacgugggaagaagaagcagaacaaacaggaguaucccacaaccuaaugauaacaguggaugacgacgggacaaugagaauuaaagacgacgagacugaaaacauacuaacuguucuacuuaagacagcacuacuuaucguaagcgguauauucccuuacagcauucccgcaacauugcuaguuuggcacacuuggcaaaaacaaacgcagcguucagguguucuaugggauguuccgucuccgccugaaacccaaaaagccgaacuagaagagggaguguacagaauaaaacaacagggaauauucgggaaaacccaagugggaguaggcguacaaaaagaaggcguuuuucauacaauguggcacgugacaagaggugcuguuuuaaccuauaacggaaaacgccuagagcccaauugggcaucuguaaagaaagauuuaauuucauacggggguggauggagacugagcgcucaguggcagaaaggggaagaaguacaagugauugcaguugagccagguaaaaaccccaaaaauuuucaaacgaugcccggaaccuuccaaacgacaacaggagaaauaggugccaucgcccuagauuuuaaaccggguacaucaggguccccaauaauaaauagagaagguaagguaguugguuuauacgguaacggcguugugacgaaaaaugguggauaugugagcggaaucgcccaaaccaacgcagagccagacggaccuacgccagaauuggaggaagagauguuuaagaaacggaauuuaacaauaauggaucuacacccagggagcggcaagacaaggaaauauuuaccugcaauaguacgcgaagcuauaaaacguaggcuacgaaccuuaauauuggcuccuacacgggugguugcggcggaaauggaagaggcauugaaaggacuuccuauacgauaccagacaacagcgacaaagagcgaacacacuggucgcgaaauuguugacuugaugugucaugcgacuuuuacuaugcgacuucucucgccaguacgaguaccaaauuauaauuuaauuauaauggaugaagcucauuucacagauccagcaagcauagcagcaagaggauauauaucuaccagaguugguaugggcgaagcagcagcaaucuuuaugaccgccacgccgccugggacggcugaugcuuuuccacagaguaacgcaccaauacaggaugaagaaagagauauuccugagcgcagcuggaacuccggaaaugaguggauaacagauuucgcgggaaaaaccguaugguuuguuccaucgauuaaagccgggaaugacauugccaacugucugaggaaaaauggaaagaaaguaauacaacuaagcagaaaaacauucgacacagaauaucagaaaaccaaacuaaaugauugggacuucguugugacaacggacauauccgaaaugggagccaauuucaaggcugacagaguaauugauccucgcagaugccuuaaaccaguaauucugacagaugguccggaacgaguuauacuugcugggccgaugccgguaacggcugcgagcgcugcucaacgucguggcagaguaggcagaaauccucagaaagaaaacgaccaauauauuuucacuggacagccacuaaauaaugacgaagaucacgcacauuggacagaggccaaaauguuauuggauaauauaaauacaccugaagguauaauuccggcucuauuugaacccgagagggaaaaauccgcugcuauagacggagaauacagguuaaagggugaaucgcguaaaacuuuuguggaauuaaugcgaagaggcgaccuuccagugugguuagcacauaagguugcgagugaaggaauuaaauauacagaucgaaaaugguguuucgauggucaaagaaacaaucaaaucuuagaagagaauauggauguugagaucuggacuaaagaaggugagaagaagaaauugagaccgcguuggcuagacgcgcgaaccuauucggacccuuuggcacucaaagaauuuaaggaguucgcggccggccguaaaucaaucgcgcuagauuuaguaaccgaaauagggcgcgucccuagccaucuugcacaucguacucgaaacgcgcuggacaaccuaguuaugcugcacaccagcgaacacgggggaagggcuuacagacaugcuguggaagaacugccugagacuauggaaacucuccuauugcuaggccucaugauauuauuaacaggaggggcaaugcuauucuuaaucagcgggaaaggaaucggaaaaacuucuauaggacuaauuugcguaaucgcaucuucagguauguuauggauggcagagauaccuuuacaauggaucgcaucagcuauuguuuuagaguuuuucaugaugguuuuacuaaucccagaaccagaaaaacaaaggaccccgcaggauaaccaacuagcauacguuguaaucggaauauuaacauuggcggcuauuaucgcggcaaaugaaaugggucuacuugagacaacaaaaagggauuugggcaugaguaaggaaccagguguuguaagcccaacaagcuauuuagauguggaucugcauccugcaucagcguggacuuuauacgcuguagcaacuaccguaaucaccccaauguuaagacauacaauugaaaauucaaccgcgaacguaagucuagccgcaauagccaaccaagcgguuguacucaugggauuagauaaaggguggccaauuucuaaaauggauuuaggagucccuuuguuggcuuuaggcuguuacagucaagucaacccauuaacauuaacugcagcuguuuuguuauuaaucacacacuacgcaauaauuggaccaggccuacaagcgaaagccacccgugaggcccaaaaacguacagcagcuggcauuaugaaaaacccuacuguagacggcauuaugaccaucgaucuagauccaguaauuuaugauagcaaauuugaaaagcaauuaggucaaguuaugcuucucguucucugugcagugcaacucuuacuaaugaggacuucaugggcucuaugugaggcuuuaacucuagcaacagguccaauaacaacauuaugggaaggaucgccaggcaaguucuggaauacuacuauugcgguauccauggcgaauauuuuuagagguucauauuuagccggugcuggcuuagcauucucuauaaugaaaaguguaggcacagggaaaagggggacuggaucacaaggugaaacucucggagagaaauggaagaagaaacuaaaccaauugagcagaaaagacuuugauuuguauaagaaauccgguauaacugagguagauaggacagaagcaaaagaagggcuaaagcgaggugagauaacccaccaugcgguuucucgagguucugcaaaauuacaaugguucguugaaaggaacauggucauaccagaaggaaggguaauagaucuugguuguggucgaggcggauggagcuauuacugugccgggcucaagaaaguaacugaaguuagaggauacacaaaaggugggccgggacaugaggaaccuguuccaauguccacuuacgguuggaauauagugaaguugaugagugggaaggacguguucuaucuuccgccagagaaaugugauacacuacuuugcgauauuggcgaaucaagcccuucacccaccguugaagaaaguaggacuauaagaguccucaagaugguugaaccauggcucaaaaauaaucaauuuugcaucaaagugcuaaacccuuauaugccaacagugaucgaacauuuagaaaggcuacaacguaaacauggaggaaugcuuguaaggaacccauuaucgcgaaacucuacccacgagauguauuggauaucaaacgguacaggaaauauuguagcaucagucaacaugguaaguagacuguuacuuaacagauuuaccaugacccaucgaagacccacgauagaaaaagauguagacuugggcgcagggacaagacauguaaaugcugaaccagagacaccgaacauggacgugauuggcgaacguauuaagagaaucaaggaagaacacaauagcaccuggcacuaugaugacgaaaauccuuauaaaacaugggccuaccaugguagcuacgaggugaaagcaacaggcagugcauccaguaugauuaauggaguaguaaaacuacugacaaaaccuugggauguagugccaaugguaacacaaauggccaugacagauacuacgccauucggucaacagaggguauuuaaagaaaaagucgacacacguaccccaagaaguaugccggggaccagacggguaaugggcaucacagccgaaugguuguggagaacccuuggccgaaauaagaaaccaaggcuauguacaagggaagaguucacuaagaaaguacgcacaaacgcagcaaugggugcaguuuucacagaagaaaaccaaugggacuccgcaaaagccgcaguugaagaugaagauuuuuggaaacuuguggaucgagaacgagaauuacacaaauuaggaaaauguggcucuuguguauauaauaugauggguaaaagggagaagaaacuuggcgaguuuggcaaagcaaaagggucacgugccauaugguauaugugguuaggcgcgcgauaccuagaguucgaagccuuaggauuucucaacgaagaucauugguucucuagagaaaauucuuacagugguguagaaggagaagguuuacacaaauuggguuauauauuaagagauauaaguaaaaucccuggaggagccauguacgcagaugacaccgcaggaugggauacgagaauuacugaagaugaucuucauaaugaggagaaaaucacucaacaaauggacccggaacaucgccaacuggcuaaugcaaucuuuaaacucacauaucaaaacaaggugguuaaaguacaacgucccacaccaacaggaacagucauggacauaauuucaagaaaagaccaaagaggaagcggucaaguggggacauauggauuaaauaccuuuacaaauauggaggcucagcuaauucgucaaauggaaggcgaaggaguucucucaaaagcggaccuagagaacccacacuuaccggagaagaaaauaacacaguggcuagaaacgaaggguguugagagauugaaacggauggcaauaucaggggaugauuguguggucaagccuauugacgauagauucgcuaacgcguuacuugcuuuaaacgacauggguaaagugcguaaagauaucccucaguggcagccaucuaaaggcuggcacgauuggcagcagguccccuucugcucccaucauuuucaugagcugauaaugaaagaugguagaaaauuagucguuccaugcagaccccaggaugaacugauuggcagagcuagaauuucacaaggagcaggauggagccucaaagaaacggcaugccucgguaaggcuuacgcucaaauguggagucuuauguauuuccacagacgagaccuacguuuagccucaaaugcaauaugcucggcuguaccuguacauugggugccaacaucgaggacaacauggucgauucacgcacaccaccaauggaugacaacugaagauauguugaccgucuggaauagaguauggauagaggacaacccauggauggaagacaaaaccccuguuacuacgugggaaaauguacccuaucuaggaaaaagagaagaucaauggugugguuccuuaauaggucuaacuagcagagcuaccugggcgcaaaacaucccaacugcuauccagcaaguacggucgcucauagguaacgaggaguuccuugacuacaugccuucaaugaagagauuucgaaaggaggaagagucagaaggagcgauaugguag

SEQ ID NO: 23213 - RNA, 9873 nt, Artificial Sequence
  derived and/or modified CDS sequence (opt6) from DENV-3__JF920402__SS-prME
acgucucuaugccuaaugaugauucuaccagcggcauuagcauuucauuuaacaagucgggauggugaaccacguaugauagucggcaaaaaugaaaggggaaaaucauuauuauucaaaacugcuucaggaaucaacaugugcacuuuaauagcuauggaucuuggugaaaugugugaugacaccgucacauacaaaugcccacacauuacagaaguugaaccggaagauauagauuguugguguaaccuaacuucaacuugggucaccuacgggacauguaaccaagcaggagaacaccgcagagacaaacggucaguugcauuggcgccgcauguaggaaugggucuagacacgagaacacagaccuggaugucagcugaaggugcauggaggcaaguggaaaaaguugagacaugggcauuacgucacccugguuucacaaucuuagcauuauuucuagcccacuauaucggcacaucgcuaacacaaaaagugguaaucuuuauucuauuaaugcucguaacaccgucaaugacaaugcguuguguaggaguuggaaauagggacuuuguggaaggucuaaguggagcaaccuggguagacguuguauuagaacacggcgguugcguuacaacuauggcuaaaaauaaaccaacauuggacauugagcugcagaaaaccgaagcaacacaacuagcuacucuaagaaaacucuguauagaaggaaaaauaacaaauauuacgacggauucaagaugcccuacccaaggagaagcaacacugccagaagaacaagaucaaaacuauguuuguaaacacaccuacguagauagaggauggggaaacggguguggcuuauuuggaaaagguucccuaguaaccugcgcgaaauuucagugcuuagaaccgauagaaggcaaaguaguacaacacgaaaaccuaaaauauacagugaucauaaccguucacacaggagaccagcaucaaguuggaaacgagacucaagguguuacagcugagauaacaccucaggcaaguacaacagaggcaaucuuaccagaauacgguacauuaggauuggaguguucaccuaggacuggacuagacuuuaaugaaaugauauuacuaaccaugaaaaauaaggcuuggauggugcaucgucaaugguucuuugaucuuccucucccguggacaucaggagcaacuacagaaacaccgacuuggaaccgcaaagaguuguugguuacauucaaaaaugcgcacgcgaagaaacaggaagucguaguauuaggaucgcaagagggcgccaugcauacagcgcuaacaggggcuacggagauacaaaauagugguggaaccucaauauuugcaggacaccuuaaaugccgacuuaaaauggacaaacucgaauuaaaaggaaugucuuacgcgauguguacgaacacauucguacuaaagaaagaaguuagcgaaacgcagcacggaacgauccucauuaaaguagaauauaaaggagaagacguaccguguaaaauacccuucucuaccgaggaugggcaggggaaagcccacaacggucgguuaauaaccgccaacccaguagucacuaagaaagaagaaccuguaaauauugaagccgaaccuccuuucggugaaucaaauauuguaauagguaucggagauaacgcguuaaaaaucaauugguauaagaaaggaagcucgaucgggaaaauguuugaggcgacagccagaggggcacgaagaauggcaauacuuggugauacagcaugggauuuugguagcguaggaggaguucuaaauaguuuggguaaaaugguacaucaaauauuuggcagcgccuacacagccuuguucagugggguaucauggguaaugaaaauugggauugggguucuacugacguggauaggccuaaauuccaaaaacacaucaaugaguuuuaguuguaucgcuauaggcauaauuaccuuauauuugggagcuguaguccaggcagacauggggugcgucauaaauuggaaagguaaagaacucaaaugugguaguggaauuuucguaacgaaugagguacauacguggacugaacaauacaaauuucaagcagauucaccaaaaagauuagcgacugcgauagcuggcgcuugggagaacgggguaugcgguauacgcucuacaacaagaauggaaaauuuacuuuggaaacaaauagccaacgaauugaauuauauuuuaugggagaacaacauaaaacuaacuguuguuguaggugauauaauagguguucuugaacaggguaaacggacacucacuccccagccaauggaauuaaaauauucauggaaaaccugggggaaagcaaaaauuguaacugccgagacacaaaacagcucuuucauuauugauggaccgaauacgcccgaauguccaucugugagccgcgcuuggaacguuugggaaguggaggacuauggguuuggugucuuuaccacaaacauaugguuaaaacuucgugaaguuuacacccaacugugugaccaucgucuuaugucggcagccguaaaagaugagagagccguacacgcugauaugggauacuggaucgaaagccagaaaaaugguaguuggaaauuagagaaagccucuuuaaucgaaguuaaaacuugcacauggccaaaaucacauacucuuuggucgaacggaguuuuggaaucugacaugauaauuccaaaaagucuagcuggaccaauaagucaacacaaucaucgccccgguuaccauacgcaaacugcugggccguggcaucuuggcaaacuugaacuugauuuuaauuauugcgagggaacgacaguaguaauaacagaaaauuguggagcgagaggaccuagccuaagaacuacuacgguuagugguaaacuaauacaugaaugguguugccgcucuugcacucuuccgccauugcgauauaugggggaagauggaugcugguacgggauggagauuagaccuauaucagagaaagaagaaaauaugguuaaaagucuagucucagcuggaucuggaaagguagacaauuuuacuaugggaguuuuaugucuagcgauccuauuugaggaagugaugagagggaaauuuggcaagaaacacaugauagcgggcguguucuuuacguuuguauugcugcuuaguggucaaauaacauggcgagauauggcacauacuuugauaaugauaggcaguaaugcaucagacagaaugggaaugggaguaacauaucucgcacuaauagcaacuuucaagauccaaccauuucuagcgcucggguucuuucuuaggaaauuaacaagucgugaaaacuuauugcugggaguggguuuagccauggcuacaacacuucaacuaccggaggacaucgagcaaauggcaaauggaauugcauugggcuuaauggcuuuaaaauuaauaacucaauuugaaauuuaccaacuguggaccgcacugauuagucuuacguguucaaauaccauauucacgcugacuguagcauggagaacugcaaccuugauacuugccggugugagucuucucccuaugugccagaguaguucaaugaggaaaacggauuggcucccuauggcaguagcugcaaugggagucccgccauuaccucuguucauauuuucacugaaagauacacuaaaacgaagaaguuggcccuuaaacgaaggagucauggcggucggacuugucaguauacuggcaucaagccuacuaagaaacgauguaccaauggcuggaccucugguugcagggggacuacuaauagcuuguuacguaauuacaggaacuucagcagauuuaacaguagagaaagcggcagacauuacaugggaagaagaagcagaacaaacggguguuagccauaaucuaaugaucacaguagacgacgauggcacaaugcggauuaaggacgaugaaacugaaaauauauuaacaguauugcuaaaaaccgcuuuacuuauugucucugguauauuccccuauagcauuccagcuaccuuacuuguuuggcauacuuggcaaaaacaaacccagagaucggguguacugugggauguacccucaccaccugaaacacaaaaagccgaacuugaagaaggaguauaccgcauuaaacaacaagguauauuuggaaaaacgcagguaggcguaggaguucaaaaagaaggcguauuccacacaauguggcaugugacuagaggggcagugcuaacuuauaacggaaaaagacuagaacccaacugggcaaguguaaagaaggauuuaauaaguuacggagggggcuggcgauugagugcucaguggcaaaaaggugaagaaguccagguuauugcaguugagccuggcaaaaauccuaaaaauuuucaaacaaugccugggaccuuccagacuacuacgggcgaaauuggggcaauagcucucgacuucaaaccggguacaaguggaucaccaauaauaaaucgcgaaggcaaaguagugggucuauaugggaauggaguagucacuaaaaaugguggcuauguaagcgguauagcucaaacaaacgcagaaccggacggaccuaccccugaguuggaagaagaaauguucaaaaagagaaaccuuaccaucauggaucugcauccuggaaguggcaagacuagaaaauaccugccggcuaucguacgagaagccauaaaaagaagauugcguacucuaauacuagcuccuaccagagucguugcugcggagauggaagaggccuuaaaaggucucccaaucagguaccaaacuacugcaacuaaaucagagcauacuggaagagaaauuguugaucuuaugugccaugcaacuuucacaaugagauuacuaucacccguacgcgucccuaauuauaacuugaucauaauggaugaagcacauuuuacugauccugcgucaauagcagccagaggauacaucucaacuaggguaggaaugggcgaggccgcugcaaucuucaugacagcaacuccaccgggaacggcugaugcguucccgcaaucuaaugcaccuauccaagacgaggagcgcgauauucccgaaaggagcuggaacuccggcaacgaauggauaacagauuucgcgggcaaaacaguaugguuuguuccuaguauaaaagcaggaaaugacauagcaaacugccuacguaaaaacgguaagaaagugauacaguuaagcagaaaaacauuugacacggaauaccagaaaacuaaauuaaacgacugggauuucguaguaacuacugacauuucagaaaugggagcaaauuucaaagcagacagagugauagacccccgaagaugucuuaaaccgguuauacugacagacggcccggaaagaguuauauuagcugggccaaugcccguuacugcugcaagugcggcacaaagaagagggcgaguuggaagaaauccacaaaaagaaaacgaucaguacaucuuuacuggacagccgcuuaauaacgacgaggaccaugcacacuggacugaagcuaaaaugcucuuagacaacauaaacacuccggaagguauuaucccugcacuguuugagcccgaacgagaaaaaucugcagcaaucgacggagaauaccgauugaaaggagaaucaagaaaaaccuuuguggaguuaaugcgaagaggggacuuaccgguaugguuagcccauaaaguugcuagugaaggcauuaaauauaccgaccguaaaugguguuuugacggucaaagaaacaaucaaauacuugaggaaaauauggauguagaaaucuggacgaaagagggggagaagaagaaacugcguccuagauggcucgaugcucgaacauauucugacccacuugcauugaaagaauuuaaagaguuugcggccgggagaaaaucgauugcccuugaccuaguaaccgagauugguaggguaccgucacauuuagcacauaggacuagaaaugcuuuagacaaucuggucauguuacacacgagugaacauggcggaagggcauacagacacgcagucgaagaacuaccagaaacgauggagacauuacuacuacuaggccuaaugauuuuauuaacaggcggcgcaaugcuuuuucuuauaagcggcaaaggaauaggaaaaacuucaauaggcuuaauaugcguuaucgccucuucagggaugcuuuggauggcugaaauaccucuccaguggauagcaagugcaauaguucuagaguucuuuaugaugguuuuauuaaucccagaacccgaaaaacaacgaaccccgcaagauaaucagcuugcuuacgugguuauagggauuuuaacgcuagcugcaaucauagcggcaaaugaaaugggacugcuagaaacuacgaaacgagauuuagggauguccaaagaaccagggguaguguccccuacaaguuaucuagauguagaucuucauccggcuucggcuuggacguuauacgccgucgcgacuacuguaaucacaccaaugcugcggcacaccauugaaaauucaacagcaaacguuucauuagcggcuauugcgaaucaggcggugguacuuaugggguuagauaaagguuggcccauaaguaaaauggaccuaggaguuccuuuauuagcucuaggguguuacagucaaguaaauccucugacacucacugcagccguuuuacuucuaauuacacacuaugcgauaauugguccagguuuacaagcaaaagcgacaagagaagcacaaaaacggacugcagcagguaucaugaagaauccaacuguagacggaauuaugaccaucgaucuagaucccgucauauaugacucaaaauuugaaaaacagcuuggacaaguuaugcuacuuguguugugcguuguacagcuacuccuaaugcggacaagcugggcacuuugugaagcucuuacacucgcaacaggaccuaucacaacucuuugggaagggagcccuggaaaauucuggaacaccacaaucgcugucaguauggcaaauauuuuuagaggaucuuacuuggcaggcgcaggacuugcguuuucaauaaugaagucuguuggaacggguaaacgcgguacgggaagucaaggagaaacacuuggagagaaguggaagaagaaauuaaaucaacuuagccguaaagauuuugaccuuuauaagaaaagugguauuacugaagucgauagaacagaggccaaagagggauuaaaaagaggagaaauaacacaucaugcgguaucuagaggaucagcgaaauuacagugguuuguugagcgcaauauggugauucccgaaggaaggguuauagaccuaggaugcggccgcgguggguggucguacuauugugcaggguuaaagaaaguaaccgaagugcgcgguuauacuaaagguggaccuggacacgaagaaccaguaccaaugucaacauacggguggaacaucguaaaauuaaugucagggaaagaugucuuuuaccuuccgccagaaaaaugcgacacccuguugugcgauauuggcgaaagcagcccauccccaaccguagaggaaaguagaacaauccgaguauugaaaaugguugaaccauggcuaaagaacaaccaauuuuguaucaaaguuuuaaauccauacaugccuacuguaauagaacacuuagaacgacuucaaagaaaacauggaggaaugcuagugaggaacccauugucaaggaacucuacucaugaaauguauuggaucuccaacgggacaggcaacauaguagccucaguaaauaugguuucuagauuacuacucaauagauucacaaugacucaucggagaccgacaauagaaaaagacgucgaucuuggugcaggaacuagacauguuaaugcugagccugaaacucccaacauggauguaauaggagaaagaauaaaaagaauuaaagaagaacauaacucaacauggcacuaugaugacgaaaauccuuauaaaacaugggcauaucaugguaguuaugaaguaaaagcuaccgguuccgcuucuaguaugauuaauggcguggucaaauuauugacuaaacccugggauguuguuccaaugguaacacaaauggccaugacagauacaacgccguuuggacaacagagaguuuuuaaagaaaaaguagacacaaggacgccccggucaaugccagggacuagaagaguuaugggaauaacugccgaauggcuauggagaaccuuaggacggaauaagaaaccacgcuuaugcacgagagaggaguuuacuaaaaagguaaggacuaacgcagcuaugggagcgguuuuuacugaagaaaaccagugggacagugcuaaggcagcuguagaagacgaggacuuuuggaaguuaguugaccgagaaagagagcuacauaaguuagggaaauguggaucuuguguguauaauaugauggggaagcgagagaagaaauugggugaauuuggcaaagcuaaagguucaagagcgauaugguacaugugguuaggggcgcgauauuuagaauuugaagcccuaggcuucuuaaacgaggaccacugguuuaguagagaaaacagcuauagugguguugaaggagaaggguugcacaagcuaggauacauauuaagagacauaucaaaaauaccaggaggagcaauguaugcagaugacacggccgggugggauaccagaauuacagaagacgacuugcauaaugaagagaaaaucacacagcaaauggacccagaacacagacaacuggcaaaugcuauauuuaaguugacuuaucaaaacaaagucgugaaaguucaacggccaacccccaccggcacaguaauggauauuauuucgaggaaagaucaaaggggaucaggacaaguagggacuuauggauuaaauacuuucacgaauauggaagcgcaauuaauaaggcagauggaaggagagggaguauuaucuaaagcggacuuagaaaacccucaucugccagaaaagaaaaucacgcaauggcuugaaacaaaagggguagaaagguuaaagaggauggcaaucaguggggaugauugugugguaaaaccuauugacgaccgauuugcaaaugcucuuuuagccuuaaaugauaugggcaagguacgaaaagacauaccacaauggcagccaaguaaaggguggcaugauuggcaacaaguucccuucuguucacaccauuuucacgaguugauaaugaaagacgggaggaagcuagucgucccaugucgcccgcaggacgaacuaauuggccgggcacgaaucucgcaaggagcaggauggucauuaaaagaaacagcaugccuugguaaggcguacgcucagauguggagccugauguauuuccaccgccgggaucuacgacuagcaucaaaugccauuuguagugccgucccaguucauugggucccaaccagccgaacgacauggagcauacaugcucaccaccaguggaugaccacugaagauaugcucacaguauggaaucgaguauggauagaagacaauccauggauggaggauaaaacacccgucaccacuugggaaaaugucccuuauuuagguaaacgagaggaccaauggugcgguucuuugauagggcucacuucaagagcgaccugggcacagaauaucccuacagcaauccaacaggugcgaagucuaaucgggaaugaagaguuccuagauuacaugccuucuaugaaacgguuccgaaaagaagaggagagugaaggagcaauaugguga

SEQ ID NO: 23214 - RNA, 9873 nt, Artificial Sequence
  derived and/or modified CDS sequence (opt6) from DENV-3__JF937652__SS-prME
acauccuuaugucuaaugaugauacuaccagcggcacuagcguuccauuugacaucaagagacggagaaccuaggaugauuguggguaaaaaugaacgaggaaaaucauuauuauucaaaacagcaagcggaauuaauauguguacacuaauagcuauggauuuaggagaaaugugcgacaacacugucacauauaaaugcccgcacauuacggaagucgaaccugaagauauagauugcugguguaauuuaacaaguacuuggguaacauauggaacuuguaaucaagcgggggaacauagaagagauaagcgguccguagcucuugcuccgcauguaggcaugggguuggauacaagaacacaaaccuggaugucggcagaaggggcauggaggcaaguugaaaaaguugaaacaugggcacugcgacacccuggauuuacaauccuagcacuuuuucucgcccauuauauaggaacuucauugacucaaaaaguuguaauauucauucugcuaauguuggucacccccucuaugacaaugagaugcguaggaguugguaacagggacuucguggaaggacuuagcggugcaacuuggguagauguuguauuagaacaugguggcugcgucacgaccauggcuaaaaacaaacccacccuagacauagaacuacagaaaacggaagccacucaacuugcaacucuaagaaaauuaugcauugaaggaaaaauuacaaauauaacgacagauagucgauguccgacgcagggugaagcgacucuacccgaagaacaagaucaaaacuauguuuguaaacauacuuauguagauagaggauggggcaacggcugcgggcuguuuggaaaagguagcuuaguuacuugugccaaauuucagugccuugaaccaauagaaggaaaaguaguucaguaugaaaauuugaaauacaccguuaucauuacuguucacacuggagaccaacaucaaguuggaaaugaaacccagggaguuaccgcggaaauuacgccacaagcauccacaacagaagccgugcugccagaauaugguacauuaggacuggaaugcucaccuagaacaggguuagacuuuaaugaaaugauccugcuuacgaugaaaaacaaggcuuggaugguacaccggcaaugguucuuugacuugccuuugccguggacaucaggugcaacaacggaaacacccacauggaaucgaaaagaacugcuuguuacauuuaaaaacgcacaugccaagaaacaggaaguaguagucuuagguucgcaagaaggcgcuaugcacacagcgcugacuggagcuacugaaauacaaaauucagguggaacgaguaucuuugccgggcaccuaaaaugccgcuugaaaauggauaaacucgaacucaaagggaugucuuacgccaugugcacaaacacauuuguauugaagaaagaagucagugaaacucagcacggaacuauuuuaaucaaagucgaauacaaaggcgaagacgugccuugcaaaauccccuucucgacagaagacggacaaggaaaagcacacaacggcagauuaaucacggcaaauccagugguaacuaagaaagaagaauuaguuaauauagaagccgaaccaccuuucggggaaucuaacaucgucauuggaauaggagacaacgcucugaaaauaaauugguacaagaaaggaucuucuaucggaaaaauguucgaagcgacugcucgaggcgcgagaagaauggcgauacugggugacacagccugggauuuuggaaguguuggagguguacuuaauagcuuaggaaaaaugguucaucaaaucuucggcuccgcuuacaccgcacuguucagcggaguuucauggguuaugaaaauagguauaggugugcucuuaaccuggauuggcuuaaauucuaaaaauacaucaaugucauuuuccuguauagcuauuggaaucauaacucucuaucuaggagcagucguacaagccgacaugggcugcguuaucaacuggaaagggaaagaacuuaaaugcggaucugguauuuucgucacuaacgaaguccauacuuggacggaacaguauaaauuucaagcggauucaccuaaaagacuugccacagcaaucgcaggagcaugggaaaacggaguuugcggcauucgcagcacuacccguauggaaaauuuacuuuggaagcaaauagcuaaugaacuaaauuauaucuugugggaaaacaacauaaaguugacugugguagugggcgacauaauagggguuuuagaacagggcaagcgcacucucacuccgcaaccuauggagcuuaaauauuccuggaagacuugggguaaagccaaaauagugacagcggaaacccaaaacucuagcuucauuauugacggaccaaacacaccugaaugcccuucaguaaguagggcuuggaaugucugggaaguugaagacuaugguuuugguguuuuuacuacaaacauuugguuaaagcuaagagaggucuauacacaacuuugcgaccauagguuaaugagugcggcagugaaagacgagcgugcuguacaugccgacaugggcuacuggaucgaaagccaaaagaacgguaguuggaagcuagaaaaagcaagucuaauagagguaaagacauguacauggccaaaaagccacacucuuuggucgaauggcguauuggaauccgacaugauaauaccaaaaucauuagcgggaccgauuucacaacauaauuauagaccaggauaucauacacaaacagcuggcccuuggcaucuggguaaacuagaauuagauuucaacuauugcgaggguacaacaguagugaucacagagaacugcggaacccgagguccuucacuaagaacuacgacagucucuggaaagcugauucaugaauggugcugucgguccugcacgcugccaccauuaagauauaugggggaggauggaugcugguauggaauggagauuagaccgauuucugagaaagaagagaauaugguaaaaucccuaguaucagcugguuccgguaaaguagauaacuuuacaaugggaguauugugucuggccauucuguuugaggagguuaugcguggaaaauuaggcaagaaacauaugauagcuggaguguucuuuacuuucguuuuguuacuaucgggccagauuaccuggagggauauggcacauacccuaauuaugauagguucaaaugcuagcgacagaauggguaugggagucaccuaucuagcacucauagccacguucaaaauacaaccauuucuagcucuggguuucuuucugaggaaacuaacaucuagagaaaacuuacuucugggaguaggcuuagcaauggcaaccacacuucagcuucccgaggauauagaacaaauggcgaauggcauugcccugggacucauggccuuaaaacuuauaacgcaauucgaaaccuaccaacuauggacugcacuuauaucuuuaacauguucuaacacgauuuucaccuuaacugucgcguggagaacugcaacacuuauucucgcaggaguaagucugcuaccaguaugucaaaguaguagcaugagaaagacugacuggcuaccaauggcagucgcagccauggguguaccgccauuacccuuguuuauuuucggucuaaaagacacucuaaaacgaagaagcuggccuuuaaaugagggcgucauggcaguuggauuaguaucaauacuggcuagcagccuucuucgaaaugauguaccgauggccggcccuuugguugccggaggacuacuuauagcaugcuacguaauaacuggaacuucagcagaucuaaccguggaaaaggccgcugauaucacaugggaagaagaagcagagcaaaccggaguaucgcacaaccuaaugauaaccguugacgacgauggaaccaugcgaauuaaagaugacgaaacggaaaacauuuugacaguuuuacugaaaacugcccuccuuaucguuagcggaauuuuuccuuacucaauaccggccaccuuacuuguuuggcauacuuggcaaaaacaaacacaacguucagguguucuaugggaugugccuucaccgccugaaacacaaaaggccgaauuagaagagggcguuuaccgaaucaaacaacaggggauauuugggaaaacgcaagucggaguaggagugcagaaagagggagucuuccauacaauguggcacguaaccagaggagcuguacucacuuacaacgguaaacgccuugaaccaaauugggcgaguguaaagaaggauuuaauaucguauggagguggcuggcgucucagcgcccaauggcagaaaggagaggaagugcaagugauagccguugaaccagguaaaaaucccaaaaacuuucagacaaugcccgguacauuucaaacaacaacuggugaaauaggagcaauugcuuuagauuuuaaaccagguacuuccggauccccaauuaucaaucgcgaaggcaaagugguuggucuauacggaaacggagucguaaccaaaaacggaggcuauguaucagguauugcacaaacaaacgccgaaccggacgguccaaccccugaguuagaggaagaaauguuuaagaaacgaaaucuuaccaucauggauuuacauccuggaagcgggaaaacacgaaaauaucuuccggcuauuguaagggaggcaauuaaaaggcgcuugcgaacucugauacuagcaccgacaagggucguagccgcagaaauggaagaggcuuuaaaaggacucccuauaagauaccagacuacagccacaaagagugaacauacaggccgugaaaucguugaccucaugugucacgcgaccuucaccaugcguuuacuuagccccguaagaguaccaaacuacaaccuuaucauuauggacgaagcucauuuuacggacccagcuucaauugccgcucguggguacauuucaacacgaguggguaugggggaagcggcagcaauauuuaugaccgccaccccaccaggaaccgcagaugcauuuccacaaucuaacgcuccaauccaggaugaagaaaaggauauucccgaacgaucguggaauaguggcaaugaauggauaacagauuucgcuggaaaaacuguuugguuuguacccuccauaaaagcagguaaugauauagcaaacuguuugaggaaaaaugggaagaaagugauacaauugucgaggaaaacuuuugauacagaauaccagaaaacgaagcuaaacgauugggacuucguaguaacaacagauauaucagaaaugggggcaaauuuuaaggcggaucgaguaauagacccucgccgguguuuaaaaccaguaauauugacugacgguccagaaagaguuauucuugccgguccgaugccaguuacagcggccucugcugcgcagagaagaggaagaguaggucguaacccucagaaagaaaaugaucaguacauuuuuacugggcaaccauuaaauaaugaugaagaucaugcccauuggacugaggccaaaaugcucuuggauaauauaaauacgccagaaggaauaauuccugcacucuucgaaccagaaagagagaaauccgcugcgauugacggagaauaccguuuaaagggugagucaagaaagaccuuuguugagcuaaugagacguggggauuuaccgguguggcuagcacacaaaguugcuucagaaggaauuaaauauacagauaggaaaugguguuuugacggccagcgaaauaaccaaaucuuggaagagaacauggacguagagaucuggacuaaagaaggagaaaagaagaagcuaagaccucgaugguuggaugcaagaacuuauagcgacccguuagcacuaaaagaauuuaaagaguucgccgcaggucgaaaauccauagcgcuagaucuaguuacagaaaucggcagggugccaucacaucuggcacauagaacaagaaaugcauuagauaaucucgugaugcuacacacaucagagcacgguggcagagcuuauagacaugcagucgaagaauuaccugagacaauggaaacucuguuauuauuaggacuaaugaucuuacucacuggaggagcuauguuauuucuuauaaguggaaaagguauuggcaaaacauccauagguuuaauuugugugauugcaagcucaggaaugcuguggauggcugaaauaccuuuacaauggauugccagugccauaguacuugaauuuuucaugaugguuuuacuuauaccagagccagaaaaacaaagaacgccacaagacaaccaguuagccuaugucgucauagggauauuaacacuggcugcuauaaucgccgcuaacgaaauggggcuacuagagacuacaaaaagggauuuaggcaugucaaaagaaccgggcguaguaaguccaaccucauacuuagauguagauuugcacccagcuagugcauggacacucuaugcaguugcaacaaccguaauaaccccuaugcuacggcauacuauugaaaacuccaccgccaauguaagucuagcugcgaucgcuaaucaagccguugugcuuaugggacuagacaaaggauggccgauaucaaaaauggaccuaggaguuccccuucucgcacucggcuguuacagucaagugaacccccuuacuuuaaccgcggccguuuugcuacucauuacacauuaugcaauaaucggaccuggauuacaagcgaaagccacucgagaagcacaaaaacggacugcagcgggaaucaugaagaauccaacgguagacgguaucaugacaauugauuuagauccgguaauuuacgauucuaaauucgagaaacaauuaggacaagucauguuauugguuuugugcgcaguccaacuguuauuaaugaggaccucuugggcuuuaugcgaagcacuuacacuagcaacaggaccgauaacaacuuuaugggaaggcagcccuggaaaauucuggaacacgacuauagccguaucuauggcaaacauauuuagggguaguuauuuggccggagccggacuagcauucaguauaaugaagucuguuggaacaggaaagagaggaacggggucacaaggggaaacauuaggggaaaaguggaagaaaaagcuaaaucaacuaagccgcaaagacuucgaccuauauaagaaauccggaauaacggaaguagauaggacggaggccaaggaaggucuaaaaaggggugaaaucacacaccaugcuguaaguagaggcucugcuaaguuacagugguuugucgaaagaaauauggucauuccggaaggaagaguaauagacuugggaugcgggcgaggcggguggucauauuacugugcaggucuuaagaaaguaacagaagugcgagguuauacaaagggcggaccaggacaugaagaaccaguuccaaugucuaccuacgguuggaauaucguaaaauuaaugucaggaaaagauguauuuuauuuaccgcccgaaaaaugugauacacuuuuaugugacauuggagaaucaaguccguccccuaccguagaggaaaguagaacuauaaggguuuugaaaaugguugaaccaugguugaaaaacaaccaauuuugcauaaagguccuaaauccuuauaugccgacaguuaucgaacacuuggagaggcugcagcggaaacauggcgguauguugguaagaaacccauuaucucgaaauucuacccaugagauguauuggauaaguaacggaacuggaaacauugucgcaucagugaacaugguaagcagacuauuauuaaaccgauuuaccaugacgcaucguagaccaacgaucgaaaaagacguggauuuaggagccgguacacgacaugucaaugcagaaccagaaacaccuaauauggauguaauuggugaacgaauuaaacgcauaaaagaggaacacaacaguacguggcauuaugacgacgagaauccguauaaaaccugggcauaucaugguucguacgaggucaaagcaacagguucagcuucaaguaugauaaaugguguggucaaauuauuaacuaaaccaugggauguggugccgauggucacacagauggcuaugaccgauaccacgcccuucggucaacaaagagucuuuaaagagaaaguagauacacguacgccuagaaguaugccuggcaccaggaggguuaugggaauaacagccgaaugguuauggagaacucuagggagaaacaagaaaccaagauuauguaccagagaagaguucaccaagaaaguaagaaccaaugcugcuaugggugcaguuuucacggaagaaaaucagugggauuccgcaaaggcggcgguagaagaugaagauuuuuggaaguugguagaucgagaaagagaacugcacaagcuaggcaaguguggaucuuguguauauaauaugauggggaaaagagagaagaaacuaggggaguucgguaaagcuaaagguagcagagccaucugguauaugugguuaggagcacgguaccuagaguucgaagccuuaggauucuugaacgaagaccauugguucaguagagaaaauucuuauaguggaguagaaggcgaaggucuacauaagcuaggauauauccuacgagauauaucaaaaaucccgggaggagcaauguaugcagaugauacagccggaugggauacuagaauaacugaagacgaccuccauaaugaagaaaagauaacacaacaaauggauccagagcaccgacagcuagcaaaugcaauauuuaaacuuacauaucagaauaaagucguuaagguucaacggccaacuccuaccgguacaguaauggauauuaucucuagaaaggaccagcguggaucagggcagguuggaacauauggucuuaauacauuuacaaauaugggagcacaauuaauaagacagauggaaggugaagggguuuuaucaaaagccgaucuggaaaauccgcauuuaccagagaagaaaauaacccaaugguuagagaccaaagggguggagcgauuaaaacgaauggcaauuucaggugaugacugugucguuaaacccauagaugauagauuugcuaacgcuuuacucgcccuaaaugauaugggaaaagugagaaaagacaucccccaguggcagccaagcaaaggauggcaugacuggcaacaaguccccuuuugcucccaccauuuccaugaauugauaaugaaagaugguagaaaacucgugguuccuuguagaccucaagaugagcugauuggucgagccaggauuagucaaggugccggcuggucacuuaaagaaacugccugucuugguaaggcauaugcucaaauguggucacuuauguauuuccauagacgggaccuuaggcuugccucgaacgcaauuuguagcgccguaccaguucacugggugccaacaaguaggaccacauggaguauacacgcgcaucaccaauggaugacuacggaagauauguuaaccguuuggaauagaguauggauagaagauaaccccuggauggaagauaaaacgccagucacuacaugggaaaaugugccauaccuuggcaaacgcgaggaccaauggugcgggagcuuaauagguuuaacaucacgugcaacuugggcccaaaacauaccaacggcuauucagcaaguuagaaguuugaucgguaacgaagaguucuuagauuauaugccgucaaugaagagauuuagaaaagaagaagagagugaaggagcuauuugguaa

SEQ ID NO: 23215 - RNA, 9873 nt, Artificial Sequence
  derived and/or modified CDS sequence (opt6) from DENV-3__JF920404__SS-prME
acaucuuuaugccugaugaugauacuuccugcggcucuagcauuucaccuuacaucuagagauggugaaccaaggaugauaguuggaaaaaaugagagaggaaaaucauuacucuuuaaaacagcauccgguauaaauauguguacauuaauugcaauggaccuuggagaaaugugugacgauacuguuacguacaagugcccgcauaucaccgaaguagagccugaggacauugauuguugguguaaccuaaccuccacauggguaacauauggaacguguaaccaagcaggugaacauaggcgugacaagagaucaguggcacuggcuccucacgucggcaugggcuuagauacaaggacacaaaccuggaugagugcugaaggagcguggcgacaaguggaaaagguugagacuugggcgcugcgccauccgggauuuacuauucucgcccucuuucuggcacauuacauugguacuaguuuaacucaaaaaguugugauuuuuauucuacuuauguuagugacaccauccaugacuaugagguguguagguguagggaauagagauuuuguagaaggacuuuccggagcaacauggguggacguaguacuagaacacgguggcugcguuacuaccauggcgaaaaacaaaccaacccuugacauagaauuacaaaaaacagaagcgacccagcucgcaacuuuacgaaaacuaugcauagaaggaaagauuacuaacauuacgacagacagucgauguccaacacaaggugaagcaacccuuccggaagaacaagaccagaacuacguuuguaaacacacauauguggaucguggguggggcaauggcugcggucuuuuuggaaaaggaagcuuagucacaugugccaaauuucaaugucuugagccuauugaagguaaggucguacaguacgaaaacuugaaguauacagucauaauuaccgugcauaccggggaucagcaccagguaggaaacgaaacucaagguguuacggcagaaauaacuccacaagcgaguacaacagaggcuauucuaccagaauauggaacucuaggguuagaauguucaccucgcacaggacuugacuuuaaugaaaugauacuuuuaacaaugaaaaacaaagcauggaugguccauaggcaaugguuuuucgaccuaccauuaccauggacgagcggagcuacuacugaaacccccaccuggaauaggaaagaauuauuggucacuuuuaagaaugcacaugcuaagaaacaggagguugucguucucgguucacaagaaggugccaugcauaccgcauuaacaggcgcaacagaaauacaaaauuccggaggcacuucuauuuucgccggucaccuaaaaugucgauuaaaaauggauaaauuggaacugaaagguaugucguaugcgaugugcaccaacgcuuucguauugaagaaagaagugagcgaaacacaacauggaacaauacuaaucaagguggaauacaaaggugaagauguaccaugcaaaauuccguuuuccacggaagaugggcaaggcaaggcacauaaugggaggcuaauuacagcuaaucccguagucacuaaaaaggaagagccaguaaacauagaagcagagccacccuuuggcgaaagcaauauaguaaucggaauaggggauaacgcauuaaagauuaauugguauaaaaaagggaguucgauugggaagauguucgaagcgacagcaagaggugcccgacgaauggcuauauugggggauacagcaugggauuuugguagcgucggaggcguacuaaauagcuuaggaaaaauggugcaucaaaucuuugguucggccuacacugccuuauuuaguggaguaagcugggugaugaaaauaggaauaggaguccuuuugacauggauuggacugaacucgaaaaauacgucgaugagcuuuuccugcauugcuaucgguauaauaacauuauaccugggagcaguagugcaagccgauaugggaugcguuauuaacuggaagggcaaggaauugaaauguggcuccggcauauuuguaacaaaugaaguucauacuuggacagagcaguauaaauuccaagccgacucuccgaaacgauuagcaacggccauagcaggggcuugggaaaacggaguuugugguauuagaucgacuacaagaauggaaaacuuacucuggaaacaaaucgcaaaugagcuuaauuauauauuaugggaaaacaauauuaaauuaaccguaguaguaggagacauaaucgguguacuugagcagggaaagagaacauuaaccccacaaccaauggaguuaaaauacucguggaaaacaugggggaaagcuaaaauuguaacagcagaaacucaaaacagcagcuuuauaauugacggccccaauacgccagaguguccaucaguuagcagagcauggaacguaugggaaguugaggauuacggauucggaguauuuacaaccaauauaugguuaaaguuaagagaaguauauacgcaauuaugugaccauagauuaaugagcgcagcagugaaagaugagagagcuguccaugcagauaugggauauuggauugaaucccaaaaaaacgggucguggaagcuugaaaaagcuucucuaauugaaguaaaaacuuguacuuggccaaaaucacauacauuauggucaaauggcguauuagaaagcgacaugauaauaccuaaaucccuugcuggacccauuucccaacauaaucaccgccccggauaccacacgcaaacagcaggcccauggcaccuggguaaguuagaauuagacuuuaauuacugcgaaggaacaacuguuguuauaacagagaacugcgguacccggggaccaagucuaaggacgacuacugucaguggaaaauuaauucacgaauggugcugcagaagcugcacacuaccuccacuccguuauaugggugaagaugguugcugguauggaauggaaaucagaccgaucagugaaaaggaggaaaauauggucaaaucacucgucucagcgggaucaggcaagguagacaauuucaccaugggaguacuuuguuuagcuauccuuuucgaagaagucaugagagguaaauuuggaaagaaacauaugauugcagguguauuuuuuacuuucgucuuacuucuaagcgggcaaauaacguggcgcgacauggcccauacauugauaaugauuggaucgaacgcuucugaccggauggguauggguguaaccuacuuagcgcuaauagcaacguuuaaaauacaaccuuuccuagcauuagguuuuuuucugcguaaguuaacgaguagagaaaacuuacuucuuggcguuggucuagccauggccacuacauugcaauugccugaagauauagaacaaauggcgaaugguauagcauuaggauuaauggcguuaaaauuaauaacacaguuugagacauaccaacuuuggacagcucuaauuucccuaacuugcaguaauacaauauucacauuaacgguagccuggcguacagcaacacuaauucuugcaggggucaguuuacugccagucugucagucguccucaaugagaaaaaccgacugguugcccauggcaguagcagcaaugggaguuccaccucugccacuguuuauauucggguuaaaagacaccuugaaaagaagaagcuggccguuaaaugaaggagucauggccguaggacuagucuccauucuugcgucaucacuauugcguaaugaugugccgauggccggaccgcuggucgccggaggacuucuaauugcauguuauguaauuacagguacauccgcagauuuaacagucgagaaagcagcagacaucacaugggaggagggagcugaacaaacagguguuucacauaaccuuaugauaacaguugacgaugaugguacaaugcggaucaaagaugacgaaacggaaaauauucuaacaguacuccugaagacagcccugcuaaucguaaguggaauuuucccuuacucaauuccugccacucuauuaguguggcacacuuggcagaaacaaacgcaaaggaguggaguacucugggacgugccgagcccuccggaaacacaaaaagcagaacucgaagaggguguuuaucggauaaagcagcaagggaucuucggcaaaacacaaguaggcguugguguccaaaaagagggagucuuucacacgauguggcacgucacuagaggugccguguuaacauacaaugguaaaagauuagagccuaauugggcaucugucaaaaaagauuuaauuucauacgguggaggauggcgauugucagcccaguggcaaaaaggagaggaagugcaaguaauagcuguugaacccggaaaaaacccaaaaaauuuucaaacaaugccgggaacuuuccaaacaaccacaggagaaauaggagcuauugcccuggauuuuaagcccgguacgagcgggucacccaucauaaaucgggaagggaaaguugucggauuguacggcaauggagucguaacaaaaaauggggguuauguaaguggaauugcacagacaaaugcagaaccagauggaccuacaccagaauuggaagaagagauguucaaaaaaagaaacuuaacuaucauggaucuucauccggguucaggaaaaacaagaaaauaucuaccagcaauaguuagagaagcuauaaaaagacgacuaagaacucucaucuuggcgccuacccgaguuguugcugcggaaauggaggaagcacuaaagggucuuccgauacgauaucagacaacggccaccaaaagcgaacauacuggucgugaaauaguagaucuaaugugucaugcuaccuuuacgaugaggcugcuuagccccguuaggguccccaauuacaaucugauuauaauggaugaagcgcacuucacugauccagcuucaaucgcugcucgaggauauaucucgacgcggguaggaaugggugaagcagcagcaauauuuaugacggcuacuccaccggggacugcugacgcuuucccccaaucgaaugcgccaauacaagaugaagaaagagacauuccugagcguucauggaauuccgguaaugaauggauuacugacuuugcuggcaaaacugucugguucgucccgucaauaaaagccgguaacgauauagcaaacuguuugcgaaagaauggaaaaaaagucauacaauuaaguagaaaaacguuugauacugaguaucagaagaccaaauuaaacgauugggauuucguuguaaccacagacaucucggagaugggagcaaauuucaaagcagauagaguuauugauccuagacgaugccuaaaacccgucauccuaacagacggcccggaaagagucauucuggcagguccaaugcccgugacagcagccucagcagcacaaaggcgagguagaguaggccgaaauccacagaaagagaaugaucaauacauauucacaggucaacccuuaaauaaugaugaagaccacgcacauuggacagaagcaaagauguuacucgauaacauaaacacaccugaggguauaauucccgccuuauucgaaccagaaagggagaaaucggcggcaaucgacggagaauaucgacucaaaggugaaucccggaaaacauucguugaguuaaugagaaggggcgacuuaccuguuuggcuagcacacaaaguggcaagugaaggcaucaaguauacagaccgcaaaugguguuuugacggacaaagaaauaaccagauauuagaagaaaacauggauguugaaauuuggacaaaggaaggagagaaaaaaaaacuuaggccgagaugguuagaugcuagaaccuacagugacccuuuagcgcuaaaagaauuuaaagaguucgcagcugguagaaaaucaauugcauuagacuuggucacagaaaucgguagaguccccagucaccuugcacauaggacaaggaaugcacuagacaaucuugucauguuacacacaucggagcacgggggucgugcauacagacaugcuguagaagaauugccagaaacaauggaaacguuauuauuguugggguuaaugauucuccuuaccggaggcgcaauguuguuucuuauaagugguaaaggaauaggaaaaaccaguauaggacuaauauguguaaucgcuagcagugguaugcuauggauggccgaaauuccguugcaauggauagcaagugcaauaguucucgaauucuucaugaugguacucuuaauaccagaaccagaaaaacagcggaccccacaggauaaucagcucgccuacgucguuauuggaauucuuacguuagcugcgaucauagccgcuaacgagauggguuuauuagaaacuaccaaaagggaucuuggaauguccaaagaaccaggggugguaagcccaacuucuuaccuagauguugaccuccauccagcaucggcauggacacucuaugcuguggcgacuacaguaauuacucccauguuaagacauacgaucgaaaacuccaccgcgaauguuuccuuggcggcaauagccaaucaggcaguagucuugaugggguuagauaaaggguggccuauaaguaaaauggauuuggguguuccguuacucgcuuuaggauguuauagccaaguuaacccuuuaacguuaacugccgcuguacuuuuauuaaucacgcacuaugcuaucauugggccagguuuacaagcaaaagcaacucgugaggcucagaaaagaaccgcggcaggcaucaugaagaauccaacaguggacggaauuaugacaauugaccuagauccaguaauuuaugauucgaaauuugagaaacaacuaggacaaguaauguugcuaguacuaugcgccguucaacuacuacuuaugcguacaaguugggcauuaugugaggcuuuaacucuggcaaccgggcccauuacuacauuaugggaagggaguccaggaaaauucuggaauacuacaauugcuguauccauggcgaacauuuucaggggcucauaucuagcaggugcaggucuagcguucaguaucaugaaauccgucggaacgggaaagagaggaacaggaucucagggcgagacucuaggcgaaaaguggaagaagaaacucaaucaauugaguagaaaagauuuugaucuauauaagaaaagugguauaacagaaguagaucggaccgaggcgaaggaagguuuaaaacggggugaaauuacacaucaugcagucucuagaggcucagcaaaacuccaaugguuuguugaacgaaauaugguaauuccggaaggcaggguuauagaccuuggaugcggaagagggggcugguccuacuauugcgccggucucaagaaagucacugaaguuagaggauacaccaaaggagguccaggacaugaagaaccaguaccaaugucaacauauggauggaacaucgucaaguugaugagugguaaagacguuuuuuauuuaccuccggaaaaaugcgauacucuuuuaugugacauaggugaguccucgccgaguccgacuguugaagaaaguagaacaauuaggguauuaaaaaugguugaaccuugguuaaaaaauaaucaauuuugcaucaaaguuuuaaauccauacaugccaacuguaauagagcauuuagaaagacuccaaagaaaacaugggggaauguugguacgcaacccacuaucaaggaacucuacacaugaaauguauuggauuucaaacgguacaggcaacauagucgcaucgguaaacauggucagcagguuauuacuaaaccgcuucaccaugacccauaggaggccaacaauugaaaaagacguagauuugggggcggggacaagacauguaaacgcggaaccugagaccccuaacauggacguaauaggagagagaauaaaacgaaucaaagaagaacauaacucaacguggcauuaugaugaugaaaauccauauaaaacgugggcauaccaugggaguuaugaagucaaagcuaccggaucugcuaguagcaugauuaauggaguaguaaaauugcuuacuaaacccugggauguaguuccaaugguuacacaaauggcaaugacagacacuacccccuuuggucagcaaaggguauuuaaagaaaaaguugacacaagaaccccacgaucaaugccaggcacgagaagaguuaugggaauaacggcugaaugguuguggcgaacacucggaagaaauaaaaaaccgagauuguguacucgagaagaauuuacaaaaaaaguacgaacaaaugcggccaugggagcugucuuuacugaggaaaaccaaugggauagugcuaaagcggccguggaagaugaggauuuuuggaaacuuguggaccgagaaagagaacuacauaaacuaggcaaaugcggauccuguguguacaacaugauggguaaaagagagaaaaaauuaggagaguucgguaaagcgaaagggucucgcgcgauaugguauaugugguuaggagcacgauaccucgaguucgaagccuuaggauuucugaaugaggaccauugguucucacgagaaaauucguauucuggggucgaaggagaagguuuacacaaacucggguauauuuuacgggauauuuccaagauucccgguggugcaauguacgccgacgauacagcaggaugggauacaagaauaacagaagaugaucuucauaacgaagaaaagauaacacagcagauggaucccgaacaccggcaauuagccaacgcaauauuuaaauuaacuuaucagaauaaggucguaaaggugcaaagaccaacccccacaggaacaguuauggacauaauauccaggaaagaccaacgagguucgggccaaguagggaccuacggguugaauacauuuacaaauauggaagcacaguuaauaagacaaauggaaggcgaaggaguucuuuccaaagccgaccuagagaauccucacuuaccggaaaaaaagauaacacaaugguuggaaacuaaaggaguagaacgguuaaaacggauggcuauuaguggagaugacuguguaguuaagccgauugacgacagguucgcaaaugcauuacuagcgcuaaaugauauggguaaaguaaggaaagauaucccacaauggcaacccucaaaagguuggcaugauuggcagcaggucccuuuuugcagccaucacuuccacgaacucauaaugaaggacggaagaaaguuaguaguuccauguagaccacaagacgagcuaauugguagagcucggauaucccaaggagcaggcuggucuuuaaaagaaacggcuugccuaggaaaggcauaugcccagauguggucgcuuauguauuuucacagaagagaucucagauuagcuagcaaugcaauuuguagcgcugucccaguucauuggguaccuacgucucgaacgaccuggucaauucacgcacaccaucaauggaugacaacagaagacauguuaaccguuuggaaucgagucuggauugaagauaauccauggauggaagauaaaacacccguaacgacgugggaaaauguucccuauuuagguaaaagagaagaccaauggugcggaucgcuaauaggucucacuucaagagcaacgugggcgcaaaacauuccgacagcaauucagcaaguacguucucuuaucggaaaugaggaauucuuggacuauaugccgaguaugaaaagauuccgaaaagaagaggagagugaaggggcaauaugguaa

SEQ ID NO: 23216 - RNA, 9873 nt, Artificial Sequence
  derived and/or modified CDS sequence (opt6) from DENV-3__JF937641__SS-prME
acuucacuuugucucaugaugaucuugccugcagcauuggcguuucauuugacgaguagagauggugaaccaagaaugauaguagggaaaaaugaaagggggaaaaguuugcuguuuaaaacagcgaguggcauuaacauguguacucuuauugccauggacuuaggugaaaugugugaugauacaguuacuuauaaauguccacacauuacagaaguggaaccagaagacaucgacugcuggugcaaucugacaucaaccugggugacauaugguacauguaaccaagcuggagaacaccguagagauaaaagaaguguugcacuugcuccacauguuggaaugggacuagauacuaggacccaaaccuggaugagugcagaaggggcuuggcgacaagucgaaaaagucgaaaccugggcguuaagacacccaggauuuacaauacuugcguuauucuuagcucauuauauaggaacaucccuuacucaaaaagucguuauauuuauuuuacuuaugcucguaaccccuaguaugacuaugcgcugcguagguguagggaaccgagauuuuguggaagguuuaucuggugccacguggguagauguaguacuggaacacggaggaugugugacgacaauggcuaaaaauaaaccaacauuggacauagaauuacagaaaacagaagcaacucaacuggcaaccuuacgaaaacucugcauagaagguaaaaucaccaacaucacgacagauucuagguguccaacccaaggcgaagccacauuacccgaagaacaagaucaaaauuauguguguaaacacacauauguggaucguggguggggcaauggauguggccuauucgggaaaggaucacuugucacuugcgcuaaauuccaguguuuagaaccgauagaagggaaaguugugcaauaugaaaacuuaaaauauacaguaauuauaacaguccacacaggagaucaacaccaaguagguaacgaaacacagggugugacagcagaaauaacgccucaagcgucaacaacagaagcaaucuuaccugaauacgguacucucggucuggaaugcucaccaagaacagguuuagauuuuaacgaaaugauacuguuaacuaugaaaaacaaagcauggaugguacacagacagugguucuucgaucucccgcugccauggacgucgggcgccacaacagagacaccgacauggaauagaaaagagcuauugguaacauuuaaaaaugcccacgcaaagaaacaggaaguggugguacuaggcucucaagaaggugccaugcauacggcguuaaccggugcgacggaaauacaaaauagcggaggcaccaguaucuucgcaggacaccuaaaaugcagacuaaaaauggauaaauuagaacugaaagguaugucauacgcgaugugcacaaaugcuuucguauuaaagaaagagguuagugaaacacagcauggcacaauacuaaucaaaguagaauauaaaggggaagacguaccaugcaaaauaccauucucuacagaagauggacaaggaaaagcccauaacggucguuuaauaacagcaaacccuguaguaacgaagaaagaggaaccugugaacauagaagcugagccgcccuuuggugagucaaacaucgugauugggauaggagauaaugcauuaaaaauuaauugguacaagaaagguaguucuauagguaaaauguuugaagcaacagcacgcggagcacgacguauggccauauuaggagauacagcaugggauuuuggaaguguaggaggaguucucaauucguuagggaaaaugguccaucaaauuuucggaucagcauauacagcauuguuuaguggagugagcuggguaaugaaaauagguauugggguauuauuaacuuggauuggauuaaacagcaaaaauaccaguaugaguuuuaguuguauagccauuggcauuauaacucuuuaucuaggugccgugguucaggcggauaugggaugcguaaucaauuggaaaggaaaggaauuaaaguguggaaguggaaucuucgugacaaaugaggugcauaccuggacggaacaauauaaauuucaagcugacagccccaaacgcuuagcuacagcuauugcaggagcaugggaaaacggaguauguggaauacgcaguacaacacguauggagaacuugcucuggaaacagauagccaaugaauuaaacuacauucugugggaaaauaacaucaaauugacagugguaguuggagauaucauagguguguuagagcaagguaaaaggacccuuacaccacaaccuauggaauugaaauacagcuggaagacaugggguaaggcuaagauaguaacggcagagacgcaaaacagcucuuuuauaauugaugguccaaauacacccgaaugccccuccgucucacgagcauggaauguaugggaaguagaggauuaugguuuugguguuuucacuacaaauauuuggcuuaaacuuagggaaguguacacccaacuaugugaccaucgguuaaugucggcugcugucaaggacgaaagggcaguacaugcagauaugggcuacuggaucgaaucucagaagaacgggucauggaaauuggaaaaggcaucccugauagaagugaagacuuguacuuggcccaaaucucauacacugugguccaaugguguauuggagucugacaugauaauaccuaaaagccuagcaggaccuauuagccaacauaaucaucgaccaggauaccauacccaaacugcgggaccguggcacuuggggaaacuagaauuagacuuuaauuauugcgaaggaacgacugugguaauaacagaaaauugcgggacaagaggaccuucucuacgaacuacaacuguuagugggaaguuaauacacgaauggugcuguagaucuugcacucuaccacccuuaagauauaugggcgaagauggaugcugguacggaauggaaauuaggccaauuagugaaaaagaagaaaacaugguuaaaaguuuagugagcgcgggaagcgguaaaguugacaauuucaccaugggaguucucugucuagcuauucuuuucgaagagguuaugagaggcaaauuugggaagaaacauaugauagcugggguguucuuuacuuuuguuuuacuucuuagugggcaaauuacuuggagggacauggcgcacacacugauaaugauugggucaaacgcgucagaucggaugggaaugggagugacauauuuagcuuugauugcgacauucaaaauacaacccuuuuuggcccuaggguucuuccucagaaaacuaacaucgcgcgaaaacuuacucuuaggaguuggucuugcuauggcaacuacacuacaauuaccagaagauaucgaacaaauggcgaauggaauugcgcucggcuuaauggcacuaaaacuuauaacacaauucgaaacauaccaacuuuggaccgcguuaauaagccuuacaugcuccaacacaaucuucacauuaacgguagcguggcggacagccacauuaauucucgcugggguuucacuauuaccuguaugucaguccucaaguaugcgaaaaacagacuggcuuccgauggccgucgcagcaauggguguaccgccauugccucuguuuauuuuugggcuuaaagauacuuugaaaagaagaagcuggccacuaaacgaggguguaauggcuguaggacuggugucgauacuggcaucaaguuuauuaagaaacgauguaccgauggcaggaccuuuaguagcagggggacugcuaauagcuuguuacgucaucacagguacaucugcagauuugacgguugaaaaagccgcagacauuacuugggaagaagaagcagagcaaacagggguuucgcauaaucuuaugaucacaguugaugaugauggaacaaugagaaucaaagaugacgaaacugaaaauauauuaacaguccuacuaaaaaccgcccucuugaucgugucuggcauuuuucccuacaguauaccagcgaccuuacucguauggcauacguggcagaaacagacucaacgaaguggggugcugugggauguccccaguccaccggagacacaaaaagcagaacuagaagaaggcguguacaggauaaaacagcaagggauauucggcaaaacgcaaguuggaguaggcguucaaaaagaagguguauuucacaccauguggcaugucacgagaggcgccguauuaacuuacaauggaaaacgacuagaaccgaauugggcgagcgucaagaaagauuuaaucaguuacggcggaggguggagacuaucggcucaauggcaaaagggagaagaaguacaagucauagcagucgaaccugguaagaauccuaaaaacuuccaaaccaugccaggaacauuccaaacuacaacgggugagauuggagcaauagcacuggauuucaagcccggaacaucagggaguccaauaauuaaccgcgagggaaaaguagugggccuauaugguaauggcguagugacuaagaauggaggguacguauccgggauagcacaaacaaaugcagaacccgauggacccaccccagagcuggaagaagaaauguuuaagaaacgcaauuuaacgauuauggaucuacauccaggaucugggaagacacgaaaguauuuaccagccaucguuagggaagcaauaaaacggcgcuugagaacucugauccuagcacccaccaggguaguggcggcggaaauggaagaagcacucaaaggauuaccgauaagauaucagacaacugcaaccaaaagugaacauacuggaagagagauaguagacuuaaugugccaugccacauucaccaugagguuacuaucacccguaagaguuccuaauuauaaccuaaucauaauggacgaagcacacuuuacugauccagccucuauugcagcaagggguuacaucagcacucgaguuggaaugggagaagcagcugcaaucuucaugacagccacgcccccggggacugcagaugcuuuuccacaaucaaaugcuccuauucaagaugaggaacgcgauauaccagagagaaguuggaacaguggaaacgaauggauuacugauuucgcaggcaaaaccguaugguucguuccuucgauuaaggcgggaaacgacaucgcuaacuguuuaaggaaaaauggcaagaaaguaauacaacugucgagaaagacauuugauacagaauaccagaaaaccaagcugaacgacugggacuucguagugaccacagacaucucggaaaugggcgcgaauuuuaaagcagauagaguaauagauccacgccggugcuuaaaaccgguuauacucacugacgguccggagagaguaauauuagccgguccaaugccugugacagcugccucugccgcacaaaggagaggacgcguggguagaaacccucaaaaagagaaugaccaauacauauuuacaggucaaccuuuaaauaaugaugaggaccaugcccauuggacggaggcaaagaugcuguuagauaauauaaacaccccggaaggaauuauuccggccuuauuugaaccugaaagagaaaaaucagcagcaaucgacggagaauacagauuaaaaggagaaucuagaaaaacauucguugagcucaugcguagaggagaccuuccagucugguuggcacacaaaguugcauccgaggggauaaaguacacugaucggaaauggugcuuugacggucagcgaaauaaucaaauuuuggaagaaaauauggacguagaaaucuggacgaaggagggugagaagaagaaauuaaggccacgauggcucgacgcacgaacauauucagacccuuuagcgcucaaagaguucaaggaguucgcagcgggucgcaaaaguauugcucuugacuuagucacagaaauuggaagaguaccaucacaucucgcacaccguacacgaaacgcacuggauaauuuaguaaugcuccauacgucagagcacggaggacgagcauauagacacgcaguugaagaacugcccgaaacaauggaaacguuacuauuauuaggccuaaugauauugcucacugguggagcuaugcuauuuuuaauaucaggaaaaggaauugguaaaacguccaucggauuaauaugcguaaucgcaagcagcgguaugcucuggauggcugaaauaccacuccaauggauugcaucagccauaguacuagaguucuucaugaugguacuacuuauacccgagccagagaaacaaagaacuccgcaggacaaccaauuagccuaugucguaauaggcauauuaacacuugcugcaauaauagcagcgaacgaaaugggucuccuagaaacaacuaagcgagaucuugggaugucaaaggaaccuggaguaguaucaccaaccagcuauuuagacguugaucugcauccagcaucagcauggacgcuguaugcgguagcaacaacaguaaucacaccaauguuacgacacacuauagagaacaguacggcaaacgugaguuuggcugcuauagcaaaucaggcuguuguccuuaugggucuugauaaaggauggcccauaucuaaaauggaucuaggaguuccgcuguuagcccuaggguguuacagccaaguaaacccacuaacauuaaccgcagcgguacucuuacuuauuacgcauuacgcgauaaucggaccuggacuccaggccaaagcaacacgagaagcucagaaacgaacugcagcaggaaucaugaaaaauccaacaguagacgggauuaugacuaucgacuuggauccugugauuuaugauaguaaauuugagaaacaguuaggacaagugauguugcuuguguuaugcgcaguccagcuauugcuuaugcgaacauccugggcauugugcgaagcacuaaccuuagcuacagggccaauuacaacucuuugggaaggcaguccuggcaaauucuggaacacuacgauagcuguaucaauggcaaauaucuuucgaggaucauauuuagcaggcgcaggucuggcuuucucuauuaugaaaucuguaggaacaggaaaacgcggcacuggcucacaaggagaaacuuuaggggaaaaauggaagaagaaauuaaaucaacuaucuagaaaggacuuugauuuauacaagaaaucagguauaacugaaguugacagaacugaagcuaaggaaggauugaaaagaggagaaaucacucaucacgccguuucuagaggaucggcgaaauugcaaugguucguagaacgcaauaugguuauaccagaagggagaguuaucgauuugggaugugguagaggaggguggagcuauuauugugcaggauugaaaaagguaacagaaguacggggauacaccaaaggcgggccaggucaugaggaaccggucccaaugagcacauacggcuggaacauuguaaaacucaugagcgguaaagacguuuucuaccuaccacccgaaaaaugcgacaccuuguuaugcgauauaggcgaguccuccccgucgccaacagucgaagaaagcagaacaauuagaguuuuaaaaaugguagaacccuggcuaaagaauaaccaauuuuguauuaagguacucaauccauauaugcccacgguaauagaacaucuugagcggcuccaaaggaagcauggagguauguuaguccggaacccacuuucgagaaauaguacacaugaaauguacuggauauccaaugggacuggaaacauaguugcaucugucaacaugguuagccgauuacuauugaauagauuuacaaugacacauaggcgucccacaauagaaaaagacguugauuugggcgccggcacucgacacgugaacgccgagcccgaaacuccaaauauggacguuauuggagaaaggauuaagcgaauuaaagaagaacauaacucaaccuggcacuacgaugacgagaauccauacaagacgugggcauaucaugguucuuacgaaguaaaggcgacaggcucagccucuucuaugauaaacggagucguaaaacuuuuaacuaaaccaugggaugugguucccauggugacacaaauggcaaugacagacacgacaccguucggacaacaaagagucuucaaggaaaaaguugacacuagaacgccuagaucuaugccgggaacgaggagaguuaugggaauaacggcagaaugguuauggagaacuuuagggaggaacaaaaagccacgguuguguacaagagaagaauuuacaaagaagguaagaacaaaugcugcuaugggagccguauucacugaagaaaaccaaugggauucagcuaaagccgcaguagaagaugaagacuuuuggaaauuagucgacagagaaagagaacuucacaaacuaggaaagugcgggagcugcguauacaacaugaugggaaagagagaaaagaaauuaggcgaguucggcaaagcaaaaggcaguagagcuauaugguacauguggcuuggcgcucgguauuuagaauuugaggcuuuaggguuccugaacgaagaucauugguuuucccgggagaauagcuacucaggaguagaaggugaagguuuacacaaacuaggcuauauacuacgagauauaagcaaaaucccaggaggagcuauguaugcagaugauacagcaggcugggacacaagaaucacagaagacgaccuccauaaugaggagaaaauaacucaacaaauggauccugagcauagacaauuggcuaaugcaaucuuuaaacugaccuaucagaacaaagugguaaagguucaacgaccaacacccacaggaacggugauggauauaaucucucgaaaagaccaacguggaaguggacaaguaggcacguacggacucaauaccuuuaccaauauggaagcucaauuaaucagacaaauggagggugaagggguacucucuaaagcagacuuggagaacccucauuuaccugagaagaaaaucacacagugguuagaaacaaaaggaguagaaaggcuaaagcgaauggccaucuccggugaugauugcguagugaagccaauagacgaucgauucgcaaaugcacuuuuagcccuaaacgauaugggaaaggugagaaaagacauuccacaauggcagcccucuaaaggauggcacgauuggcaacaaguuccauuuuguagccaccauuuccacgagcuaauaaugaaagaugguagaaaguuaguuguaccuuguagaccucaagaugagcucauagggcgugccaggauuucacaaggggcgggcuggucacuaaaggaaacagcuugucugggcaaagcauacgcacaaauguggagucuaauguacuuucauaggagggacuuaagguuggccagcaacgcaauuugcucagcaguaccuguccacuggguaccgacaucacgaacaaccuggucaauccacgcgcaucaucaauggaugacgaccgaagauaugcucacuguuuggaaucgggucuggauagaagauaauccuuggauggaagacaaaaccccaguaacaacaugggaaaacguaccauaucuuggaaaaagggaggaucaauggugcggcagccuuauaggacugacuucgcgagcuacgugggcacagaauaucccaacagcaauacaacaggugcguuccuugauugguaacgaagaauuuuuagauuauaugccaucuaugaagcguuuuagaaaagaggaggaaucagaaggagcaaucugguaa

SEQ ID NO: 23217 - RNA, 9873 nt, Artificial Sequence
  derived and/or modified CDS sequence (opt6) from DENV-3__JF920396__SS-prME
accaguuuguguuugaugaugauccuaccagcugcauuagcauuucaucuuacuucuagggacggugagcccagaaugauugucgggaaaaaugaacgugguaaaagccuuuuguucaaaacugcaucugguauaaauauguguacucuaauagcaauggauuuaggggaaaugugcgacgauacugugacguauaaaugcccccacaucacagaaguggaaccggaagacaucgacugcugguguaacuuaacuucaacguggguaacauaugguacauguaaccaagccggugaacauagacgcgauaaacgaucaguggcucuugcuccacauguggggaugggucuagacacgcgaacacagacuuggaugucagcugaaggugcauggcgucaaguugaaaaaguugaaacuugggcauuacgucauccgggguuuacaauucucgcccuauuccuagcgcauuacauaggaacaagucuuacucaaaaagucguaauauuuauccuacugaugcuugucacaccuucaaugaccaugcgcugcgucggaguaggaaauagggauuucguugaaggacucucaggagcuaccuggguagaugucguauuagagcacggcggaugcguuacaacaauggccaaaaauaaaccaacauuggauauugaguugcagaaaacagaggcuacccaacuugcuaccuuaagaaaauuguguauagaaggcaaaauaacgaauauaacaaccgacagucgcugcccuacucaaggagaagcaacguuaccggaggaacaagaccagaauuacgucuguaaacacacauauguagaccgaggcugggggaacggguguggauuauuuggaaaaggcucuuuaguuacgugugcgaaauuucaaugucuagaaccaauagaaggaaaaguaguacaauaugaaaaucuaaaauacacuguuauuauuacuguacauacgggagaucaacaucaaguggguaacgaaacccaaggaguaacugcugagauaacaccacaggcauccacgaccgaagcgauuuuaccagaguauggaacgcuuggucucgaaugcaguccccguaccggauuagauuuuaacgagaugauauuacucacaaugaaaaauaaagcauggaugguccauagacaaugguucuuugaucuaccccugccauggacaucaggagcaacaacggaaacaccgacguggaaccgaaaagaacugcuugugacauucaaaaacgcacacgcgaagaaacaagaagugguuguauuaggaucccaagaaggcgcaaugcacacagcacugacuggcgcgacagaaauucaaaauucugguggaaccagcauauuugcaggacaucugaaaugccgacugaaaauggacaaacuagaacuuaaagggauguccuaugcaaugugcaccaauacauucguguugaagaaagaaguuucggagacccaacacgguacaauccuuaucaaaguagaauacaaaggcgaagacguaccauguaaaauaccauucuccacagaggauggucagggaaaagcacauaacgguagguuaauaaccgccaaccccguugucacuaagaaagaagaaccgguaaauaucgaagcggaaccacccuucggagagagcaauauugugauuggaauuggggauaacgcacucaaaauaaacugguauaagaaagggucaagcauaggcaaaauguuugaagccacagcacgaggugcacggaggauggcgauucuuggcgauaccgcuugggacuuugguuccguuggggguguucugaacagucugggaaaaaugguucaccaaauuuucgguuccgcguacacagcauuauuuucagguguaucaugggugaugaaaauagggauaggagcauuacuuacauggaucgggcuaaauucgaaaaacacuucaaugucauuuuccuguauugccauagguauaauaacuuuguaccuaggggcaguaguacaagcggauaugggaugcguagugaauuggaaaggaaaagaacuaaaauguggaagugggaucuuuguuacaaaugaggugcacaccuggacggaacaauacaaauuucaagcagacucaccuaaacguuuagcaacagcaauugcuggugcgugggaaaauggagucuguggaauuagaucgacgacuagaauggaaaaucuauuauggaaacaaauugcuaacgaauugaauuacauacuaugggaaaacaacaucaaauuaacuguagucguuggugauauaaucggugugcuugaacaaggaaaaagaacccuuacaccccaaccgauggaauuaaaauauagcuggaaaacuuggggcaaagcaaagauaguaacugcggaaacacagaacagcucauuuauaauugaugggcccaauaccccugaaugucccagugugucacgagccuggaauguuugggaagucgaagauuaugguuuuggcguauuuacaacgaacaucugguugaaguugagggaaguguauacacaacuuugugaccacaggcucaugucugcagcgguaaaggacgaaagggccgugcaugcagacaugggcuauuggauugagagucaaaagaaugggucguggaaacuggaaaaagcuagccuuauagaaguaaagacguguacguggccuaaaucacacacucuuuggagcaacggcguacuggaaucagacaugauaaucccaaaaagucuagcaggaccaauaucucaacacaaucacaggccagguuaucacacccagacagccggucccuggcaucugggaaaacuugagcucgacuuuaauuauugcgaaggaacuacaguaguuaucacagagaauugcgguacaagagguccaucauuacggacaacgaccgugagugggaaguuaauacaugaauggugcugcaggucauguaccuuaccaccauuaagauauaugggagaggacgguuguugguauggaauggagauucguccgauaucggaaaaagaagaaaacauggucaaauccuuagugucagccggcuccggaaaaguggauaacuucacuaugggcguacuuugucuagcaauucuauucgaagaggugaugagaggaaaauucggaaagaaacacaugauugcaggggucuucuucacauucguacuguuauuaucuggccagauaaccuggagggauauggcacauacauuaauaaugauaggaucgaacgcgagugacagaauggguaugggaguaacauaucuagcguuaaucgcaacauuuaaaauacaacccuuccuugcucugggauucuuuuuaagaaaauugacaagucgagaaaacuuacuauuagguguuggguuagcaauggccacaacauugcaacuaccugaagauauugaacaaauggcaaaugggauugcccugggguugauggcauuaaaacuaauuacucaauucgaaaccuaucaauuguggacagcccuuauuucguuaacguguaguaauacgauauuuacauugacaguggcauggagaacagcaacccuuauccucgccgggguuagcuugcuuccaguaugccaaucaucuucaaugaggaagacagacugguugccuauggcuguugcugcgaugggcguuccaccacuuccccuauuuaucuuuagccuuaaagauacgcugaaacgacguucauggccccugaaugaagguguuauggccguaggucuagugagcauuuuagcuaguucacuguugcgcaaugauguuccaauggcugguccuuugguggcgggaggguugcugaucgcaugcuauguuauaacaggaacgucggcagauuuaacuguagaaaaggcagcggacauaacgugggaagaagaagcugagcaaacagguguuucacacaaccuaaugauuacaguugacgacgauggaacuaugaggauuaaagacgaugaaacagaaaacaucuuaacaguacuucucaaaacugcauugcugauagugaguggaaucuuuccauauaguauaccugcuacacuccuaguauggcacacauggcaaaaacaaacucagcgaucuggaguucucugggaugugccuaguccgccggaaacacaaaaggcggaacuagaagaagggguauacagaaucaagcaacaaggaauuuuuggaaaaacacaaguaggaguuggagugcaaaaagagggcguguuucauacaauguggcacguuacgcgaggugcuguacuaacuuacaaugguaaaagacucgaaccaaauugggcaagcgugaagaaagaccucaucagcuauggcggaggauggagauugagugcgcaauggcagaaaggugaagagguucaaguaauagcaguggaaccaggcaaaaaucccaaaaauuuucaaacaaugccaggaaccuuccagacaacaacaggagaaaucggggcaauugcacuugauuuuaaaccuggaacaagcggaagcccaauuauaaacagggaaggaaaaguaguuggauuauauggaaaugguguuguaacuaaaaauggugguuacgucucuggaauagcccaaacuaaugcugaaccagauggaccaacuccugaacucgaagaagaaauguucaagaaaaggaaccuuaccauuauggauuuacauccaggaaguggaaaaacgagaaaauauuuaccagcaauuguacgggaagccauaaaacguagacuucggaccuuaauucuugcaccaacaagaguagucgcagcagaaauggaagaggcauugaaaggguuacccauuagguaccagacaacagcaacuaagagugaacacacaggaagagaaauaguugaccuaaugugccaugcuacauuuacuaugagauuauuaucuccuguucguguaccuaauuauaacuuaauuauuauggacgaagcacacuuuacagacccugcaaguauagcagcucgcggauacauaaguacgagaguuggaaugggagaggcugcugccaucuucaugacggcaacgccgccgggaacagcugaugcauuuccgcaauccaaugcuccuauucaagaugaagaaagagauauaccugaaagaucguggaacuccgguaacgaauggauaaccgacuucgcugguaaaacaguaugguuuguaccgagcauuaaagcugguaaugacauagcgaauugucuaaggaaaaacggcaagaaaguuauucaauugucgcguaaaacuuuugacacugaauaucagaaaaccaaacuaaaugauugggacuuugucgucacuacagacaucagugaaaugggcgcaaacuucaaagcagaccgaguuaucgacccacggagaugccucaaaccagucauccugacagacgggccagaaaggguaaucuuagccgguccgaugccaguaacagcagcaucggcugcucagagacguggcagagucggacgcaacccccaaaaagagaaugaccaauauauuuucacugggcaaccauuaaacaaugacgaggaucaugcgcauuggacagaagcuaaaaugcuucuagauaauauuaauacuccagaaggaaucauaccugcacuauuugagccagagagagagaaaagugcagcgaucgauggcgaauacaggcuaaaaggugaaucgagaaagacauuuguggaauuaaugcgaagaggagauuuaccuguuugguuggcccauaaaguagcaucagaaggaaucaaauauaccgaucgcaaaugguguuuugauggacagcgcaacaaucagauacuugaagaaaacauggacguugaaauuuggacaaaagaaggugagaagaagaaacucaggcccagauggcuagaugcgcgaacuuauucagacccguuagcauuaaaggaauuuaaagaguuugcugcaggaaggaagucuauagcccuugaccuggucacagaaauagguagaguaccuagucauuuggcacaucgaacacggaacgcucuugauaaccuagugauguuacauacuucugagcacgguggaagggccuaucgucacgcaguagaagaacuuccugaaacuauggaaacucuacucuuacuuggauuaaugauuuuauuaacaggaggugcaaugcuauuccuaauuucgggaaaaggaaucggaaaaacauccauaggauuaauaugcguuauugcauccucagguaugcuauggauggcagaaauuccguugcaauggauagccuccgcaauuguauuggaauuuuucaugaugguuuuauugaucccugagccugagaaacaaaggacuccgcaagacaaucaacuggcauacguaguuauuggaauccuaacucuagcagcaauaauagcagcuaaugaaaugggucuuuuggaaacaacuaaaagagauuuagggaugaguaaagaaccagguguagucagcccgacuucuuaucuagacguugauuugcacccagccucugcuuggacacuguaugcuguagcaacgacaguuaucacuccaaugcuaaggcacacaauagaaaauucaacagcaaauguuagccuagcagcaaucgcaaaccaagccguaguuuuaauggguuuggauaaaggauggccaauaucgaaaauggauuuggguguaccccuauuagcauuagggugcuauucccaagugaacccuuuaacucugacagcggcuguccucuuacuaaucacacacuacgccaucauugggccaggacuacaagccaaagcaacaagagaggcucaaaagcgcaccgcugcagguaucaugaagaauccaaccguggauggcauaaugacaauagauuuggauccaguaaucuaugacaguaaauuugaaaaacaguuggggcaaguaaugcuauuaguucuaugcgcuguucaauuguuacuaaugcgaacgaguugggcccuaugugaggcuuugacgcuugcuacuggaccaaucacuacucuaugggaaggaucuccgggaaaauucuggaauacaacaauugcuguuaguauggcaaacauauucagagguucuuaucuagcaggagcaggcuuagcguucucaauaaugaagaguguuggaacugguaaaaggggaacaggcagucaaggagaaacccuaggugaaaaauggaagaagaaauuaaaucaauuaucucgaaaagacuucgaucucuacaagaagucuggcaucacugagguugaccggacugaagccaaggaaggacuaaaaagaggagaaaucacccaccaugcaguuucuagagguucggcaaaguuacaaugguuuguugaacgcaacaugguaauaccagagggccgaguaaucgaucuagguugcggcaggggaggcuggagcuauuauugugcaggccucaagaaaguaacagaaguaagaggauauacaaaaggaggaccaggacaugaggaaccagugccuaugucuacuuacggauggaacauagugaagcugaugagcggaaaggacguauucuacuugccaccggagaagugugacacuuuauugugcgacauuggagaaucaaguccgaguccaacugucgaagagucaaggacaaucagaguguugaagaugguagaaccuugguugaaaaacaaccaguucugcauaaaagugcuaaauccuuacaugcccacaguaauagaacaccuagaaagauuacagcgaaaacacggcgguaugcuugucagaaauccucugucaagaaauaguacucaugaaauguacuggaucaguaacgguaccggaaacauaguagcaagugucaacauggucucaagguuacuacuaaacagauucacgaugacucacagacgucccacaaucgagaaggauguagaccuaggggcugguacaagacauguuaaugccgaacccgaaacacccaauauggaugugauaggugaaaggauaaaacguauaaaagaggaacacaauucuacauggcauuacgaugaugagaacccauauaaaacgugggcauaucacggcucguacgaaguaaaagcgacaggcucugcgucaagcaugauuaacggugucguaaaauugcucacaaagccaugggaugucguacccaugguaacacaaauggcuaugacagauacaacaccauucggacaacaaaggguauucaaagaaaaagucgacacgagaacgccgcgauccaugccggggacacguagaguaaugggaauuacugcagaaugguuauggaggaccuuaggucgaaacaagaagccucgacuuuguacucgagaggaguuuacuaagaaaguacggacaaacgcagcaaugggagccguguuuacugaagaaaaccaaugggauagcgcaaaggcggcuguggaagaugaagacuucuggaagcuaguggaucgggaaagagaauuacacaaacuagguaaauguggcagcuguguauauaauaugaugggaaaaagggagaagaaacuaggagaauuuggaaaagccaaaggcaguagggcuauaugguacauguggcuuggggcaagauacuuagaauuugaagcacucggauuucucaaugaggaucacugguuuagcagggaaaauaguuacucagguguagagggagaagguuuacauaaacugggguauauccuaagagauauuagcaaaauuccuggaggugcuauguaugcggaugauaccgccgguugggacacgcgaauaacugaagacgacuuacacaacgaagaaaagaucacucagcaaauggacccugagcaucgacagcuggcuaaugcaauauuuaaacuaacauaccaaaauaaaguuguaaaaguacaaagacccacaccuacugguacuguaauggacaucauuucuagaaaagaucaaagagggaguggacaaguuggcacauauggacucaacacuuucacaaacauggaagcacaacuuauaagacaaauggagggcgagggaguacucaguaaagccgaucuagaaaauccucacuugccugagaaaaagauaacucaguggcucgagacgaaaggcgucgaaagacuuaaacgcauggcgaucagcggagaugauuguguugucaaaccaauagaugauagguuugcuaaugcucuacuagcuuuaaaugacauggggaaagugcguaaagacaucccgcaguggcaaccaaguaaaggauggcacgauuggcaacaaguacccuuuugcagucaucacuuucaugaguuaaucaugaaagacggcagaaaacuuguaguacccugucgaccacaggaugaacugauaggucgagcuaggauuucacaaggagcagguuggagucuuaaggaaacagcgugccuagggaaggccuacgcucaaauguggucccuaauguauuuccauaggagagaucuacgauuagcaucgaacgccauauguucugcagucccagugcauuggguuccgacuucacguacaacauggaguauucaugcgcaucaucaauggaugacgacagaggauauguugacggucuggaaucgagucuggauugaggauaauccuuggauggaggauaaaacgccugucacuacaugggaaaacguacccuauuuagggaaaagagaagaucaaugguguggaaguuugaucggguugacgucaagagcgacuugggcucaaaauaucccgacagcuauacaacagguccgaucauugauaggaaaugaggaguucuuagauuacaugcccucgaugaaaagauucaggaaagaagaagaaucugaaggggcaauaugguaa

SEQ ID NO: 23218 - RNA, 9873 nt, Artificial Sequence
  derived and/or modified CDS sequence (opt6) from DENV-3__JF920406__SS-prME
acaagccucugucucaugaugauuuugccugccgcucuagccuuccauuugaccucgcgggauggcgaaccaagaaugaucgucgguaaaaacgaaagagguaagucucuauuguuuaaaacugcauccggaauuaauaugugcacauuaauagccauggaccugggcgagaugugugaugauacuguuacauauaagugcccucauauaacugaagucgaaccugaagacauugauugcugguguaauuugacuaguacauggguaacuuacggaacuugcaaucaagcgggagaacacagacgagauaaaagaucaguagccuuagcaccacacgugggaaugggucuugauaccagaacccaaacauggaugucagcagaaggagccuggagacaaguagagaaggucgagacgugggcacuucgucauccuggauucacuauauuggcauuauuuuuggcucauuauaucggcacuagcuuaacacaaaaaguugucauuuuuauccuccuaauguuaguaacaccuucuaugaccaugagguguguuggagucggaaauagggauuucguugagggacuuucuggagcuacauggguggaugucguacuugaacacgggggguguguaacaacgauggcaaaaaauaagccgacccuggacaucgaauuacaaaagaccgaggcgacacaauuagcuacacuccgaaagcuuugcauagaaggaaagaucacuaacaucacaacugacucccgguguccuacacaaggcgaagcgacacuaccugaagaacaagaucagaacuauguuuguaaacauacauauguugaucgcggauggggcaacgggugcggacuauucgggaaagggucauuaguuacaugugcaaaguuucaaugucuagaaccaauagagggaaaaguaguucaauacgagaaucuaaaauauaccguaauaauuacuguucacacaggagaccaacaccaaguugggaaugaaacgcaaggagugacagcagagauuacaccacaagcaucaaccaccgaagcaauccuuccagaauauggaacacuuggccucgaaugcucgccacgcaccggacucgauuucaaugagaugaucuuacuuacaaugaagaauaaagcauggauggugcaucgacaaugguuuuuugauuuaccccuaccuuggacaaguggagccacuacagaaacaccuaccuggaaucgaaaagaacuauuaguaacauuuaaaaacgcucaugcaaagaagcaagaaguaguaguucucgguagucaagagggugcuaugcauacggcccuaacuggggccaccgaaauacaaaauucugguggaacuucaauauuugcaggacaccuaaagugucgacugaaaauggacaaacucgaguuaaaaggcaugucauacgcuaugugcacaaacgcuuuuguucugaaaaaagaaguaucugaaacucaacaugggacaauacuaauaaaaguugaauauaagggagaagaugugccaugcaaaauaccauuuucgacggaagaugggcaggguaaggcacauaacgggcgucucauaacagccaacccuguugugacuaaaaaagaagaaccaguuaauauagaagcggaaccacccuuuggagaaagcaacauugugauugggauuggcgacaaugcucucaaaauaaauugguacaaaaaaggaagcucaaucggaaaaauguuugaagcaacugcacgaggagcuagacgcauggcaauccuaggagauacagcgugggacuuuggaucugugggaggggucuuaaacucacuuggaaaaaugguccaucaaaucuucggaucugccuacaccgcgcuguuuucgggaguaucuugggucaugaagauaggaauagguguacuauuaacauggauaggauugaauaguaagaauaccucaaugucguuuucauguauugcaauaggaauuauaacguuguauuuaggggcaguugugcaagcggauaugggguguguaauaaauuggaaaggaaaagaacucaaauguggaagcgguaucuuugugaccaacgaaguacauacguggaccgaacaguauaaguuccaagccgauaguccaaaaagauuagcgacugcaaucgcaggugcaugggagaaugggguuugcgguaucaggaguacgacucggauggagaauuuauuguggaaacagauugccaacgaauugaauuauauacuaugggaaaauaauauaaaguuaacuguaguugugggugacaucauuggaguacuggagcaagguaagcguacuuuaacaccccagccaauggaauuaaaauacucauggaaaacuuggggaaaagccaaaauagugacagcagaaacucaaaacucuucuuuuauuaucgauggaccuaacacacccgaaugucccuccgucucgagggcguggaacgugugggagguugaggauuauggauucggaguuuucaccacuaauauauggcuuaagcuaagggaaguuuacacucaauuaugugaucacagacuaaugagcgcagcggugaaagacgaacgagcuguccaugcugauauggguuacuggauugagucccagaaaaauggaaguuggaaauuggagaaggcaagccuaauagaggucaagacguguacguggccgaaaagucacacacuauggagcaauggaguauuagaaagcgauaugauuauaccgaaguccuuagcuggcccgauuucacaacauaaccauaggccuggauaccauacacagacggcaggcccauggcauuuagggaagcuagaacuagauuucaauuacugugaaggaaccacaguaguuauaacggaaaauuguggaacacgaggaccuucauuaagaacuacuacaguuucugguaaauuaauccaugagugguguugucgaagcugcacauugccaccucuacguuauaugggagaagacggcugcugguacgguauggaaauucgacccauauccgagaaagaagaaaauaugguaaaaaguuugguauccgccggcagcggaaaagucgacaauuucaccaugggcguacuauguuuagcaauacuauuugaagaaguaaugagaggaaaauuuggaaaaaaacauaugauagccggaguauucuuuacauuuguauugcuccuaucuggacagauaacuuggcgugacauggcgcauacacugauaaugaucgggaguaacgcuuccgaucgaauggguaugggugugacauauuuggcauuaauagcaacguuugaaauucaaccguuccuagcacucgguuucuuccuaagaaaacugacgucgcgugaaaacuuauuacuaggcguuggacuugcaauggcaaccacccuacaacucccagaagacauugagcaaauggcuaauggaaucgcguuaggacugauggcauuaaaacugauaacccaguuugaaacauaccaacuuuggacugcacuaaucucccuaacuugcagcaacaccauuuucacauuaacaguugcuuggcgaacagcaacccuaauacuggccggaguaagcuuauugccaguaugucaaaguagcucaaugcgaaagacagacuggcuaccuauggcuguggcagcaaugggagucccaccgcuaccucuuuucauuuucgggcuaaaggauacccuuaagagaaggucuuggccuuuaaacgaagguguaauggcugucggucuagugagcauucucgcuucaagccuucuacgaaacgauguaccaauggccggaccacucguugccggaggguuauuaaucgcguguuacguaauaaccgguaccucagcagaucugacaguagagaaggcagccgacauaacgugggaagaagaagcagaacaaacuggggugagccauaaucuuaugauaacuguagaugaugacgggacaaugagaauaaaggacgaugagacagaaaauauucugacaguucuacuaaaaaccgcgcuuuuaauaguuucggguauuuucccguacucaauuccugccaccuuauugguguggcacacguggcaaaagcaaacccaaagaucgggaguucuaugggauguuccaagccccccagaaacucagaaagcagaacuagaagaagguguauauagaaucaaacaacagggaauuuuugguaaaacacaaguugguguuggcguucaaaaagaagguguauuccauacaauguggcauguaacgagaggcgcaguucuaaccuauaacgggaaacggcuugagccuaauugggcgagugugaaaaaagauuuaauuucguacggugguggcuggcgccuaagugcccaguggcaaaaaggagaagaaguccaaguaauagcuguagaaccagggaaaaaucccaaaaauuuccaaacgaugccugguacauuucagacgacuacaggagagauaggugcaauagcuuuagauuucaaaccuggaacuucgggaaguccuauuauaaaccgggaaggaaaaguuguuggucucuauggcaauggaguggucacuaaaaacggagguuauguuucaggcauugcccagacaaaugcagaaccagacggaccuacaccugaauuagaggaagaaauguuuaagaaacgcaacuuaacuaucauggaccuucacccgggaucugguaagacaagaaaguaucucccugcaauagugagagaagcaaucaagaggagacuaaggacacuaauuuuggccccgacgcgaguuguagcugcagaaauggaagaggccuuaaaaggucucccaauaagauaucaaaccacggcaacaaaaucugaacauaccggacgggaaauaguugauuugaugugucaugccacguuuacaaugcgccuucuaucuccuguccgagugccuaauuauaaccuuauaaucauggacgaggcacauuucacagauccagcuucaauagccgcccgcggauauauaaguacucguguaggaaugggugaagcugcggcaaucuucaugacggcaacaccacccggaacugcugaugcuuuuccacagaguaaugcuccgauccaggacgaagagagagacaucccugaacggaguuggaacagugggaaugaguggauaaccgacuuugcaggaaagacgguuugguuugugccaagcauaaaggcugggaaugauauagcgaauugucuacgaaaaaacgggaagaaaguuauucaauugagucgaaaaacguucgauacugaauaucaaaaaacaaaacugaaugacugggacuuuguaguuacuacagacauaagugagaugggagcgaauuuuaaagcagacaggguuauugauccucgaaggugccuuaaacccgugauacuaacagauggaccagagagaguaauacuggcggguccaaugccuguuacugcggcaagugcugcacaaagacgaggcagaguaggccgaaauccacaaaaagagaaugaccaauauaucuucacaggccaaccuuugaacaaugacgaggaucaugcucacuggacagaagccaaaaugcucuuagauaauaucaacacuccggaagguauuaucccagcucuauuugagccugagcgagaaaagagcgcggccauugacggagaauauagguugaagggugaaucucguaaaacauuugucgaauuaaugagacguggagaucuaccugucugguuagcgcacaaaguugcuuccgaagguauaaaguacacugaccgcaaaugguguuuugacggucagagaaauaaccaaauacuugaggaaaauauggaugucgaaaucuggacaaaagaaggggaaaaaaaaaagcuaagaccgcguuggcuugaugcgagaaccuacucugauccacucgcuuuaaaagaauucaaagaauucgcagcuggaagaaaaucaauugcauuggaccugguuacagaaauaggccguguccccucacauuuagcucaucguacucggaacgcauuagacaaccuuguuaugcuucacacuagugaacauggcggaagggccuacagacaugcgguagaagaauuaccagaaacgauggaaacauuauuauuacuaggauugaugauauuacucacagguggggcaauguuauucuuaauaagcggaaaggguauagggaaaacaucuauaggacuuauaugugucauagcaaguagugggauguuauggauggccgaaauuccacuacaauggauugccagcgcgauuguguuagaauuuuuuaugaugguauuauuaauucccgaaccugagaagcaaagaacgccacaagauaaucaauuggccuauguagucauagguauauuaacacuagcagcuauuauugcagcgaacgagaugggucuauuggagaccaccaaaagagacuuaggaaugagcaaggaaccggguguaguaucaccaacuaguuacuuggauguggaucuccauccagcaagcgcauggaccuuguaugcgguugcaacgacagugauaacaccaauguuaaggcacacuauagaaaacucaaccgcgaaugugagccuagcagccauagcaaaccaggcagucgucuuaaugggacuagacaaaggauggcccauaagcaaaauggaccuggguguaccgcugcucgcccucgggugcuauucucaagugaauccacucacccuuacggcggcaguccuuuuauuaauaacucauuaugccauaauuggccccggauuacaagcuaaagcgacacgggaggcacagaaacguacagccgcggggaucaugaagaacccaacggucgaugggaucaugacuauagaucuagauccagugauuuaugauaguaaguucgagaagcagcugggacaaguaauguugcucgugcugugugcgguacagcuacuccugaugcgaacaucaugggcucucugugaagcauuaacucuagcaaccgggccaauaacuacauuaugggaaggaagcccugguaaguucuggaauacuacaauugccguaucaauggcgaacauauuuagagguucuuaccuggcuggagcugguuuagcguucaguauaaugaaaagcgucggaaccggaaaaagaggaacaggaucacaaggugaaacacuaggagaaaaauggaaaaagaaacuaaaucagcuguccagaaaggauuucgaccucuauaaaaagaguggaauaacugagguagaucgaacugaggccaaagaagguuuaaaaagaggcgaaauaacacaucaugcaguaucacgugggagugcaaagcuucagugguuugucgaaagaaauauggucauaccggaaggaagagucauugaucuaggaugugggagagguggguggucauauuacugcgcaggacuaaagaagguaacagagguuagagguuacacaaaaggggguccaggucacgaagaaccagucccuaugucaacauacggauggaauauaguaaaacuuaugagcggcaaagauguauuuuacuugccuccggagaaaugugauacucuacuuugugauaucggagaaaguucaccuaguccaacgguagaagagagcagaacgauccgaguuuuaaagaugguagagccauggcuuaaaaacaaucaguuuuguauaaaagugcuuaacccauauaugcccacugugauugagcaccucgaaagacuacaaaggaaacacggugguaugcugguuaggaauccauugagcaggaacuccacacacgagauguauuggauaagcaacgggacaggaaauauaguagccucuguaaauauggugucccgcuuguuguugaaucguuucacaaugacccauagaagaccaacaauagaaaaggacguugaccugggagcgggaacaagacaugugaaugcugaaccugaaacaccgaacauggauguaauaggugaaagaauaaaacgaauaaaggaagagcacaauagcacauggcacuaugacgaugaaaauccuuauaaaacgugggcuuaucauggaucuuaugaaguuaaagcgacaggcagugcaucgucaaugaucaauggugucguuaagcuacucacuaaaccuugggacguggugcccaugguuacacaaauggcaaugacggacacaacaccauuuggccaacagagaguguuuaaagaaaaaguagacacacggacaccucgaaguaugcccggcacacgaaggguuaugggaaucaccgcugaaugguuguggcgaacuuuagguagaaauaagaaaccccgauuauguacccgcgaagaauucacuaaaaaaguuagaacaaaugcggcaaugggagcuguauuuacugaggaaaaucaaugggauuccgcuaaagcugcaguagaagacgaagauuuuuggaaauuagucgacagagaacgagaacuccacaaauuaggaaagugcgguagcugcguguacaauaugaugggaaaaagggaaaagaaauugggcgaauuugggaaagcaaaaggaucaagggcaaucugguacauguggcuuggggcuagauaucuugaauucgaagcauugggauuucuuaacgaagaccauugguuuagucgcgaaaauuccuauucugggguggaaggcgaaggacuacauaaauuaggcuacauauuaagggacauuuccaaaauaccgggaggagcaauguacgcugaugacacugcagguugggacacgaggauuacagaagaugacuuacauaacgaagaaaaaaucacacaacaaauggacccagaacacaggcaacuugcgaaugcaaucuuuaaacuaacuuaccaaaauaagguaguaaaaguucaaaggccgacgccaacuggaacagugauggauauaauaucaaggaaagaucagcggggcagcggacaagucggaacuuacggccuuaauacauucacaaauauggaagcacaauugauaagacaaauggaaggugaaggaguguuaucaaaggcggaccucgagaauccacaccuuccagaaaaaaaaauaacacaaugguuggaaacuaaagggguagaacgucuaaaacgaauggccauuaguggugacgauugcgucguaaagccgauagaugauagauucgcuaaugcgcuauuagcucucaaugacaugggaaaaguccgaaaggauauuccacaguggcaaccaaguaaaggauggcaugauuggcaacaaguucccuuuugcagccaucauuuccaugaacuuaucaugaaggacggucggaaguuaguaguacccugucgaccccaagacgagcuuauaggaagagcaagaauaagccagggagcaggauggucccuuaaggaaacugcuugucuggguaaagccuacgcucaaauguggucucuaauguauuuccauagacgagaucugcgauuagcuucuaaugccaucuguuccgcaguucccguccacuggguuccaacaaguagaacgacuuggucaauucacgcucaucaucaauggaugacuacugaagacaugcucacaguauggaaucgaguauggauagaagauaauccuuggauggaagacaagacgccaguaacaacgugggaaaauguuccauaucuugguaaacgagaagaucaauggugcgguucucuuauaggucuuacaucaagggcaaccugggcacaaaacauuccaacagccauccagcaagugcguagcuuaauagggaaugaagaguuucuagacuacaugccuucaaugaaaagauuuagaaaagaagaggaaucugagggcgccauaugguaa

SEQ ID NO: 23219 - RNA, 9873 nt, Artificial Sequence
  derived and/or modified CDS sequence (opt6) from DENV-3__JF920409__SS-prME
accucguugugucuuaugaugauccuaccugcugcauuggcuuuccacuugacgucacgagauggagaaccccgcaugauaguaggcaaaaaugaacgggggaaaucguuauuguuuaaaacugcaagcgguauuaauaugugcacgcuuauagccauggauuuaggugaaaugugugaugauacugucacauacaaauguccgcacauaaccgaaguugaaccagaagauauugauuguugguguaaucuaacgaguacaugggugacuuaugguacauguaaucaagcaggagagcauagacgagauaaaaggucaguagcacucgcuccgcaugucgggaugggguuagauacgagaacucaaacuuggaugagugcagagggagcuuggcgacaagucgaaaaagucgaaaccugggcucuacgacaucccggcuuuacaauuuuagccuuguuucuagcacacuauauagggacaaguuuagcacaaaaagucguuauauuuauuuugcuaauguugguuacacccagcaugacaaugcgaugugucgggguugggaaucgagauuuugucgagggacuuucgggagccacuuggguagauguaguacuagagcacggaggaugugucacgacuauggcuaaaaauaaaccgacauuagacauagaguuacagaaaacagaagcuacacaauuagcaacucugcgcaaauuaugcaucgaagggaaaaucacgaauauuacaaccgacucaagaugccccacacaaggcgaagcaacuuuaccagaagaacaagaccaaaacuauguguguaaacacacguaugucgaucgggguugggggaacggaugcggccuuuucgguaaaggaucccuaguuacaugugcgaaauuucagugccuagagccuauagaaggaaaaguaguacaguaugaaaacuuaaaauacacuguuaucauuacgguucauacuggugaccaacaccaagucgggaaugagacucaggguguaacugcagaaauaacaccccaagcaaguacaacagaagcaauccuucccgaguacggaacacucggacuagaaugcaguccuaggacagggcuggacuuuaacgagaugauauuguuaacaaugaaaaacaaagcauggaugguucauagacaaugguuuuucgauuuaccguugccauggacaaguggugcaacgacugagacuccuacauggaacagaaaagagcuucuagucacuuuuaaaaacgcccaugcuaagaaacaggaaguugugguacuugggucacaagaaggugcuaugcacacggcauuaacaggggcuacggagauacagaacagcggaggaacaaguauauuugcuggccacuuaaaaugccgccucaaaauggacaaacuugagcuuaaggguaugaguuaugccaugugcacuaauacguuuguacuuaagaaagaaguuagcgagacacagcauggaacaauacuaaucaaaguagaauauaagggcgaagacguaccaugcaaaauuccuuucagcaccgaagacggacaaggcaaggcacacaaugguaggcuuauaacggcaaacccuguagugacuaagaaagaagaaccagugaacaucgaagcggaaccgccauucggagaaucaaacauaguaauuggaaucggagauaaugcuuugaagauaaacugguauaagaaaggaucuagcauaggaaagauguucgaagccaccgcaagaggagcacggagaauggcaauacuuggugauacagcaugggauuuugggagugugggcggaguguuaaauaguuuaggaaaaaugguucaucagauauuugggucugcauauacggcauuauucucagggguuaguugggugaugaaaauaggaauaggaguccuauuaacguggauaggacuuaauagcaagaacacuagcaugucauuuucauguauugcgaucgguauaaucacguuguacuuaggggcgguuguacaggcugacaugggguguguaauaaacuggaaagguaaagaauugaaaugcgguaguggaauauuugucacaaaugagguccauaccuggacagaacaauauaaauuucaagcugauucuccaaaaagauuagcuacggcuauagcgggagcaugggagaaugggguauguggcauaaggagcacaacucgcauggagaaucuguuauggaaacaaauagcuaacgaacuaaauuauaucuuaugggaaaauaacauuaaauuaacuguaguuguaggagauauuauagguguacuagaacaaggaaaaagaacuuuaacuccacaaccgauggaacuaaaauacaguuggaaaacaugggguaaagcaaaaauugucacagccgaaacacaaaauuccaguuucaucauagauggacccaacacaccagaguguccaagugucagcagagccuggaacgugugggaaguagaagauuauggauucgguguuuuuacuacuaauauaugguuaaaauuaagggagguauacacccaacucugcgaucaccgucuaauguccgccgcggucaaggacgagcgagccgugcacgcagacaugggguacuggauugaaagucagaaaaauggcuccuggaaacuagaaaaagcaaguuuaauugaaguaaaaacuugcacauggccaaaaagucauaccuuauggucuaaugguguucuagagagcgauaugauuauccccaaaucucuugcaggucccaucucccaacauaaucauagaccuggguaccauacgcaaacagcaggcccguggcauuuagguaaacucgagcuugacuucaauuacugugaaggaacgaccguaguaauuaccgagaacugugggacaagaggaccaagucugcggacaaccacaguauccgguaaauugauacacgaauggugcugucguagcuguacacuacccccuuugcgauauaugggugaggauggaugcugguauggaauggaaauccggccaauuuccgaaaaagaggaaaacaugguaaaaaguuugguuagcgcagggucugggaaggucgauaauuuuacuauggguguccuaugccuugccauacuuuucgaagaagucaugagaggaaaguuugggaaaaagcauaugauagcaggagcguuuuucauguucguauuacuauuaagcgggcaaaucacauggcgagacauggcgcacacuuuaauaaugaucggguccaaugcaagcgaccguaugggaaugggagucacguacuuagcgcuaauagccacuuuuaagauccaacccuuucucgcguugggguucuuuuuaagaaagcuaacuucuagagaaaaucuauuauuaggcguaggguuagcgauggccacuaccuuacaacuucccgaagacaucgagcaaauggccaacggaauagcccuaggcuuaauggcacuaaaacuaauuacgcaauuugagacauaucaauuauggacugcacucauuagccuaaccuguaguaauacaaucuuuacacuaacgguagcauggcgaacugcaaccuuaauauuagcaggcgugagucuauugccaguaugccaauccucgagcaugcgcaagacugacuggcugccuauggccguugcggccaugggagugccuccacuuccccucuucauuuucucauuaaaagacacacucaaaagaagaucauggccguuaaacgaaggcguaauggcuguaggacuugugaguauauuagccagcucuuuacuaagaaaugacgugccaauggcugguccgcuuguagcgggcggacuucuaaucgcuuguuauguaauuacagggacaucugcagacuuaacaguagaaaaagcugcggauaucacuugggaagaggaggcagaacagacagggguaagccauaacuuaaugauuacaguagaugaugauggcacaaugcgaaucaaggacgaugaaagcgagaauaucuugaccguacuuuuaaagacagcauugcuaauuguaagugguauuuuuccauacuccauacccgcuacucugcuaguauggcacaccuggcagaagcaaacacaaagaucgggcguguugugggauguuccguccccgccugaaacacaaaaggcggaauuagaagagggagucuaucguauaaaacaacagggaauauuugggaaaacccaaguugggguuggaguucaaaaagagggcguguuccauacgauguggcauguuacaaggggagcaguucuuacuuauaaugggaaacgucuagaaccuaauugggcaagugucaagaaagauuugauaagcuauggcgguggauggagacuaucugcacaguggcaaaagggggaagaaguacagguaauagcaguagagccugguaagaaucccaaaaauuuucaaacgaugccaggcacuuuccaaacuacaacaggggaaauaggcgcaauagcauuggacuuuaaaccaggaacguccggaagucccaucauaaaucgcgaaggcaaaguagucgggcuuuauggcaacgggguagucacuaagaauggaggauacgugucgggaauagcgcaaacaaaugcagaaccggauggaccaacaccagaauuagaagaggaaauguucaaaaagagaaaccugacgaucauggauuuacauccagguucgggaaaaacuagaaaauaccucccggcgauaguucgcgaggcgauaaagaggagguugcgaacacuaauucucgcuccaacuagggucgucgcggcggaaauggaagaagcacuuaaaggccuaccgauaagauaucaaacuacugcaacaaaaucggaacauacagguagagaaaucguggaccuaaugugucaugcaacauucacuaugagauuauuaagccccguuagggucccuaauuacaacuuaauaauaauggaugaggcucacuucacagauccugcgucaauugcagcucggggauauauuucaacaagaguugggaugggcgaggcagcggcaaucuucaugaccgcuacaccaccaggaacagcagacgcauuuccacagagcaaugcgccgauucaagacgaggagcgcgauauuccagagagaucauggaacucuggaaacgaguggauaacggauuucgccgggaagacaguuugguuuguuccaaguauuaaagcugguaaugauauagcuaauugcuuacgcaaaaauggaaagaaaguaauacaacugucacguaagacauucgacacugaguaucaaaagacaaaacuaaacgacugggauuuuguagugacuaccgacaucucugaaaugggagccaauuuuaaggcugacagaguaauagauccucggagaugcuugaaaccgguuaucuuaaccgauggcccugaaagaguaauacucgcugguccaaugccugugacagcggcaagugccgcgcagagaagaggccguguaggucgcaacccgcagaaggaaaaugaccaguacauauucacggggcaaccacuuaacaaugacgaggaccaugcacacuggacagaagcaaagauguuauuggauaacauuaacacaccggaaggaauuauuccagcucucuuugaacccgaaagagagaagucagcggcaaucgauggugaauauagauuaaagggcgaaaguaggaagaccuuuguugaacuaaugagacgaggggauuuaccuguuuggcuugcccauaaaguugcaagugaaggaauaaaguauacagacagaaaauggugcuuugauggacaacguaauaaucagaucuuggaagaaaacauggacguugaaaucuggacuaaagaaggcgagaaaaagaaguuacgaccgagauggcuggaugcaagaacauauagugaucccuuagcccuaaaagaguuuaaagaauuugccgccggccgcaagagcaucgccuuagaucuugucacugaaauaggucgaguaccaucccaucuggcacacaggacaagaaaugcucuugauaaucuuguuaugcuacauacaagugagcauggagguagagcuuaucgccacgcaguagaagaacuucccgaaacaauggaaacacuucuucuacuuggucuaaugauccuuuuaacagguggagccaugcuguuccuaauaaguggcaaaggaauagguaaaacaaguauuggccuuaucuguguuauugcaucaucagguauguuauggauggcggaaaucccauugcaguggauagcgagcgcaauaguucuugaguucuucaugaugguacuccuaauaccagaaccugaaaaacagagaacaccccaggauaaccaacuggcuuauguagucaucggaauauuaacacuggcagcuaucauugccgcaaaugaaauggggcuacucgaaacuacaaaacgugaccucgggaugucgaaagaaccuggaguuguaucuccaacuucuuacuuagauguggaucuucaucccgcuucagcuuggacguuauacgcgguugccacaacugucauaacaccaauguuaagacauacuauagaaaacaguacagcaaaugugucauuagccgcuauugcuaaccaagccgucguuuugaugggucuagacaaaggauggccuauuucaaaaauggaccuagguguaccucuguuagcccugggauguuauagucaaguaaauccuuuaacacucacugcagcaguuuuauuauugaucacccauuacgcaauuaucggaccaggauuacaagcuaaagcuacaagagaggcucagaaaagaacagcugcgggcauuaugaaaaauccaaccguagaugguauaaugacaauagaucuggauccgguaaucuacgauucaaaauucgagaaacagcugggucaagugaugcuauuaguuuuaugcgcugugcaacuuuuacuuaugaggaccagcugggccuugugugaagcauuaacuuuagccacuggaccuauaacaaccuugugggaaggaaguccuggcaaauucuggaauacuacuauugccgucucaauggcaaacauuuuuagggguuccuauuuggccggugcaggguuagccuucaguauaaugaagucggucgggacaggaaaacgcgggacagguagucagggagaaacuuuaggugaaaaauggaagaagaaauugaaucaauugucaagaaaggauuucgaucuauacaagaaaagugggauaacggaaguagauagaaccgaagcuaaagaaggcuugaaaagaggugagauuacgcaucaugcaguuuccagaggaucagccaaguuacagugguucguugaaagaaacauggucauaccagaaggaaggguuauagaccuaggaugugguagagggggauggucauacuauugcgcuggacucaagaaagugacagagguaaggggauauacuaaaggaggcccaggucaugaagaaccagugccuaugagcacauauggauggaauaucgugaaauugaugagugggaaagacguauucuaucuuccaccagagaagugcgacacccugcucugcgacauuggagagucaagccccucuccaacaguagaagaaucaagaacaauuagggucuuaaaaaugguugagccuuggcucaaaaauaaucaauuuuguauaaaaguucuaaacccauacaugccuacaguaauagaacauuuagaaagauuacaacggaaacaugggggaauguuaguuagaaaccccuuaucacgaaacucuacccaugaaauguauuggauuagcaauggaacuggaaauauaguugcgucuguaaauaugguaucaagauuguuacucaaccgcuuuacaaugacgcauagacguccaacuauagaaaaggaugucgaccuaggcgcuggaacuagacacguaaaugcggagccggagacaccaaauauggauguuaucggugaacgaauuaaaagaauaaaagaagaacauaauagcacauggcauuaugaugacgaaaauccuuauaaaacgugggcuuaccauggaaguuaugaaguuaaagcaacagggucagcaucguccaugauaaauggugucguuaaacugcuaaccaagccuugggauguugugccaaugguuacucaaauggcaaugacagauacaaccccauucggucaacagcgcguauuuaaagagaaaguagauacucgaaccccacgaucuaugccuggaacgcguagagucaugggaaucacugcagaauggcuuuggcgcacacuugguagaaacaagaaaccacgacuauguacaagagaagaguucacuaagaaaguacggacuaacgcugcaaugggugcaguuuucaccgaagagaaccaaugggacucugcuaaagcugcuguagaagaugaagacuucuggaagcuaguugauagagaaagggaacuccauaaauuagggaaauguggcagcuguguauauaacaugaugggcaagcgagagaagaaacugggugaauuugguaaagccaaaggaucaagggcaauaugguauauguggcuaggggcccgauauuuagaguuugaggcacucggcuucuuaaacgaagaccauugguuuucaagagaaaacaguuacagcggaguugaaggagaaggucuacauaaauuagguuauauacuacgagauauuucuaaaauaccagguggggcaauguaugcagaugacacugcaggaugggauacucgcauaacggaagaugaucuacacaaugaagagaaaauaacucaacaaauggauccggagcaccgacaauuagcgaacgcaauauuuaaauuaaccuaucaaaauaagguaguuaaaguacagagaccaacaccuacagggacuguaauggacauaauaucccgaaaagaccagcgcgguagcggccagguuggcacauacgguuugaacacauuuacaaauauggaggcccaacuuauacgucaaauggaaggugaaggaguguuaaguaaggcagaucuugaaaauccucauuugccagagaaaaagaucacucagugguuggaaacaaaaggaguagaaagacuaaagagaauggcgaucucaggugaugauugugucgugaaaccuaucgaugacagauuugcaaaugcacucuuagcauuaaacgacauggguaaaguacguaaggacauaccacaguggcaaccuuccaaaggauggcaugauuggcaacaaguuccguucuguucgcaucauuuucaugaauuaauuaugaaagaugguagaaaguuaguggucccuuguaggccgcaagacgaauuaauaggcagagcacgaaucagccaaggagcaggcuggucauuaaaggaaacagcuugucuagguaaagcguaugcgcaaauguggagccuuauguacuuucaucgcagggaucuaaggcucgcaaguaacgcgauauguucagcagucccaguccauuggguaccaacgucgagaaccacuuggagcauucacgcucaucaccaauggaugacuaccgaggauaugcugacaguguggaacagagucuggaucgaagacaauccauggauggaggauaaaacccccgucacaacaugggagaacguuccuuauuuagguaaaagagaagaucaauggugugggucacuaauaggccugacuucaagggcaacaugggcucaaaauauaccuacugcaauucaacaaguaagaaguuuaaucggaaacgaagaguuccuugacuauaugccaucgaugaaacgauuuaggaaagaggaagaaagugaaggagcuauaugguaa

SEQ ID NO: 23220 - RNA, 9873 nt, Artificial Sequence
  derived and/or modified CDS sequence (opt6) from DENV-3__JF920408__SS-prME
acaucccugugccuaaugaugauauuaccagcugcuuuggcauuccauuuaacuagccgagacggagaaccaagaaugaucguuggcaaaaaugaaagaggaaaaucauuauuguucaaaacagcaaguggaaucaauaugugcacucuaauagcuauggaccuaggugaaaugugcgacgacacuguuacuuauaaaugcccucacaucacggaaguggaaccggaagauaucgacuguugguguaauuuaacuucaacuuggguuacauacgguaccugcaaucaagcuggagaacaucgacgugauaaaagaaguguagcgcuugcuccacacguaggaaugggacuugacacuagaacccagacauggaugagcgcagaaggugcuuggcggcaaguugaaaaaguagaaacuugggcacuacgccacccaggauuuacaauacuagccuuauucuuagcacauuauauugguacaucguuaacgcaaaaaguuguaauauuuauauuguuaaugcuugucaccccaucgaugacuaugagguguguaggaguggguaaucgggacuuuguggaaggacuaagcggugcaacuugggucgauguaguacuagaacauggaggcugugugaccacaauggccaaaaauaaaccaacuuuggauauagaacuacagaaaaccgaagcuacacaauuagcaacccuccgaaaauuauguauagagggcaaaauaacaaauauaaccaccgacucaaggugucccacacaaggugaggcaacacuaccagaagaacaagaucaaaacuacgucuguaaacacacauaugucgaccgaggauggggaaauggaugcggccucuuugguaaagggagcuuaguuacaugugcaaaauuucaaugccuugaaccaauugaagggaaaguaguucaauacgagaaccuaaaauauacugucauaaucacaguacacaccggggaccaacaucagguuggaaauggcacacagggagucacagccgagauaaccccgcaggcuucaacuacggaggcaauuuugccagaguacggaacauuaggacuggaauguucaccccgaaccggguuagauuuuaaugaaaugauauuauuaacaaugaaaaauaaggcuuggauggugcauaggcaaugguuuuucgaucugccgcuaccauggacuucuggugcaacgaccgaaacgccgaccuggaacaggaaagaacuacuuguaacauucaaaaaugcccaugcaaagaaacaagaagugguaguauugggaucacaggaaggagcaaugcacacagcuuugacaggagcuacggaaauccaaaauuccggugggaccgguauuuuugcuggacaucuaaaaugcagauugaaaauggauaaacuagaacuaaaaggaaugucauacgcuaugugcaccaauacauuuguucucaagaaagaagugagugagacucagcauggcacuauacucauuaaaguggaauauaaaggcgaagaugugcccugcaaaauucccuucaguaccgaagauggacaagguaaagcucauaauggacgauuaaucacagcaaacccagucguaacuaagaaagaggaaccuguaaauauugaagcugaaccaccauucggagaaaguaacauagucauaggcauuggggacaaugcauuaaaaauaaauugguauaagaaagggagcucaauaggaaaaauguuugaggcgacagcacgaggggcuaggagaauggcaauccuuggggauaccgcaugggacuucggcaguguuggagggguuuugaacagucuagggaaaaugguccaucaaauauuuggcucagcguauacugcucuauucagcggaguaaguuggguaaugaaaauuggaauugguguucuauuaacuuggauugguuuaaacagcaaaaacacaucuaugucguucucauguauagcaaucgguauuaucacgcuauaccuaggugcaguaguucaagccgauaugggaugcguuaucaacuggaaagguaaagaauuaaaaugcgguagcgggauuuucguaaccaaugagguucauacauggacggaacaguauaaauuccaagcagauaguccgaaacggcucgcuacagcuauugcuggggcaugggaaaauggcgucugugggauucgauccacuacaagaauggaaaauuugcuuuggaaacaaauugcaaacgaacuaaauuauauuuugugggaaaauaacauaaaacuuacuguuguuguaggggacauaauugguguucuugagcaaggaaaaagaacguuaacuccucaacccauggaauugaaauacucuuggaaaacgugggggaaagccaaaauuguaacggcagaaacccaaaacucaaguuucauaauagauggcccuaauacgccggaauguccaucugucucaagagcauggaauguaugggaaguagaggacuauggcuuugguguguucaccacuaacauauggcucaaacuaagagaaguauauacucaauuaugugaucaucgccugaugagugcagcgguuaaagaugaaagagcaguacaugcagacaugggauauuggaucgaaucucagaaaaauggaucuuggaaauuggaaaaagcaucauuaauugagguaaaaacaugcacauggcccaaaucacacacccuuuggaguaauggaguucuggaaagugacaugauaaucccaaaaagucuagcugguccaauuucgcaacauaaccacagaccaggauaucauacccagacagcugguccauggcauuuaggcaaacuagaauuagacuuuaacuauugcgaggggacaacaguaguaauuacagaaaauugcgguacacgagguccuagucuucggacaaccacugucucaggaaaauuaauacaugaaugguguugcagaucaugcaccuuaccaccacuucgguacaugggggaagauggcuguugguacgguauggagauucgaccgauaucagaaaaagaagagaauauggugaaaucauuaguaagcgcgggauccggaaaaguagauaauuucacuaugggaguccucugccucgcgaucuuauucgaggaaguuaugagaggaaaauuugguaagaaacauaugaucgcugguguauucuuuacauuugugcuccuccucaguggacaaauaacauggcgugauauggcgcacacauugauaaugauagguucaaaugcaagcgaccgaauggguaugggcguaaccuacuuagcucucauagccaccuucaaaauccaaccguuccuagcgcugggcuucuucuuaagaaaacucacuucccgcgaaaaccuucuuuuagggguaggacuagcaauggcaaccacacuacaauugcccgaagauauugaacagauggcaaauggaauagcucucggucugauggccuuaaaauuaaucacccaguuugaaacauaccaacuuuggacagcacuaauuuccuuaacauguaguaauaccauuuuuacauuaacagucgcuuggcgcaccgcaacuuuaauacuagcuggagucucuuuauugccagucugucaaagcaguucgaugcgcaaaacagauuggcugccaauggcgguggcagccaugggcgucccgccccuaccgcuguuuaucuuugggcuaaaagauacauugaaaagaaggucguggccauugaacgagggaguuauggccguaggucuaguuaguauauuagcuucaagccuacuaaggaacgauguacccauggcugguccacucguugcgggcggucuacucauagcauguuacguaauaacagguacauccgcagauuugacaguagaaaaagcugcagacaucaccugggaagaagaagcugagcaaacagggguaucacacaaccuuaugauaacaguugaugacgauggaaccaugcgaauuaaagacgaugaaacugaaaacaucuugaccguccuucuuaaaacagcuuuauugauaguaaguggcauuuuuccauauuccauuccggcaacucucuuaguauggcauacauggcagaaacaaacgcagcguuccgggguucuuugggaugucccaucaccgccggagacccagaaagcugaguuagaggagggaguguaccguaucaaacaacaagguauauuugguaaaacacaaguuggaguuggaguacaaaaagaaggcgucuuccauacgauguggcauguuacacgaggagcaguucuaacauacaauggcaaacgacuagaaccuaauugggcgagcguuaagaaggauuuaauaucauacggagguggauggcgcuugucggcacaauggcaaaagggcgaggaaguacaaguuauagcaguggagccuggcaaaaacccgaaaaacuuucagacgaugccuggaacauuucaaacuacaacgggugagauaggugcaaucgccuuagauuucaaaccaggaacaagugggagcccaauuauuaaucgggaaggcaaaguagucggauuguacggcaaugguguaguaaccaaaaacggggguuacguaucuggaauagcacagacgaaugcugaaccagauggaccuaccccugaacuagaagaggaaauguuuaagaaaagaaacuuaacuauuauggaucuucauccaggcucaggcaaaacaagaaaauauuuaccagcaauuguacgagaagcuauaaaacggcgauuacguacccuaauacucgcgccgacuagagucguagccgcagaaauggaggaggcauugaagggauuaccuauccgauaucaaacuacugcuacaaagagugagcacacugguagagaaauagucgaccuaaugugucaugcaacuuuuacaaugcgcuuacuuaguccuguaaggguaccaaacuauaacuuaauuauaauggacgaagcccauuuuaccgauccugccaguauagcggcuaggggcuauauaaguaccaggguugggaugggagaagcggcagcgauauuuaugacugcaacacccccuggaacugcagaugcuuuuccgcaguccaaugccccgauucaagacgaagaaagagauauaccagagagaucauggaacucgggaaacgaauggauaacugacuuugcggguaaaacggucugguucguaccaaguaucaaagcugguaaugauauagcgaacugucuacguaaaaacggcaagaaagucauacaauuaucuaggaaaacuuuugacacggaguaccagaaaacuaaacuuaacgacugggauuucguuguuacgacggauauaucagagaugggggcaaacuuuaaagcugauagaguaauagauccacguagaugucucaaaccaguuauuuuaacugauggucccgaaagggucauauuagcugguccuaugccuguaacugccgcuucagcugcucaacgacgugguaggguuggaagaaacccccaaaaagaaaacgaucaauacauauucacaggacagccauuaaauaaugaugaagaccacgcgcauuggacagaagccaagaugcuacucgacaacauaaacaccccagagggaauuauacccgccuuauuugaaccugagcgugaaaaauccgcggcuaucgauggcgaauauagacuaaaaggugaaucaaggaaaacguuuguugaauuaaugaggcgaggggaucuaccgguuugguuagcucauaaaguugcuagcgaaggaaucaaguauacagacaggaaauggugcuucgauggacaaagaaacaaucaaauacuagaagaaaauauggauguugagauauggacuaaagaaggagagaagaagaaauugagaccucgauggcuagaugcaaggacguauagcgauccgcuggcauugaaagaguuuaaagaauuugcugccggacggaaaucgaucgcuuuagauuugguaacagagaucgguagagucccaucccacuuggcccauagaacaaggaaugcauuggauaaccugguaauguuacauaccucagaacacggcggcagagcuuacagacaugcuguugaagaacuuccugaaacuauggaaacauuacuucuuuuagguuuaaugauauugcucacaggaggagccauguuauuucuaaucucaggcaaaggaaucgguaaaacgucaauaggccuuauaugcguaauagccucgucuggcaugcuauggauggcagagauaccacuacaauggauagcgagugcaauuguacuagaguucuuuaugaugguauuguuaauuccagaaccagaaaaacagcgcacuccacaagauaaucaauuagcguauguagucauugggauucuaacacucgcugcgauuaucgccgcgaacgaaaugggauuauuggaaacuacuaaacgggacuuggggaugucuaaggaacccggagucgucucgccaaccucauaccuggauguugaucuacauccggcaucggcauggacucuauacgcaguagcaaccaccguaauaacaccuaugcuacgucauacgauagaaaacucaacagccaauguaaguuuggcugcaauagccaaccaagcgguuguauuaauggggcuggauaagggauggccuaucuccaagauggaccuaggaguaccguuacuagcacuuggaugcuacucucaagucaauccucugacacuuacugcggcuguacuucuucuaauaacucacuacgcaaucauaggcccaggucuacaagcuaaagcuaccagagaagcacagaaaagaacggcugcuggaauaaugaaaaacccaacaguagacgguauaaugacuaucgauuuagauccagucauauaugauagcaaauucgaaaaacaguuggggcagguuaugcuuuugguauuaugcgcaguucaguuacuacuuaugagaacaagcugggcacuaugcgaagcacuaacccuagcaacaggcccaauaacaacgcuaugggaaggcucaccugguaaauucuggaacacuacaauugcagucucuauggcgaacauauuuagagguucauaccuugcuggagcugggcuugcauucuccauuaugaagucagucgguaccggaaaaagaggaacuggaucacaaggugagacucucggagagaaguggaagaagaaauuaaaccaacuaucgaggaaagauuucgaccuauauaagaaaagugguauaacagagguugaucgaacagaggcaaaagaaggacugaaacgaggugagaucacgcaucaugcaguuucaaggggguccgcaaaacuacagugguucguugaacggaacaugguuauaccugagggucguguaauagaucuagggugugguagaggaggguggucguauuauugugcagggcuaaagaaaguaacagagguccgagguuacacaaaaggagggccaggacaugaagaacccguaccuaugucuacauacggcuggaauauagugaaacuaaugucaggcaaagacguauucuacuuacccccagaaaaaugcgacacccuauuaugugacauuggugaaucaaguccgucgccgacagucgaggaaucuaggacaauaagaguacuuaaaaugguugaaccauggcuaaagaauaaccaguucuguaucaaaguuuuaaauccauauaugcccacagucauagaacauuuggaaagauugcaaaggaaacaugggggcaugcuaguaagaaacccauuaucucguaacaguacucaugaaauguacuggauuucaaauggcacugggaauauaguugcaucuguaaacaugguaucacgucuucuccugaacagauucacuaugacucaucgacgcccuacgauagagaaagacguagaucuaggugccgguacacgacaugucaaugcugaaccagaaacaccaaacauggaaguaauaggcgaacgaaucaagagaauuaaagaggagcacaauagcacuuggcacuaugacgaugaaaacccauauaaaacaugggccuaccacgguucauacgaaguaaaagcaacggguucugcaaguagcaugaucaacggcguuguaaaacucuugacaaaaccuugggacguagucccaaugguaacucagauggccaugacagauacuaccccauuuggucaacagagagucuucaaagagaaaguugacacuagaaccccaaggaguaugcccggaacgagacgcguaaugggaauaacagccgagugguuauggcgcacacuggguagaaacaagaaaccuagacuaugcacccgggaagaauuuacgaagaaaguacgaacaaaugcagccaugggagcuguauucacugaggagaaucagugggauuccgcuaaagcagccguagaagacgaagacuuuuggaaacuuguggacagagaaagagaacugcauaaauuagguaaaugugguuccuguguauauaacaugauggggaagcgugagaagaaacuuggagaguucgguaaagcgaaaggcuccagagcaauaugguacaugugguuaggagccagauauuuagaauuugaagcauuaggauuccuaaacgaagaccauugguuuagcagagaaaauucauauagcggaguugaaggggaagguuuacauaaauuggguuauauauugagagauaucucuaaaauuccgggaggcgccauguacgcagaugauacugcugguugggacacgaggauaacagaagaugaccuccauaacgaagagaaaauuacccaacaaauggauccagagcaucgacagcuugccgacgcuauauuuaaguuaacauaccagaauaagguuguaaaaguucagcggcccacaccaacaggaacuguaauggacaucauaucaagaaaagaccaacggggaucaggacagguugguacauaugggcuaaauacuuucacaaacauggaagcucaacuaauuagacagauggaaggagaaggaguacuaaguaaagcugaucuggaaaauccccaccuaccggaaaagaaaaucacacaauggcuagaaacuaagggaguggaaagguugaaacguauggcaauaucaggcgaugacugcgucgucaaaccuauagacgaucgcuuugcaaaugcacuucuagcacuuaacgauauggggaagguacgaaaagacauuccucaguggcaaccgaguaaggguuggcaugauuggcagcaagugccuuuuuguucucaccacuuccaugagcugauuaugaaagauggaagaaaguuaguggucccgugcagaccgcaggaugaacucaucgggagagcgcguauuucacagggagccggauggucauuaaaagagacagcauguuuaggcaaagcauacgcacaaauguggucccuuauguauuuucaccgaagagaccuuagacuugcaaguaaugcuauuuguagcgcaguaccagugcacugggugcccacaaguaggaccacguggucgauucaugcucaccaucaauggaugacaacagaagauauguuaacaguguggaacagaguauggauugaagauaauccuuggauggaagacaaaacgccaguaacuacuugggaaaacguaccuuaucuugggaaaagagaagaccaguggugcggaagucuaaucggacuaacgucccgugcaacuugggcucaaaauaucccaacugcaauacaacaaguccgauccuuaauaggcaaugaagaguucuuagacuauaugccaucaaugaaacgguuucgaaaagaagaagagucagaaggagcuauaugguag

SEQ ID NO: 23221 - RNA, 9873 nt, Artificial Sequence
  derived and/or modified CDS sequence (opt6) from DENV-3__JF920397__SS-prME
acuucacugugucuuaugaugauccuuccagcugcacuagcauuucacuugacaucgagagacggugaaccuagaaugauagucggcaaaaaugaacgaggaaaaucauuguuguucaaaacggcauccggaaucaacauguguacacuaauugcaauggaccugggagaaaugugugacgacacugucacauauaaauguccacacauuacagaaguugaaccggaagacauagacuguugguguaaucuaacgucuaccugggucacguacgguacuuguaaucaagcuggagaacaccgcagagauaaaagaucagucgcuuuagcgccacaugucggaaugggguuagauacaagaacacaaacauggauguccgcggaaggagcguggagacaaguagaaaaaguagaaacuugggcucuacggcauccuggauuuacaauacuagcgcuauuuuuggcucacuacauuggaacgucauuaacacaaaaaguagucaucuuuauucucuuaaugcuagucacuccauccaugacuaugcgcugcguuggaguagguaauagagauuucgucgaaggguuaaguggagcuacuuggguugaugugguccucgaacauggaggguguguuaccacaauggcgaaaaauaaaccuacucuggauauagaacuacagaaaaccgaagcaacacaacuggcuacacuaagaaaacuaugcauagaaggaaaaaucacgaacauaacaacagauaguagaugccccacucaaggagaagccacauugccagaagaacaagaucaaaacuauguauguaaacacaccuauguggaucgaggaugggguaacgggugugggcuguuuggaaaaggaagucuuguaacaugcgcaaaauuccaaugucuagaaccgauugaaggaaaaguuguucaacacgaaaaucuaaaauauacgguaaucaucacuguacauacaggggaucaacaccaagugggcaaugaaacacaggggguaacggcagaaauaacaccucaagcgucgacuacagaagcaauccuaccagaguaugggacauugggauuagaaugcaguccaagaacaggccuagacuucaacgaaaugaucuuauuaacaaugaaaaauaaagcguggaugguacaucgacagugguucuucgacuuaccccuaccauggaccucuggagcuacaacugaaacacccacauggaaucgcaaagaucuauugguaacauuuaaaaaugcacaugcuaagaaacaagaaguagucguucuugguagucaagaaggggccaugcacacagcauuaacaggggcuacagagauacaaaauaguggcgggacaucuaucuucgcaggucaucugaaauguagauuaaaaauggacaaacuagaacugaaaggaaugagcuaugcaaugugcacuaauacauucguccucaagaaagaaguuagcgaaacacagcauggcacaauuuuaaucaaaguagaguauaaaggcgaagauguuccuuguaaaauaccguuuucgacugaggacggucaggggaaagcccauaauggccgauuaauaacagccaacccaguagugacuaagaaagaagaaccagugaauauugaggcagaaccaccauucggcgagucaaacauagucauagguauuggagacaacgcccuaaaaauuaauugguauaagaaaggaucaucuaucggaaaaauguucgaagcuacggcaagaggggcgcgaagaauggcgauauuaggcgauaccgcuugggacuucggcucagucgggggaguguugaacagcuuagggaaaauggugcaucagauauuuggaagugcauacacugcauuguucucuggaguaaguuggguaaugaaaauaggaauaggaguauuauuaaccuggauuggccucaacucgaaaaauacuucuaugucguucagcugcauagcaauuggaauaauuacacuauaccucggagccgucguacaggcagauaugggcugugucauuaacuggaaaggaaaagaacuuaaaugugggagcgggauuuuuguuacuaaugaggugcauacauggacagaacaauacaaauuccaggcggauaguccgaaaagauuagcgacugcaauagccggcgccugggaaaauggcguuugcgguaucagaucaacuacgcgcauggaaaaucuacuuuggaaacaaauagcuaaugaacuaaauuauauccuaugggaaaauaauauaaaacuuacgguuguagugggagauaucaucggaguacuugaacaagguaaacgaacucuaacaccgcaaccaauggaguuaaaauauagcuggaaaacauggggaaaagcuaaaauugucacagcagaaacgcaaaauaguaguuuuauaauagaugguccuaacacgccggaguguccuucaguaagccgugcuuggaaugugugggaaguugaggauuauggcuuugguguauuuacaacuaauauauggcuaaaauugagagagguuuacacgcagcuuugcgaucaucgacugaugucugcagcgguuaaagaugaacgcgcugugcaugcagauaugggcuacuggaucgaaucacaaaagaauggaaguuggaaacuagaaaaagccagcuuaauagagguaaaaaccuguaccuggccgaaaagucauacuuuauggaguaaugguguguuagagucggauaugauaaucccgaaaagccuggcaggaccaauuucacagcauaaccauagaccuggcuaccauacacaaacagcaggcccguggcaccuaggaaagcuagaauuagauuucaauuacugcgagggcaccacaguuguuauuacggagaacugcggaacacgaggaccuucauuaagaacuacuacuguaaguggaaaacuaauacacgaauggugcuguagaucuuguacguuaccaccacucagauauaugggcgaagacggaugcugguauggaauggaaauacggcccauaucggagaaagaggaaaauaugguaaagucuuugguaagcgcgggaaguggaaaaguugauaacuuuaccaugggcgugcugugucuagcuauccuuuucgaagaagugaugagggguaaauuuggcaagaaacauaugauagcaggcguauuuuucacauuuguacuacuauugucugggcaaauuacguggagagauauggcgcauacacugauaaugauuggcucgaacgccagugaucguauggggaugggaguaaccuaccuggcacuaauagcaaccuuuaagauacagcccuuucuugcauuaggauucuuccuacgaaaauuaacuucacgggagaaucuucuacucggaguaggacuugccauggcgacaacguugcaacuaccagaagauaucgaacaaauggcuaauggcauugcacuuggcuuaauggcauuaaagcucauuacacaauucgagaucuaucaacuuuggacagcauuaauuucauuaacgugcagcaauacaauauuuacucuaaccguugcauggagaaccgccacauugauccuugcuggaguaucauuacuacccaugugucaaucaaguuccaugcgaaagaccgacugguuacccauggcaguugcagcaaugggaguucccccuuuaccacuguuuauauuuuccuuaaaagauacguuaaaaaggagaaguuggccacuaaacgaaggagugauggcagugggccuuguaaguauauuggcaaguaguuuacuaagaaaugauguaccgauggcgggaccgcugguggcuggagguuuacugauugcuuguuacguaauaacuggcaccagugcugauuuaacgguagaaaaagccgcagacauaacuugggaagaagaagcagaacaaacaggaguaucacauaaccucaugauuacaguagacgacgaugggaccaugcgcauuaaagacgacgaaacagagaacauucuaacgguucugcugaaaacagcuuuguuaauuguuaguggaauauucccuuacucaauucccgcaacacuacucguuuggcauacuuggcagaagcaaacacaaagaucagguguccuaugggaugucccuaguccucccgaaacccagaaagcugaguuagaggagggagucuaccggaucaaacaacaggguaucuucggaaagacgcaaguaggcgucgguguucaaaaggaggguguguuucacacaauguggcauguaacaagaggugcaguccugacauacaauggaaaacgccuugaacccaacugggccucaguuaagaaagaucucauuucauacggugggggauggaggcuaaguacccaauggcagaaaggagaagaaguacaagucauugcaguagaaccgggcaaaaacccuaaaaacuuccaaacaaugccggggacguuccaaacaaccacuggagaaauuggugcuauagcacuagacuucaaaccaggaacaagcggaucuccuauaauaaaccgugaaggcaagguaguuggucuauauggaaauggaguuguaacuaaaaauggaggauaugugucaggaauagcccagacgaaugccgaaccagauggaccaacaccggaacuugaagaggaaauguuuaagaaaagaaacuuaacaauaauggauuugcacccaggaucuggaaagacaagaaaauaucuaccagcaauaguaagagaagcgaucaaaagacgacuucguacgcuuauauuggcuccgacgagaguuguagcugcagaaauggaagaagcgcuuaaaggacugccuauccgauaucaaacgacagcaacaaaaucggaacauacagguagagaaauaguagacuuaaugugucacgcaacauucacaaugcgccuguuaagcccaguuagaguaccuaacuauaauuuaauuauaauggacgaggcacacuuuacugaucccgcuucaauagcagcgaggggcuauauuucuacgagaguaggcaugggagaagcugcagcaauuuuuaugacugcaaccccgccaggaacggcugaugcauuuccacagagcaaugcuccuauacaagacgaagaaagagacaucccggagagaagcuggaauagugggaaugaguggaucacugauuuugcugguaaaacaguaugguuuguccccucaauuaaagcgggaaaugacauagccaacugccuaaggaaaaacgguaagaaaguuauucagcuaagcaggaagacauucgauacugaauaucaaaagacuaaauuaaacgacugggacuuuguaguaaccacggauauaagcgaaaugggcgccaacuucaaagcagauagaguuaucgauccccguagaugcuuaaaacccguuauucugacugauggcccagagagagucauacuugccgguccuaugccagugacugcggcaucagcugcacaaagaagagguagaguaggccgcaauccccaaaaggaaaacgaucaauauauuuuuaccggccaaccuuuaaauaaugaugaagaucaugcgcacuggacugaagcuaaaauguuacuggauaauauuaacacaccggaaggaauaauuccagcucuauuugaacccgaacgagaaaagucugcagcaauagauggggaauacagauugaaaggagaaagucguaaaacauucguugaauuaaugagaaggggagacuuacccguguggcuggcucauaaagucgcaagcgaaggaaucaaguacacugaccgaaagugguguuuugacggacaaagaaauaaucaaauacuagaagaaaacauggaugucgagauuuggacaaaggaaggagagaagaagaaacuaagaccgagaugguuagaugcuaggaccuacagcgauccauuagcucuuaaagaguucaaagaguucgcugcggguagaaaaucuaucgcacuagauuuaguaacagaaaucggaagggucccuucgcauuuagcucacagaacgagaaaugcauuggauaaccuugugaugcuacacacaucagaacacgguggcagagccuaucgccaugcaguagaagaauuacccgaaacaauggaaacauuauuacuguuaggacuaaugauacuccuuacaggaggugcaaugcuauuccuuauaagcggaaaaggaauaggaaaaaccaguauagggcucauaugcgugauugcuucgagugguauguuauggauggcugaaaucccuuugcaguggauagccucagccauuguauuggaguucuuuaugaugguacuacucaucccggagccagaaaagcagagaacgccccaagacaaccaacuggcauauguugucaucggaauuuuaacccuugccgcaauuauugcugcgaaugaaaugggguuguuggagacaacaaagagggauuugggaaugucaaaagaacccggaguaguuucgccuacaaguuauuuagacgucgacuuacauccugcgucagcauggacacucuaugcgguggcuacuacuguuauaacaccgauguuacgacacacaauagaaaacucaacagcaaauguuagccuugccgcaauagccaaucaggccguaguacucaugggacuggacaaagguuggccgauuucaaagauggacuuaggaguuccauuacuagcacuaggguguuacagccaaguaaauccgcugacacuuaccgcugcuguuuugcugcuuauaacucacuacgcuauaauagggcccgguuuacaagcgaaagcgacaagggaagcacagaaaagaacagcagccgggauuaugaaaaauccaacuguagacggaaucaugacaauugauuuggaccccgucauauaugauaguaaauuugaaaaacagcuuggucaaguuauguugcugguauuaugcguaguacaauuacucuuaaugagaacuucaugggcguuaugugaagcacuaacacuagccacagguccaauaacgaccuugugggaaggaagucccggaaaauuuuggaauaccacaauagcuguaagcauggcuaauauuuucagagguaguuacuuagcaggagcugguuuggcguuuucuauaaugaaaaguguagguacagggaagcgaggaacgggcagucagggugaaacacucggggagaaauggaagaagaaacuaaaucaguugaguaggaaggauuuugaccuuuacaagaaaucugguauaaccgagguugaccgaacggaggcuaaagagggacucaaacguggcgaaauaacacaccaugccgugucaagagguuccgccaaacuucagugguuuguugaaagaaauaugguuauaccugaggggcgaguaauagauuuaggauguggccggggaggcuggaguuacuauugcgcgggauuaaagaaaguaacggaaguacgugguuauacgaaaggaggacccggucacgaagaaccugucccuaugucaacguauggguggaauauagugaaacuaaugucgggaaaagacguauuuuacuugcccccagaaaaaugcgacacccuacuuugugacauuggagaaaguaguccgaguccaacggucgaagaaucuagaaccauaagagucuuaaaaaugguagaaccauggcucaaaaacaaucaauucugcauuaagguucugaacccauauaugccaaccguuauagagcacuuggaaaggcugcaacguaaacauggagggaugcuagugagaaauccauuaagccguaauucaacccaugaaauguauuggauaucuaacggcacgggaaauaucguugcaagcguuaauaugguaucaagacuucuauuaaaccgauuuacgaugacacaucgaaggccuacuauagagaaagauguugacuuaggagcaggcacccgacauguaaacgcggagccagaaacgccgaacauggaugucauuggggaaagaauuaaaagaauaaaggaagaacacaacucgacauggcacuacgaugaugaaaaucccuauaagacgugggcuuaucauggcaguuacgaaguuaaagccacgggaucggcgaguaguaugauuaauggagucguaaagcuguuaacaaaaccgugggacguuguaccaaugguuacccagauggcuaugacggacaccacuccuuuuggacaacaaaggguauuuaaagaaaaaguggauacgcgcacaccuagaaguaugcccggaacacguagagugauggguauaaccgccgaaugguuauggaggacacuugggcggaauaagaaaccucgacuauguacuagggaagaguucaccaagaaagugcgcacaaaugcagccaugggagccgucuuuaccgaagaaaaccagugggauucugcaaaggcugcaguagaagaugaggauuuuuggaaauuggucgaccgcgaacgagaacuacauaagcugggaaaauguggaagcugcguauacaauaugauggggaaaagagagaagaaacuuggagaauuugguaaggcgaaaggaucucgcgcaauaugguauaugugguugggggccagauaccuagaguucgaagcucuuggauuccuaaaugaagaccacugguucucaagagagaacucguauagugggguagaaggagaaggccuacacaaauuaggcuacaucuuacgagacaucagcaaaauacccggaggagcuauguaugcugaugauacggcggguugggauacccggaucacugaagaugaucuucacaacgaagaaaagauaacacaacagauggacccagaacaucggcaauuagcaaacgcaauauucaaacuuacauaccaaaacaagguaguaaagguacaacgcccgacaccaaccggaacggucauggauauaauuucgcgaaaagaccaacgcggauccgggcagguaggaacauaugggcuaaauacauucaccaacauggaggcacagcuuauaagacaaauggaaggugaagggguacuuaguaaggcagaucuugaaaacccacaucugccggaaaagaaaauuacacaauggcuagaaaccaaagguguagaacggcuaaaacgaauggcaauaagcggcgacgacuguguaguaaagccuaucgaugacagauuugccaacgcguuauuagcguuaaacgauauggguaaaguccguaaggacauuccccaauggcagccauccaaagguuggcacgacuggcagcaaguuccuuuuugcucacaucacuuccacgaauuaauaaugaaagacgggcgcaagcuaguuguacccugccgcccucaagacgaacuaauuggcagagcgcgaauaucacaaggagcaggauggucucucaaggaaacagcaugucuugguaaggcauaugcucaaauguggagccucauguauuuucacagacgagauuugcgauuagcaucgaaugcgauaugcagcgcaguuccuguccauuggguaccgaccucucggacuacuuggagcauacacgcucaucaccaguggaugacaaccgaggauaugcugacuguguggaacaggguguggauugaagauaacccuuggauggaagauaaaaccccgguuacaacaugggagaauguaccauaucuaggaaagcgggaggaccaaugguguggcucucuuauaggccuuacuucuagagccaccugggcacaaaauauucccacagcaauucaacaaguacggagucuaauaggaaacgaggaguuccuagacuauaugccaagcaugaagagguuuagaaaagaagaagaaagcgaaggcgcuauuugguag

SEQ ID NO: 23222 - RNA, 9873 nt, Artificial Sequence
  derived and/or modified CDS sequence (opt6) from DENV-3__JN093513__SS-prME
acaucucuauguuugaugaugauauuacccgcagcgcuagcuuuucauuuaaccucaagagacggugaaccaagaaugauaguaggcaaaaaugaacgcggaaaaagucuacuauuuaaaacagcauccggaauaaacauguguaccuuaauugcaauggaccugggagaaaugugugacgacacuguaaccuauaaaugcccacacauuaccgagguagagccagaagauauagauuguugguguaaucucaccucgacauggguaacauacgguacuuguaaucaagcuggagagcauagaagagauaaacgcaguguagcucuggccccacauguggguaugggauuagacaccagaacccaaacauggaugagugcugaaggagcauggagacaaguagagaaaguggaaacaugggcgcuaaggcacccgggauuuacgauucuugcuuuauuuuuagcucauuacauaggaaccucacuuacacaaaaaguaguaaucuuuauuuuacuaaugcuuguuacuccaucaaugacaaugcgcugcguaggaguuggaaaucgagacuucguagaagguuugucgggagcaacguggguagauguuguacuugaacauggcggauguguuacgacaauggcuaaaaauaaacccacuuuagauauagaacuacagaaaacagaggcuacgcaauuggcgacauugcgaaaacuaugcauagaagguaaaaucacaaauauaacgacagauuccagaugucccacacaaggcgaagcaacauugccagaggaacaagaucaaaauuauguuuguaaacauacuuacguagacagaggguggggcaacgguuguggauuauucgggaaaggauccuuaguaacuugugcuaaauuucaaugccuugaacccauagaggguaaaguaguucaacaugaaaauuuaaaauauacuguuauaauaacagugcauacaggagaucaacaccaagucggcaaugagacacaagguguaaccgccgaaaucacgccucaagccaguacuaccgaggcaauucuaccugaguauggaacgcuugggcuagaauguucuccacgaacaggucuagacuucaaugaaaugaucuuacuaacuaugaaaaauaaagcauggaugguacacagacaaugguucuuugauuuaccacugcccuggacauccggagccacgaccgaaacaccaacauggaauaggaaagaacuauuagucaccuuuaaaaaugcacaugcgaagaaacaagaagugguuguuuuaggcagccaagaaggugcaaugcauacugcauugaccggggcaacugagauccagaauagcggggguacuagcaucuuugcagggcacuugaaaugucggcugaaaauggacaaguuagaacuaaaaggcaugucuuaugcuauguguacuaauacauuuguauuaaagaaagagguaucagaaacucaacauggaacuauuuugauuaaaguagaguauaaaggugaggaugucccaugcaagauuccuuucagcacagaagauggucaaggcaaagcacacaacggaagguuaauaacggccaauccagugguaacaaagaaagaagaacccgucaauauugaagcugagccucccuucggugaauccaauauaguuaucggaauuggggacaacgcccuaaaaaucaauugguauaagaaaggaucuucaauuggcaaaauguuugaagcaacugcacguggagcaagacgcauggcaaucuuaggagacaccgcgugggauuucggaucggucggaggaguauuaaauucucuuggaaaaaugguccaucaaaucuuuggaagcgcauacacagcuuuauuuagcggagucucguggguaaugaaaaucgguauuggaguacuacuuaccuggaucggucuaaacaguaaaaacacaucgaugaguuuuucgugcauugccauuggaaucauaacauuauaucuuggugcgguuguacaagcggauaugggcugugucauaaauuggaaaggcaaagaacucaaaugcggaucuggcauauucguaacuaaugagguucauaccuggacagaacaguacaaguuucaggcagauucuccaaaaagauuagcuacggcgauagcaggcgccugggaaaaugggguaugugguauacguucaacgacccggauggagaaucuacucuggaaacaaauagcuaaugaacuaaacuacauacuaugggaaaauaauauuaaacuaacuguaguagucggggacauaauagggguacuagaacaaggaaaacgaacauugacgccacaaccaauggagcuuaaauacucauggaagacauggggaaaagcuaaaauuguuacagccgaaacccaaaauucgucauuuauaaucgauggaccaaauacacccgaauguccaucggugucacgagcuuggaaugucugggaggucgaagauuacggauuuggagucuuuacuaccaauauuuggcuuaaacuaagagaaguauacacacaacugugugaccacagacuaaugucggcugcgguaaaggacgagagagcaguacaugcagauauggguuacuggauugaaucacagaaaaauggcucauggaaguuggaaaaggccaguuuaaucgagguuaagacuuguacauggccuaagucgcauacucucuggaguaauggaguccuugaaagcgauaugaucaucccaaagucacuggcugguccaauaagccaacauaaccaucgucccgguuaucacacgcaaacagcaggaccauggcauuugggcaaacuagaacuagauuucaauuacugugaaggaaccacgguugugauaacugaaaauuguggaacacgaggaccaucucucagaacaacgacaguaaguggaaaauuaauccaugaauggugcuguaggagcugcacucucccuccguuaagguacaugggugaagacggguguugguauggaauggaaauucgacccaucagugaaaaggaagaaaauauggugaaaaguuuggugagcgcaggcagcggaaaaguagacaacuuuacaaugggcguacuauguuuagcaauucuauuugaagaaguaaugcgaggaaaauuuggcaagaaacacaugauagcagggguguucuuuacauuuguauuacuauuaaguggucaaaucacauggcgcgauauggcucauacacucaucaugauagguagcaacacauccgaccgaaugggaaugggcguaacauauuuggcauugauugcaaccuuuaaaauacaacccuuccuggcuuuaggauucuuuuuaaggaaguuaacuucacgagaaaaucuauugcuaggggugggcuuagcgauggcuacaacguugcaacuaccggaagauauagaacaaauggcaaacgguauagcauuagguuuaauggcacuuaaacuaauaacacaguucgaaauauaccaacuuuggacugcccuuauaucguuaaccuguucgaauacaauuuuuacucucacuguagcauggagaacagcgacacucaucuuagcgggcgucaguuuacuaccugucugucagaguucaucaaugagaaaaaccgauugguugccuauggcagucgcggcuauggggguaccuccgcuacccuuauucauauucgggcucaaagacacauugaaaaggagauccuggcccuugaaugaaggaguuauggcaguuggccuaguaagcauauuggcaucaucccugcugagaaacgacgugccaauggcagguccucuagucgcugguggacugcuaauugcauguuaugugauuacggggaccucugcagauuuaacuguggaaaaagcggcggauauuaccugggaggaggaagcggaacaaacuggaguuucucauaauuugaugauaaccguggacgacgaugguacaaugaggauuaaggaugaugaaaccgaaaacauucuuacagugcugcugaagacggcacuuuugauuguuaguggcauauucccauauucuauccccgccacacuccugguauggcacaccuggcagaaacaaacacaaaggaguggaguuuugugggaugugccaagcccacccgaaacgcaaaaagccgaauuagaagaaggagucuaucgaauaaagcaacaggguauauuugggaaaacucaaguuggcgucggaguacaaaaggaaggcgucuuccauacuauguggcacguaaccagaggagcuguucuaacauacaauggaaagagacuugaaccaaauugggcgucugucaagaaagauuugaucucauauggugguggguggagacucucugcacaguggcaaaaaggcgaagaggugcaagugaucgcaguggagcccggaaagaaccccaaaaauuuucaaacgaugccuggcaccuuucagaccacgacaggagagauuggggccauugcgcuagacuucaaaccuggcacgaguggaucaccaauaauaaauagggagggcaaagugguaggacuauauggaaauggcguaguuaccaaaaacggaggguacguaucggguauagcucaaacaaaugcagaaccagacggccccacaccagaacuagaagaagagauguucaagaaacguaacuugacaauuauggauuugcacccagggagcgguaaaacgaggaaauacuuacccgcuauagugagagaagccaucaaaaggagacuccggacacuaauauuagcuccuacacgugucguggccgcugaaauggaggaagcucuaaagggccuaccgauacguuaucaaacaacugcaaccaaauccgagcacacagguagagagauaguagaucuuaugugccaugcgacauucacaaugcguuuacugucacccgugagaguuccaaacuacaauuuaauaauuauggacgaggcacauuuuacggaucccgcuagcaucgcagcacgugguuauaucucaacacguguaggcaugggggaggcggcagcuaucuuuaugacagcaacaccuccuggaacagcugaugcauuuccccaaucuaaugcaccaauccaggacgaagagagagauauccccgagcguucguggaacuccgggaacgaguggauuaccgauuuugcagguaaaacaguuugguuuguaccuuccaucaaagcugguaaugacauugccaauugcuuaaggaaaaauggcaagaaagucauucaacugucaagaaagacuuuugauaccgaguaucagaaaacuaaacuaaacgauugggauuucguagucacuaccgauauaucagagaugggagcuaauuuuaaagcagaucgaguaauagauccacguagaugucuaaaaccgguaauuuuaaccgauggacccgagagggucauauuagcaggaccaaugcccguuacagcagcuucagcagcgcaaagacggggacgaguaggacgaaauccccagaaagagaaugaucaauauaucuucaccggacagccuuuaaacaaugaugaagaucacgcucauuggacugaagccaagauguuguuggauaauauaaauacaccggaggguauaauaccagcccuauuugagcccgaacgagaaaaaucagcagcuauagacggugaguaucggcucaaaggagaaucacgcaaaacauucguagaacucaugaggagaggugaucuacccgucuggcuggcucauaaaguagcaucugagggaauuaaauacacugacagaaaaugguguuuugauggccaaagaaauaaucaaauccuagaggagaacauggauguugaaauauggacgaaagaaggggaaaagaagaaauuacgaccgcguugguuagaugcucggaccuauucugacccuuuggccuuaaaggaauuuaaagaguucgccgccggaagaaaaucgauugcguuggaccuuguaacagagauaggaagaguuccuucacauuuagcccaucgaacccggaaugcacucgauaauuuaguaaugcuucauacaucagaacauggagggagagcguauagacacgcgguagaagaguuaccagaaacaauggaaacacuauuauuacucgggcuuaugauucucuuaaccgguggagccauguuauuuuuaauuagcggaaaagguauuggaaaaacgaguaucggauuaauaugcguaauugcuaguagcggaaugcuauggauggccgaaauaccacuacaauggauagcaucagcgauuguauuagaguucuuuaugaugguguugcuaaucccugagccggaaaaacaacgaacaccccaagacaaccaacuagcuuauguuguuauaggcauacuaacacuagcggcaauaauagcugcaaacgagauggggcuuuuggaaacuacgaaacgugauuuggggauguccaaagaaccagggguuguuaguccaacauccuaucuggaugucgauuuacacccugcuagcgcauggacuuuauaugcgguagccacgacagugauaacaccgaugcuaagacacaccauagaaaauucaacugcgaauguuaguuuagccgcaauugcaaaucaggcaguaguauuaaugggccuggacaagggguggccuaucucuaaaauggaucuagguguuccacuacucgcccuggguuguuauagccaaguaaauccacuuacacuaacagcggcgguucuucuacuaauaacgcauuaugcuauaaucgguccgggauuacaagcaaaagcaacacgggaagcucagaaacgaaccgcugcggguaucaugaaaaaucccacaguagauggaauuaugacaauugaucuagacccaguuauuuacgacuccaaauucgagaagcaacucgggcaagucauguuguuggugcuuugcgcaguccaauuauuauugaugaggacaucuugggcguuaugcgaagcacucacuuuagcuacggggccgaucacaacccuaugggaaggaucuccggggaaauucuggaauacgaccauagccguaucuauggcaaauaucuuuagggguagcuaccuagcaggcgcagggcucgcauuuagcauuaugaaaucuguggggaccggaaaaagggguacgggaucacagggcgaaacucuaggagaaaaguggaaaaagaaacuuaaucaacuuucgagaaaagacuuugauuuguacaagaaaucaggaauuacggaaguugaccggacugaagcgaaggaagggcugaaaagaggagagauaacgcaucaugcugugagccguggaagugcgaaguuacagugguucguugaaagaaauaugguuauaccggaggggagaguaauugauuuggggugcggcaggggcggcuggucauauuauugcgcuggacuuaagaaaguaacagaagucagaggauauacuaagggaggaccagggcacgaagaaccuguuccaaugagcaccuacggguggaauauuguaaaacuuauguccggaaaggauguguucuaccuuccgccagagaagugugauacacuacugugugauauaggagaauccucgccuagcccuacuguggaagaaucaagaacgauaagaguuuuaaaaaugguagagccauggcucaaaaauaaccaauucugcauaaaaguucuaaauccuuauaugccuacaguaaucgaacaucucgaaagacuacaaagaaaacaugguggcauguuagugaggaacccacuaagcagaaacaguacgcacgaaauguacuggauuucaaauggaacaggaaauauuguugcaucaguaaauaugguaucaaggcuauuauuaaacagguucacgaugacgcauaggcgaccuaccauagaaaaagauguugaccucggcgcuggaacaagacauguuaacgcugaaccggaaacaccaaacauggauguuauaggcgaaagaauaaaaaggaucaaagaggaacauaauucgaccuggcacuaugaugacgaaaacccauauaaaacuugggcauaucaugguucauaugaaguuaaagcuacaggcagcgcaaguucaaugauaaauggugucgugaaguuauuaacuaaaccuugggaugucguuccgaugguaacccagauggcgaugaccgauacaacgccauuuggacaacaaagaguauuuaaagaaaagguugacacucgcacaccgcgcucgaugcccggaacaagacgaguaaugggaaucacagcagaguggcuauggcgaacacuuggaagaaacaaaaagccucggcuauguacgcgggaagaguuuaccaagaaagucagaacaaacgccgcaaugggggcuguauuuacagaagaaaaucaaugggacagugcgaaagccgcagucgaagaugaagauuuuuggaaauuagucgauagagaaagagaacuacacaaauugggaaaauguggauccugcguauauaacaugauggggaaacgggaaaagaaacuaggugaauuuggaaaggccaaagguagucgagcuauaugguacauguggcuuggagcaagguacuuggaguuugaagcccuagguuuucuuaaugaagaucauugguucucaagagaaaacaguuacaguggaguugaaggugaaggguuacacaaauuaggauauaucuuaagagauauuucaaaaauccccggaggugcaauguacgcagaugacacagcgggcugggacacaagaauuaccgaggaugauuuacauaaugaagagaaaaucacacaacaaauggacccugaacaucgucaacuagcaaacgccauuuuuaagcuaacuuaucaaaacaaggucgugaaaguucaacgaccuacuccgacuggaaccgugauggauauaauaaguagaaaagaucaacguggaucgggccaagugggaacuuacgguuuaaauacuuuuacuaauauggaggcucagcugauaagacaaauggagggagaaggaguauuaucuaaagcagaucuggagaauccucauuuaccagagaagaaaaucacccaaugguuggaaacaaaaggcguugaacgcuuaaagagaauggcaauuucaggcgacgauugcguaguuaaaccuauugaugacagauuugcaaaugcucucuuggcuuuaaaugacaugggcaaagugagaaaagacauaccucaauggcagcccagcaaaggauggcacgauuggcagcaaguuccuuuuuguagucaucacuuucacgaacuaaucaugaaggauggcagaaagcuaguagucccuugcaggccacaagacgaauuaauuggcagagcuagaaucucacagggagccggauggucucuaaaagaaaccgccugucucgguaaagccuaugcucaaauguggucacuaauguacuuccauagaagagauuuacgguuagcgucaaacgcaauauguucggcaguaccaguccacuggguacccacgucgcgcaccacauggaguauacaugcucaccaccaauggaugacaacggaagauaugcuaacaguauggaaucguguguggauagaagauaauccguggauggaggauaaaacacccguuacaacaugggaaaauguaccuuaccuaggaaagagggaagaccaaugguguggaucucuuauugggcuuacgagcagggcaacgugggcacaaaacauuccaacggcaauacagcaaguuagaucuuugauaggaaaugaggaauuuuuagacuacaugccuuccaugaaaagguuccgaaaagaggaagaaagcgaaggagcaauaugguga

SEQ ID NO: 23223 - RNA, 9873 nt, Artificial Sequence
  derived and/or modified CDS sequence (opt6) from DENV-3__JF937624__SS-prME
acgaguuugugcuugaugaugauauuaccggcagcacuugcuuuucaccucacuucgagagauggugaaccaagaaugaucguuggcaaaaacgaacgcggaaaaucccuacuauuuaaaacagcgagcggaaucaauauguguacacucauagcaauggacuugggagaaaugugugacgauacgguuacuuacaaauguccucacauuacagaagucgagccggaagacauugacuguuggugcaaucuaacuucaacguggguuacuuacggaaccugcaaucaagccggugaacaucgucgagacaaacgcucuguggcuuuagcaccgcacguugggaugggguuagauacuagaacgcagacuuggaugucugcagagggggcauggcgccaagucgagaaaguggaaacaugggcuuuaagacacccaggauuuacuauccuugcauuauuucuggcacacuacauuggaacaucacuaacucagaaaguagugauuuuuauauuauuaauguugguuacgccuaguaugacgaugagaugcguuggcguagguaaucgggacuuuguugaaggacucucgggugcaaccuggguggauguaguucuugagcacggaggcugugucacuacuauggcuaaaaauaaaccuacgcuagauauagaacuacagaaaaccgaagcaacacagcuggcaaccuuaagaaaacucuguauugaaggaaaaauuacaaacauuacgacggauucaagaugcccuacacagggagaagcaacacucccggaagaacaagaccagaauuacgucuguaaacauacauauguagauaggggauggggcaacggcuguggccucuuugggaaaggaucauuaguaacuugugcaaaauuucaaugucuagaaccaauagaaggaaaagugguccaauacgaaaaccucaaauauacuguaauaauaacaguucauacaggcgaucaacaucaaguaggcaaugaaacgcaaggcguuacagcggaaauaacgccacaagcaucaaccacugaggcuauauuacccgaauaugguacauuagguuuagaaugcaguccaagaaccggauuggauuuuaacgaaaugauuuugcuaacuaugaaaaauaaagcauggaugguucacaggcagugguucuuugauuugccucuaccauggacaaguggcgcuacaaccgaaacuccgacauggaacagaaaagaacuacuugugacuuuuaaaaacgcccaugccaagaaacaggaagugguaguccuuggaagccaagagggcgcuaugcauacggcacuuacaggagcaacagagauucaaaacagcggugguacuucaauuuuugcaggccauuugaaauguaggcugaaaauggauaaacuugaauuaaaagggaugaguuaugcuauguguaccaauacguucguuuuaaagaaagaaguuucagaaacucaacacggaacaauacuaauuaaagucgaguauaaaggugaggauguaccuuguaaaauuccauuuaguacugaggauggucaagguaaagcacacaauggcagauugauuacagcaaauccggugguaacuaagaaagaagaaccuguuaauauagaagcagagccaccuuuuggugaaucaaauauaguaaucggaauaggcgauaacgcacuuaaaauaaauugguauaagaaagguucauccauaggcaaaauguuugaagcuacagcuagaggggcgcgcaggauggcaaucuuaggagacacugcaugggacuuugguucaguaggugggguauuaaauucccugggaaaaaugguacaucaaauauucgguagugcguacacagcguuauuuucggguguauccugggugaugaaaauaggaaucggaguauuacucaccuggauaggacuaaauagcaaaaacacaaguaugagcuucucaugcauagcgauaggcauaauaacuuuauaucuaggcgcagugguucaagccgauauggguugcgucauuaauuggaaaggaaaagaauuaaaaugcgggagcgguauauucguuacgaacgagguccacacuuggacugaacaauacaaauuucaagcggauuccccaaaaagacuagccacggcuauagccggagcuugggaaaaugguguuugcgguauucgaaguacuacacgaauggagaaccucuuauggaaacaaaucgcuaacgaauuaaauuauaucuuaugggaaaauaacauaaaauugaccguugugguuggagauauuauaggaguucuagaacaggggaaacgaacccucacgccacaaccaauggaacugaaauauaguuggaaaacauggggcaaagcaaaaauagugacagccgaaacccaaaacaguucuuuuauuauugacggaccgaauacgcccgaauguccgucgguaagcagagcguggaacguaugggaaguagaggauuauggauuugguguauucacuacuaauauuuggcuaaaauuacgagaaguuuauacacaauuaugugaccaucguuuaaugucugcugcgguaaaagacgaacgggcaguacaugcggauaugggauauuggauagaaagccagaaaaacgguucauggaaacucgaaaaagcaucacuaauagaaguaaaaacguguacauggcccaaaucgcacacauuauggucgaacggaguuuuggaaucagauaugauaauacccaagagcuuggcggggccuauuucacaacacaaccauagaccuggcuaccauacccaaacagccggaccuuggcacuuaggaaaacuugaauuggacuuuaacuauugcgagggaacgacagugguuaucacggaaaauugugguacuaggggaccgucucuacguacaacaacagugagcgggaaauuaauacacgaauggugcugcagaucgugcacuuuaccaccucuuagauacaugggagaagauggauguugguauggcauggaaauucggccuaucagcgaaaaagaggagaauauggugaaaucuuuagucucugcagguagcggaaaagucgauaauuuuacaauggguguacuuugcuuagcuauucuauuugaagaagucaugagggguaaauucggcaagaaacauaugauugcuggaguguuuuucacguucguacucuuacuguccggucagauaacauggagggacauggcccacacccuaauuaugaucggaucaaaugcaucugaccgaaugggcauggggguaacguaucuugcacuaauugcaacauucaaaauacagccguuccuggccuuaggauucuuuuugagaaaacuaacaucacgggagaaccuccuacuggguguaggacucgcgauggcuacgacguuacaacuaccagaagacauagaacagauggcaaacggaauugcacucggccucauggcgcuuaaacugauaacccaauucgagacauaccaacuauggacagcuuuaauaucucugacuuguucgaacacgaucuuuaccuugacuguggcuuggagaacagcaacccucauuuuagcggguguaaguuuauuaccaguuugucaaaguaguucaaugcguaaaacugauugguuacccauggcaguugccgccaugggcguaccaccauugcccuuauuuaucuuuggauuaaaagauacauuaaaaagaagaaguuggccuuuaaacgaaggagugauggcaguaggacucgucucgaucuuagcgucgagccucuuacgaaacgauguacccauggcuggaccuuuagucgccgguggauuauuaauagcauguuaugugaucacuggaacuuccgcagaccucacaguugagaaagcagccgauauaacgugggaagaagaggcggaacagacuggagugagccacaaucuaaugauaacugucgacgaugacggaacuaugagaaucaaagaugacgaaacagaaaauauauuaacuguauuacuuaagacggcguugcuaauuguaucggggauauucccguacucuauuccggcaacuuuauuaguuuggcauacauggcaaaagcaaacucagaggucaggaguacugugggaugucccuucaccaccggaaacccaaaaggcagaacuagaagaggggguauaccggauaaaacaacaaggaauauucggcaaaacucaaguaggaguuggcguucaaaaagaaggcgucuuucauacaauguggcacguaacacgaggggcaguacuuacuuauaacgguaaaagacuagagccgaauugggcaucggucaagaaagauuugauuucguacgguggaggauggagguuaagugcccaauggcaaaaaggagaagaaguucaaguaauugcaguagaaccagguaaaaauccuaaaaauuuccagacgaugcccgguacauuucaaacaaucacuggagagaucggcgcaauugcuuuagacuuuaaaccgggcacuuccgguucacccauaauuaauagagaagguaagguaguaggacuauacgguaauggaguuguaacuaaaaacgguggauauguaagcggaauagcccagacuaaugcugaacccgauggaccaacacccgaacuugaagaagaaauguucaagaaacgaaaucuuaccauaauggaucuucauccugguagugguaagacaagaaaauaccuaccugcgauugugcgagaagcuauaaagaggcgucuuaggaccuuaauacuggccccaacaagaguaguggcggcugaaauggaggaggcacuuaaaggccuccccauacgauaccagacuaccgcuaccaaaucugaacauacaggaagagagauaguggauuuaaugugucaugcuacuuucacaaugcgucugcugucuccaguuagaguuccuaacuacaacuuaauuauuauggacgaggcccacuucacagaucccgcaucgauagcagcaagaggauacaucuccacaagaguggguaugggggaagcagcugcaauuuuuaugacggcuacgccgccaggaacagccgacgcguuuccccaauccaacgcaccaauucaagacgaggagagggauauuccagaaagauccuggaacagcggaaacgaauggauuacagauuuugcaggaaaaacuguaugguuugucccgucuaucaaagcagguaacgacauagcuaacuguuuaaggaaaaacggcaagaaagugauccaacuaaguagaaaaacguuugacaccgaauaucagaaaacuaaacuaaaugauugggauuucguuguaacgacggauauaagugaaaugggagcgaauuuuaaggcugaucgagugauagauccacgucgaugucuuaagccaguaauuuuaaccgacgggcccgaacgagugauuuuagcugggccuaugccggugacagcagcaucagcagcgcaaagacggggcagaguagguagaaacccccaaaaagaaaacgaccaauauauauuuacagggcaaccauugaauaaugacgaagaucaugcacauuggaccgaagcgaaaaugcuauuagauaacaucaacaccccagaagggauaauaccagcauuauucgaacccgaacgugaaaaaucugccgccauagacggagaauauagauuaaaaggagaaagccgcaaaaccuucguagaauuaaugcgucgcggugauuuaccaguauggcucgcacauaagguugccucagaaggaauuaaauauacggauaggaaaugguguuuugacgggcaacguaauaaucaaauucuagaagagaauauggacguagaaaucuggacuaaagaaggagaaaagaagaaauuacggccucguuggcuagacgcgagaacauauagugacccauuggcccucaaagaauuuaaagaauuugcggcggggcgaaaaucgauugccuuagaccugguaaccgagauugggagagugccuucacauuuggcgcacaggacaagaaaugcacuagauaaccuugucauguuacauacaucagaacacgggggccgagcuuaucgucacgcaguggaagaacuaccugaaacuauggaaacuuuauuacucuugggacuaaugauacuccucaccgggggagcaauguuauuccucauauccggcaaggguauagguaaaacauccauaggauuaauuuguguaaucgcauccucagguaugcuauggauggcagaaauacccuuacaauggauagcgagcgcgaucguauuggaguucuuuaugaugguucuguuaaucccagaaccugagaaacagcgaacgccacaagauaaucaacuugcguacguuguaaucggaauccuaaccuuggccgccauaaucgcugcaaaugagaugggacuauuagaaacgacuaagagggacuuggggaugagcaaggaaccgggaguagugucaccgaccucguaucuagauguagacuugcacccagcauccgcauggacccuguaugcaguugccacgacagugauuacgccuauguuaaggcauacaauugaaaauaguacagcuaacgucucauuagcagccauugcgaaccaggcgguuguuuuaaugggauuggacaaggguuggccgauaucuaaaauggaccuaggaguuccccuuuuggccuuaggaugcuauucacaaguaaacccguuaacgcuaacagcggcaguacucuuacuaauuacccacuacgccauuaucgguccaggacugcaagcuaaagcuacaagagaagcacaaaagcgaaccgcugcaggcauaaugaaaaacccaacuguagacgguauaaugacaaucgaccuagacccuguaauauacgauuccaaguuugaaaaacaacuggggcaagugauguuauugguucuaugugcuguacaauuacugcucaugcgcacuucaugggcuuuaugugaagcccuaacacuggcaacaggaccaauuacgacacugugggaagguucucccgggaaauuuuggaauacgacaaucgcaguuuccauggcaaauauauuuagaggaagcuauuuggcaggcgccggacuugcguuuaguauuaugaaguccguagguacugguaaacgaggaacagggucucaaggggagacccucggugagaaguggaagaagaaauuaaaucaacucucaagaaaagauuuugaucuauacaagaaaagcgggaucacggaaguagaucgaacagaagcaaaagaaggacuaaaaagaggugaaauuacacaucacgcagucucaagaggcucggcaaaacuccaaugguuuguugaaaggaauaugguaauaccugaaggacguguaaucgaccugggauguggaagagggggcuggucauauuauugugcugguuuaaagaaaguuacugaagugcggggauauacaaaaggcgggccgggacacgaggaaccaguaccgaugucaaccuauggguggaauaucguuaaacuaaugaguggaaaggaugucuuuuaccugccaccugagaaaugcgacacgcuuuuaugcgauaucggugagucaagccccaguccgacagucgaagaaagcagaacaauacgcguucucaaaaugguugaaccuugguugaaaaacaaccaauuuugcauuaagguucugaacccauacaugccuaccguuauagaacauuuagagcgacuacaacgaaaacauggaggcaugcuaguucgaaacccacuaaguagaaacaguacacaugaaauguauuggauuucaaauggaacgggaaacaucguggcguccguuaacaugguaagucguuuacucuuaaaccgguucacgaugacgcauagaaggccuacgaucgagaaggauguagaucuaggagcaggaacaagacacguaaaugcagaacccgagacgccaaauauggauguuauaggagagcggauaaagaggauuaaagaagaacauaauucaacuuggcauuacgaugacgaaaauccuuacaagacuugggcauaucauggaucauacgagguuaaggcuacgggaucagccuccucuaugaucaauggaguaguaaaacucuuaacgaaaccaugggauguuguuccuaugguaacacaaauggcuaugacagauacgacaccuuucggccaacaacgaguguuuaaagagaagguagauacucguacgccacgaaguaugccagggacacgaagaauaauggggauaacugcagaguggcuguggaggacucuuggccgaaacaaaaagccucgucucuguaccagagaagaauuuaccaagaaaguuaggacuaaugcggcuaugggcgcugucuucacagaagaaaaccagugggacagcgcaaaagcagcggucgaagaugaagacuuuuggaaguuaguggaucgugaaagggaauuacauaaacugggaaaaugcgguucauguguauacaacaugaugggcaaaagggagaagaaacuaggugaguuuggaaaagcaaaggggagcagagcgauaugguauauguggcucggagcacgauauuuagaauuugaagcacuaggauuuuuaaaugaagaucacugguucucaagagaaaauucauauucgggaguagagggagaaggguuacauaaguuaggcuacauuuuaagggauauuucuaaaauucccgguggugcuauguaugcugaugauacggcugguugggauacacggaucacggaagaugacuuacauaacgaagagaaaauuacccagcaaauggaucccgaacaccgucaauuagcuaacgccauuuucaaauuaacauaucagaauaaaguugugaaaguacaaagaccgacgcccacggguacaguaauggacauuaucucuaggaaggaucagagaggaucaggacaaguagggacauauggacuaaauaccuucacaaauauggaagcgcaauuaaucagacaaauggaaggagaaggaguccuuagcaaggcagauuuagaaaacccacacuuaccggagaagaaaauuacucaauggcuugagaccaaaggaguugaacgcuugaaacguauggcaauuaguggagacgauuguguaguaaaaccgauagaugaucgauucgccaacgcccuauuagcgcuuaaugauaugggaaaaguaagaaaggauauuccacaauggcaaccaucgaagggguggcacgauuggcagcaaguuccuuucuguucacaucacuuccacgagcuaauaaugaaagacggcaggaagcuaguugugccaugucggccgcaagacgaauuaauaggccgagcaagaauaucccagggagcuggauggaguuugaaggagacugccugccugggaaaagcguaugcacaaauguggucgcuaauguauuuccauaggcgugauuuacgucucgcaagcaaugccauauguagcgcuguaccgguacauugggucccaacaaguaggacaaccuggucaauacaugcacaucaccaauggaugacuacugaagacaugcugacgguauggaauagaguguggauagaagauaaucccuggauggaagauaaaacaccuguaaccacgugggaaaaugucccuuacuuagguaaacgcgaagaucaaugguguggcaguuuaaucggucuaacaucaagagccacaugggcucaaaauauaccaacugccauacaacaaguaagauccuuaauagguaacgaagaguucuuagauuacaugccuagcaugaaacgguuuagaaaagaagaagagagugaaggagcaauuugguaa

SEQ ID NO: 23224 - RNA, 9873 nt, Artificial Sequence
  derived and/or modified CDS sequence (opt6) from DENV-3__JN000938__SS-prME
acaucacuaugccuaaugaugaucuuaccagcggcacuggccuuccauuugacaucacgggacggagaaccccggaugauugucggcaaaaaugaaagaggaaaaagucugcuguuuaaaacugcuaguggaauaaacauguguacucuaaucgcaauggaucugggagaaaugugcgacgauacuguaacauauaaauguccucauauaacugaagucgaaccugaagacauugacugcuggugcaaucuaacuuccacgugggugacauacgguaccuguaaucaggcaggagaacauaggcgugauaaaaggucaguggcacuugcaccacauguuggaauggguuuagauacuagaacucaaacuuggauguccgcugaaggggcauggagacaaguagaaaaaguggaaacuugggcguuaagacacccggguuucaccauuuuggcguuauuccuugcacauuacauagguacaucuuugacccaaaaaguugucauuuucauucuauuaaugcuaguaaccccaucgaugacaaugagaugugucggaguaggaaacagagauuucgucgaaggucuuucaggggcgacauggguagacgugguucuagaacacggcggaugugugaccaccauggcuaaaaacaaaccuacacuagauauugaacuucagaaaacagaggcuacacaguuagcuacccuacggaaacucugcauagagggaaaaauaacuaauaucacaacagauagucgguguccaacacagggcgaggcaacacuaccagaagaacaagaucaaaauuacguuugcaagcauacuuauguagauagaggauggggaaauggcuguggauuauuuggaaaagguaguuuaguuacgugugcaaaauuucagugucuagaaccuauugaagggaaaguuguucaauacgagaacuuaaaauauacgguuauuauaacuguucacacuggagaucaacaucagguaggaaacgaaacgcaagguguaaccgcugaaauuacgccccaggcaaguacaacagaggcuauuuuaccugaauauggaacucuuggauuagaguguucgccuagaacuggcuuggacuuuaacgaaaugauccuuuuaacaaugaagaacaaagccuggaugguacaucgucaaugguucuuugauuugccuuugccauggacuucaggggccacuacagaaacaccuacauggaaucgaaaggagcuauuaguaacauucaaaaaugcacacgccaagaaacaagaagucguaguacuaggaucgcaggaaggagccaugcauaccgcauugaccggcgcgacagaaauacaaaacucgggaggaacaaguauuuucgcagggcauuugaaguguaggcuaaaaauggauaaauuggaacuaaagggaaugucauaugcaauguguacaaauacauuuguauuaaagaaagaagugagcgaaacucaacauggaacuauacugauuaaaguggaauacaaaggugaagacguacccugcaaaauuccuuuuagcaccgaagacggacaaggaaaagcucauaacggacgacuaaucacagcuaauccgguugugacuaagaaagaagaaccaguuaacaucgaagcugagccaccuuucggcgaaucuaacauuguuaucgggauaggagacaaugcuuuaaaaauaaauugguauaagaaaggaagcuccaucgguaaaauguuugaggcuacagcucgcggagcucguagaauggcaauacuaggcgacacagcaugggauuucggaucaguaggggguguauugaacucguugggaaaaaugguccaccagauauuuggaucggccuacacagcacuuuucucuggggucaguuggguaaugaaaauaggaaucggcguucuauugaccuggauaggacuuaacucuaaaaauacaucaaugucauuuuccuguauugcgauaggaauaauaacucuauauuugggagcgguagugcaggcagauaugggguguguaauaaauuggaaaggcaaagaauugaaaugugguagugguauauucguaacaaacgaaguccacacguggacagaacaguauaaauuucaagcagauucgccgaaaagauuagcaacugcuauugccggagcuugggaaaauggcguauguggaauuagaucuacaacgcgaauggaaaauuuauuauggaaacaaauagccaaugaacucaacuauauauuaugggaaaacaauauaaaauugacaguugugguaggugacauaaucggggugcuugagcaaggaaaacgaacccuaacuccccagccaauggaauuaaaauacucauggaaaacaugggguaaagccaaaaucgucacugcagaaacucaaaacagcuccuuuaucaucgacggaccaaacaccccugaaugcccgaguguaagucgagcuuggaauguaugggaaguugaagacuauggauucgggguauuuacuacuaauauaugguuaaaacuacgagaaguuuauacccagcuaugugaucaccguuugaugagcgcagccguuaaagaugagagagcaguacacgcugauaugggauacuggauagaaucgcagaaaaauggaucauggaaacucgagaaagcgucucuaaucgaaguaaagaccuguacuuggccuaaaucacacacguuauggagcaacgguguucuagagagugauaugauaauuccaaaaucacuagcagggccuauuagccaacauaaccaucgcccagguuaucauacucaaacagcagggccuuggcaccucggaaaguuggaacucgauuucaauuauugugagggaacaacagugguuauaacggaaaauugcgguacgcgagguccaucauugcgaacaaccacaguuuccgggaaauuaauacaugaguggugcugccgcaguuguacacuuccaccauugagauacaugggagaagacggcuguugguauggaauggagauccgaccauuuagugagaaagaagaaaacauggugaaaucauuaguaucggccgguggaggaaaaguagauaacuucacuauggggguguuaugcuuagcaauacuuuucgaagaaguuaugagggggaaguucgggaagaaacauaugauagcgggagucuucuuuacuuuuguauuauuacuaucuggucaaauaacguggcgagauauggcacacacuuuaaucaugauagguucgaacgcaagugaucgaauggguaugggaguaacuuacuuggcucuuauugcaacauucaagauucagccguucuuagccuuaggguuuuucuugcgaaaauugacuagccgcgagaauuuauuauuaggaguaggucuagcaauggcgacgacucuccaacucccagaggacauugaacaaauggcgaauggaaucgcguuaggucugauggcuuugaaacuaaucacccaauucgagacauaccaauuauggacggcucuaauuucacucaccuguuccaauacgaucuucacacuaacgguagcauggcggacagcgacacugauacuagcuggugugucccuucuaccagugugccaaucgucaucaaugaggaaaacagacuggcuuccaauggccguggccgcuaugggugugccaccacuccccuuguuuauauuuggguugaaagacacauuaaaacgucguucuuggccucuaaaugaaggcgucauggcuguagggcuuguaagcauucuggcgucgucacuucuucgaaaugacguuccaauggccggaccccuaguagccggagggcuuuuaaucgcuuguuacguuaucacagggacgagcgccgaccucacaguugaaaaagccgcagauauaacuugggaggaagaagcagagcaaacagggguaagucacaaucuuaugauaacaguugacgaugacggaacaaugcgaauaaaagaugaugagacugaaaauauauuaacaguauuauuaaaaacggcucuacuuaucguaucagggauuuuuccauauagcaucccagcgacucuauuaguauggcauaccuggcaaaagcaaacacaaagaagcggaguauugugggauguuccuagcccaccagaaacacaaaaggcggagcuggaagaaggaguuuacagaauaaaacaacaaggcauuuucggcaaaacccaaguggguguuggaguucaaaaagagggaguauuucauaccauguggcaugucacaagaggagcugugcugacauacaacggaaagagacuugaacccaauugggccagugucaagaaagauuuaaucaguuacgguggggguuggagguuaagugcucaguggcagaaaggagaagagguucagguaauagcuguagaaccggggaagaauccgaaaaacuuccaaacuaugccaggaaccuuccaaacaacgacuggugagauaggggcgaucgcucuugacuucaagccagguacuucggguucucccauaauaaaccgcgagggaaagguuguggggcuguauggaaauggugucguaaccaaaaaugguggauauguuaguggcaucgcucagaccaaugcagaaccagacgggcccacaccagaguuagaggaagaaauguucaaaaagagaaaucuaacgauuauggauuugcacccaggcagcggcaagaccagaaaguaccugccagcaauuguaagagaagccauaaagagaagauuacgaacucuaauucuugccccuacgagaguaguagcagccgaaauggaggaagcacucaaaggucucccgauucgauaccaaacgaccgcaacaaaaucggaacacacuggaagagaaauaguugaccuuaugugucacgcgacuuucacuaugagacucuugucgcccgucagaguacccaauuauaaccuaauaaucauggaugaagcgcauuuuaccgaucccgcgucaaucgcugcccgggguuauauauccacaagaguuggcaugggggaagcagcagccaucuucaugacagcaacuccacccggaacagccgacgcauuuccacaaucaaacgcacccauccaagaugaggaaagagauauuccugaaagaucguggaacuccggaaaugaauggaucacagauuucgcggguaaaacugugugguucguucccagcauaaaggcgggaaaugauaucgcuaauugccuacguaaaaaugguaagaaaguuauacaauuaucaagaaaaacguuugauacagaauaccagaagacaaaauuaaaugauugggauuuuguaguuacaacagauaucagugaaaugggggcaaauuuuaaagccgaccgggucauugaucccagacguugcuuaaaacccgugauuuugacggauggcccagaaagaguuauccuugcaggaccaaugcccgugacagcggccuccgcugcucaaagacguggcagagugggaagaaacccacagaaagagaacgaccaguacaucuuuaccggacaaccacuaaauaaugacgaagaucacgcucacuggaccgaagcaaaaauguuguuagacaacauuaacacaccagaagguauuauacccgcccuuuuugaaccagaaagagaaaaaucagcagccaucgauggugaguaucgcuuaaaaggugagucucggaaaacauucgucgaauuaaugcguagaggugauuuacccgucuggcuagcucacaagguugcuucagaagguauuaaauauaccgaucgaaaaugguguuucgauggccagagaaacaaccagauucuagaggaaaauauggauguugaaauauggacaaaggaaggcgagaaaaagaaacucagaccacgauggcucgaugcgagaacguauucugauccuuuagcauuaaaagaauuuaaagaauuugcugcuggucggaaaucaauagcguuagaucuagugacugaaauaggacgaguaccaucacacuuagcgcauagaacacgaaaugcccuagauaauuuaguuaugcuacauacuucugaacacgguggacgagcauaucgccaugccguggaggaacuuccagaaacaauggaaacacuccuucuucugggacucaugauauuacuaacgggaggagcuaugcuuuuucugauaucagggaaagggauagguaagacuucuauaggucuaauauguguaauagcuagcucaggcaugcuuuggauggcugaaauacccuuacaauggauugcaucagcaaucguacuagaguucuuuaugaugguacuccucauuccggaaccagaaaaacagagaaccccacaagacaaucaacuagcuuauguagugauaggcauuuuaacauuggcggcaauaauagcugcuaaugaaaugggacuauuagaaacaaccaaaagagauuuaggaaugaguaaggaaccaggaguaguguccccaaccucguaccucgauguagacuuacacccugcaucagcauggacauuauacgcaguagcuaccacaguaauuacaccaauguuacgacauacaauagaaaacucaacugccaacguaagccuggcugccauugccaaccaagcagucguauugaugggauuggacaaaggauggccaauaucaaaaauggaccuaggagucccacugcuugcccuuggauguuauagucaagucaauccacugacuuugacggccgccguacuacuauuaauuacacauuacgccauaauuggaccaggacuucaggcuaaggcuacaagggaagcucagaaaagaacagccgcaggaauaaugaaaaaucccacgguugacgguauaaugacgauagaucucgaccccguaauauacgacaguaaauucgaaaaacaacugggucagguuaugcuuuuaguauuaugcgccguucaauuauuauugaugagaacaaguugggcguuaugugaagcccuuacacuagccacaggcccaauaacaacucuaugggaagguagcccaggaaaauuuuggaacacaacuauagcagucuccauggcaaauauauucagggguucauaucuagcuggagcaggauuagcauucuccauuaugaaaagugucgguacagggaaacgaggaaccgguucucaaggggaaacccugggcgaaaaguggaagaagaaacuaaaccaacuuucuagaaaagauuucgacuuauauaagaaaagugguaucacagaaguagauaggacggaagcgaaagaaggguuaaaaagaggugaaauaacccaccaugcuguauccagaggauccgcgaaauuacagugguuugucgagcgcaauaugguaauaccggaagguagaguuauagaccucggauguggucgagguggauggagcuauuauugugcuggacucaagaaaguaacugaaguccguggauacacgaaagggggaccgggacacgaggagccuguaccuauguccacuuauggauggaauauuguaaaacuuaugucugggaaagauguauucuaccucccuccagaaaaaugugauacucugcucugcgauauuggagagagcagcccuucgccaacuguggaagaaucgagaacaauaagaguucuuaaaaugguugaaccuuggcuuaaaaacaaccaguuuugcauaaaaguucucaauccguacaugccaacuguaauagaacaccuugaacgucuucaacggaaacaugguggaaugcuuguacgaaacccucuaagucguaacucaacucaugagauguacuggaucagcaauggaacuggcaauaucguugcaagcgugaacaugguaucuagauuauuacucaauagauuuacgaugacacaccgaagacccacaauagaaaaagauguagaucugggagcaggaaccagacacguaaaugcagaaccagaaaccccaaacauggaugugauuggcgagagaauaaaaagaauuaaagaagaacauaauucaacauggcacuaugaugaugaaaauccguacaaaacuugggcuuaccacggauccuacgaagucaaagcgacuggaagcgccagcucaaugauuaauggaguaguaaaguuacuaacuaagccaugggauguaguuccaaugguaacucaaauggccaugacagauacaacaccuuuuggccaacaacggguauucaaagaaaaaguagauacuagaacuccacgaucaaugccugguacacguagagucauggggauaacggcagaguggcuguggcgcacucucgguagaaauaagaaaccuagacuauguaccagagaggaauuuacuaagaaaguacgaaccaacgccgcaaugggcgcaguguucacugaagagaaccagugggauuccgcaaaagcagcagucgaagaugaagauuucuggaagcuagucgauagggaacgagaacuucauaaacuagggaaaugcggaaguugcguauauaauaugaugggaaaaagggagaagaaauugggagaauuugggaaggcuaaaggaagucgugccaucugguauauguggcuuggggcaagauaucuagaguucgaagcucuagguuucuuaaaugaggaucauugguucuccagagaaaauaguuacucaggaguugaaggcgaaggguuacauaaacuuggcuacauuuuacgagacauaaguaagauucccggcggagcuauguacgccgaugacacagcggggugggacacccggauaacugaagacgaucuacauaacgaagagaaaauuacccaacaaauggaucccgagcaucgacaauuagcaaaugcaauauuuaaauuaacguaucagaacaaagucgugaaaguacaaagaccaacuccaacugggacugugauggacauuauuucuagaaaagaucaaagagguaguggucaaguagguacguacgguuuaaauacauucacaaacauggaggcucaauugauacgacaaauggaaggugaaggugucuugucgaaggcagauuuagaaaauccacacuuaccggagaagaaaauaacucaaugguuagaaacaaagggaguugaaagacuuaagaggauggcgauaaguggugaugacugugucgugaaaccaauugaugaccgauuugcgaaugcucuacuugcacugaaugacaugggcaaaguuagaaaagauauuccacaauggcaaccaucgaaagguuggcacgacuggcaacaaguuccuuuuuguucccaucacuuucaugaacuuaucaugaaggauggacgaaagcuaguaguaccuuguaggccucaagaugagcuuauaggcagagcccguauaagucaaggugcgggcuggucuuuaaaagaaacagcuugucuaggaaaagccuaugcucaaauguggucucuaauguauuuccaccgaagggauuuacgucuagccaguaaugccauuuguucagcagugccaguccacuggguccccacaucaagaacaacuuggagcauucacgcacaccaucaauggaugaccaccgaagauaugcuaacugucuggaaucgagucuggauagaagacaauccauggauggaagacaaaacaccagugaccacaugggaaaauguacccuaccuuggaaaacgugaggaucaauggugugguucauugaucggauuaacaucucgagcuacaugggcacagaauauuccaacugcgauccagcaaguccgaaguuuaauuggaaaugaagaguuccucgauuauaugccuucaaugaaacgcuuucgcaaagaagaggaaucagaaggugcaauaugguaa

SEQ ID NO: 23225 - RNA, 9873 nt, Artificial Sequence
  derived and/or modified CDS sequence (opt6) from DENV-3__JN093515__SS-prME
acuucuuuauguuugaugaugauauuaccagcugcauuagcauuccacuuaacgucuagggauggggaaccgcgcaugauaguggggaaaaaugaacgagggaaaucuuugcucuuuaaaacugcuucaggaauuaacaugugcacauuaauagcaauggaccugggagaaaugugugaugauaccguuaccuauaaauguccgcauauaacggaaguagagccagaggauauugacuguuggugcaauuugacaucuacuuggguuacguacgguaccugcaaucaagccggugaacaccggagagauaaacgaaguguugcauuagcaccgcacguaggaaugggauuggauacacgaacucaaacauggaugagcgcagaaggagcauggagacaaguagagaaaguugaaacaugggcucucaggcaucccggauucacaauucuugcacuuuucuuagcacacuacauaggaacgagccuaacgcaaaaaguuguaauauuuauacuacugaugcuugucacgccuucaaugacuaugagaugugucgguguaggcaauagggacuuuguggaagggcucucaggugcaacauggguagauguggucuuggagcauggcggcuguguaaccacuauggcgaaaaauaaacccaccuuagauaucgaauuacagaaaacagaggcuacgcaacuagccacacucaggaaauugugcauagaaggaaaaaucacgaacauuacuaccgauagucguugcccaacucaaggagaggcuacucuuccugaagaacaggaucaaaauuacguauguaaacauacuuacguagacaggggcuggggaaauggauguggauuauuugggaagggaucacuuguaacaugcgcaaaauuucaaugcuuagaaccaauagaagguaaaguuguucaacaugaaaaucucaaauauaccgucaucauuacaguucacacaggggaucaacaucaaguaggaaaugagacacaaggggucacagcugaaauaacgccccaggcuagcacaacagaagcaauacucccagaauaugguacguugggguuagaaugcucgccucgaaccggauuagauuuuaacgaaaugauccuacuaaccaugaaaaauaaagcguggauggugcauagacaaugguucuucgaccuaccacuucccuggacaagcggggcgacaaccgaaacucccacauggaaucgaaaagagcugcuggugacauucaagaacgcacaugcuaagaaacaagaaguugucguacuagguagucaggaaggagcaaugcauacagcccugacaggagcaacugagauccaaaacucaggagggacaaguauuuucgccgggcacuuaaaguguagauuaaaaauggauaaacuagaauuaaaggggaugaguuacgccaugugcaccaauaccuuuguucuaaagaaggaagugagcgaaacgcaacacggcacaauccugauuaaaguugaauacaagggcgaggacguacccuguaaaaucccauucaguacggaagauggacaaggcaaggcacacaacggccgccugauaaccgccaaucccguugucacaaaacgagaagaaccaguaaauauagaggcagaaccuccauuuggagaaucgaacaucgucauagguaucggcgauaaugcucucaaaauaaacugguauaagaaagguucguccauugguaagauguucgaagcuaccgcaaggggagcccgcagaauggccauauuaggcgacacggccugggauuucgggucaguagggggaguacuaaauucgcuugguaaaaugguacaccagauuuucggcucugcauauacggcacuguucaguggcgucucuugggucaugaagauagguauaggaguccuauuaacuuggaucgguuuaaauaguaaaaacacaagcaugucauuuuccuguauugcuaucggaauuaucaccuuguaucucggagcaguaguucaagcagacauggguuguguaaucaacuggaaggguaaagaguuaaaaugugggagugguauuuuuguaacaaaugaaguacacaccuggacugaacaauauaaauuccaagcagauucuccgaaaaggcuagcuacugcaauugccggugcaugggagaauggcgugugcggaauaagaucgacuacaagaauggaaaaucuucuguggaagcaaaucgcaaacgaauuaaacuauauuuuaugggaaaauaauauuaaauuaacuguagucguuggugacauaauaggugugcucgagcagggaaaacguacuuugacaccgcaaccaauggaauuaaaauauucguggaaaaccuggggcaaagcgaaaauaguaacagcagaaacgcaaaauagcaguuuuauuauagacggucccaauacuccagaaugccccucaguuucgcgagcguggaacguuugggagguagaagacuauggauucggcgucuuuacaacgaauauaugguuaaaauuacgugaaguauacacucaacuuugcgaccaucgacucaugagcgcagcgguaaaagacgaaagagcagugcacgcugauaugggguauuggauugaaucucagaaaaacgggucuuggaaacuggagaaagcaucauuaauagagguaaaaaccugcacauggccgaaaagucauaccuuauggucaaauggcguucuagagucagauaugauaauaccaaagagcuuagcaggacccaucucucaacauaaucacaggccggguuaccacacacaaacagccggacccuggcaucucggcaaacuagagcuagauuuuaauuacugugaaggcacuacggucgugauaaccgaaaacugugguacuagagguccaaguuuaaggacaacaacuguuagcgguaaacuuauacaugaaugguguugccggaguuguacccucccaccgcuuagauauaugggcgaggacggauguugguacggaauggagauccggcccauaucagaaaaagaagaaaauauggucaaaucacuuguaagcgccggcucaggaaaaguugauaacuuuacuauggguguauuaugucuagcaauacuauuugaggaaguaaugagaggaaaauucggcaagaaacauaugauagccgguguauuuuucaccuuuguauuguugcuaucaggacaaauuacuuggcgcgacauggcucauacuuugauaaugaucgguuccaaugcgucagacagaauggggauggguguuacuuaucuagcacugauugccacauuuaagauccagccauuccuggcucucggauucuuucuaagaaaacuaacuucuagggagaaccugcuauuagguguaggacuggccauggcuacuacacuucaacuaccggaagauauagagcaaauggcgaacggaauugcgcuaggccuaauggcauuaaaauuaaucacacaauuugaaauauaucaauuauggacugcucuaauuucauuaaccuguucaaauacaauuuuuacacuaacaguugcauggcguacugcuacacuaauauuggcagggguaagccuccuaccaaugugucagucaagcaguaugagaaagacagacuggcuucccauggcuguugcagccaugggaguaccuccucugccgcuuuucauauucucauuaaaagacacauuaaaaagacggagcuggccauuaaaugaagggguuauggcggucggucuaguaaguauuuuagccucgaguuuacuacguaaugauguaccuauggccggaccccuaguagcuggaggacuacucauagcuuguuacguaauuacugggacgagcgcugaucugacaguugaaaaagcugccgacauaacaugggaagaagaggcagaacagacaggagucucgcacaaucucaugauuaccguagaugacgaugggacaaugaggauuaaggacgacgagacggaaaauauauuaacgguauugcuuaaaaccgcacuacuaauuguaagcgggauauuuccauacucaauaccagcaacauuguuaguuuggcauacauggcagaaacagacccaacgaaguggcgugcuuugggaugucccuucuccuccggagacacaaaaagcggaauuagaagaagggguuuauagaauuaagcaacaaggaauuuucggaaaaacacaagugggcguaggagugcaaaaagagggcguuuuccacacuauguggcauguuacaaggggagcgguacuaaccuacaacggaaaaaggcucgagccgaauugggcgucagugaaaaaggacuuaauaucauauggaggaggauggagacuauccgcacaauggcaaaagggugaagagguccagguuauugcaguagaaccaggcaaaaauccaaagaacuuucaaacgaugccagguaccuuucaaaccacaacgggggaaauuggcgcgauugcacuagacuuuaaacccggaaccucuggaucaccaauuauaaaucgcgagggaaaaguugucggauuauaugggaauggagucguaacuaaaaauggcggauacgugucagguauagcccagaccaaugccgaacccgacggaccaacaccagaacuagaagaagagauguucaagaaacguaaucuuacgauuauggacuuacaccccggcagcggcaagacaagaaaauaucuaccugcaauugugagggaagcaauaaaacgacgauuaagaacucuaauacucgccccaacaaggguaguugcggccgaaauggaagaagcgcuaaaaggauuaccaauucgguaccaaacaacagcuacuaaaucggaacauacuggaagagaaauaguagaucuaaugugucacgcuaccuuuacaaugagacugcuuucucccguuagaguaccgaacuacaauuuaauuauaauggacgaagcgcacuucacagaccccgccagcauagcagcaagaggcuauaucucaacaaggguagguaugggagaagcagcugccauuuucaugaccgcaacgccacccgguacagcggaugcuuuuccacagagcaaugcaccaauucaggacgaagaacgagacauaccggaaagaaguuggaauagcggaaaugaauggauuacagacuucgcagggaagacgguuugguuugugccuaguauaaaagcuggaaaugauauugcgaacuguuuaaggaaaaaugguaaaaagguuauacaauugucaagaaagaccuucgauacagaauaucaaaagacaaaacugaaugauugggauuuuguaguuaccacugacauaagugaaaugggugcuaacuucaaagcugauagagucauagauccgcgacgcugucucaaacccgucauuuuaacugacgguccggaacgaguaauacuggcaggaccaaugccugucacagcagccucugcagcucaaagaagaggaaggguaggaagaaauccucagaaagaaaacgaucaauauauauucacaggccaaccgcuaaacaacgaugaagaucacgcccacuggacugaagcaaaaaugcuacuagauaauauuaauacaccugagggcaucauaccugcauuguuugaaccagagcgggagaaaagugccgcgauagacggugaauauagauuaaaaggagaaaguagaaaaacauucguagaacuaaugagacgaggagacuuaccgguauggcucgcucauaagguagcaucggaggguauuaaguauacggaccggaaguggugcuucgauggacaacggaauaaucagauucuugaagaaaacauggauguagagauauggacuaaagaaggugagaaaaagaaacucaggccccguugguuagaugcacgaaccuacuccgauccacuagcuuuaaaagaauuuaaagaguucgcggcaggccgaaaaaguauugcucuugaucuugucacagaaauuggucggguaccuucucaccuagcccauagaacaagaaaugcguuggauaaucuggucaugcuacacacaagugaacauggagguagagcuuacaggcaugcuguggaagaauugccggaaacgauggaaaccuuguugcugcugggauuaaugaucuuacuuacagguggugccauguuauuucuuauaaguggcaaagguauagggaaaacuuccauugguuugauaugcguuauagccucaucagguauguuauggauggcagaaauaccuuugcaauggauagcaucggccauaguccuagaguucuuuaugauggugcuacuuauuccggaaccugagaaacaacguacuccccaagauaaucaacuagcauauguagucaucggaauccugacauuagcugcaauaaucgcggccaaugaaaugggauuacuugaaacaacaaaacgagauuuaggaaugucuaaagaaccgggaguaguuagucccacaaguuaccuugauguagaucuacacccugcuucggcauggacccucuacgcuguggcgaccacaguaaucaccccuaugcuaagacauaccauagaaaacucaaccgccaauguuucguuggcagcuauugcuaaucaagcuguagugcugaugggguuagacaagggcuggccaauuaguaagauggacuuaggggucccuuugcuagcauuggggugcuacucacaagugaauccccuaacauugacagcggcgguauuauugcuaauuacacauuacgcuaucauuggcccaggacuccaggcaaaagcaacgcgagaggcucagaaaaggacagcagcggguauaaugaaaaauccaacuguggauggaauaaugaccauugaucuggacccaguaauuuacgacuccaaauuugaaaaacaguugggacaaguaaugcugcuuguucuuugcguuguucaauuacuauuaaugagaacaucaugggccuuaugugaagcacuaaccuuagccacagguccuauaaccacgcucugggaaggcaguccagguaaauuuuggaauacuaccauugccguuucaauggcaaacauauuuagagguucauauuuagcaggggcggguuuagcauucaguauuaugaaaagugugggaacaggaaagcgaggcacagguucacaaggagaaacucugggggagaaauggaagaaaaaguugaaccagcuaagucgaaaagauuucgaucuauacaagaaaagcgggauaacugaaguagauagaacagaggcuaaagaagguuuaaaacguggcgagauaacacaucacgcaguuucccgugguucagcaaaauuacaaugguuuguagagagaaacaugguaaucccggaaggcagaguuauagaucuggguuguggacgaggaggguggucauauuauugugccggauuaaagaaaguaacggaaguccguggcuacacaaagggagggccaggacacgaagaaccagugcccauguccacuuacggguggaacauagucaaacuaaugucaggaaaggacgucuuuuauuuaccgccagagaagugugauacguuacuaugugauauaggagaauccaguccaucacccacaguugaagaaucucgaaccaucaggguacuaaagaugguagaaccauggcuaaagaauaaucaauucuguauaaaaguauuaaacccuuauaugccuacagucauagaacauuuggaacgacuccaaagaaaacacggcgguauguuggugagaaauccgcuauccagaaacucaacucaugagauguauuggauaagcaacggaacgggaaauauaguagccuccgucaauaugguaaguagauugcuguuaaaccgauucacaaugacucauagacguccaacuauagaaaaagacguagaucuaggagcuggaaccagacaugugaacgcggagccugaaacgccaaacauggacauaauaggggaaagaauaaaacguaucaaagaggaacauaacucaacauggcauuaugaugaugagaaucccuauaaaacuugggcguaucaugguuccuaugaaguuaaagcuacuggaagcgcguccucgaugauuaauggaguugugaaacuucugacaaaacccugggacgugguaccaaugguuacacaaauggccaugacggauacaacaccauuuggucaacaaagaguuuuuaaagaaaaaguggacaccagaacaccgcgaagcaugccuggaacccgaagagucaugggcauaacugccgaauggcuguggcgcacucuaggccgaaauaaaaagccacggcugugcacaagagaggaguucaccaaaaagguaaggacaaaugcugcgaugggugccgucuuuacagaggaaaaucaaugggacucugcgaaagcagcuguggaagacgaggacuuuuggaaacucgugaaucgcgaacgugaauugcacaaacuuggcaaaugcgggucuuguguauauaacaugauggguaaaagagagaaaaaguuaggcgaguucgguaaagcuaaagggucaagagcaauaugguauaugugguugggagcacgauauuuggaauuugaggcuuuaggauuucuaaaugaagaccacugguucucccgagaaaacucuuacucaggggucgaaggugagggacuacauaaacugggguacauacuucgcgauauuaguaaaauaccugguggggccauguaugcggacgacacagcgggaugggacacacgaauaacagaagaugaucuucacaacgaagagaagauaacucaacaaauggaccccgagcaccgacaacuggcaaacgcuauauucaaacuaacuuaccagaauaaaguaguaaaaguucagcguccuacacccacagguacagucauggacauuauaagcaggaaagaccaaagggggagcgggcagguaggcacauauggacucaacaccuuuacaaauauggaagcucaacuaauuagacaaauggaaggagaaggaguauugucaaaagcagaucuagaaaacccccaucugccagagaagaaaauaacgcagugguuagaaacuaaaggaguugaacggcuuaaaagaauggcuauaagcggcgacgauuguguaguuaagccuauagaugacagauucgcuaacgcauuguuagcauugaaugauaugggaaaaguucgaaaagauauaccgcaauggcaaccaucgaaaggguggcacgacuggcaacagguaccauuuuguucgcaucauuuccaugaauugaucaugaaagacggucguaaauuagucgucccaugcagaccucaggacgaacuaauaggucgggcacggauaucucaaggagcgggauggucacucaaagaaacugcgugucuuggaaaagcauacgcacagauguggucauugauguauuuccacagacgagaucuaagacucgcauccaaugcaaucuguagcgcagugcccguacacuggguaccaacgucacgcaccaccuggaguauucaugcgcaucaccaauggaugacuacagaggauauguuaacugucuggaauagaguguggauagaagacaauccguggauggaagacaagacuccgguaacaaccugggagaauguaccguacuuagguaaaagagaagaucaauggugugggucccucauuggauuaacuucacgugccaccugggcccaaaauauaccaacagcgauucaacaagugaggagucuaaucggaaaugaagaauuuuuagauuacaugccaucaaugaaaagguuccggaaggaagaagaaucagaaggugcuauuugguaa

SEQ ID NO: 23226 - RNA, 9873 nt, Artificial Sequence
  derived and/or modified CDS sequence (opt6) from DENV-3__JF937646__SS-prME
acaagucuuugucuuaugaugauauugcccgccgcuuuagcauuucacuuaaccucgagagacggcgaaccaaggaugauagucgguaagaacgagagaggcaagagucuauuguuuaaaacugcuuccggaauaaauaugugcacacuaauugcuauggaucuuggugaaaugugugacgacacuguuacauauaaauguccccauaucaccgaaguagaaccagaggauauagauugcugguguaauuuaaccucaacuuggguaacguacggaacuugcaaucaggccggcgaacacagacgagacaaacgaucaguagcacuagcuccgcacguaggaaugggucuagauacuagaacccaaacguggaugagugcagaaggcgccuggagacagguugaaaagguagaaaccugggcucuaagacauccaggauuuacuauauuggcacuauuuuuagcucacuauauagggacuaguuuaacgcaaaaaguagucauauucauauuauugaugcuaguaacaccaucuaugacuaugagaugcguaggaauuggcaaccgugacuucguagagggacucucuggugcaaccuggguagacguaguucuugagcauggagguuguguaaccaccauggcuaagaauaaacccacuuuagauauagaacugcaaaaaaccgaagcuacucaauuggccacauugaggaaguuguguauugaagguaaaauaacgaauauaacgacagauuccagguguccuacgcagggagaagcaacacuaccggaggagcaagaucaaaacuauguuuguaaacacacguauguggacagaggaugggguaacggcugcggacuauuuggaaaaggcagccuaguuacgugugcaaaauuucagugcuuggaaccuauagagggaaaagucguucaguacgaaaacuuaaaguacaccguaauaauaaccguacacacuggagaucaacaucaagucggcaacgagacucaaggaguaacagcggaaaucaccccacaggccucuacaacggaagcuauuuuaccagaguacgggaccuuagggcuugagugcucuccgagaacggggcuagacuucaacgaaaugauuuuauuaacgaugaagaauaaagcauggaugguacauagacaaugguuuuucgauuuaccucuuccauggacgucuggagcaacaacagagacuccaacauggaaccgcaaagagcuucuugugacauucaaaaaugcucacgcuaaaaagcaggaagucguaguauuaggcagucaagaaggagcaaugcauaccgcgcugaccggagcuacagaaauucaaaauagcggagggacgaguauuuucgcuggacacuuaaagugucgacuaaaaauggauaaguuagaauugaaggggaugucauacgccaugugcacaaaugcguuuguuuuaaagaaagaaguaucggaaacucaacauggcacaauucugauuaaagucgaauauaagggagaagacguacccuguaaaauuccguuuucaaccgaagauggacaagggaaagcacauaaugguagauuaauaacugcaaauccagucguuacgaagaaggaagaaccaguaaauauagaggccgagccaccauuuggagaaucaaacauaguaauaggcaucggggauaaugcacuuaaaauuaauugguauaaaaaaggaucuucaauaggaaaaauguuugaagcgacagcuaggggggcuagacggauggcaauacucggagauaccgccugggacuucggaucaguuggcgggguacuaaacucgcuugggaaaaugguccaucaaaucuuugguucagcauauacggccuuauucucaggaguuucuugggucaugaaaauaggaauugggguauuauuaacauggauaggauugaacuccaaaaacacaucgaugucguucucguguaucgcaauagguaucauaacauuauauuuaggcgccguuguacaagcugacaugggcuguguaauuaauuggaaaggcaaggaacuaaagugcgguucuggaauuuuuguaacaaaugaaguucauacguggacugaacaguauaaauuccaagcagauucaccuaaaagacuggccacagccauagcuggagcaugggagaacggaguauguggaauaaggucuaccacaagaauggaaaaucuccucuggaaacagaucgcuaacgaacuaaauuacauucuaugggaaaacaauauaaaacuuacaguaguuguuggagauauuauuggggugcuggaacaagguaaacgaacauuaacaccgcaaccgauggagcuaaaauauuccuggaaaacauggggaaaggcaaagauugucaccgcagagacacaaaacuccucguucauaauugauggaccuaacacuccagaauguccaaguguaaguagagcuuggaaugucugggaaguagaggauuaugguuucgguguauuuacuacaaauaucugguuaaaacuucgagaaguauauacccaguuaugcgaucauagacuuaugagugcagccguaaaagaugaaagagcuguacaugcagauaugggcuauuggauagaaucgcagaaaaacggaagcuggaaauuagaaaaagcaucccuaaucgaaguaaaaacauguacuuggcccaaaucucauacauuauggucgaacgggguauuagaaucagacaugaucauaccaaaaucccuggcaggacccauuagccagcauaaucaucggccuggcuaucauacacaaacggcagggccuuggcaucuagggaaauuggaauuagacuuuaauuauugugaagguacgacaguuguuauaacugagaacugcggaacucgaggaccaucauuaaggacuacaacaguuaguggaaaacuuauacacgaguggugcugcagaucauguacucuacccccauugcgguauaugggugaagauggaugcugguauggcauggaaauuagaccgauuucagaaaaagaagagaauaugguuaaaucucuaguuucagcgggguccggaaagguagacaacuuuacuaugggaguguuaugucucgcaauacuauuugaagaaguuaugagagguaaguuugguaaaaaacauaugauagcuggcgucuuuuuuacauuugucuuacuccuuaguggccagauaacauggagagauauggcacauacacuaaucaugauuggaucaaacgcgucagauagaaugggcaugggagugaccuaccuagcucucauugcaacauuuaaaauucagccuuuucuagcucuuggauuuuucuugagaaaguugacaagcagagaaaacuuauuacuaggaguuggauuggcgauggucacaacauuacagcuuccugaagauauugaacaaauggcaaauggaauugcacuaggccuuauggcacuuaagcuaaucacucaauucgaaaccuaucaauuauggacggcacuuaucucauuaacgugcaguaacaccauauucacguugacgguagcauggagaacagcuacuuugauauuagcugggguaagccugcuaccagucugucaaagcaguucuaugagaaaaacagauuggcugccaauggcaguggcggcuaugggaguucccccucucccacuuuucaucuuugggcuaaaagauacucuaaagagacgcucguggccucucaaugaaggugucauggcuguuggccugguaucaauauuagcuucaucucuauuaaggaaugauguuccgauggccggaccuuuaguggcagguggguugcuuauugcaugcuaugugauuaccgguacuagugcggaccucacggucgaaaaggccgcagauauuacuugggaagaagaagcagaacagaccggcgucucccauaauuugaugauuacaguagaugaugacggaacaaugagaauaaaagaugaugaaacagaaaacauacuuaccguucuacuaaagacagcuuuacuaauaguaucaggcauauuucccuacucgauuccggcgacccuguugguguggcacacauggcaaaaacaaacucaaagaagugguguacucugggacguacccucuccaccagaaacacaaaaagccgaguuggaagagggcguuuauagaauaaaacaacaagguauauucggaaaaacccagguuggaguaggcgugcaaaaggaaggaguauuucacacgauguggcauguaacccgaggggccguguuaacauauaauggcaaacgucuagagccaaauugggccucagugaagaaagaccuaauaucguauggagguggauggagacugagugcgcaauggcagaagggagaagaaguacaaguaauugccguggaaccaggaaaaaaucccaagaauuuucaaacaaugccaggaaccuuucaaacgacaaccggcgaaaucggagcaauugcccuagacuuuaagccugguaccucggguucucccauaauaaacagggagggaaaaguaguagggcucuaugguaacggggucguuacgaaaaaugguggcuacguuuccggaauagcccaaaccaaugcugaaccggaugguccaaccccagaauuggaagaagagauguucaaaaagaggaacuuaacaaucauggaucuacauccaggaucagggaagacgagaaaauaucuuccggcaaucguuagagaagcaaucaagcgcagacuaagaacacugauauuagcgccaacgcgaguagucgcagcagagauggaagaagcccuuaaagguuuaccaauacgcuaccaaacgacagcuaccaaaagcgaacauacaggaagggagauuguggauuuaaugugucacgcuacguuuacaaugcgucuguuaucacccgugcgaguaccgaauuauaaccuaauaauaauggaugaagcgcauuuuaccgauccggcaucuaucgccgcccgcggauauauaucaacacgaguuggaaugggggaggcugcagcuauauuuaugacagcuacgccuccugguacagcagaugcauucccucaaagcaaugcaccuauucaagaugaggaacgagacauuccagaacgcucauggaauaguggaaacgaauggauuacugacuuugcgggcaaaacaguaugguucgugccaagcauuaagguagggaacgauauagcaaacugcuuacgaaaaaacggcaagaaagugauucaacucagcagaaagacguuugacacagaauaucaaaaaacgaaguugaacgauugggauuucguaguaacaacugauauuucugagaugggggcuaauuuuaaagccgacagaguaauagauccuaggagaugucuaaaaccaguaaucuuaacugauggacccgaacggguuauacuggcugggccaaugccugugacagcagcuucagcagcacaaaggcguggccgugucggaagaaauccgcagaaagaaaaugaccaauacauuuucacuggacaaccccuuaauaaugaugaagaccaugcacacuggaccgaagccaaaauguuguuagacaauauaaauacgccagaaggaauaauaccagcacuauucgaaccugagagagaaaaaagcgcugcaauagauggggaguaucgauugaaaggagagagucgcaaaacguucguagaacuuaugcguagaggugauuuacccgugugguuggcacauaaaguagcuagugaaggaauuaaguacacagaucgaaaaugguguuuugauggucagcgaaacaaccaaauauuagaagaaaauauggauguugaaaucuggacuaaagaaggcgagaaaaaaaagcuacguccgagaugguuggaugcgaggacuuauucugauccgcuagcauugaaagaauuuaaagaguuugccgcaggaagaaaaagcauagcucuggaucuugucacagaaauuggacgcgucccaagccaucuagcacaucguacucguaacgcacuggacaaccucguaauguuacacacgucagagcaugguggaagagccuacagacaugcaguagaggaacuaccagaaacuauggaaacacuucuuuuauuagguuugaugauuuuguuaaccggaggcgccauguuauucuugauaucaggaaaagguauuggaaaaacaaguauagguuuaauaugugugauagcgucgucaggaauguuauggauggcagaaaucccuuuacaauggauugcuagugcaauuguguuagaauuuuucaugaugguccuauuaauaccugaacccgaaaaacagcggaccccucaagauaaucagcuugcuuacguugucauaggaauuuugacucuugccgcuauaauagcagccaaugaaauggggcuauuagagacaacaaaaagagacuuaggcaugagcaaggaaccagguguuguuucaccuacuucguaucucgacguagauuugcauccggccagugcauggacauuguaugcuguagccacaacuguuauuacgccaauguugcgccacacuauugaaaauucuacagcuaacguaucauuagcugcaaucgcaaaucaagcugucguucuuauggguuuagauaaagguuggccgauaucuaaaauggaccucggagucccucuacucgcccuaggauguuauagucaggugaauccucuaacauuaacagcggcaguauuacuacugauaacgcacuacgcuauaauuggaccaggacuacaagcaaaagcuaccagagaggcucagaaacguaccgcggcuggaauaaugaagaauccaaccguagauggcauuaugacaaucgacuuagauccaguuauauacgacaguaaguuugaaaaacagcugggacaggugaugcuuuuaguucuuugugcggugcaauuacuauugaugcgaacgucaugggcuuugugcgaggcccuaacucucgcgacaggaccuaucacuacacuaugggagggaucgccugguaaauucuggaacacaacuauugccgugagcauggcuaauauauuucguggaucauaccuggccggagcaggauuggccuucuccauaaugaagagcguaggcacaggaaagcgugggacggggucccaaggagaaacuuugggcgaaaaauggaagaagaaguuaaaucaauuaucgcggaaggauuucgaucuauauaaaaaaagcgguauaacagaaguagaccggacagaagcuaaggaaggauuaaagagaggagaaauaacucaccacgcagugaguagggguagugcgaagcuacaaugguuuguagaaagaaauaugguaaucccagaaggucgagugauagaucuagggugcggcagaggagguuggucauacuauugugccggacuaaaaaaaguuaccgagguacggggauacacuaaagguggaccaggacaugaagaaccgguacccaugagcacguacggcuggaauauaguaaaacugaugucagggaaagauguuuucuauuuaccuccagaaaaaugugauacuuuacucugcgacaucggugaaucgucgccaucucccacuguagaagagucacggacgauaaggguuuugaaaaugguggaacccugguuaaaaaauaaucaauuuugcauuaaaguacuaaauccuuauaugcccacaguaauagaacacuuggaaagauuacaacgaaaacacggaggaauguuaguacgaaaccccuuaucaaggaauaguacucacgaaauguauuggauauccaaugguacaggaaacauaguggccuccguaaacaugguaucgagauugcuauugaacagauuuacaaugacacauagaaggccaacuauagaaaaagauguagaucuuggugccgguacucggcauguaaacgcagaaccagaaacccccaacauggauguaauaggugaacgaaucaaaaggauaaaagaagaacauaauaguacauggcauuacgaugacgagaacccuuacaagaccugggccuaccacgggucauaugaaguaaaagcaacagguagcgcaagcagcaugauaaacggaguaguaaaacugcucacaaagccaugggacguagucccaaugguaacacaaauggcaaugaccgauacgacuccauuugggcaacaacgaguauuuaaagaaaaaguagauacaagaacaccaaggucgaugccugggaccagacgcguaauggggauaacugcggaauggcuguggagaacccuuggaaggaauaaaaagccgcgauugugcaccagggaagaauuuacaaaaaagguucgcacaaacgcagcuaugggagcugucuucaccgaagagaaucaaugggacagcgcuaaagcagcaguagaagaugaggauuucuggaaauugguagaucgagaacgugaauugcacaaacugggaaagugcggaucuuguguauacaauaugaugggaaagagagagaagaaacuaggggaauuugguaaagcgaaagggucgagagcuauaugguauaugugguugggggcuagguaucucgaauuugaagccuuaggguucuuaaaugaagaccacugguuuuccagggaaaauaguuauagcggaguagaaggugagggacugcauaagcuuggguauauucuccgagacauuucgaaaauacccggcggagcaauguaugccgaugauaccgcgggaugggauacgaggauuaccgaagaugauuuacauaacgaagagaaaaucacccagcaaauggauccagagcacagacaacucgcuaaugcaauuuuuaaauuaacauaccaaaacaagguaguaaagguacagagacccacaccaacgggaacaguaauggauauaauuucacgcaaagaucaacgugguucgggucaaguuggaacauauggcuuaaauacauucacaaacauggaagcacagcuaauuagacaaauggaaggagaggggguacuuuccaaagcagaucuggaaaauccgcacuuaccggaaaaaaagaucacccaaugguuagaaacaaaagguguugaaagguuaaagagaauggcaauaucaggagaugauuguguaguaaaacccauagacgaucgauuugccaaugcauuguuagcauugaaugacaugggaaaaguaagaaaagacauuccgcaauggcaaccauccaaaggauggcaugacuggcaacaagugccguucuguucacaccauuuucacgaauuaauuaugaaagacggacgaaaacuaguagugcccuguagaccacaagaugagcuaauaggccgagccagaauaagucaaggcgccggguggucucucaaagaaacugcgugucucggaaaagccuacgcacagauguggucacuaauguacuuucauagacgagaccugcgguuagcuucuaacgcuauaugcucugcagugccaguacacugggugccgacgaguaggaccaccuggagcauacaugcucaucaccaauggaugacuacggaagauauguuaacaguuuggaauaggguauggauagaagacaacccuuggauggaggauaaaacaccuguaacaacuugggagaauguaccuuauuuaggaaaacgggaagaucaauggugcggcagucuuauaggguuaacaaguagagcuaccugggcucaaaacauccccaccgcaauucaacagguacgcaguuuaauagggaacgaagaauuccucgacuauaugccuucaaugaaaagguuccggaaagaagaagaguccgagggagcuauaugguag

SEQ ID NO: 23227 - RNA, 9873 nt, Artificial Sequence
  derived and/or modified CDS sequence (opt6) from DENV-3__JF937633__SS-prME
acgaguuuauguuugaugaugauccuaccagcagcuuuagcuuuccaucucacgagccgugauggagaacccagaaugauaguaggcaaaaaugaacgugggaaaucacugcuguucaaaacagcaaguggaauuaauauguguacacuaauagcaauggaucuuggugaaaugugugaugacacugucacguacaaauguccucauauuaccgaaguggaaccagaagauauugacugcuggugcaaccuaacuucuacuugggugacguauggaaccuguaaucaagcgggugaacauagaagagauaaaagaucagucgcccuagccccacaugucgguaugggacuagauacaagaacucaaacguggaugagcgcugaaggagcuuggcgucaaguagaaaaaguugaaaccugggcacuccgccacccuggauucacuauccuagcuuuguuccucgcacauuacaucgggacgagucuaacacaaaaaguaguaauuuucauccuuuuaaugcuaguuacuccgaguaugacuaugagauguguagggguggguaaucgagauuucguagaaggacucagcggcgcaacuugggucgauguuguucuugaacacgguggcugugugacaacaauggccaaaaacaaaccaacauuagauaucgaacuacagaaaacggaagccacacaauuagcaacuuugcgcaaauuaugcauagaaggaaaaauaacuaauauuaccacugacucaaggugcccaacucaaggcgaagccacucugccagaagaacaagaccaaaacuaugugugcaaacauacauacgucgauagaggcuggggaaacggaugugggcuguucggaaaagguucauuaguuaccugcgcaaaauuucaaugccuugaaccaauagaaggaaaagucgugcaauaugaaaaccuuaaauauacugucauaaucacaguccacaccggagaccaacaucaaguugguaaugaaacacaaggcguuacagcagaaauuacgccacaagcaucgacaacugaagcuauacuuccagaauaugggacacucgggcuagaaugcaguccacguacaggccuagacuuuaaugaaaugauucucuuaacuaugaaaaacaaagcauggaugguucaccgccaaugguuuuucgacuuaccccuaccuuggacaucaggagccacaacagaaacuccaacuuggaauaggaaagaauuauuaguaaccuuuaaaaacgcacacgcuaagaaacaggaaguaguuguccuagguagucaagaaggagccaugcacaccgcauuaacaggggcuacugaaauucaaaauucagguggcacgucuaucuuugcgggacauuuaaaaugcaggcucaaaauggauaaacuagaacuaaaagggaugucauaugcaauguguacaaacacauucguucuuaagaaagaggucagcgaaacacaacacgguacaauacuaauaaaagucgaguauaaaggagaagauguacccuguaaaauuccauucaguacagaagauggacaagguaaagcccacaauggacgccucauaacggcgaacccugucguuaccaagaaagaagaaccuguaaauauagaagcagaaccaccuuuuggagaaucaaauaucguaauuggcauuggugacaaugcucuuaaaauaaacugguacaagaaaggaucgucaaucgguaaaauguuugaagccaccgcucgaggcgcaagaaggauggcgauucuuggagacacugcaugggacuuuggaaguguuggugggguacuuaacagucugggaaaaauggugcaucaaauauucgguucagccuauacagcauuauuuaguggaguaucguggguuaugaaaauaggaauaggagugcuacucacuuggauaggacuaaacuccaaaaauacaucuaugucuuucuccugcauagccauuggcauaaucacacuuuauuuaggggcaguuguacaggcggacaugggaugugucauaaauuggaaaggaaaagaacugaaauguggaucaggaauauuugucacuaaugaagugcauaccuggacugaacaauacaaauuucaggcagauucucccaaaaggcuggcaacagcaauugcgggcgcuugggaaaaugguguuuguggaauacgaucaacaacacgcauggaaaaucugcuauggaaacaaauagcuaaugaguugaauuauauauuaugggaaaauaauauuaaguuaacuguagugguaggagauaucauaggcguauuagaacaaggaaaaaggacauugaccccacaaccuauggaacuaaaauacucauggaaaacgugggguaaggcuaagauagugaccgcagaaacgcaaaacagcuccuuuauaauugacggucccaauacuccagaaugcccuagcguuagcagagccuggaacgucugggaaguagaggauuauggauuuggagucuuuaccacgaacauauggcuuaaauugcgcgaagucuauacccaguuaugcgaucaucgacuaaugucggcggccgugaaagaugaaagggcaguucaugccgacaugggauacuggaucgaaucacagaaaaauggcucguggaaauuagaaaaggcuucucuaaucgaagugaaaacuugcacguggccaaagucacauacgcuaugguccaaugggguauuagaauccgauaugauuauaccgaaaucucuagcgggaccgauaagccaacacaaccaccgucccgguuaucauacacagacggcuggucccuggcacuuagggaaauuggaacuagauuucaacuauugugaaggcacuacaguaguuauaacugaaaauugcggaacaaggggaccgucacuaagaacuacaacaguauccgguaagcuaauacaugaaugguguugcagaaguuguacuuuaccuccacuaagguacaugggugaagaugguuguugguauggaauggaaauacgcccuauaucagaaaaagaagaaaacaugguaaaauccuuaguaagugccggaucugggaaaguugacaacuuuacaaugggugucuuauguuuagccauacuguuugaagagguaaugagaggaaaguucggcaagaaacacaugauugcgggcguauucuuuacuuucguccucuuguuaucuggucaaauaacauggcgcgacauggcucauacccugauaaugauuggaucaaacgccagcgacagaaugggaaugggcguaaccuaccucgcguuaauugcgacauucaaaauucagcccuucuuagccuuaggauucuuucuaaggaaguuaacgucaagagaaaaccuuuuauuaggcguuggcuuagcaauggcaacgacacuacagcucccugaagauauugaacaaauggccaacgggauagcguuaggucugauggcccuaaaacuuauaacucaauuugagacauaucaacucuggacagccuugaucaguuuaaccugcaguaacaccauauuuacucuaacgguagcauggagaacugcuacgcuaauacucgccggugugucccuucuccccgucugucaaagcucaucaaugcgcaaaaccgacugguuaccaauggcagucgcugcgaugggaguaccaccuuuaccccuguucauauuugguuuaaaagacacacuuaaacguaggaguuggccucuaaaugaaggagucauggcaguaggacugguguccaucuuagcgucaucgcuccuaagaaaugauguuccaauggcaggaccccuuguugccggaggauuauuaauugcaugcuacguaauaaccgguacuucggcagacuuaacaguagaaaaagcagcggauauaacuugggaagaagaagccgaacagacuggugugucgcauaaucuaaugauaacuguggacgacgauggaaccaugcgcauaaaagacgacgaaacagaaaauauucugacaguacucuuaaagacagcacuuuuaauaguaucagguauauucccauacucaauuccagccacgcugcuaguauggcauacuuggcaaaagcaaacccaacgaagcggcguacucugggauguuccuucgccuccugaaacgcaaaaagccgaacuagaagagggaguguaucgaaucaagcaacaaggcauauucggaaaaacacagguaggcguagguguccagaaggaagguguguuccauacaauguggcauguuacaaggggagccguucuaacguauaacggaaaaagacuggaaccaaauugggccagcgugaagaaagaccucauaucauaugguggcggcuggcguuuaagcgcucaauggcaaaaaggagaagagguucaagugauugcaguagaaccuggcaagaauccuaaaaauuuucaaacuaugccgggaaccuuucaaacaacgacaggggaaauuggcgcgauagcccuagauuuuaaaccugggaccucgggcuccccaauaaucaacagagaagguaaaguaguagggcuuuacgggaauggaguuguuacuaagaacgggggauauguuagugguaucgcacaaacaaaugcagaaccggauggcccaacaccagaacucgaagaagagauguucaagaaaaggaaucuaacaauaauggauuuacacccaggaucuggaaagacaagaaaauauuugccagcuaucguacgggaagcuaucaaaagaagguugcgaacacugauuuuggcaccaaccagaguaguugcugcugaaauggaagaggcacuaaaagguuuaccaauacgauaucaaacgacagcgaccaaaucagaacacacaggcagagaaauuguagacuuaaugugccacgcaacuuuuacgaugagauuacuuaguccgguuagaguucccaacuacaaucuaauaauaauggacgaagcccauuuuaccgacccugcuucuauugcggcuagaggcuauauaucuacgagaguaggaaugggugaagccgcugccaucuucaugacagccacgccaccggguacagcagaugcuuucccccaaucgaaugcaccgauccaagacgaagaacgcgacauaccagaaaggucauggaacucuggaaaugaguggauaacagacuucgcuggcaaaaccguaugguucguaccgucuauuaaagcgggaaaugauauagccaauugucuacggaagaaugguaaaaaggucauacagcuauccagaaaaacauuugacacagaauaccagaaaacaaaauuaaacgacugggacuuugugguaacgacagauauuucagaaaugggugcuaauuucaaggcagauagaguuauugauccgcggagauguuuaaagccagucauucucaccgaugggccagaacgggugauauuagcuggaccuaugccaguaacagcagcgucugcggcucagaggaggggucgcguaggacggaauccucaaaaagagaaugaucaauauauauuuacuggucagccacuaaacaaugacgaagaccaugcucauuggacggaagcgaagaugcuguuagauaauaucaauacgccagaaggaauuauuccagcucuuuuugagcccgaacgagagaaauccgcagcaauagacggagaauacagauuaaaaggcgaaucaaggaaaaccuuuguagagcucaugcggagaggagaccuuccuguaugguuagcgcacaaaguggcuucugaaggaaucaaguauacggaccgaaaaugguguuucgacggucaaaggaacaaucaaauucuagaagaaaacauggacguggagauauggacaaaagaaggcgagaagaagaaacucagaccccguuggcucgacgccagaaccuacucggauccacucgcacuuaaagaauuuaaggaauuugcagcaggaagaaaaagcauaacucuagauuuaguaaccgaaaucggacgcguuccaagccacuuagcucacagaacaaggaaugcauuagacaauuuaguuaugcuacacacguccgaacaugggggacgcgcauauagacaugcaguggaagaacuaccggaaaccauggagacauuguuauuacuuggauugaugauucuucuaacagguggagcuaugcuauucuuaauaagcggaaaggguauagggaagacgagcaucggccuuaucugcgucauagcaaguucaggcauguuguggauggcugagauaccacuacaauggaucgcuuccgcuauaguacuugaguucuucaugaugguauuguugaucccagaaccggaaaaacaacgcacgccacaagauaaucaguuagccuauguuguuauugguauacuuacacuggcugcuauuaucgcugccaaugaaaugggauuacuugaaacuacuaaaagagaucucgguaugucaaaggaacccggagucguuagcccuacuagcuacuuggauguggaucuccauccagccagugcauggaccuuauaugcugucgcaacgacgguuauaacgccuaugcuacggcacacaauugaaaacucuacagcaaacgugagucuagcagccauagcaaaucaagcagugguacuaaugggacuagauaaaggauggccaaucucgaaaauggaucuaggugugccacuacuagcuuuaggcuguuacucccaagucaauccccuaacacuaacagcagcgguucuauuacuuauuacucauuaugccauaauaggcccuggacuccaagccaaagcuaccagagaagcucagaaaagaacagcugccgguauuaugaagaauccaacugucgauggcauaaugacaauagauuuagauccuguaauuuaugauucgaaauucgaaaagcaacucggacaggugauguuguuggucuuaugugcgguacaguugcuacuaaugcguacgucaugggcacuuugcgaagcauuaacacuggcuacaggaccaauuacaacccuuugggaaggaagucccggcaaauuuuggaauaccaccauagcgguaucaauggcuaacauauuuagaggaucauaucuugcgggugccggguuagccuuuucuauaaugaaaucaguugguacaggaaaaagggguacugguagucagggagagacacuaggagaaaaauggaagaagaaauugaaccaguuauccaggaaagacuuugaucuguauaagaaaucgggaauuacugaagucgaucgaacagaggcuaaagaaggucuaaaacggggugagauaacacaccaugcaguaucaagaggaucggcuaaacuccaaugguuugucgaaagaaauaugguuauuccggaaggacguguaauugaccuaggguguggaagaggggguuggucuuacuacugcgcuggauugaagaaggucacggagguacgagguuacacuaaaggaggaccuggucaugaggagccugugccuaugaguacauacggguggaacauuguaaaauuaaugaguggaaaagaugucuuuuauuuaccaccagagaaaugugauacauuauuaugugauaucggagaaucgucuccuucaccaacuguagaagaaagccgcacgauccgugucuuaaaaaugguggaaccgugguuaaagaauaaucaauuuugcauaaaaguuuuaaauccauacaugccgacaguaauagaacaucuggaaagacuacagagaaaacauggagguaugcuaguuagaaacccucuuagccguaauucaacacacgagauguacuggauuaguaacggaacugguaauauaguagcgaguguaaauauggugucacgauuauugcuaaaucgcuucacgaugacccaccgccgcccaaccaucgaaaaagacguagaccuuggagccgggacaaggcacguaaacgcagaacccgaaacgccuaauauggauguuauuggcgaacguauaaaacgaauuaaagaagaacacaauaguacuuggcacuacgaugacgagaauccuuacaagacgugggcauaucaugggucuuaugaagugaaagccacaggcucagcgucaucaaugaucaacggaguaguaaaacuccugacaaaaccaugggacguuguuccaaugguuacccaaauggcgaugaccgauacaacucccuuuggacaacaaagaguauucaaggagaaaguugacacacggacaccucguucaaugccggggacgagacgugugauggguauuacagcggaauggcuauggagaacauuggggcggaauaagaaaccaagauuaugcacaagggaagaguucacaaagaaaguucgaacaaaugcagcgaugggggcuguguucacagaagaaaaucagugggauucugcgaaagcagcgguagaagaugaggauuuuuggaagcuaguggauagggaacgugaacuacauaagcucgguaagugcggauccuguguuuacaauaugaugggaaaaagagaaaagaaacuaggagaguucggcaaagccaaagggucaagagccauuugguacauguggcugggggcccgauauuuagaguucgaggcacuaggauuuuuaaacgaagaucacugguuuucaagagaaaacucauauucaggugucgagggagaaggacuccauaaacuaggauauauuuugagagacauuucaaaaaucccaggaggagcuauguacgcugacgauacugcagggugggauacacgaauaaccgaagacgaucuccauaaugaagagaaaaucacccagcaaauggaucccgagcaccgacaguuagcaaaugcaauuuuuaaauugacauaucaaaauaaaguaguuaaagugcaaagacccaccccgacuggaacagugauggacauaauuucaaggaaagaccaaagagggucaggccaagucggaacuuacgggcuaaauacauucacgaauauggaggcgcaacucauucgucagauggagggugaagguguauuauccaaagccgauuuagaaaacccacaucuccccgagaagaaaauaacacagugguuagagacuaaaggcguagagagauuaaagcgaauggcaauaucaggcgacgauugcgugguaaaaccuauagacgacagguucgcuaacgcacuucuggcccuaaacgauaugggaaaaguaaggaaagacauuccccaauggcagcccagcaaaggauggcacgauuggcaacaaguuccuuucugcucgcaucacuuucaugaauuaauaaugaaagacgguaggaaguuaguaguuccauguagaccucaagaugaauuaaucggaagggcacggauuagccaaggagcaggauggucucuaaaagagacagcuugucuuggcaaagcauaugcacaaauguggaguuugauguauuuucauagacgagaccuccgucucgcaucaaaugcuaucugcuccgcuguaccaguacacuggguaccaacaaguaggacgacauggaguauacacgcacaucaucaguggaugacuacugaggauauguuaacagucuggaaucggguauggauagaggacaauccauggauggaagauaaaacacccguaacuaccugggaaaaugugccuuaccucgggaaacgagaagaucaguggugcgguucauugauagguuugacauccagagcaacuugggcucaaaacauuccuaccgcaauacaacaagugaggaguuugauagguaaugaagaauuuuuagauuauaugccgagcaugaaacgcuucagaaaagaggaagaaagugagggagcgauaugguaa

SEQ ID NO: 23228 - RNA, 9873 nt, Artificial Sequence
  derived and/or modified CDS sequence (opt6) from DENV-3__JF937634__SS-prME
accagcuuaugccugaugaugauacuaccagcugcacuugcauuccaucuaaccucgagggacggggaaccaagaaugauaguaggcaaaaacgaaagaggcaaaucauuguuauucaaaaccgcuucugggauuaauauguguacccuaauugcaauggaucucggagaaaugugcgaugacacggugacguacaaauguccacacauuacugaaguagaaccagaagacauagauuguugguguaauuuaaccucgaccuggguuacuuauggcacguguaaccaagcaggagaacauaggcgugauaaaagaaguguggcuuuagcuccucauguaggaaugggauuggacacaaggacucaaacauggaugucggcagaaggugcauggcgacaagucgaaaaagucgaaacgugggcuuuaagacacccaggcuuuacaauauuagcuuuauuucuggcacauuauauugggacgagcuuaacucaaaaaguaguuauuuucauacuauuaaugcucguaacuccgucaaugacaaugaggugcguugguguugggaauagggacuuugucgaaggguuaucuggagccacauggguagacguaguucuagaacauggugguuguguaacuacgauggcuaaaaauaaacccacucuagauauagaacuacagaaaacagaagcaacucaacuggcaacguuaagaaaauuaugcauagaagguaaaauuacaaacauaacgacagauucucguuguccaacacaaggcgaagcgaccuuacccgaggaacaggaucaaaauuauguguguaaacacacauacguagacagaggcugggguaacggaugcggucuuuucggcaaaggaucguuggugaccugugcgaaauuucaaugccuugagccaauagaaggaaaaguuguucaauaugaaaacuuaaaauacacgguuauaaucacuguacauacaggagaucaacaccaaguagggaacgaaacacaaggaguuacagcagaaauuacaccacaagcaucuacaaccgaagcgauucuaccggaauauggaacauuagguuuagaauguucaccaaggaccggauuggacuucaaugaaaugauucuacugacaaugaaaaauaaagcguggaugguccauagacaaugguucuuugauuuaccacuuccuuggacauccggagcaacgacggaaacgccgaccuggaauagaaaagaacuauuggugacauucaaaaacgcgcacgccaagaaacaagaaguuguaguguuggguagucaagaaggagcaaugcauacugcauuaacaggagcgacagaaauucaaaauucgggagguaccucaauuuuugcuggacacuuaaaaugcagauugaaaauggacaaacucgaacuuaaaggaaugucauaugcuauguguacuaacacguuuguucucaagaaagaaguuagcgagacacagcaugguacuauacugaucaaaguggaauauaaaggcgaggauguacccuguaaaauucccuucaguaccgaagauggacaagggaaggcacacaauggucgacuaauaaccgcuaauccagucguaacuaagaaagaagaaccaguaaacaucgaagcugaaccuccauuuggagagucaaauauagugauuggcauaggcgauaacgcauugaaaauuaauugguauaagaaagggucaucaauagguaaaauguucgaagcgacagcaaggggagcucgucgaauggcaauauuaggagacacagcgugggacuucggaagcgugggagguguauuaaacucacuuggaaaaaugguacaucagauauucggaagugcauacacggcgcuauucucgggcguaucauggguuaugaaaauagggauuggugucuuguuaacuuggauaggacuuaauagcaaaaacacaaguaugaguuucuccugcauugcgauaggaauaauaacuuuguaucuaggugccgucgugcaagcugauaugggcuguguuauaaauuggaaaggaaaagagcugaagugugggucaggaaucuuugucacaaacgaaguucauacuuggacagaacaauacaaauuccaagcagauucaccuaaacgacuugcuacggcaauagcuggugcuugggaaaauggugugugcgguauaagaucuaccacucguauggaaaacuuacuuuggaaacaaauagucaaugaacuaaauuacauacugugggaaaauaacaucaaguuaaccguaguugugggagacauaauaggaguguuggaacaagguaaacgaacguuaacaccccaaccaauggaacuaaaauauucauggaaaaccuggggaaaggcuaagauaguaacugcugaaacacagaacaguucauucauuauagauggaccuaauaccccugaaugccccucuguuagcagggcauggaauguuugggagguagaagauuaugguuuugguguuuuuacaacgaacauuuggcuuaaacucagagaaguauauacacaacuuugugaucacagauuaaugucagccgccgucaaagacgagagagcugugcaugccgacaugggguacuggauagagucacagaaaaaugggagcuggaaacuagaaaaagcauccuuaaucgagguaaaaacuuguaccuggcccaagucgcauacguuauggaguaaugggguucucgaaagcgauaugauuauuccaaaauccuuagcaggaccuauaucacagcauaaucaccgucccggauaucauacucaaacagcuggcccguggcaccuaggcaaacuugaacuagauuuuaacuauugcgaaggcacaacgguuguuauuacggagaacuguggcaccagaggacccucauugaggacaacaacgguaagugggaaacuuauucaugaaugguguugcagaucauguacccuaccuccccuaagguauaugggugaagacggauguugguauggaauggagauuagacccaucagugagaaagaagaaaauauggucaaaucauugguaucugcagguaguggcaaagucgauaauuuuacuaugggcguauuaugcuuagcgauacuuuuugaagaaguaaugcgcggcaaauucggcaagaaacacaugaucgcagggguuuucuuuacauucguacuuuuacuuagugggcaaauaacguggagggauauggcacauacauuaauaaugauuggcucaaacgcaucggaccguaugggcaugggagugacauacuuggcgcuaaucgcgacuuuuaaaauacaacccuuucuggcccuuggcuuuuuccuacguaaacuuacgaguagagagaaccuccuacuuggagugggcuuagcuauggcuacaacacugcaacuaccggaagauauugagcaaauggccaauggcaucgcccucgguuuaauggcgcugaaguugauuacgcaguuugaaacguaccaauuauggacugcacuuaucagucucacguguagcaacaccaucuuuacacuaacggucgcuuggcguacggcaacguuaauccuugcgggugugucacuacugccuguuugccaauccagcucaaugcgaaaaacggauuggcuaccaauggccguugcagcaaugggaguaccaccauugccacuguuuaucuucggauuaaaagacacacuaaaaagacguaguuggccucucaaugaaggaguuauggcaguaggauugguaaguauacuagcaucgagccuauugaggaaugacguacccauggccggcccccugguggcugggggucuccugauagcauguuaugugauaaccggaacaucugcagaucucaccguagaaaaagcagcagauauuacgugggaagaagaggcggagcaaaccgguguaagccacaauuugaugauuacggucgaugaugacggaacuaugagaauuaaagacgaugaaacagaaaauauuuuaacgguuuuacuaaagacagcuuuacuaauuguaucuggcauauuuccguacaguauacccgcgacccuccuaguauggcacacauggcaaaaacagacgcagcgaagugggguucuuugggauguaccaucacccccagagacucaaaaagcggaauuagaggaaggaguauauagaauaaaacagcaagguauauuugguaagacacaggucggcguuggcgugcagaaagaaggagucuuucacaccauguggcaugugacaaggggugccguauugacauauaauggcaaacggcucgaaccaaauugggcuucagucaagaaagauuuaauaagcuacggagguggguggagacugucugcccaauggcaaaaaggagaagaaguacaaguaauagcgguagagccugggaaaaauccgaaaaacuuccagaccaugccuggaacauuucaaacaaccacaggugaaauaggagcaauagcacuagacuucaaaccaggaaccuccgguucaccaauuauaaacagagaggguaaaguaguaggucucuaugguaaugguguagugacuaaaaauggaggguauguauccgguauugcacaaacuaaugccgagccagauggacccacaccagagcuagaagaggagauguucaagaaaagaaaucucacaauaauggaucugcaccccgggagugguaaaacacgcaaguaucugccagcaauaguacgagaggcgauaaagcgacgguuaaggacacuaauacuggcgccuaccagaguaguugcugccgagauggaagaagcacugaaagggcucccaauaagguaccagaccacugcuacuaaaucagaacacacugguagagaaaucguagaucuaaugugucacgcuacuuucacaaugagacuauuaucuccuguucggguuccaaauuacaaccuuauaaucauggacgaagcucauuucaccgauccggcaagcauagcggcacgaggguacauaucaacacgaguagguaugggagaagcagcagcgauuuuuaugacagcaacaccuccagguacugcugaugccuuuccccagaguaacgcgccgauccaagacgaagagagagacauuccagaaagaagcuggaacuccgguaaugaauggauuacugauuucgccggaaagacuguaugguuugugccuagcauaaaagcaggaaaugacaucgcuaacugucuacgaaagaacggaaagaaaguaauacaguuauccagaaaaacguucgauacugaguaucagaaaacaaaacuaaaugauugggauuucguagugaccacugauauuucagaaaugggugcaaacuuuaaagcagaccgaguaauagacccaaggcggugucuuaagccagucauucuuaccgauggacccgagagagucauacucgcaggcccuaugcccguaacggcugcaucagcagcacagagacgaggucgagugggcagaaauccacaaaaagaaaaugaucaauacauauucacaggacaaccauuaaauaaugaugaagaucacgcacauuggacagaagcuaaaauguuauuagacaacauaaacacuccagaagguauaaucccagcguuauucgagccagagcgagaaaaaucagcugcaauagacggggaauaucgucuuaagggugagucacgcaaaacauuuguagaauuaaugcguagaggcgaucucccaguaugguuagcucauaaagucgccucggaggguauaaaauauacggaccgaaaauggugcuuugaugggcagaggaacaaccaaauuuuagaagaaaauauggauguugaaauauggacuaaggaaggugagaaaaagaaacugagaccacguuggcuugaugcccgaacuuauucagauccucucgcacucaaagaauuuaaagaguucgcggcagguagaaaaucgauugcuuuggaccuaguuacggaaaucggccgagucccaagccacuuagcccaucguacgaggaacgcacuggacaaccuagugaugcuucauacaagugagcauggugguagagccuaucgacaugcuguagaagaauuaccugaaacaauggaaacuuuauuacucuuaggucuaaugauauugcuaacagggggagcaaugcuuuuucuuauaagugggaaaggaauuggaaaaaccagcauuggacugauauguguuaucgcuucaagcgguaugcucuggauggccgaaauuccauuacaguggauugcaucugcuaucguuuuagaguucuuuaugaugguguuauuaauaccggaacccgaaaagcagagaaccccucaagacaaucaacuugcuuacgucguuauaggcauauuaacacuggcugccauuaucgcggccaaugaaaugggcuuguuggaaacaaccaaacgagauuuagguaugucuaaagaaccuggaguugucucccccacgaguuaucucgaugucgauuuacauccagcuucagcauggaccuuauacgcggucgcuaccaccguaauuacaccuauguuacgacacacaauugaaaacucaacagcaaacguuucauuagcggccauagcuaaucaggcuguaguacuaaugggacuggauaaaggauggccaauaucgaaaauggaucucgguguuccacuucuagcacuagggugcuauagccaaguaaaucccuugacacuaaccgcggcaguucuauuacuuauaacacacuacgccauuauugggccuggauuacaagccaaagcuacacgagaagcacagaaaaggacggccgcuggaauaaugaagaauccaacuguugacggaauuaugacaauagacuuggacccaguuauauaugauucaaaauucgaaaagcaguuagggcagguaauguugcucguauuaugugcuguacaacuauugcuuaugcgaacaagcugggcauugugugaagcauugacuuuggcaaccgguccuauaacaacucuuugggaaggauccccgggaaaauuuuggaauacuacaauagcagugucaauggcaaacauuuuucgaggaucauauuuagcuggugcaggcuuagcuuuuucuauaaugaagucugucgguacugggaagagaggcaccggcucacagggagagacacuaggcgaaaaauggaaaaagaaauuaaaucaacuuucgcgcaaggauuuugacuuauacaagaaaaguggaauaaccgagguagacagaacagaggccaaagagggguuaaaacgaggagaaauaacacaucaugcugugagucguggcucugcaaaauuacaaugguuuguggagagaaacaugguuauaccugaaggccgaguaauugacuuagguuguggccgugguggcuggucauauuauugugcagguuugaagaaaguuacugaaguucgaggauauacaaaaggcgguccuggucaugaagaaccgguaccaaugucaacguauggauggaacaucgucaagcuaaugucaggaaaagauguguucuaccuaccuccugaaaaaugugacaccuugcugugcgauauaggugagagcaguccuucaccaaccguggaagagucucgaacuauccgcguauuaaaaaugguagaacccuggcucaaaaacaaucaauuuugcauaaaaguauuaaaucccuacaugcccacggucauagaacacuuggagagauuacaacgcaaacacggcggcaugcuaguaagaaauccauuaagcagaaauuccacacacgagauguacuggaucucuaauggaaccggaaacauuguggcgucggucaauaugguaagucguuuauuacuaaaucgauucacaaugacacauaggagaccgacaauagaaaaagauguggaucuuggagcagggacucgacauguaaacgcagaaccugaaacaccuaauauggaagugauaggugaaaggauuaaaagaaucaaagaagaacauaacagcacuuggcauuaugaugacgagaacccauauaaaacaugggcuuaccaugguucauaugagguuaaagcgacgggcagugcuucaucaaugaucaaugguguugucaaguugcugacgaaaccgugggacguuguacccaugguuacccaaauggcaaugacagauacgacaccguucggacaacagcgcguauuuaaagaaaaaguagacacacguacgccgcgaaguaugccuggaacucgacgcgucaugggaauaacagcugaguggcuuuggaggacacuuggacgaaauaagaaaccacgucuguguacaagagaagaauuuacaaagaaaguacguacaaacgcagcaaugggggcaguauucacugaggaaaaucaaugggacuccgcaaaagcugcggucgaagaugaagacuucuggaagcuaguggaucgugagcgugagcuccacaaauuaggaaaaugcgggucaugugucuacaauaugauggguaaaagagagaagaaacucggagaguuuggcaaggccaagggcagucgagcaauaugguacauguggcuaggugcucgauaucucgaguucgaagcucugggauuuuugaaugaggaccauugguucagcagagaaaacagcuauagcggaguugaaggggaagggcuccacaagcuaggguauauucuaagagacauaucuaaaauaccgggaggagcuauguacgcagaugauacagcaggcugggauaccagaauaacugaagacgauuuacacaaugaagagaaaauaacucaacaaauggaccccgaacacagacaacuagccgaugcaauauuuaaacuaaccuaccagaauaaagucguaaaaguucagaggccgacaccaacaggcacggucauggauauuauauccagaaaggaucaacggggaucuggacaggucgggacauacggacuaaauaccuucacaaacauggaggcacaacuuauccgucaaauggaaggugaaggcguccugucuaaagccgauuuggaaaauccacacuuaccugagaagaaaaucacucaauggcuugaaacaaaaggaguagaacgcuuaaagaggauggcaauuaguggcgacgauuguguaguaaaaccaauagacgauagauuugccaacgccuugcuugcacuaaacgauauggggaagguacgaaaggauauuccacaguggcagccaucaaaaggcuggcacgauuggcagcaagugccauuuuguagucaucacuuccaugagcucauuaugaaagauggucguaagcuaguggucccaugcagaccucaggaugagcuaaucggacgcgcacgaauaucucaaggcgcggguuggaguuuaaaagagacagcaugccuagguaaggcuuacgcacagauguggucccuaauguacuuccauaggcgugauuugaggcuggcuaguaaugcaauauguagcgcaguaccaguccacuggguaccuacuucucggacaacauggucaauacacgcgcaucaucaauggaugacaacugaagacauguuaacaguuuggaauagagucuggauugaggacaauccguggauggaagauaaaacgccggucacaacaugggaaaacguaccguauuuaggcaaaagagaagaccagugguguggauccuuaauaggacuaaccucacgugcaacaugggcucaaaacauuccaacagccauucagcaagucagaucgcucauaggaaaugaggaauuuuuagauuacaugccaucgaugaagagauuucguaaagaagaagaaucagaaggcgccauaugguaa

SEQ ID NO: 23229 - RNA, 9873 nt, Artificial Sequence
  derived and/or modified CDS sequence (opt6) from DENV-3__JF937636__SS-prME
acgucuuuaugucuuaugaugauauugcccgcagcgcuagccuuccacuugacaagucgggauggggaaccaagaaugauaguaggcaaaaaugaaagaggaaaaucauuacuauucaaaacagcgaguggaaucaacaugugcacacucauugcgauggacuuaggugaaaugugugaugauacaguaacauacaaauguccacacauuacagaagucgaacccgaagauauagauuguugguguaacuugacuuccacgugggugacuuacgguacauguaaucaagcuggggaacauagaagagauaaaagauccguagcacuagcaccccauguaggaaugggacuugauacacgcacacaaaccuggaugucagcggaaggggccuggagacaaguagaaaaaguagaaacaugggcacuaagacauccuggauuuacaauuuuggcacuauucuuagcccauuauauugguacgucgcuuacccaaaaagucgugauauucaucuuauuaaugcuuguaacaccaucaaugacgaugagauguguugguguagggaaucgagacuuuguugaaggacuuucaggagcuaccuggguugauguagucuuagaacacgggggaugugucacaacaauggcuaaaaauaaaccaacauuggauauugaacuacagaaaacggaagcuacacaauuggccacauugcgaaaacuaugcauagaagguaaaauaacaaauauuacgacagauagucgguguccaacccaaggugaagcgacuuugccugaggagcaagaccaaaauuauguaugcaaacauacauacguugaucguggguggggaaaugguuguggacucuuuggaaaggguucuuuagucacaugcgcaaaauuucaauguuuagaaccuauagaaggaaaaguuguacaauaugagaaccuaaaauauacaguuauuauuacuguacacaccggagaucaacaccaaguggguaacgagacccaaggaguaacugccgaaauaacuccacaagcgaguacuacagaagcaauacugccugaauauggaacguuaggacuagaguguucucccagaacaggauuagauuucaacgagaugauccugcucaccaugaaaaauaaggcuuggaugguacaucgacaaugguucuuugaucuaccucuaccauggacaucaggagcaacgacagaaacacccacauggaacagaaaagaacuauuagucacuuuuaaaaaugcacaugcgaagaaacaagagguaguaguuuuaggaucccaagagggggcaaugcauacugcuuuaacaggggcaacugaaauccaaaacucuggaggaacgaguauauucgcuggacaucugaagugucgauugaaaauggauaaauuagaauuaaaaggcaugagcuacgccauguguacaaauacauucguauuaaagaaagaggugucggaaacacaacacggaacuauucuaauuaaaguugaauauaaaggugaggauguuccuuguaagauaccauuuaguacagaagauggacagggaaaagcucauaaugggaggcuaauaacggcaaauccuguaguaacuaagaaagaagaaccagucaacauugaagcagaacccccuuuuggugaaucgaauaucguuaucgguauuggugauaaugcguuaaaaauuaauugguauaaaaagggaucuucgaucggaaaaauguuugaggcaaccgccagaggugcucgcagaauggcuauacuaggagauacugcaugggacuuuggguccguugguggugugcuaaauucacuaggcaaaaugguucaucaaauauuugggucugcguauacggcguuauuuagcggaguauccugggucaugaagaucggaauaggcguucuuuuaacauggauuggacuaaauucuaaaaauacgucuaugucauuuaguugcauugcaaucggaauaauuacauuauaucuuggggcagugguccaggcagauaugggauguguuauuaauuggaagggaaaagaguuaaaaugugguaguggaauuuucguaacgaacgaaguacacacuuggacagaacaauauaaauuccaagcagacucuccuaaacgguuggcaacagcaauagccggcgcuugggaaaaugggguuugugggauucggucuacaacccgcauggaaaauuuauuauggaaacaaauagcaaaugaauuaaauuauauucugugggaaaauaacaucaaguuaacggucguggugggagacauaauuggaguguuggaacaaggaaaaaggacucuaacgccccagccaauggaacuuaaauauuccuggaaaacuugggguaaggcaaagauaguuacagcugaaacucaaaacuccaguuucauaauagacgguccuaauacuccggagugccccucugucuccagagcuuggaacgugugggaaguagaagacuauggguuugggguuuuuacgacaaauauauggcucaaauugcgagaagucuauacacaacucugcgaucaucgauuaaugagugcggccguaaaagaugaacgagcugugcacgcagauaugggguauuggaucgaaucgcagaaaaaugguucguggaaacucgaaaaagcauccuugauagaagugaaaacauguacauggccgaaaucucauacuuuauggagcaacggaguacuugaaucugauaugauaauaccaaagucacucgcaggaccgauaagccaacauaaccauagaccgggguaccauacucagacagcaggcccguggcaccuaggcaaacuggagcuggauuucaauuacugugaagguacuacaguaguaauaacagaaaauuguggaacgcggggcccuagucuucguacaacaacgguaucaggaaaauugauucacgaauggugcuguagaucauguacccuuccaccauugcgauauaugggagaagauggauguugguaugggauggaaauaagaccaauaucagaaaaagaagaaaacaugguaaaaucuuugguaagcgccgguagcgggaagguugauaauuuuacgaugggcauucuuugucucgccauuuuguucgaagaggugaugagggguaaguuuggaaagaaacauaugauagcaggaguauucuuuaccuucguccuacuacuaagcggacaaauaacauggagggacauggcacacacccuuauuaugauaggauccaaugcuucugacagaaugggaauggggguuacauauuuagcccucaucgccacuuucaaaauacaaccguuuuuagcacucggauucuuuuuaaggaaacuaacaaguagagaaaaccuuuuacuagguguggguuuagccauggcaacuaccuuacaauuaccagaagacauugagcaaauggcaaauggaauugcgcucggcuuaauggcauuaaaacugauaacacaauuugaaacuuaucagcuauggaccgcuuuaauaagccugacguguucgaacacaauuuucacauuaacuguggcuuggcggacagcuacacuaauucucgcuggagugagccugcuacccgucugccagucaaguucgaugcggaaaacagauuggcuuccaauggcuguugccgcuaugggcguaccuccccucccucuauuuauuuuuaguuuaaaagauacgcuuaaaagaagaucauggccgcugaacgaagguguaauggcagucggcuuagugaguaucuuggcgucaagucuucuuaggaaugauguaccgauggccggaccucuuguugccggagggcuccuaauagcguguuacgucauaacggggacauccgcagacuuaacuguagaaaaagcugcagauaucacuugggaagaggaagccgaacaaacuggcguaucucauaacuugaugaucacaguagacgaugauggaacaaugcgcauaaaagaugacgaaacagaaaacauuuuaaccguauuacuaaagacugcuuugcuaaucgucagugguauauuuccuuauagcauaccagccacucuauuaguauggcauacguggcaaaaacaaacccaacguucuggcguacugugggauguaccuaguccgccagaaacacaaaaagcagaacuggaagaaggcguuuaucgcauuaaacaacaggguauuuuugggaaaacgcaaguagguguagggguacagaaagaaggugucuuucauacaauguggcauguuacacggggcgcuguacuaacauauaacgguaaaaggcuugaaccuaacugggccucuguuaaaaaggaucuaauuaguuacgggggcggguggagacuaagcgcacaauggcaaaaaggugaagagguacaagugauagccguagagccagguaaaaaccccaaaaauuuucaaaccaugccaggaacauuucaaacgacaacaggagagaucggugcgauagcccuugacuucaaaccgggcaccagugguucuccuauaauaaacagagaagggaagguuguaggucuauauggaaacgggguuguaaccaaaaauggcggauaugugagcggaaucgcucagacuaacgcugaaccagacgggccaacgccagaacuagaagaggagauguuuaagaaacggaauuugaccauuauggaucugcauccaggaucugggaaaacucgcaaguaucuaccagcaaucguuagggaagcgauaaggcguagguuacgaacgcuuauauuggcucccacaagggugguagcugccgaaauggaggaagcacuaaagggccuuccgauacgcuaccaaacgacagccacaaagucugaacacacuggaagagagauuguggacuugaugugccaugcuacuuucacaaugagguuacucucuccaguacgaguccccaauuauaaccucauuauaauggacgaagcucauuuuacugacccggcuaguaucgccgcucgaggcuacauuucuacaagaguuggaaugggagaagccgcugcaauauuuaugaccgcaacuccucccgguacggcagaugccuuuccgcaaucaaaugcccccauacaagacgaggaaagggauauaccugaaagaaguuggaacucuggaaacgaauggauaacagauuucgcugggaaaacaguaugguuuguacccuccauaaaagcugguaacgacauugcaaauuguuuacgcaaaaacggcaaaaagguaauacaacucucgagaaaaacguuugauacagaauaucagaaaacaaaauuaaaugacugggacuuuguugugacuacugauauaagugagaugggugcaaauuuuaaagccgaucguguuauagauccccgccgauguuugaaaccugugauucuaacagauggaccagaacgagugauucucgcuggcccaaugccuguaacugcagcaucagcagcccaaagacgcgguagaguaggcagaaacccucaaaaagaaaaugaccaauauauauucacuggacaaccguuaaauaaugacgaagaccacgcacauuggacugaagcgaaaaugcuguuagauaauauaaauacgccagagggcauuauaccagcacuauucgagccagaaagagaaaaguccgcagcaauagacggggaauaccgauuaaaaggcgagucucgaaagacguuuguggagcuaaugcgacgcggagauuuacccguuugguuagcucauaaaguagcaagcgaaggaauaaaguacacagaccguaaaugguguuucgacgggcaacgaaacaaucaaauccucgaagaaaauauggaugucgagauuuggacuaaggaaggugagaaaaagaaguugcgacccagaugguuagacgcgaggaccuacucggauccucuugcgcuuaaagaauuuaaggaauuugcagcugggagaaaaucaaucgcacuagaucucgugacagaaauagggagaguuccaagucacuuagcgcauaggacgcgaaaugcacucgauaauuuagugaugcuacauacaucagagcacgguggcagagcauaccgucacgcaguugaggaacuucccgaaacgauggaaacauuauuacuacuaggauuaaugauuuuacuuaccggaggcgccaugcuauuuuuaauuucaggaaaggguauaggaaaaaccaguauaggucucauuuguguuauugcaucauccgguaugcuuuggauggcugaaauaccccuucaauggauugcaagcgcgauagucuuagaauuuuucaugauggucuuguugauuccugaaccagagaagcaaagaacaccacaagacaaccaacucgcuuacguuguuaucggcauccucacucuagcagcaauuauugccgcuaaugagaugggacuauuagaaacuacaaaaagagaucuaggaaugucgaaggagccaggcguugucucuccaaccucguaucucgacguggaucuucacccugcaucugcuuggacuuuauaugcgguagccaccacuguuauuacgcccaugcuaaggcauacuauagaaaacucaacagcaaauguuucauuggcugcuauagcaaaccaagcggugguauuaauggguuuggacaaaggauggccgauuucaaagauggaccuagggguaccauuauuagcucucggcuguuauucacaagucaauccacuaacacuuacggcugcaguauuauuacuaauaacccauuacgcaaucauaggaccaggauuacaggccaaagcaacuagagaagcccagaaacgaacugccgcaggaaucaugaaaaacccaacaguggauggaauuaugacaauugacuuagacccaguaauauaugacucaaaauuugaaaagcaacuaggucaaguuauguuacucguacucugcgcgguacaauuacuacuaaugcguacaucaugggcacuaugcgaagcgcuaacucuagcuacagggcccauuacaacccuaugggaaggaaguccagggaaguuuuggaacacaaccauagccgucaguauggcaaacauauuccgagggaguuaccucgcaggggcagguuuagcauuuucgauuaugaagaguguaggcacuggaaagcguggaacgggaucacaaggagaaacccuaggggaaaaauggaaaaagaagcuaaaccaacuaagucguaaagacuucgauuuauacaaaaagagcgggauuacagaagucgaccggaccgaagcgaaagaagguuuaaaaagaggggaaauaacacaucacgcaguuagccgugguagcgccaaauuacaaugguucgucgaaagaaacauggucauccccgaagguagagugauugauuuaggguguggaaggggaggcuggucuuauuauugugcaggacugaagaaaguuaccgagguccgaggcuacaccaaaggagguccgggccacgaagaaccugucccgaugucgacauaugguuggaacauuguuaaauuaaugucagguaaagauguauuuuaucuaccaccagaaaagugcgacacucuacuuugcgacauaggggaaaguagcccaucuccaaccguggaagaaucuagaacgauacgcguacuaaaaaugguugaacccuggcucaaaaauaaucaauucugcaucaaaguccuaaauccauacaugcccacgguuaucgagcacuuagaaaggcuccagagaaaacauggagguauguuaguucgcaauccacucucacguaacagcacacaugaaauguauuggauuaguaauggaacggggaauaucguugcgucagucaauaugguaucucgacuacuauuaaaccgauucacaaugacucaccgcaggccuaccauugaaaaagacguugaccuaggcgcaggcacaagacauguaaacgccgagccagaaacgcccaauauggauguaauaggagaaagaauaaaacgcauaaaagaagaacauaauagcacuuggcacuacgaugaugaaaaucccuauaaaaccugggcauaccacgggucauacgaaguaaaggcuacuggcucugcgaguucaaugauaaaugguguuguuaaacuccuuaccaaaccaugggacguaguuccuaugguaacccaaauggcgaugacagacacaacgccuuucgggcaacagagaguuuuuaaagaaaaaguagacacuaggacaccaagaucuaugccuggaacuaggagagugaugggaauaacagcggagugguuauggcguacuuuaggcaggaacaagaaaccgagacucuguaccagagaagaauuuaccaagaaagugcguacaaaugcagcaaugggagcaguuuuuacugaagagaaccagugggacucagcaaaagcagcgguagaagaugaagauuucuggaaacuugucgacagggaaagagagcuucauaagcuaggaaaaugcggaaguuguguuuacaacaugauggggaaaagagagaagaaacucggagaguucgguaaagcaaagggcucgcgggccauaugguauaugugguuaggcgcaagauaucuggaauuugaggcuuuaggauuuuuaaacgaagaucacugguucucgagagaaaauuccuauuccggugucgaaggggaaggucuucacaagcugggcuauauacuccgcgacauuucgaaaauacccgguggggcaauguacgcggaugacacugcaggcugggauaccagaauuacugaagaugauuuacauaacgaggagaaaaucacccaacagauggacccagaacaccggcagcuagcgaacgcaauauuuaaacuaaccuaccaaaauaaaguaguuaaaguacagagacccacgccuacuggcacugugauggauauaauuucaagaaaagaucaaagaggcagcggucaagucggcacauauggucuuaacacuuuuacgaacauggaggcacaauuaauaaggcaaauggaaggugaaggaguucugucgaaagcugaucuggaaaacccccauuuaccugagaagaaaauaacacaaugguuagaaacgaaagggguugaaagacuuaaacgaauggcuauaucaggagaugacugcguggugaagccuauagaugauagauucgccaacgccuuacuagcucugaaugauauggggaaagucaggaaggauauuccacaguggcaaccaaguaaggguuggcaugauuggcaacaaguaccauuuuguagccaccauuuccaugaauugauuaugaaagacggacgaaaguuaguaguaccuugcaggccccaggaugagcucauaggccgugcaaggauuucacaaggcgcagguuggucacugaaagaaacugcaugucucgguaaagcguaugcacaaauguggucacugauguacuuucacagacgagauuuaagauuggccucuaaugcuauauguucugcaguccccguacacuggguaccaaccucucguacgacauggucaauucaugcacaucaucaguggaugacaaccgaagauauguuaacaguuuggaaccgcguauggauugaggauaauccauggauggaagacaagacaccgguaacaacuugggaaaacguaccguaucuuggcaagcgugaagaccaauggugugguucgcucaucggacucaccucgagagcuacgugggcacagaauauaccaacugcuauucaacaaguuagaucuuuaauaggcaaugaagaguucuuggauuauaugccuucaaugaaaagauuucggaaagaagaggaaagcgaaggugcaaucugguaa

SEQ ID NO: 23230 - RNA, 9873 nt, Artificial Sequence
  derived and/or modified CDS sequence (opt6) from DENV-3__JF937626__SS-prME
acuucccuuuguuuaaugaugauauuaccugcagcacuugcauuucacuuaacuucaagggauggagaaccuagaaugauuguagguaaaaacgagcguggaaaaagccuguuauucaaaacugcuagcggaauaaauaugugcacacugauagcaauggaccuaggagaaaugugcgaugacacagugacauauaaaugcccacauauuaccgaaguggaaccagaggacauagauuguugguguaaucucacaaguacauggguaacauacggaaccuguaaccaagcaggagaacaucgcagagacaaacgaucaguggcacuagcgccacacguaggaaugggcuuagacacccgaacacaaacguggaugagugcugaaggggcguggaggcaaguagagaaaguugagacaugggcacuccgacacccaggauucacaauccuugcuuuauuucuugcccacuauaucggcacuucuuugacgcaaaaaguagucauauucauacuauugauguugguaacaccgagcaugacaaugcgauguguugguguaggcaaucgggauuucguagagggauuaaguggagcgacaugggucgauguaguucuagaacaugggggaugcgucaccaccauggccaaaaauaaaccgacgcuugauauagagcuccagaaaacagaagcaacgcaacuggccacacuaaggaagcucuguaucgaagguaaaauaacaaauauuacaacggauaguagauguccaacacaaggugaagcaacccuaccggaggaacaagaccaaaauuauguauguaaacauacauaugucgaucgcggauggggaaaugguugcgguuuguuuggaaagggaucguugguaacuugugcuaaauuccaauguuuggaacccauugaagggaaaguaguacaauacgaaaauuugaaauauacaguaaucauaacaguucacacuggugaucaacaucaaguggggaacgaaacccaaggagucaccgcggaaauaacgccccaagccaguaccacugaagcaaucuuaccagaguacgguacguugggccucgaauguaguccaagaacuggcuuagacuuuaacgaaaugauauuauuaaccaugaaaaauaaggcguggaugguccaccggcaaugguucuuugaccuaccuuuaccauggacaaguggagcaacaacugaaacaccgacuuggaaucguaaggaauuacucgucacauuuaaaaaugcacacgccaagaaacaagaagugguaguacuggggagucaagaaggugcaaugcacaccgcucuaacaggagcaacugaaauacaaaauucgggaggaacaaguauuuuugcaggacaccuaaaaugcagauuaaaaauggauaagcuagaauuaaaagguaugucauacgcgauguguacaaacacuuucguacuuaagaaagaagucagcgaaacacaacaugguaccauacuuauuaaaguggaauauaaaggagaagauguuccauguaaaaucccauuuucaacugaagacggccaagguaaagcucauaauggaagacugauuacagcaaauccuguaguuacuaagaaagaagaacccgucaacauagaagcagaaccacccuucggugagucaaacauaguaauagguauaggagacaaugcacuaaaaauuaacugguauaagaaagguucuuccauaggaaaaauguuugaggcuaccgcucgaggagccaggaggauggcgauacuaggagacacugcgugggauuuuggcagcgucgggggaguauuaaauagccuagguaagauggugcaccaaauauucggcagugcguauaccgcauuauuuucaggagugucauggguuaugaaaauuggaauaggcgucuuauuaacauggaucggacuuaauucgaaaaauacaaguauguccuuuaguugcauugcaaucgggauaauuacauuguaucuuggagcuguagugcaagcagauauggggugugugauuaauuggaagggaaaagaacucaaauguggaucugggauuuuuguaacaaaugaaguacacacauggacugaacaauauaaauuucaagccgacagcccuaaacggcuagcaacugcaauagcaggggcaugggaaaaugggguaugcgguauaaggaguacuaccaggauggaaaaucuucuguggaaacaaauagcaaaugaguugaauuacauccucugggagaacaacauuaaacuaacuguagucguuggggauauaaucggaguacuugaacaaggaaaacguacucucacaccgcaaccaauggaacuaaaauauaguuggaaaaccuggggaaaagccaagauugucaccgcggagacgcaaaauaguagcuucauaauagauggaccaaacacuccggaaugcccuucgguaucccgugcguggaacguuugggaaguagaagacuacgguuuuggugucuuuacaacaaacauauggcucaaacugcgagaaguauacacucaauuaugugaucacagacuuaugagcgcagcgguuaaagaugaaagggcaguucacgcagauaugggauacuggauugaaagucagaaaaauggcucauggaaacuugagaaggcgucacugauagagguaaagacauguacguggcccaagucgcauacucuuuggagcaauggaguuuuagaaucggacaugauuauacccaaaucucuugcaggucccaucucacaacacaaucaucgaccgggauaccauacacaaacggcgggaccuuggcaucuuggcaaguuagaacuagauuuuaacuauugugaagguacgacuguaguaauuacagaaaauuguggcacccgaggcccaucacuacgcacaacgacaguaucugggaaacuuauacacgaaugguguugccgaucauguacacuaccuccccuacguuacaugggagaggauggaugcugguacggaauggaaauuagaccuauuucugagaaagaggaaaacauggucaaaaguuuaguaucugcugggucugguaaaguagacaacuuuacaaugggagugcuuuguuuagcgauucuauuugaagaaguuaugagggggaaauucgguaagaaacauaugauugccggagucuucuucacguuuguccuucugcuaagcggacaaaucacuuggagggacauggcucacacacuaauuaugauaggcaguaaugcgucagacaggaugggaaugggaguuacuuauuuggcucugauagcaacauuuaaaauucaaccauuuuuagccuuaggcuucuuuuuaaggaaacuuaccaguagagaaaauuuacuucuaggaguaggcuuagcaauggcuacuacauuacaguuaccagaggauauagaacaaauggcgaaugggaucgcacuaggccuuauggcccugaaacugauuacacaguucgaaaccuaccaacuauggacugccuuaaucucgcugaccuguucgaauacaauauucacuuugacuguggcauggaggaccgcgacacucauucuagccggaguauccuuacuaccagugugccaaucaucgaguaugcgaaagacagacuggcugccuauggccgucgcugcuaugggugucccaccguuaccccuauuuauauuugggcugaaagauacguuaaaaaggagaucguggccccucaaugaaggagucauggcugugggauuagucagcauauuagcguccagucugcuaagaaaugauguaccaauggcaggaccacugguugcuggagggcugcuuaucgcgugcuaugugauaaccggaacgucugcagaccuaacaguagaaaaagcugcagauaugacaugggaagaggaagcagaacaaacgggaguuagccauaacuuaaugauaaccguagacgacgacggaaccaugcgaauaaaggaugaugagacugagaauaucuuaacaguacuacucaagaccgcucuacuaauaguaagcggaauauucccguauucaauuccagcgacuuugcuaguauggcauacauggcaaaaacaaacccaacgaaguggggucuuaugggauguuccuaguccucccgaaacacaaaaagcggaguuagaagaaggugucuaucgaauuaagcagcaaggcauuuuuggaaaaacacaagugggcgucggggugcaaaaagagggaguuuuccauacuauguggcauguaacucgcggagcgguacuaacauacaacggcaaacgacuugaaccuaauugggcaagugugaagaaagaucuuauaaguuauggcggcggauggcggcuguccgcacaguggcaaaaaggugaagaaguccaaguaauagcugucgaaccgggcaaaaauccuaaaaauuuucaaacaaugcccgggacauuucaaacuacgacaggagaaauaggugcuauugcccuagauuucaagccagguacaucuggcucaccaauaaucaauagagaagguaagguuguaggacuauauggaaacggcgucgucacuaaaaaugguggguacguaagcggaauagcccaaacgaacgcggaacccgauggaccgacuccagagcucgaggaggaaauguuuaagaaaagaaacuuaacuauuauggacuuacacccugggucggggaaaacaaggaaauaucucccugcaauagucagagaagcuaucaagagacgacuuagaacauugauauuagcaccaacuagaguaguagccgcagaaauggaagaggcuuuaaaagguuuaccaauuagauaucaaacaaccgcaacuaaaagcgaacauacuggucgcgaaauuguugaccucaugugucacgcuacuuuuacgaugagacuccucaguccaguacgagucccgaauuauaaucuuauaaucauggaugaggcucauuuuacggauccagcaaguauagccgcacggggauacauauccacacgaguuggcaugggagaagccgccgcaauuuucaugacggcuacaccgccaggaacugcugacgccuuuccacagagcaaugccccaauacaggacgaggaacgagauauaccagaacgaucuuggaacucagggaacgaauggauaacagacuucgccggaaaaacagucugguuugucccgucaauaaaagcugguaaugauauagcaaacuguuuaagaaagaauggcaagaaagucauacaguuaagucguaagaccuucgauacggaauaccagaaaacuaaacuuaaugacugggacuuuguuguaacgacggacauaucugaaaugggagcaaauuuuaaagccgaucgugucauagauccaaggaggugucuaaaaccaguuauuuugacugauggaccugaaagaguaauccucgcuggaccaaugcccgugaccgcugcuagugcugcacaacgucgcggacggguuggcagaaauccucaaaaagaaaacgaccaguacauuuucacugggcaaccucuuaauaaugaugaggaucacgcucauuggaccgaagcuaaaaugcugcucgauaauauaaauacucccgagggcauaauuccagcguuguucgaaccugaaagagaaaaaucugcagcgauagauggagaguaucgacuuaaaggagaaucucgaaaaacuuuuguagagcuaaugagacgcggagacuugccuguguggcucgcucacaaaguagcaagugaaggaaucaaauacacagacaggaaaugguguuuugauggucagcgaaauaaccaaauauuagaggaaaacauggacguugaaaucuggacuaaggaaggagagaaaaagaaauuaaggccaagauggcuggacgcuaggacguacuccgauccucuggcacuuaaagaguuuaaagaguucgcugcagguagaaaauccauugcuuuagaccuugugacagaaaucggacgagucccuagccauuuggcacacagaacacgcaaugcguuagacaauuuggugauguugcacaccagugagcacggugggcgagcauauaggcacgcuguagaagaauuaccagaaaccauggagacgcuucuucuucuuggcuuaaugauacucuugaccggaggugcuaugcuuuuucuaauuagcggaaaagguauaggaaagacauccauuggacucauaugcgucaucgcaaguucagguaugcuauggauggcagagauaccgcugcaauggaucgcaagugcaauagugcuggaguucuuuaugauggucuuacuaauccccgaacccgaaaaacaaagaacaccacaggauaaucaacuagcuuauguaguuauaggaauccuaacucuagcagcaaucauagcagcgaaugagaugggucuccucgaaacuacaaaacgugauuugggaaugaguaaagaaccuggagugguaucgcccacaucauaucuagaugucgaucuucauccagcaagugccuggacacuguaugcaguagcaacaacuguaauaaccccgauguuacggcauacgauugagaacuccacagcgaacguaucguuagcagcaauagcuaaccaagcgguaguguuaauggggcuagacaaaggguggccuauaaguaaaauggaccuggguguaccucuguuggcacuuggauguuauagccaaguaaacccucugacuuuaaccgcugcaguuuuacuacuaauuacucauuacgcuauaauugguccgggguuacaagcgaaagcaacacgagaagcacagaaaaggaccgccgcggggaucaugaaaaauccaacuguagaugguaucaugacuauagauuuagauccaguaauauaugauucuaaauucgaaaaacaauuaggacaagucauguugcucguauuaugcgcaguacaauuacuauugaugcgcacuucgugggcauugugugaagccuuaacuuuagcuacagguccuauuaccacauugugggaagggucgccuggaaaauuuuggaauacaacgaucgcagugucuauggcaaauauauuucguggcaguuaucuggcaggcgccggucuagcauucucuauaaugaaaucuguaggcacagguaaacgagguacugguagccagggugaaacucuuggagaaaaauggaaaaagaaauuaaaucaacuaagcagaaaagauuucgauuuauauaagaaaucugggauaacugaaguagaccggacugaagcaaaagaaggacucaaaagaggugagauuacucaccaugcaguaucccgugguagcgcuaaacuacagugguuuguagaaagaaacaugguaguaccugaaggaaggguaauagaccugggcuguggcagaggagggugguccuauuauugcgcgggucuuaaaaagguaaccgaaguaagaggguacacaaaagguggaccagggcaugaagaaccgguacccaugucuacuuauggauggaacauuguuaaguuaaugaguggaaaagauguguuuuauuuaccacccgagaaaugugauacauuacuaugugauauaggggagucaucgcccuccccuacgguggaagaaucgagaacaauacggguauuaaaaauggucgaaccaugguugaagaauaaccaauuuugcaucaagguauuaaauccauauaugccaacaguuauugaacaucuagaacguuuacagagaaaacacggcggaaugcuuguacggaauccauuaagucgaaauucgacucacgaaauguacuggaucucuaaugguacaggcaauauaguagcgucuguuaacauggucagucgucuauuauuaaauagguucacuaugacacacaggcgcccaacaauagagaaagacguagaccuuggagcagggaccagacaugucaaugcggaaccugaaaccccuaacauggacgucauuggugaacgaauaaaaagaauuaaagaggaacauaauucaacuuggcauuaugaugaugaaaacccguauaagacgugggcauaucaugguaguuaugaagucaaggcgacaggcagcgcuuccucuaugauaaaugguguaguaaaauuacuuacgaagccgugggauguuguaccaauggucacgcagauggcaaugaccgauaccacgccauucgggcaacagcguguauuuaaagaaaagguagauacccguacaccaagauccaugccuggaacuagaaggguuauggguauuacagcagaauggcuuuggcgcacucuagggcggaauaaaaagccacgauuauguacucgcgaagaguuuaccaaaaaggugagaacuaacgcagcaaugggugccguuuucacagaggaaaaccagugggauagcgcaaaggccgcuguugaagacgaggacuucuggaaauuaguagacagggaaagggaauuacacaaacugggcaaauguggaaguugcguauauaauaugaugggaaaacgagagaagaaauugggagaauuuggcaaagcaaaagguucgagggcgauaugguauauguggcuuggcgcgcgcuauuuagaauuugaagcacucggguuucucaaugaggaccauugguuuucuagagaaaauucauauucugguguugaaggggagggauuacacaaguuaggauauauacuaagagauauuucgaaaauacccggcggcgcgauguacgcagaugauacagcgggaugggauacaagaaucacagaagacgauuugcauaaugaagagaaaauaacacagcagauggacccagagcacagacaacuugcaaaugcaauauucaaauuaacauaccaaaacaaaguagucaaaguccaacguccaacuccaacuggaacaguuauggauauaaucucuaggaaggaucaaagagggucuggucagguaggcacuuauggacucaacacauucacuaacauggaggcccaacuaauaaggcaaauggagggagaagggguuuuaucuaaagcagacuuagaaaauccucacuuacccgagaagaaaauuacccaauggcuagaaacuaaaggcguagaaagacugaaaagaauggcuauuucaggcgaugauugcguaguaaaaccaaucgacgaucgcuuugcgaaugcucugcucgcccugaacgacauggggaaaguaagaaaagauauaccucaauggcagccaucaaaagguuggcaugauuggcaacaaguccccuucugcagccaucauuuucaugaguuaauaaugaaagauggaagaaaauuggucgucccauguaggccacaagaugagcugauaggccgugcccgaauaucccaaggugcaggguggagucucaaagagacagcuugucuuggaaaagcauacgcacagaugugguccuuaauguauuuccauagaagggauuugagauuggcgucaaaugcuaucugcucggcaguacccguacacugggucccaacaucucgaacuaccuggucuauucaugcucaucaucaguggaugacaacagaggacaugcuaacugucuggaauagaguuuggauagaagacaauccuuggauggaagauaaaacaccgguaacaacuugggagaacguaccauauuuagggaaaagagaagaucaaugguguggaagucugauaggauuaacuuccagagcuacaugggcacaaaauauaccaacagcaauacaacaaguacgaaguuuaaucggaaacgaggaauuucucgauuacaugcccaguaugaaacgauuucguaaagaggaagaaagcgaaggggcuauuugguaa

SEQ ID NO: 23231 - RNA, 9873 nt, Artificial Sequence
  derived and/or modified CDS sequence (opt6) from DENV-3__JF937621__SS-prME
acuucgcuaugccugaugaugauauugccggcagcauuagcauuucaucuaacuagcagggauggugaaccacgcaugauaguugggaaaaaugaaagggguaaaucacuauuguuuaaaaccgcuagugguauuaauaugugcacauuaauugcaauggaccuaggugaaaugugugaugauacaguuacuuauaaauguccacauauuacagaaguagagccagaagacaucgauugcuggugcaaucuaacauccaccugggugacguauggaacguguaaccaagccggugaacauagaagggacaaaagaucuguugcuuuagcuccacacguaggaaugggacuugauacccgaacacaaacuuggaugucagccgaaggggcauggagacaaguugagaaaguggaaacaugggcgcuaagacacccuggguuuacaauauuagcucuauuuuuggcgcauuauaucggaaccucgcuaacacaaaaaguagucaucuuuauacuccuuauguuagucaccccguccaugacuaugcgaugcguaggagugggaaaucgugauuucguagaaggccucucaggggcaaccugggucgauguaguuuuagaacaugguggauguguuacuacaauggccaaaaacaaaccaacgcuggauaucgaacuccagaaaacagaggcgacacaauuggcaacucuaagaaaacuuuguauagaaggcaaaaucacuaacauuacgacagauucaagaugcccuacacaaggagaagcuaccuuaccagaagaacaagaccaaaauuacguaugcaaacauacguacguugauagagguuggggcaacgguuguggguuguucggaaaaggaucucuugugaccugcgcuaaauuccaaugccuugaacccaucgaaggcaaaguaguucaauaugagaauuugaaauacaccguuauuauaacugugcauacaggagaccaacaccaagucggaaacgaaacucaaggggucacagccgaaauuacuccccaagccaguacaacagaagcuauccuaccugaauaugguacucuuggcuuagaaugcuccccucgaacagggcucgacuucaacgaaaugauacuucugacuaugaaaaauaaagcauggaugguucauagacaaugguucuuugauuuaccccuuccauggaccaguggagcaacaacagagacgccaacauggaaucgaaaagaguuacuugugaccuuuaaaaacgcacaugccaagaaacaagaagugguaguacucgguucucaagaaggugcgaugcauacggcacuaaccggggcaacagaaauacaaaauucgggaggcaccuccauauuugcagggcaucugaagugcagacuuaaaauggacaaauuagaauugaagggcauguccuaugcuaugugcacaaauacguuuguccuaaagaaagaaguuagugagacgcaacauggaaccauuuuaaucaaaguagaauacaaaggugaagauguuccaugcaagauuccauuuagcacagaagauggccaaggaaaagcccacaacggcagacuaauaaccgcuaacccaguugugacuaaaaaggaggaacccguuaauaucgaagcagaaccaccauuuggcgagucaaacaucgugauaggaauuggagacaaugcacugaaaauuaacugguacaaaaaggggaguuccauaggcaaaauguucgaagcuacugcaaggggagcuagacgaauggcuauacuaggugacaccgcuugggauuuuggaaguguaggaggcguccuuaacagcuuaggaaaaaugguucaucaaauauucggaucugcauacacggcacuauuuucugggguuaguuggguaaugaagauugguauaggagugcuucuuacauggauagguuuaaauucgaaaaacacuucaaugaguuuuuccuguauagcaauuggcauaauaacacucuaucuuggugcaguaguacaagcugacauggguuguguuauuaacuggaaaggaaaagagcuuaaauguggcucaggaauauuuguuacaaaugaagugcacacuuggacugaacaauacaaauuucaagcggauucuccuaagagguuagcaacagcgaucgcuggagcuugggaaaauggaguuuguggcauaagaucgacaaccaggauggaaaaucugcucuggaaacaaauagcgaaugaauuaaauuauauauuaugggaaaauaacaucaaauuaacugucguggugggagauauuauuggaguguuagaacaagguaaaagaacacucacaccccaaccaauggaacuaaaguauucuuggaaaacuugggggaaggcaaaaauaguaaccgcagaaacccagaacucaucauucaucaucgacgggccaaacacuccagaauguccaucuguuaguagggccuggaacguuugggaaguagaagacuauggguuugguguauuuacaacaaacauaugguuaaaacuucgggaagucuauacucagcugugugaucauagacuaaugagugccgcagugaaggaugaaagagcgguacacgcggauaugggguauuggauugagagucagaaaaauggaucauggaaacuugaaaaagccucauuaaucgagguuaagacuuguacuuggccaaaaucccauacuuuauggucaaacggagugcuggaaagcgauaugauaauuccaaaaucucuagcgggaccuaucucgcaacacaaucauagacccgguuaucauacccaaacggcaggacccuggcaccuaggaaaauuggaacuugauuuuaauuauugcgagggaacuacagugguaauuacggaaaauugcgguacaagaggaccgucauuacguacuacaacagucaguggaaaacuaauacaugagugguguugccgaucauguacuuuaccaccccuacgauauaugggggaggauggaugcugguacggaauggaaauucgaccuauuagcgaaaaagaggaaaauauggugaaaucucuaguuagugcugguagugguaagguagacaacuuuacaaugggaguucuaugucuggccauacuuuuugaagaagugaugcguggaaaauucggaaagaagcauaugauugcggguguuuucuuuacauuuguguuacuacucagugggcaaauuaccuggcgagauauggcacauacccuuauuaugauagggucaaaugcaucggaccguaugggaaugggaguuacauaccucgcguuaauagcuacauucaaaauacaaccguuucucgcacuuggauucuuuuuaagaaaauuaaccucaagagagaaccugcuacucgguguaggacuggcuauggcaacaaccuuacaacuuccggaagacauagaacaaauggcgaacgguauagccuugggacuaauggcgcuuaaacuuauaacucaauucgaaacauaucaacucuggacagcacucauuagucuuacuuguucuaauacaauauuuacauuaacuguggcauggcgaacagcuacacugauacuugcgggagucucgcuauuaccaguuugucagaguucauccaugaggaaaacugauuggcuuccgauggcaguagcagcaauggguguucccccucucccacuuuuuauauuuggacucaaggauacucuaaaaagaagaucauggccacuaaaugaaggaguaauggcaguaggguuaguuucuauuuuagcgaguucauuguuaagaaacgauguaccgauggcuggaccucuaguagcaggcggguuacuuauagcaugcuauguaauaaccgguacaucugcagaucucacuguugaacgggcagcagauauaacuugggaagaagaggccgaacagacuggaguuucucauaauuugaugauaacaguugaugacgaugggacaaugagaauaaaggacgaugaaacagaaaacaucuugacgguacugcuuaaaacugcgcuauugauagucagcgggauauuuccuuacagcauaccugcuacgcuuuuaguauggcacacauggcaaaaacagacucaaagaaguggcgucuuaugggacguaccuucaccaccggaaacacagaaagcggaacucgaggaagggguguauaggauaaaacaacaaggcauauucggcaagacucaagucggcguaggcguucaaaaagagggaguguuucauacaauguggcauguaacgcgaggcgcuguacuuacuuauaacggaaagagacuagaacccaauugggcuucggugaaaaaggacuuaauuucauacgguggaggcuggagauuaucagcacaguggcaaaaaggcgaggaaguucaaguuaucgcaguagaaccgggcaaaaaucccaaaaacuuccagaccaugccaggaacauuucagacgacuacgggcgagauuggugcuauagcacuugacuuuaaaccagguacguccgggagcccaauuauaaacagagaagguaaagucguaggauuauaugguaauggagucguaaccaaaaauggaggguauguuagugggaucgcgcaaacuaaugcggaacccgacggaccaacaccugaauuagaagaagaaauguuuaagaaacgaaaccugacaauaauggaccugcauccuggaucagggaagacucggaaguacuuaccugcaauaguaagagaggcuaucaaaagaaggcuccgcacauuaauacuagccccaacaaggguaguggccgcagaaauggaggaagcucuaaaaggauugccaauacgauaccagacaacagcaaccaaaagcgagcauacgggucgugaaauaguagaucuaaugugucaugcaacguucacuaugcgacuauuaucacccguuagaguuccaaacuacaaccuaauaauaauggaugaagcacauuuuaccgauccagcuucaauugcugcgcguggguauaucagcacaaggguaggcaugggggaggcagcugcaaucuuuaugacggcaaccccucccggaacugcggacgcauuuccucaaucuaaugccccaauucaagaugaagaacgugauauaccugaacgaucguggaacucuggaaacgaauggauuacagacuuugcaggcaagacggugugguucguaccaucgauaaaagcggguaaugauaucgcgaacuguuugcguaaaaaugggaagaaaguaauacaacuuagccgaaaaacauuugacaccgaauaccagaaaacuaaauuaaaugauugggacuuuguaguuacuacagacauauccgagaugggagccaauuuuaaggcugauagagugauugaucccagaaggugucucaaacccguaauacucacagauggcccagagcgggucauauuagcagggccaaugccuguaacugcggcaucagcagcgcaacgcagagggaggguaggcaggaauccccaaaaagaaaaugaccaauauauauuuacuggccaaccucuuaauaacgaugaagaccaugcucacuggacagaagcaaaaaugcuguuggauaauauaaacacgccugaaggaaucauaccagcacuuuucgaaccugaacgugaaaaaucggcagcgaucgauggugaauaccgauuaaaaggugagucccgaaaaacuuucgucgaacuuaugcgucguggugacuugccggucuggcuugcgcauaaaguagccagugagggaauaaaauacacggauagaaaauggugcuucgauggacaaagaaauaaccaaauauuagaggaaaacauggauguugaaaucuggacaaaggaaggagagaagaagaaauugagaccccgcugguuagaugcucgaacauauagcgauccacuagcccuaaaagaauuuaaggaauuugcagccgguagaaagucuauagcuuuagaccucgugacagagauaggaagaguaccuucccaucuugcccaucgaacaagaaacgcucuugacaaucugguuaugcuucacacuucggaacauggaggcagagccuaccgacacgcuguggaagaacuuccggagacgauggaaacacuauugcuguuaggauugaugauauuauuaacaggaggugcgauguuauuuuugauaucgggaaaagggauagguaagacaagcauuggauugaucugcguaauugcuuccucaggaauguuauggauggcagaaauuccauugcaauggauagcuuccgcaauuguccuagaguuuuucaugaugguucuccuaauacccgaacccgaaaaacaaagaacaccacaagacaaccaauuagccuacguugucauagguauauugacauuagcggcgauaauagcagccaaugaaauggguuuacuagaaacaacuaaacgggaucucggaauguccaaagagcccggaguaguuucuccuacgucauauuuagauguagacuuacaucccgcauccgcguggacacuauacgcgguagcaacaaccgucaucaccccgauguuaagacauacgaucgaaaauucaacggccaacguuucauuagcagcuauugccaaccaggcuguaguucuaaugggacuggauaaaggcuggccaauuagcaaaauggaucuagguguuccucuccucgcacucggcugcuauagucaaguuaacccguuaacucugacagcggccgugcuuuuacucauaacucauuacgcgaucauaggaccaggacugcaagcaaaggccacacgggaagcucagaaaagaacagcagcuggcauaaugaaaaacccaacaguagacggaaucaugacuauagaucuugaucccguaauauacgauucuaaauucgaaaaacaauugggacaagugaugcucuuaguucuaugcgcaguucaacuguuauugaugcgcacauccugggcuuuaugugaagcccuaacacuagcuaccgguccuauaacaacauuaugggaagguucuccaggaaaguucuggaauaccacgaucgccgucaguauggcuaauauauuccgagguucuuaucuggcaggggccggacuugcguuuuccauaaugaaaucaguugguaccggaaaaagaggaacagggucacaaggugaaacgcucggcgaaaaauggaagaagaaauuaaaucaacuguccagaaaagauuuugauuuguacaaaaagaguggaauaacugagguggacagaacagaagcaaaagagggauuaaaaagaggagagaucacacaccaugcuguaucgcgugguucggcgaaguuacagugguucguagaacguaauaugguuauuccagaaggacgggucauagaucuaggcugcggaagaggugguuggucauacuauugugcuggucugaaaaaggucaccgaaguucgcggguauacaaaagguggaccuggacaugaggaaccugugccuaugagcacuuauggauggaauauugugaaauuaaugagcggaaaggauguauuuuaccuuccaccugaaaaaugugacacacuauuaugugauauuggcgaaucauccccuucaccuacaguagaagagagccguacaauacgcguacucaaaauggucgaaccguggcucaaaaacaaucaauuuugcauaaaaguccuaaauccauacaugccaacgguaauugaacaucuagaacgucuccaacgaaaacacggagguauguuaguaagaaaucccuuaucacgaaauucaacacacgaaauguauuggauaucaaaugggacagggaauauaguugcaagugugaacaugguaagucgccuucuucuuaaucgguuuacgaugacacauagaaggccaacgauagagaaggacguugaucugggagcgggaaccaggcacguuaacgccgaaccggagacaccaaacauggacguuaucggugaaaggauaaaacgcauaaaagaagaacauaauucuacuuggcauuaugacgacgagaauccuuauaaaacgugggcguaucaugguuccuaugaaguuaaggcaacuggcagugcaagcagcaugauaaauggaguagucaaauuguuaacaaagccaugggauguaguaccgaugguaacgcaaauggcuaugaccgauacgacuccauuuggccaacaacgcguuuucaaggaaaagguagauacaaggacaccgcggucaaugccgggaacgaggaggguaaugggaauaacugcugaaugguuauggagaacauugggaagaaauaagaaaccgagacuuugcacccgcgaggaauuuacaaagaaaguuagaacaaaugcugcgaugggagccguauuuacagaagagaaucaaugggauagcgcuaaagccgcgguugaggaugaggacuucuggaaacucguugauagggaacgagaguugcauaagcuaggaaaaugcgguagcuguguauacaauaugaugggaaaacgugagaagaaacugggagaauuuggcaaagcuaaagggucuagagcaauaugguauauguggcuaggagcacgauaucuagaauuugaagcgcuaggauuccucaacgaagaucacugguuuucaagggaaaauagcuauagugggguugaaggagaaggccugcacaaauuaggcuauauucuaagggauauuucgaaaauacccgggggagcgauguaugccgacgauacagcgggcugggacacuaggauaacagaagaugaccugcacaacgaggagaaaauuacacaacagauggacccugaacauaggcaacuagcaaacgcuauauucaaguugaccuaucaaaacaagguaguaaagguucagcggccuacccccaccggaacaguuauggacauaauaucaagaaaggaccaacggggaaguggccaggucgguacauacggguuaaauacuuucaccaauauggaagcgcaauuaauaaggcagauggagggugaaggagugcugagcaaagcggaucucgaaaauccccaucuacccgagaagaaaauaacucaaugguuagaaacaaaaggcguagagagauuaaagagaauggcaauaaguggagacgauuguguagucaagccaauagacgaccgauucgcaaacgcacuccuagcucuaaacgacauggguaaaguccggaaagauauaccgcaauggcaaccaucaaagggguggcacgacuggcaacaaguaccauuuugcagucaucauuuccaugagcucauaaugaaagauggaagaaaguuaguagugccauguaggccacaagaugagcuuaucggacgggccagaauaagccaaggagccgguuggagcuugaaagaaaccgcauguuuagguaaagcauacgcucaaauguggucuuuaauguacuuucacagaagagaucugcguuuagcaucuaaugcgauauguucggcggucccuguacacugggucccaacaucaagaacgacauggucaauacacgcucaccaucaauggaugacuaccgaagacaugcuaacugucuggaaucguguuuggauagaagauaauccauggauggaagauaaaacgccagucacaacaugggaaaacguaccuuauuuagggaaaagagaagaucagugguguggcucgcuuauuggucuaacuucgcgagcaacaugggcccaaaacaucccaacugcaauacaacaaguaagaaguuugauuggaaacgaggaguuucuugacuauaugccaaguaugaaaagauuccgaaaagaagaagagucugagggagccaucugguaa

SEQ ID NO: 23232 - RNA, 9873 nt, Artificial Sequence
  derived and/or modified CDS sequence (opt6) from DENV-3__JF937623__SS-prME
gcuucccuuugcuuaaugaugauauuaccagcggcacuugcauuccaucuaaccaguagggauggugaaccuaggaugauuguagguaaaaaugaaaggggaaaaucauuacuauuuaaaacagcaagugggaucaacaugugcacuuuaauugcaauggaccuuggggaaaugugugaugauacgguaacauauaaauguccacacaucaccgaagucgaaccugaagauauagacuguugguguaaucuaacaaguacuugggugacauauggaacguguaaucaagccggggaacacagacgugauaaaagaucaguugcccuagccccacaugucgguaugggcuuggacacaagaacacaaacauggauguccgcagaaggagcauggcgacaagucgaaaaaguugaaacuugggcacuacgucauccgggauuuacaauacuggcucuguuuuuagcccacuauauaggaacuucguugacucaaaaaguagugauuuuuauacuauugaugcuagucacccccucuaugacgaugcgaugcgugggcguaggaaaccgagauuucguggaagggcucaguggagcuaccuggguagacguaguauuagaacacggugguuguguaacaacaauggccaaaaauaaaccgacacuagacaucgagcuccagaaaacggaagcaacacaauuggcuacccugcgcaaacuguguaucgaggguaaaauaaccaacauaacaacagacucucgcugcccaacucaaggcgaagcaacuuuacccgaagaacaagaucaaaacuacgucuguaaacacaccuauguugaccgaggaugggggaacgguuguggucuguucgggaaaggaagccuuguaacuugcgcgaaauuccaaugcuuggaaccuauugagggaaaaguugugcaguaugagaaucuaaaauauacaguaaucauaacugugcacacgggcgaucagcaccaaguugguaacgaaacccaaggagucacagcagaaauuacaccucaggcuucuacuacagaagccauucuaccagaguacggaacacuaggcuuagaauguuccccuagaaccggacuugacuucaacgaaaugauacuauuaacuaugaaaaacaaagcauggaugguucaucgacaaugguuuuucgacuuaccgcuaccuuggacaucaggagccacaacugaaaccccaacauggaaucgaaaagaacugcuuguaacguuuaaaaaugcacaugcgaagaaacaagaaguuguaguucuuggaagccaggaaggugcgaugcacacugcucuaacuggcgcuaccgagauacaaaacagcggggguacuucaaucuuugcuggacaccuaaaauguaggcuaaaaauggauaaacuugaauuaaaagguaugucauacgcgauguguacuaauacauuuguguuaaagaaagaaguuucagaaacccaacacgggacgaucuuaauaaaaguugaguauaaaggagaagacguuccuuguaaaaucccauucagcacagaggauggccaaggaaaagcucauaacgguagacugauaacagcaaauccuguuguuaccaagaaagaggaaccuguaaauauagaagccgaaccucccuuuggagagucuaacauagucauaggaauuggagacaaugccuugaaaauaaacugguauaagaaaggaucgucaauagggaaaauguuugaagcaacagcuaggggagcaagaagaauggcgauucucggagacaccgccugggacuucgguucagugggaggggugcuaaauucacuagggaagaugguacaucagaucuuugguucagcuuacacugcacuauucucagguguaucuuggguaaugaagauaggaauagggguuuuacuaacauggauaggccucaacuccaaaaauaccagcaugucguuuucguguauagcuaucgguauuauaacgcuuuaccuaggagcuguuguucaagcagauaugggauguguuauaaacuggaaggguaaagaauugaagugcggcuccggaaucuucgugacuaacgagguacauacauggacagaacaauacaaguuucaggcagauucuccuaaaagguuagcgacagcaauugcgggcgccugggaaaauggaguuugcggaaucagaucgacgacaaggauggaaaaccuacucuggaagcaaauugcaaaugaauugaauuauauauuaugggagaauaacauaaaauuaacuguuguuguaggugauaucauagggguccuagagcaagggaaacgaacccucacuccucagccuauggaguuaaaauauucauggaaaacauggggaaaagccaaaaucguuacugcagaaacucaaaacagcagcuucaucauugaugguccaaauacucccgaaugccccucugugucaagggcauggaauguaugggaaguagaggauuauggauucggaguauucacgacaaauauuuggcuuaaacucagggaaguauauacacaauuaugcgaccauagacuaaugagugcggcuguaaaggaugagagagcaguacaugcugauaugggauauuggauugaaagucagaaaaauggaagcuggaaacuugaaaaagccucguuaauagaaguuaaaacuuguacuuggccuaaaucccacacacuuuggucaaauggaguuuuagaaucugauaugauuauucccaaaagccuggcuggaccuauuagucaacauaaccacaggccgggcuaucauacucagacggcaggcccauggcauuuaggaaaauuagaauuggauuucaacuauugcgaaggcacgacagucguaauaacugaaaauuguggaacacguggaccaagucuuagaacaacgacaguuuccggcaagcuaauccaugaauggugcugccgcuccuguacauuaccuccacuaagguauaugggugaggaugguuguugguauggaauggaaauccgaccaauuucggaaaaggaagaaaauauggugaagucauuaguuagcgccggaucugguaaaguagauaauuucacaauggguguucugugccuugcaaucuuauucgaagaaguaaugcgaggaaaauucggcaagaaacauaugauagccggaauauucuuuacauuuguacuauugcuaucaggacaaauaaccuggagagacauggcacacacuuuaauaaugauuggguccaacgcgucggaucggaugggaaugggggucacguaucuggcacuaaucgcaacuuuuaagauacaaccauucuuagcacuuggauuuuucuuaagaaaguugacaucacgugagaaucuacuuuuaggagucggauuagcaauggccaccacccuacaguuaccggaggacauagaacaaauggcaaacggcauagcucuuggacuuauggcucuaaagcuaauaacacaauucgaaacauaccaacucuggacagcucuaauaucauuaacuugcuccaacacgaucuuuacacuaacagucgcuuggaggacagcaacacuaauuuuagcagggguaagucuucucccaguuugucaaagcucauccaugcgaaaaacggauugguuacccauggcuguggcggccaugggcguuccaccccucccauuauuuauuuucggacucaaagauacauuaaaaagaagaucauggccccucaaugaagguguuauggcaguaggauuaguuaguaucuuggcaagcuccuugcuaaggaaugauguacccauggcaggcccauugguugccggugguuuguugaucgcuuguuacguaauaacagguaccucagccgacuuaaccguugaaaaggcggcugauaugaccugggaagaagaggcggaacaaacaggaguaucacauaauuugaugaucacuguggacgacgauggaacuaugcggauaaaagaugaugaaacugaaaacauucucacaguucuucuuaaaacugcgcuucuuauuguaagcggcauuuuccccuacucaauuccugcuacucuacucguguggcacacauggcagaaacaaacgcaacgauccgggguccuaugggacguucccucgccaccugagacucaaaaagcugaacuagaagaaggaaucuacagaauaaaacaacaaggaauauucggcaagacucaagucggaguaggaguccagaaagaggguguuuuccauacaauguggcacguuacacgcggagcgguacuuacauacaaugguaagcgauuagagccgaauugggcaucuguuaagaaagacuuaauuuccuauggaggaggcuggcgacuaucggcacaauggcaaaaaggagaggagguacaaguaauagcaguagaaccaggcaaaaauccgaaaaacuuccagacaaugccugggacauuccaaacaacaacaggcgagauaggggcaauugcccuggauuuuaagccgggaacaaguggaucaccgauaauuaacagagaagguaagguaguagggcucuauggaaauggaguaguuaccaagaauggugguuaugucaguggaauugcacaaacuaaugcagagccggacgguccaacacccgaacuugaagaggaaauguucaagaaacgaaauuuaaccauuauggaccuucauccagggaguggaaaaacgcgaaaguaucucccagcuauaguaagagaggcaauaaaacgcagacuaaggacacucauuuuagcuccaacaaggguuguugcagcagaaauggaagaagccuuaaaaggauuaccaaucagauaucaaacgacugcaacaaaaucagaacacacagggagggaaauugucgacuuaaugugccacgcgacuuucacuaugcgauuguuaucuccaguuagaguaccgaauuauaaucuuauuauuauggaugaagcccacuuuacagaucccgcuagcauugccgcuagagguuauauauccacaagaguugggaugggugaagcggcagcuaucuuuaugaccgcaacacccccaggaacagccgaugcauuuccgcaaaguaaugcaccgauacaagaugaggaaagagacauaccugaaaggagcuggaacucugguaaugaauggauaaccgauuuugcugggaaaacagucugguuuguaccuaguauaaaagcagggaacgauauagcaaauugccugaggaagaaugguaagaaaguaauacaauuaagccgaaagacguuugauacugaguaucaaaagacuaaacuuaaugacugggauuucguaguaaccacagacauaagugaaaugggggcaaauuuuaaagcggauagaguuaucgauccccgcagaugcuuaaaaccugucauauuaacugauggcccagaaaggguaauauuagcuggacccaugccuguaacagcagcuucagcggcccaacgaaggggaagagugggcaggaauccucaaaaagagaaugaucaauacauuuuuaccggccaaccuuuaaauaaugacgaagaucacgcacauuggaccgaagcaaaaauguuguuagacaauauaaacacgccagaaggaaucauucccgcgcuauuugaaccugaaagggaaaaaucugccgcaauagauggagaauacagacuaaagggggagucgagaaagacuuuuguggagcuuaugcgacguggugaucuaccaguuugguuagcucauaaagucgcuucggaagguauaaaguauacugaccgcaaaugguguuuugauggacaacgaaacaaucagauucuggaagaaaacauggauguagagauuuggacaaaggaaggagagaagaagaaacugaggccacgaugguuagaugcucggacauacucagauccacuggccuugaaagaguucaaagaguucgcugcagggcgaaaaucaauagcuuuggaccugguaacggagauagggcguguaccuagucaccucgcacaucguacaaggaaugcccuugacaauuuaguaaugcuacauacuucagaacaugggggacgagcuuaucgacacgcaguagaagaauuaccagaaacuauggaaaccuuacuacuccuaggccucaugauauugcuaacuggaggagcaaugcuauuccugauuucugggaaaggaauagggaaaacauccauaggcuuaauauguguaauagcuucgucugguauguuauggauggcagagauaccgcugcaguggauugcgagugcaauuguacuagaguucuuuaugaugguacuccuaauacccgaaccagaaaaacaacgaaccccucaggauaaccaauuagcauauguaguaauaggaauauuaacguuagcagccauaaucgcggcaaacgaaaugggacuacuagagacuaccaaaagggaccucggcaugaguaaagaaccaggaguaguaucgccaacgucguaucucgauguagauuugcacccugcauccgcuuggacuuuauaugcugucgcaacuaccguaauuacgccaauguuaagacacaccauugaaaauuccacggcaaacgugucacuugcagcaaucgcaaaucaagcgguggugcuaaugggauuagauaaaggcuggccgaucucaaaaauggaucuggggguaccucuguuggcacuaggguguuauucucaaguaaauccauuaacuuugacugcagcaguauuacuauuaauuacgcauuaugcaauuauaggaccugggcuacaggcuaaagcaacuagagaagcacaaaagaggacugcugcagguauuaugaaaaauccaaccguagauggcauaaugacuauugaucuagauccagugauuuacgacagcaaauucgaaaaacaacuaggucaaguuaugcuucuagucuuaugcgcaguucaacuauugcuaaugcgaacaucuugggcauuaugcgaggccuugacucuggccacagguccaaucacaacacucugggaagguucgcccggaaaauucuggaauacaacuaucgcgguaucaauggcaaacauuuuccgaggaagcuauuuagcuggagcagguuuagcauuuagcauaaugaaguccguggggacaggaaagagagggaccgggucacagggagaaaccuuaggggaaaaauggaaaaagaaauuaaaucaguuaucgagaaaagauuucgaucuauacaagaaaucuggaaucacagaaguagacaggacugaagcaaaagaagguuugaaaagaggcgaaauuacccaccacgcuguaagucgagguagugccaaguuacaaugguuuguggaacgaaacaugguaauuccagaagguagagugauagauuuagguugugggagaggaggguggaguuacuacugcgcagguuugaagaaaguaacagaggugcguggauauaccaaaggaggccccggccacgaagaacccguaccaaugucaacuuacggcuggaauauaguuaaguuaauguccggaaaagauguauucuauuuaccgccggagaaaugugauacacuuuuaugugauaucggagaaucaaguccuucaccuacaguagaagagucucgcacaauaagagugcuaaaaaugguugaaccauggcuuaaaaauaaccaauuuuguaucaagguacuaaauccguacaugccaacuguaauugagcaccuagaacgauuacaaaggaaacacggaggaaugcugguacgcaauccauugagccgaaauucgacucaugaaauguacuggauuucaaauggaacggguaauauagucgcaagcguaaacaugguaaguagacuuuuauuaaaucgauucacuaugacacacaggcgaccuacaauagaaaaagauguggaccugggugcagguacgagacaugucaacgcugagccggagacaccgaacauggacguuauuggagagaggauuaaaaggauaaaagaagaacauaauagcacuuggcacuaugacgaugagaacccuuauaaaacaugggcauaucauggauccuaugaggucaaggcaacaggaagcgcuagcucuaugauaaacgggguggugaaacuacuaacuaaaccgugggacguagugccgaugguuacucaaauggcgaugacagauacgacgcccuuuggacaacaacgaguauucaaggagaagguagauacgagaacuccgagaucgaugccaggaacgaggcgaguaaugggaauaacagcugaauggcuauggagaacacugggcaggaauaagaaaccccggcuaugcacgagggaggaauuuaccaagaaaguaagaacaaacgccgccaugggugcuguauucacggaagagaaucaaugggacagcgccaaagccgcuguagaggacgaagacuuuuggaaacuuguugaucgagagagggaauuacacaaacuagggaaaugcggcucgugcguuuauaauaugaugggaaaacgugagaagaagcugggcgaauuuggaaaagcaaaagggucuagggcaauaugguacaugugguuaggagcacgcuauuuagaguuugaagcacuugguuucuuaaaugaagaucauugguucucgagagaaaacucauacucuggggucgaaggggaaggauuacacaaacuagguuauauuuugagagacauuucuaaaauaccaggaggugcaauguaugcggaugauaccgcugggugggacaccaggauuacugaagacgaucugcauaacgaagagaaaaucacacaacaaauggauccugaacaucgucaacuagcgaacgcaauauuuaaacuuacuuaccaaaauaaaguggucaaaguacaaagaccaacaccuaccggcacgguuauggauauuauaaguaggaaggaccaaagagguuccggccaagucggcacuuauggccuaaauacauuuaccaauauggaggcucaguuaauucgacagauggaaggugaagguguucucuccaaggcagaccuugaaaauccacauuuacccgagaagaaaauuacgcaauggcuugaaacaaaagggguggagagguuaaaaagaauggcaauaaguggagacgauugcguuguuaaacccauugaugacagguuugccaacgccuuauuagcgcuuaaugacauggguaaaguccgcaaggacaucccgcaauggcagccgagcaaaggauggcacgauuggcagcagguccccuuuuguagucaccauuuucaugaacuuauuaugaaagauggcaggaaauuaguagucccaugccguccacaagacgaguugauaggacgagcucgaaucagccaaggagcgggcuggucauugaaagagacagcguguuuagguaaagccuaugcucaaauguggucucuaauguauuuucaucgucgcgaccuuagauuggcaagcaaugcuauuugcucugcaguaccuguucacugggucccuaccucgagaacuacuugguccauacaugcgcaccaucaauggaugacuacugaagacauguugacaguauggaacagagucuggauugaggauaauccuuggauggaggauaaaacuccagucaccacuugggaaaacgucccuuacuuaggcaaaagggaagaccagugguguggaucuuuaauagggcuuacuucccgagcuacaugggcccaaaacauaccaacggcaauucaacaaguacggucauuaauaggcaacgaagaauuucuagauuacaugccauccaugaagagguuuagaaaggaagaagagagugaaggggcuauuugguaa

SEQ ID NO: 23233 - RNA, 9873 nt, Artificial Sequence
  derived and/or modified CDS sequence (opt6) from DENV-3__JF937637__SS-prME
accagcuuaugccuaaugaugauuuugcccgcugcgcuggcauuucaccuaacaaguagggauggagaaccacguaugaucguggggaaaaaugaaagagggaaaagucuauuauuuaaaaccgcaucugguauuaauaugugcacuuuaauagcaauggaccugggagaaaugugugaugauacaguaacuuacaaauguccucacauaacugaaguagaaccagaagauauagauuguugguguaaucuaacgagcacauggguaacauacgggacuugcaaucaggcaggagaacauaggagagauaaacguucaguggcuuuagcaccccacguagguaugggacuagacacacgaacucaaacguggaugucagcggaaggagcauggagacaagucgaaaaaguugaaacaugggcuuuaagacacccaggguuuacgauacuagcauuauuuuuagcccacuauauagguacgaguuuaacucagaaaguugucaucuuuauacuauuaauguuaguaacuccuaguaugacaaugcgaugcguagguguaggcaacagagauuuuguugaaggacuaaguggagcuacauggguagacgugguacuggaacauggaggaugcguuaccacuauggccaaaaauaaaccaacgcuugacauagaacugcagaaaaccgaagcaacacaauuagcuacacuucgaaaacuuuguauagaaggaaaaauuacuaauaucacuacagauuccagauguccaacacaaggagaagcaacucuacccgaagaacaagaccaaaacuacguguguaaacauacauacguagaucguggcugggguaacggaugugggcuuuuugguaaaggaucucuuguuacaugugccaaauuucaauguuuagaaccuauugaagguaaaguaguccaauaugaaaaccuaaaauacacggucauaauaacagugcacacgggagaucagcaucaaguaggcaaugagacccaaggugucacugcggaaauaacuccccaagcaagcacaacugaagcuauuuuacccgaauauggcacguugggacuggaauguaguccacggacaggucuugauuuuaacgaaaugauucuauuaacaaugaaaaauaaggcuuggaugguacaccgccaaugguucuuugaccuaccauugccauggacgagcggugccaccacugaaacacccaccuggaauagaaaagaguuguuaguaacguuuaaaaaugcucacgcuaagaaacaagaaguagugguacucgguucccaagagggagcaaugcauacagcacugacaggugcgacagaaauucaaaauucuggagguacuuccauauuugccggucauuugaaaugucgguugaaaauggacaaauuagaauugaaagguaugucauacgccaugugcacaaacgcauuugugcucaagaaagaaguaucagagacccagcauggaacaauucugaucaagguggaauauaagggagaagacguuccgugcaagauacccuuuuccacggaagaugggcaaggaaaagcgcauaauggucggcuaauaacugcgaauccuguagucacaaagaaggaagaacccguuaacauagaagcugagccaccguuuggagaauccaacauuguuauaggaauaggcgauaacgcauuaaagauuaacugguauaagaaagguaguuccauaggcaaaauguucgaagcuaccgcaagaggggcacgacgaauggcaauacuaggagacacugcgugggauuuuggaagugucggugggguccucaauagucuagggaaaaugguacaucaaauuuuuggaagcgccuauacggcgcucuuuucaggugucucauggguaaugaaaauaggcauaggaguauuacugacauggaucggccugaacucuaagaauacgucuaugaguuuuaguugcauugcuauagguauaauuacuuuauacuuaggugcgguaguacaggcagauaugggauguguaauaaauuggaaaggaaaggaauuaaagugugguaguggaauauucguaacgaaugaaguacauaccuggacagaacaauauaaauuucaagcagauucuccaaaacgauuagcuacugcgauugcaggagcaugggaaaauggcgucuguggaauuagaagcacaacacgcauggaaaauuugcucuggaaacaaauugcuaaugaacuuaauuacauucuaugggaaaacaauauuaaacuaacaguaguagugggugauauuauaggaguccuugagcaaggaaaaaggacacuuacuccucagccaauggaacuaaaguacaguuggaagacguggggcaaagccaaaauugucacugcagaaacacaaaacucaaguuuuauaauugacgguccuaacacaccagaguguccaagcguaucacgagcauggaacguuugggagguugaagauuauggauucggagucuuuacaacaaacauauggcuaaaacuucgcgaaguuuauacccaacuuugugaucauaggcuaaugucugccgcagugaaggacgagagagcagugcacgcugauaugggguauuggauagaaagccagaagaacgguuccuggaaauuggagaaagcuaguuuaauagagguaaaaacaugcacauggccuaaaucacauacucuguggucuaauggaguacuagaaagcgauaugaucauaccgaagucucuagcuggaccgaucagucaacauaaucauagaccuggcuaucauacucaaacggcuggaccguggcaucuuggaaagcuagaauuagauuuuaauuauugugagggaacaacuguagucauuacagaaaauuguggaacuagaggaccaagucuucgaaccacaacggugucagguaaacuuauccaugaauggugcugccgaaguuguacccuuccuccgcuaagguauaugggagaggacggaugcugguauggcauggaaaucaggccuaucuccgagaaagaagagaauaugguuaaaaguuuagucagugcgggaagcgguaaaguagauaacuucacuaugggagucuuaugccuugcaauauuauucgaggaaguaaugagagggaaguucggaaagaagcacaugaucgcggguguauucuuuacauuuguucuuuuauuaaguggccaaauuacauggcgcgauauggcacauacuuuaauuaugauagguucgaacgcuagcgauagaauggguaugggggucacauacuuagcuuuaauugccacuuuuaaaauacaaccauuucuugccuuaggcuucuuucuuagaaaauuaaccagcagggaaaaucuguugcucggcgucggucuagcgauggcaacuacccuacaacucccugaggacauagagcaaauggcuaaugguaucgcccuagggcucauggcacuuaaauuaauuacgcaauucgaaacauaucaguuguggacggcauugauaucauuaacaugcucaaacacaaucuuuacgcucacgguagcuuggaggacggccacguugauacuggccggaguaagucugcuaccagugugccaaaguucuagcaugcgaaaaacugauuggcuaccaauggcgguugcagcgauggguguuccaccauuaccucuauucaucuucgguuuaaaggacacauugaaacggcgaucauggccauuaaaugaagguguuauggcaguuggccuaguaagcauccuugcauccagccuacucagaaaugacgugcccauggccgguccauuaguugcaggaggccuucuuauagccuguuacgucaucacgggaacaucugccgauuugacuguugaaaaggcugcggauauaacuugggaagaagaagcugagcaaacuggaguaagucacaaucugaugauaacugucgaugacgacggcacuaugaggauaaaagaugaugagaccgagaacauccucacggucuuauugaagacagcuuuacuaauaguaagugggauauucccuuauucgauacccgcuacucuauuaguuuggcacaccuggcaaaagcaaacccagcggagugguguccuuugggacguccccucaccaccagaaacacaaaaagcugaauuggaggagggaguuuaccgaaucaaacaacaggggauuuuuggcaaaacucaggucggaguuggaguucagaaagagggaguuuuucacacaauguggcacguaacccgaggagcgguucuaaccuacaauggaaagcgacuagaaccgaauugggcauccguuaagaaagaucucauuuccuauggagguggcuggagauuaucagcgcaguggcaaaaaggggaggaaguacaagucauagcaguugaaccugguaaaaacccuaagaauuuucaaacaaugccaggcacuuuucagaccaccacgggcgaaauuggggccauagcacuagacuuuaagcccggcacuagcggcaguccaauuauaaaccgggaaggaaaaguaguuggguuguauggaaauggagucguuacuaaaaacggaggcuauguaucggguauugcgcaaacaaaugcagaaccggacggcccaaccccugaauuagaagaagagauguuuaagaagcgcaaucucacuaucauggaccuacacccuggcucagggaaaacucggaaauauuuaccugcuauaguaagagaagccaucaaaagacggcuaagaacauuaauacuggcuccaacaagagucguggccgcugaaauggaagaagcacuuaaaggauuaccuauucgguaucaaacgacagcuacaaagucugaacauacgggaagggaaauaguggacuuaaugugccaugcaacauucacaaugaggcuacuuucaccaguaagagugccuaacuauaauuuaauaauuauggaugaggcucacuuuacugaucccgcaagcaucgcggcccgaggauacauuagcaccagaguugguaugggugaagccgccgcuauuuuuaugacagcuacgccaccagggacagccgaugcuuucccucaaucaaaugcacccauccaagaugaggaaagagauauaccagaaaggucauggaacucuggcaaugaauggauuacggauuuugcgggaaaaacagugugguuuguacccucaauaaaagccgguaaugacauagcuaauugucuacgcaaaaaugggaagaaaguuauccaacugaguagaaaaacuuuugauacugaguaucagaaaacuaaacuuaacgacugggacuuuguugugacaacagauauaagugaaaugggcgcaaacuuuaaagccgaucggguuauagacccucgaagaugccucaagcccgucauacuaacagacggaccagagagggugauacuagcugguccaaugccuguaacugcagcaagcgcggcucaacgucguggacguguaggaagaaacccacaaaaggagaacgaccaauacauauuuacaggucaaccccucaacaaugacgaggaucacgcacauuggacugaagcaaaaaugcucuuagacaauauaaacacuccugaaggcaucauuccugcacuuuuugaaccagaaagagagaaaagugcagcuaucgacggcgaguacagacuaaaaggcgagucaagaaaaacguucguagaacuuaugagacguggugaucuuccuguauggcuagcacacaagguggcaagugaaggaauuaaauacacagaccgcaagugguguuucgauggacaaagaaacaaccagauccuugaagaaaacauggauguugagauauggacuaaagaaggagagaagaagaaauugcgaccacgauggcuugaugcuagaacauauagugauccauuggcauuaaaagaauuuaaagaauuugcggcagggagaaaaucuauugcgcucgaccucguaacggaaauuggucgaguuccuucacauuuagcacaccgaacgcgaaacgcgcuugauaauuuaguaauguuacauacuucugaacauggaggcagagcuuaucgacacgccguggaagaacuaccagaaacaauggagacauuacuucuauuagguuugaugauacuacuaacaggaggagccauguuguuuuuaauuucggguaaaggaauaggcaaaaccucaauuggucuaaucugcguaaucgccaguucagguaugcuuuggauggcugaaauaccacuacaguggauagcuucugcuaucgugcucgaguucuuuaugaugguauuauugauaccugaaccagaaaaacaaagaacaccacaagauaaccaauuagcauaugucguaaucggcauccuaacacuagcagccaucauagcugcaaacgaaaugggacuguuggaaacaacuaaaagggauuuagguaugaguaaagagccagguguagugaguccaacgucauaccuggacguagaucuacacccagccagcgccuggacguuguaugcaguggccacaaccgucaucacaccaauguugagacauacaauagaaaacaguacagcaaaugucucacuagcagcuauagcaaaucaggcugugguauuaaugggacuugacaaaggauggcccauaaguaagauggaccuagguguaccguuauuagcacucggguguuauagucaaguuaauccauuaacacucacugcagcuguuuuacucuugauaacacacuacgcuauaaucggaccagguuuacaggcaaaagcgacucgugaggcucaaaagcguaccgcggccggaauaaugaagaaccccacaguagacgguauaaugacaauugauuuggaucccguuauauaugauucgaaauuugaaaaacagcuagggcaagugauguuacugguacuaugugcuguucagcucuuauuaaugcgaacaucuugggcccuaugugaggcauugacucuggcgaccggaccgauaacuacguuaugggaaggaagcccaggcaaauuuuggaauacaacuaucgcaguguccauggcaaauauauucagggguaguuaucucgcuggggcgggacuugcguucaguauaaugaaaagcguuggaacaggcaaacgagggacuggaucacagggagagacauugggugaaaaguggaagaagaaacugaaccaacuuucaagaaaagauuuugacuuauacaagaaaucuggaauaacggaaguagaccgaacggaggccaaagagggauuaaaaagaggggaaaucacacaccacgcuguaucuagaggcagugccaaauugcaaugguucguagaaagaaauaugguaauaccagaagggagaguuauugaucucggauguggaagggguggauggucauacuauugcgcaggauugaaaaaggucacagaaguacgaggauauacuaaagguggaccaggucacgaggaacccguuccaaugagcacuuacggcuggaauauugucaaauuaaugaguggaaaagauguauuuuaucugccuccagagaaaugugauacauuacuaugugacauuggcgaaaguucgcccuccccgacaguugaggaaucuaggacuauacgcguuuuaaaaaugguagaaccuuggcucaaaaauaaccaguucuguauaaaaguucuuaaucccuacaugcccacgguaaucgagcaccuugagaggcuccagcguaaacauggugggauguuaguccgaaauccacuuucgaggaacaguacccacgagauguacuggauuagcaacggcacaggaaacauuguugcuagcgugaacauggucagccggcuuuuacuuaaccgauucaccaugacgcauagacgcccaacaauagaaaaagauguggaucugggagccggcacaagacaugucaacgcugaaccagaaacgccaaacauggacguaaucggugaacgcauaaaaaggauuaaagaagaacauaauucuacauggcauuacgacgacgaaaauccauacaaaacuugggcauaucauggguccuaugaaguaaaagcaacgggaucagcuaguucgaugauaaauggggugguaaaauuauugacaaaaccgugggauguaguuccuauggugacgcagauggcuaugacagauacaacgccauucggccaacaaagaguguucaaagaaaaaguggauacaaggacacccaggucaaugccgggaacacgaagagugaugggaaucacagccgagugguuauggcgaacccugggaagaaacaagaaaccaagguuauguacucgagaagaauuuacgaagaaaguaagaacaaacgccgcaaugggagcaguauuuacagaagaaaaucaaugggauagugcaaaagcugcuguagaagacgaagauuuuuggaaauuagucgacagggagagagaacuacacaaguuaggcaaaugugguucuugugucuauaauaugaugggaaagagagagaagaaacuaggcgaguuuggaaaagcuaaaggaagucgugcuauaugguacaugugguuaggugcaagguaccuagaauuugaagcguuaggauuucugaaugaagaucauugguucagcagagaaaacuccuauaguggagucgagggggaaggucuacacaaacugggauauauauuacgagauauaagcaaaauuccagggggagcaauguacgcagacgauaccgcaggaugggauacuaggauuacagaggacgaucuacauaaugaagagaaaauaacacaacaaauggacccugaacaucgacaauuagcgaacgcaauuuuuaagcuaacguaucaaaauaaagugguaaaaguccagcgccccacacccaccgggacuguaauggacauuaucucacguaaagaccagcgcgguagcggacagguugguacuuacggccucaacacauuuaccaacauggaggcucaacuaauccgacagauggaaggugaaggagucuugcucaaagcagaccuugaaaacccacauuuaccagagaagaaaauaacucaauggcuagagacuaaaggaguugagagauuaaaaaggauggcgauaagcggugaugauugugugguuaagccgauagacgaucguuucgcaaaugcacuacuggcccuuaaugauaugggaaaaguacggaaagacauaccacaguggcagccaagcaaaggguggcacgauuggcaacagguaccauuuugcucccaccauuuucaugaauuaauaaugaaggaugguagaaaacucguuguacccugucgaccacaggaugagcuaauaggacgcgcuagaauaucacagggggccggcuggucucuuaaggaaacggcauguuuaggcaaagcauaugcccagauguggagucuaauguacuuucacagaagagaucuacgcuuagccaguaacgcaaucuguucagcgguaccuguacacuggguaccgacaaguaggacaacauggucaauccaugcacaucaccaauggaugacaacugaagauauguuaaccguauggaauaggguauggauagaggauaauccauggauggaagacaaaacaccaguuacuacaugggaaaacgugccguaucucggcaagcgggaggaccaaugguguggcagccuaauuggauugacaagucgcgcaacuugggcacaaaauauccccacagcaauucagcaaguuagaucauugauugguaaugaagaguuccuggacuacaugccgaguaugaaacgcuuucguaaagaggaagagucagaaggcgcaauuugguaa

SEQ ID NO: 23234 - RNA, 9873 nt, Artificial Sequence
  derived and/or modified CDS sequence (opt6) from DENV-3__JF937638__SS-prME
acaagccuaugucuauuaaugauacugccugcugcacuagcauuucaucuuacuaguagagauggcgaaccacgaaugauaguaggcaaaaacgaaagaggcaaaucauuauuauuuaaaacggccucuggcauaaauauguguacacuaauagcuauggaucuaggugaaaugugugaugacaccguaaccuacaaguguccccauauaacugagguggaaccugaggacauagauuguugguguaaccuaacgucgacaugggugacauacgguacuuguaaucaagcuggcgagcacagacgcgauaaaagaucaguagcauuggcaccucacguaggcaugggauuagauacaagaacccaaacguggaugagugcugaaggcgcguggcgacaagucgaaaagguugagacgugggcauuacggcauccgggauuuacaauccuagcacucuuucucgcacacuauauaggcacaaguuuaacccaaaaagugguaauauucauacuccuaaugcuuguaacuccgaguaugacaaugaggugcguugguguaggcaaucgugauuucgucgaaggccuuagcggcgcaacauggguagacgugguccuggaacauggcggauguguuacuacaauggcaaagaauaagccuacacuagacauagaacuacaaaaaaccgaggcgacacaguuagcaacguuacguaaacuauguauugaggggaagauaacgaacauaacuacggacucaagguguccaacucagggggaagcgacauugccagaagaacaggaccaaaauuaugucugcaaacauacguacguagauaggggaugggggaaugggugugguuuauuugguaaagggucacuagucacaugcgcaaaauuucaaugcuuagaaccaauugaaggaaaaguaguacaauaugaaaauuuaaaauacacuguaaucauaaccguucauacuggagaucaacaucaggugggcaaugagacccaagguguuacugcugagauaacaccacaggcaucuacuaccgaagcaauacuucccgaauacggcacacucggauuggaauguagucccaggacagguuuagauuuuaaugaaaugauauuacuaaccaugaagaauaaagcauggaugguccacagacaaugguuuuuugauuuaccacuuccuuggaccaguggagcgacgacggaaacucccacuuggaaucgcaaagaacugcuaguaacauucaaaaaugcccacgccaaaaaacaagaaguuguggugcuagguagucaagaaggcgcaaugcauacugcucugacuggugcgacugagauccaaaauucuggugguacgucaauuuucgcaggucacuuaaaaugucgcuuaaaaauggacaaacuagaacuaaaaggcaugagcuacgcaaugugcacaaacacauuuguucucaagaaagaaguaagugaaacccaacaugguacuauauuaauaaaaguagaauacaaaggagaggaugucccaugcaaaauuccauucucuacggaagaugggcaaggaaaagcccacaacggaagacuaaucacagcaaaccccguuguaacaaaaaaagaagaaccuguaaauauagaggccgaaccgccauucggagaaucuaauaucguuauuggaaucggcgauaaugccuuaaagauuaauugguacaaaaaagguagcucaauaggaaaaauguuugaagcaacagcuagaggcgcacgucggauggcaauauuaggcgauacggcgugggauuuuggaagcgugggaggaguccucaacucucucgggaaaauggugcaccaaauauuugguucagccuacacagcauuauucucaggugugaguugggugaugaaaauagggauaggugugcugcucacauggauaggauuaaauaguaaaaauacaaguaugucauuuuccuguauugcgauagggauuauuacacuauaccuaggggccguaguucaagccgacauggguugugugauaaauuggaaagggaaagaacuaaaauguggcagugguauauuuguaacuaaugaaguccauacguggaccgaacaguacaaauuccaagcagacaguccaaagcgcuuagcgacugcuauugcgggcgccugggaaaauggcguaugcggaauaagaagcacgacccgaauggaaaaucuuuuauggaaacaaauagcaaacgaauuaaacuacauucuuugggaaaauaacauaaaguugacuguuguaguaggcgauauaaucggaguacuggaacaaggcaagagaacacuaacaccccaaccaauggaacuuaaauauucguggaaaacauggggaaaagcuaaaauugugaccgcugaaacacagaacucaaguuucauuauagacgggccuaacacgcccgaauguccauccguaucccgagcauggaauguuugggaaguagaagauuaugguuucgggguuuuuacuacaaauauaugguuaaaacuucgagagguauauacacagcuaugugaccaucgucugaugagugcugccgugaaggaugaaagagcaguacaugcggacaugggcuauuggauagaaagccaaaagaaugggucuuggaaacuagagaaagccagccuuauagaaguuaaaaccugcaccuggcccaaaagucacacgcuuuggucgaauggcgugcuagagucggacaugauaaucccaaaaucguuggcugguccaauaucgcagcauaaccaccgaccuggcuaucauacgcaaacugcugggccguggcauuugggaaaacucgaacuagacuuuaacuauugcgaaggaacaacagucguaaucacagaaaauugugggaccagaggcccaucauugagaacuacgaccguuucugguaaacugauucaugaauggugcugcagaagcugcaccuugcccccccucagguacaugggagaagauggauguugguacggaauggaaauccguccaauuucggaaaaagaagaaaacaugguaaaaagcuuaguuucagcaggaaguggaaaaguagauaauuuuaccaugggaguucuuuguuuggccaucuuauucgaggagguaaugagagguaaauuuggcaaaaagcacaugauugcuggaguguuuuucacguucguucugcuauuaucaggccaaauaaccuggagagauauggcgcacaccuuaauuaugauugguucuaacgcaagugaucggaugggaaugggagugacguacuuagcauuaauugcgaccuuuaaaauccagccuuuuuuggcuuuaggauucuuuuuacggcgccuaacgucacgugaaaauuugcuacuugguguugggcuggcaauggcuacaaccuuacagcuaccagaagacaucgaacagauggcuaacggaauugcccucgggcugauggcacugaaauuaauaacacaauucgaaaccuaucaacuuuggacugcuuuaauaucauuaacuuguaguaauacuauuuucacacuaacaguagcauggagaacagcuaccuugauucuagcagggguaucguugcuuccaguaugccgaucuucgucaaugagaaaaacagacugguuacccauggcugucgcagccaugggcgucccacccuuaccacucuuuauuuuuagccuaaaggauacauugaagagacggucuuggccacuaaacgaggggguaauggcgguaggauuaguaagcauccuagcaucuagucucuugaggaaugacguacccauggccggaccauuaguagcggguggucuacuuauagcaugcuacguuauaaccggaacauccgcagaucuaacuguggaaaaggcagccgacauuaccugggaggaagaagcugaacagacaggcguaagccauaauuuaaugauaacaguagaugaugacgggacaaugagaauuaaagaugacgaaacagagaauauacuaaccguuuuacuuaagacagccuugcugauaguaagcgguauauuucccuauucaauuccugcaacguuacuuguauggcacacauggcaaaaacagacacaaaggucaggcguccucugggauguaccaaguccuccugaaacucagaaagcagaguuggaggaaggaguauacagaauuaaacaacaagguauauuuggaaaaacucaaguaggaguugguguacagaaggaaggugucuuccacacaauguggcacguaacaaggggugcugugcuuaccuacaacgguaagagauuagaaccaaacugggcgaguguuaagaaagacuuaauuagcuaugguggcgguuggcgacuuucugcucaauggcagaaaggagaagaagugcaaguaauagcgguagaaccuggaaaaaacccuaaaaacuuccaaaccaugccagguacguuccagacaacaacaggcgaaaucggggcaauugcacuagauuuuaaaccaggaacaagcggcuccccgauuauuaaucgagaaggaaaagucguuggauuauacggaaauggcguuguaaccaaaaauggcggauaugugagcgggauugcucaaaccaaugcggagccggacggcccaacaccagaacuagaagaagagauguuuaagaaacgcaacuuaacuauaauggaucuacauccuggaucuggaaaaacaagaaaguaucugccugcuaucguccgggaagcuauaaaaagaagacuacgaacucuuauacuagcaccgacuagggucguagcugcugagauggaagaagcguuaaaaggcuuaccgauucguuaucagacaacugcaacaaaauccgaacauacgggccgugaaauaguugaccuaaugugccacgcaacuuucacgaugcgacuauuaagcccaguacgaguaccaaacuacaaucucauuauuauggacgaagcccacuucacggacccagcaucuauugcugcuagaggauacauuuccacccgcguagggaugggugaagcggcugcaauauucaugacagcuacgccgcccgguacugcagacgcguuuccacagaguaaugcgccaauacaggaugaggaacgagauauaccugaaagaucauggaauagcgggaaugaauggauaaccgauuuugccgguaagacaguuugguuuguaccaaguaucaaagcagggaacgauauagcaaacugccugcgaaaaaaugggaaaaaaguaauucaguuguccagaaagacauucgacacagaguaccagaaaacaaaguuaaaugauugggacuuuguuguuacuacagacauaucugaaaugggcgcuaacuuuaaagcugacagaguuauagauccucgacgaugucuaaaaccuguaauuuuaacggacgguccagaacguguaaucuuagcugguccaaugccuguaacagcagcuucagccgcccaaaggcgcggaaggguagguagaaacccacagaaagaaaaugaccaguauaucuuuacuggccaaccacuuaauaacgacgaagaucaugcccauuggacagaggcuaaaaugcuguuagacaauaucaauacgccugaggggaucauaccagcccuauuugagcccgaaagggaaaaaucagcagcuaucgauggcgaauauagacugaaaggggaaaguaggaaaaccuucguagagcuaaugcgacgaggcgaccuaccgguaugguuagcucacaaaguugcuucagaaggaauaaaauacaccgacagaaaaugguguuuugauggucaacggaauaaucaaauccucgaggaaaauauggauguugagauuuggacuaaagaaggagaaaagaagaaauuacgcccaaggugguuagaugccagaacauauagugacccauuagcucuaaaagaauuuaaggaauucgcugccgggagaaaaucaaucgcucuagauuuaguuacggaaaucggucgugucccaagccacuuagcccacagaaccagaaaugcuuuagauaauuuaguaaugcuccauaccucagaacauggaggacgagcuuaccgucacgcaguggaggaguuaccugagacuauggaaacguuacucuuacuaggcuugaugauucucuuaacuggcggagcaaugcucuuccuaauaucagggaaagggauuggcaaaacaucgaucgggcuaauuugugucauagcaaguaguggaauguuguggauggcugaaauaccauuacaguggauagcgagcgcaauagugcuggaauuuuucaugaugguacuuuuaauacccgaaccggaaaaacaacggaccccgcaagacaaccaacuugcuuauguugugaucggaaucuugacauuagcggcgauuauagcugcgaaugaaaugggacuauuagaaacuacuaaacgugaccuuggaaugagcaaagaaccuggaguuguaucaccaacguccuaucuugacgucgaucuacauccagccucagcauggacacuauacgccguagcuacuacaguaauaaccccuaugcuccgccauaccauagaaaauagcacagccaauguuagucuugcugcgauagccaaucaagcaguaguucuaauggguuuggacaagggauggccgauuucaaaaauggaucuaggaguaccacuucucgcacugggauguuauagucagguaaacccucugacccucaccgcugcagucuuauuacuuauaacacauuaugcaauaauaggaccuggcuuacaagccaaagcaacucgagaagcacaaaaacguacugcugcaggaaucaugaaaaacccaaccguggaugguaucaugacuauagaccuugaucccgucaucuaugacagcaaauucgaaaaacaauugggucaaguaaugcuauuaguuuuaugugcaguucaacuucuucuaaugaggacuagcugggcauugugcgaagcgcuaacacuugcgacaggaccuaucacuacgcuuugggaaggaucgccggguaaauucuggaacacaaccauagcaguuaguauggcgaauauauuuagggggucguaucuggcaggugcgggauuagcguuuaguauuaugaaaucaguaggaacaggaaaacggggaacaggcagucaaggagaaacuuugggggaaaaauggaaaagaaaacuaaaucaauuaagucguaaagacuuugauuuauauaagaaaaguggaauaaccgaaguugacaggacugaagcuaaagaaggacugaaaagaggagaaauaacucaucaugcugugagcagggguagcgcaaaauugcaaugguuuguagaaagaaauaugguaacgcccgaagguagggugauagacuuggggugugguaggggaggcuggucuuacuauugugcuggacuaaaaaaaguuacagaagugaggggauauacaaaagguggcccuggacaugaagaacccgugccaaugagcacauauggguggaauauagugaaacuuaugucugguaaagacguauucuaccugcccccagaaaaaugcgauacacuauugugugacauuggcgagaguucacccucucccacaguagaagaaucuagaacuauaagaguauuaaagaugguggaacccuggcucaagaauaaucaauucuguauaaagguauuaaacccauacaugccaacaguuauagaacaucuagaaagacuacaacggaagcauggaggaaugcugguccguaauccuuuaagcagaaauucgacucaugaaauguauuggauauccaaugggacugggaauauaguugcaagcguaaauaugguaucucgcuuacuacugaaccgauucaccaugacucauaggcguccaaccauagaaaaagauguagaucuaggcgcaggaacgcgccauguaaacgcagaaccagagacaccuaauauggauguuaucggggaacguauuaaaagaaucaaggaggaacauaacuuaacauggcacuacgaugaugaaaaucccuacaaaacgugggccuaucacgggaguuaugaaguaaaagcuacagguucggcaucaucaaugauaaauggaguuguuaaauuacuaacuaaaccaugggacguagugccaauggucacacaaauggcgaugacagauacaacuccuuucggacaacaaagagucuuuaaagaaaaaguagauacacgaacaccuaggucuaugccugguacacguagagucaugggaauuacagccgaaugguuauggcgcacucucggucgaaauaaaaaaccacguuugugcacaagagaagaauuuacaaaaaaagugaggacgaacgcagcaaugggugcuguauucacugaagagaaccagugggauagcgcgaaagcggccguagaggaugaagacuuuuggaagcucguagauagagaacgggaauuacauaaacuggggaaaugcggaucauguguguauaauaugaugggcaaacgcgaaaaaaaguugggagaauuuggcaaggccaaaggcaguagagcuaucugguacauguggcucggcgcacguuacuuagaguucgaagcguuaggcuuccuaaaugaagaccacugguucagucgugaaaauagcuauuccggaguggagggagagggacugcauaaauuaggguacauccuaagggauauaaguaaaauccccgguggggccauguacgcugaugacacugcugguugggauacaaggauaacagaagaugauuugcauaacgaagaaaaaaucacucaacaaauggacccagaacauaggcaguuagcaaaugcaaucuucaagcuaacguaucaaaauaaaguagucaaagugcagaggccgacuccuacugguacgguaauggauauuaucucacgcaaagaucaaagagggagcggucaaguuggaacuuaugguuuaaauacauucacaaacauggaggcucaaauuaucagacaaauggaaggugaaggagucuuaucuaaagcagauuuagaaaacccgcaucuuccggagaaaaaaauuacacaauggcucgaaaccaaagggguagagagguugaaaagaauggcaauauccggcgaugauuguguaguaaaaccaauugaugauagauucgcaaacgcccuucuugcccugaacgauaugggcaaaguaaggaaggacaucccacaauggcaaccaucaaaaggauggcaugacuggcaacaagugccguucuguucacaucauuuccacgaacucauaaugaaagauggacgaaaacuggucgugccuugccguccacaggaugagcucauaggccgugcaagaauuagucaaggugcuggguggucguuaaaagaaacugcaugccucggaaaagcuuacgcacaaauguggucacugauguacuuccacagacgugaucuacgauuagcaaguaacgcaauauguuccgcagucccggugcacuggguuccgaccucuagaacaacauggagcauccaugcacaccaccaauggaugacuacugaagacaugcuuacgguguggaacagaguauggauagaggacaacccuuggauggaggauaagacaccgguuacuacgugggaaaaugugccuuacuuagguaaaagagaagaucaauggugcggaagucuaauaggucuaacaucuagggccacgugggcacaaaacauuccuacagcuauucaacaagucaggagcuuaauuggcaaugaagaguuucuagacuauaugccaucaaugaaacguuuucgcaaagaagaagaaucugagggggcuauaugguaa

SEQ ID NO: 23235 - RNA, 9873 nt, Artificial Sequence
  derived and/or modified CDS sequence (opt6) from DENV-3__JF937639__SS-prME
acuucguuauguuuaaugaugauauugccagcagcucuagcauuccaucuaacaaguagagauggagaaccccgaaugauaguaggcaaaaaugaacgaggaaaaagccuuuuauuuaaaacugcaucugguauaaacauguguacccucauugccauggaccuaggagaaaugugugacgacacaguaaccuacaaauguccucauauuacugaaguggaaccggaagauauugauuguuggugcaaucuuacuuccaccuggguuaccuaugguacaugcaaccaagccggugaacaucgccgagacaaacggaguguggcuuuagcaccacauguaggaaugggacuagauacccgcacacaaacauggaugucugcggaaggcgcuuggcgacaaguugaaaaaguagaaacaugggcauugcgacacccugguuucacaauacuagcguuauuccuagcacauuacauaggcacaagucuuacccaaaaaguaguaaucuuuauauuacuuauguuagugacuccaaguaugacuaugagauguguuggcguaggaaaucgagauuuuguggaaggucuaaguggcgcuacguggguugaugucgugcuugaacacggagggugcgugacaacgauggccaaaaauaaaccgacacucgacauugaauuacagaaaacugaagcgacucaauuggcaaccuugagaaaauuauguauagaaggcaaaauaacaaacauuacaacagacucaagauguccuacucaaggugaagcaacacuuccagaagaacaagaucaaaauuaugucuguaaacauacuuacguagacagaggguggggcaaugguugcgggcucuuuggcaaggguagccuuguaacaugcgcgaaauuucaauguuuggagccaauagagggcaaaguaguacaauaugaaaaccuuaaauauacggucauuauuacuguucauaccggagaucagcaccaaguagguaaugaaacucagggaguuacugcagaaauaacuccgcaagcaagcaccacagaagcaaucuuaccggaauaugggacacucggcuuggaauguucuccgcgaacgggauuagauuucaaugaaaugaucuuauuaacaaugaaaaauaaagccuggaugguacacaggcaaugguucuuugaucuuccucuuccauggacaucgggugcgacuacugaaacuccgaccuggaaccgaaaagaacuauuaguuacauuuaagaaugcccaugcaaagaagcaggagguaguaguuuuaggaucgcaagaaggugcuaugcacacugcauuaacaggcgcaacugaaauccaaaacuccggcggaacaucaauuuucgcaggccaucuaaaaugccguuugaagauggacaaacuagagcuaaaaggaaugaguuaugcaauguguacuaauacguucguucucaaaaaggaaguaagcgaaacacaacauggaacaauauuaauaaaaguugaauauaaaggcgaagacgcucccugcaaaauuccuuucagcacagaggacgggcagggcaaagcacauaaugggcgcuugauaacagcgaacccuguaguuacuaagaaagaagaaccaguaaauauugaagcagagccuccauuuggagaaucgaauauugugauagggauuggagacaacgcacuaaaaauaaacugguacaagaagggcucuagcauugguaaaauguuugaggcuaccgcaagaggggccaggagaauggcaauauuaggagauacagcuugggauuuuggauccguaggagggguccuuaacucuuuaggaaaaaugguucaucaaauauuuggcucagccuauaccgcgcuguuuuccgggguuucauggguuaugaaaauuggaauaggaguacuacuaacauggauagggcuuaauucaaggaacacuucuaugucuuucucaugcauagcaauagguauuauaacgcuuuaucuuggugcagugguacaagcugauauggguuguguaaucaacuggaaagguaaagaguuaaaaugugggagcgguauauuuguuacaaaugaagugcacaccuggacggagcaguauaaauuccaagccgacucgccaaaaagacucgccacugcgauagcuggugcuugggaaaauggaguuugugggaucagaucuacgacccguauggaaaacuuacucuggaaacagauagcuaacgagcuaaacuauauacucugggaaaacaauauaaaacuaacaguuguuguuggagauauaaucggggugcuagagcaaggaaagaggacguuaacuccucaaccaauggagcuaaaguacucguggaagacauggggaaaagcaaaaauaguuacagccgaaacacagaacucuuccuuuauuauagacgguccaaauacgccagaaugucccagcguuucccgagcauggaauguuugggaaguagaagacuauggauucgggguauuuaccacgaauauauggcuaaaauugagagaggccuacacucaauuaugcgaccauagacucaugagcgcugcaguaaaagacgaaagggcaguacaugcugauaugggauauuggauagaaucccagaaaaacggaucguggaagcuagagaaagcgaguuuaauagagguaaagacaugcacauggccgaagucucauacuauuuggucuaaugggguccucgagagugacaugauaauuccaaagagccuggccggaccgaucagccaacauaaucaccguccagguuaucacacacaaacugcagguccauggcaccuagggaagcuggagcucgacuuuaacuacugugaaggaacaacaguuguuauuacagaaaauuguggaacuagagguccaucuuugcgaacaacuaccguuucagguaagcucauucacgaauggugcuguagaucauguacccuaccaccccugcgauauaugggcgaagacggcugcugguaugguauggagauacgaccaauaagcgaaaaggaggaaaacaugguaaagagcuuaguaucagccgggucgggaaaaguagauaauuuuacuauggggguucuaugucuugcgauauuauucgaggagguaaugcgugguaaguuuggcaagaaacacaugauugccgguguauuucuuacguuuguuuuauuguuauccgggcagauaacauggagagacauggcucacacucucauaaugaucggcagcaaugcgagugauagaaugggaaugggaguaacuuaccuugcacuaaucgcaacuuuuaagauccagccguuuuuagcgcuuggauucuuuuuacgaaaacugacuagcagagaaaaucucuuacuugguguaggacuagcgauggccacuacccuacaauugccggaagauaucgagcagauggcaaauggcauagcguuagggcucauggcuuugaaacuuauuacucaauuugaaaccuaucagcuauggaccgcguuaauuucguugaccuguagcaauacgauauucacacuuaccguggcguggcgaacagcaacgcuaaucuuggcuggcguaagucuccuccccgugugccaaucaagcagcaugcgaaagacagauugguugccaauggcuguagcagcgaugggaguaccgccauugccacuuuucauauucagucucaaggauacgcuaaaacgaagaucguggccguuaaacgaagggguuauggccguaggucugguaucaauuuuagcgucuagcuuauuacgaaacgauguuccuauggcuggaccauuggucgcuggaggcuuacucauagcuuguuauguaaucacuggaacaagugcugacuuaacagucgaaaaagcugccgacauaacuugggaagaggaagcggaacaaaccgguguuucucauaaccucaugauaaccguagaugacgacgguacaaugagaauaaaagaugacgaaacugaaaauaucuuaacuguauuacuuaaaacagcuuuacuaauugugagcggaauauuuccguauucaauaccggccacauuauugguauggcauacguggcaaaaacagaccaagcggagcggaguucuuugggaugugccuaguccacccgaaacccaaaaagcagaacuugaagaaggaguuuaucgcauaaaacaacaaggaauauuugggaaaacacaagucggaguugguguacaaaaagaaggaguauuucauacaauguggcaugugacaagaggugcuguccuaacauacaauggaaaaagacuagaaccuaauugggcaucgguuaagaaagaccuuauaagcuacggaggaggguggaggcucucagcacaauggcaaaaaggugaagagguccaagucauugccguugagccagguaaaaacccuaagaacuuccaaaccaugccuggaacguuucaaacaaccacaggcgaaauaggugcgauagcacuagacuuuaaacccggaacaagugguucacccaucauaaauagagaagguaaagucgucggauuauauggaaacggaguaguuacuaaaaacggcggauaugugucuggcauagcacaaacgaacgcagaacccgacgguccuacgccugaauuggaggaggagauguucaaaaagaggaacuuaaccaucauggacuuacauccugggucugguaaaacaagaaaauauuuaccugcaauaguucgcgaggcaauaaaaagacgguugagaacauugauccuagccccaacaaggguaguagcagcagagauggaagaagcucuaaaaggacuucccaucagauaucagacuacagccacgaagagugaacacacaggaagagaaaucguugauuugaugugucaugcaacuuuuacaaugcgucuacuaagcccuguacgagugccgaauuacaauuugauaauaauggacgaagcccacuucacagacccagcaaguauagcagcgagaggcuauauaucgacacgaguagggaugggggaagccgcagcaauuuuuaugacagcaacuccuccaggaacggcugacgcauuuccucaguccaacgccccaauucaagaugaagaacgugauauaccugaaagaaguuggaauagcgggaacgaauggauuacugauuuugcugggaaaacaguaugguuugugccuuccauaaaagcaggaaacgacauagccaauuguuuacgaaagaaugggaagaaaguuauucaguuaucaaggaaaacuuucgauacagaguaucagaaaacgaaauugaacgacugggacuuuguaguuacgaccgacaucagcgaaaugggggcgaauuuuaaagcggaucgcgugauugacccacgucguugcuugaaacccguuauacucacagaugguccugaaagggucauacuugccgguccaaugccugugacggcggccucagcagcgcaaagacgagggcgcgugggucguaauccccaaaaagaaaaugaucaauauauuuuuacgggacaaccuuuaaauaacgaugaagaucaugcacacuggacggaagcaaaaaugcuucuagauaauauaaacacaccggaagguaucauuccagcauuauucgagccagaacgugaaaaaucggccgcaauagauggagaguacagacucaagggagaaucccgaaaaacauuuguugaguuaaugagacgaggggaucuaccaguguggcuagcacacaaggucgcaucggaagggauuaaauauacugaucgaaaguggugcuucgacggucaacgaaacaaccagauauuagaggagaacauggaugucgaaauauggaccaaagaaggugagaaaaagaaauuacguccuagaugguuggacgcuagaacguauagugacccacuagcacuaaaagaauuuaaagaauuugcggcgggaaggaaaucaauugcgcuugaccuagugacugaaaucggaagagucccaucucaucuagcccauagaacaagaaaugcacuagauaauuuagugaugcuccauacaucugaacauggaggacgggcuuauaggcacgcaguugaagaguuaccggaaacuauggagacgcuauuauuauuagggcuuaugauauuacucacagggggagcaaugcuauuuuuaauuucugguaaagggauaggaaaaacaucaauuggacucauauguguuauagcuuccucgggaauguuguggauggcugaaauaccucuucaguggauagccucagcgauagugcuagaguucuuuaugaugguguuacucaucccggaaccagaaaaacagagaacuccacaggacaaucaguuagcuuacguuguaauuggaauacuaacgcuagcagcgaucauagccgcuaacgaaaugggauuauuggaaacuacuaaaagagaccuuggcaugucuaaggaaccaggaguuguaucaccuaccuccuauuuagauguagaucuacauccggcgagcgccuggacauuauacgcaguagcuacuacggucaucacaccaauguuaagacauacaauugaaaauucaacagcgaacgucucacucgcggcuauugcgaaccaagcagugguccuaaugggacuugacaaaggguggccuauaucaaaaauggauuuagggguaccauuacuugcccuuggauguuauucacagguuaauccacuaacguuaacggccgccguauuauuacuuaucacacacuaugcaauaauaggucccggauuacaagcuaaggccacgcgugaggcgcagaaaagaacugcugcaggaauaaugaaaaacccaaccguugacggcauaaugacgauugauuuagaucccguaauuuaugauagcaaguucgaaaaacagcuuggacaagugauguuauuagucuugugcgccguccagcuucucuugaugaggacaaguugggcauuaugcgaagcgcuaacuuuagcuacaggaccgauuacaacauugugggaagggaguccagguaaauuuuggaacacaacuauagcaguuagcauggcgaacauuuuucgcggaucauaccuugcuggggccggacucgcauuuucaauuaugaaaaguguaggcaccggcaaacgaggcacaggcucacaaggcgaaacccuuggagaaaaauggaaaaagaaacuaaaucagcuuucaagaaaagauuuugaucucuauaagaaaucaggaauuaccgaaguggauaggacagaagcuaaagaaggacugaaaagaggugagauuacgcaccacgcgguaucaaggggcucagcuaaguuacaaugguucguagagcgaaauaugguaauuccugaaggacgagucauugauuuagguuguggaagagguggcuggucuuacuauugugcuggucuuaaaaaggugaccgaagucaggggauacacaaaaggcggaccuggccacgaagaaccaguuccaaugucgacuuauggauggaauauuguuaaauugaugucuggaaaagauguauucuaucucccuccugaaaaaugugacacucuucuaugcgauaucggugagaguagcccaaguccgacuguggaagaaucgagaacuauacgcgugcuaaaaauggucgaacccuggcuuaagaacaaucaauuuuguauuaaaguauuaaacccauacaugccgacaguaaucgaacaucuggagagauuacaaagaaaacacggaggcaugcuaguaagaaacccacuaagcagaaauuccacacaugaaauguauuggauaagcaauggaacuggaaauauaguugcuucuguaaauaugguuaguaggcuucuacugaauagauucacuaugacccauagaagacccacaauagaaaaagacgucgauuuaggcgcaggaacgagacauguuaaugcagagccagaaacacccaacauggacgucauuggcgaaagaaucaagagaauaaaagaagaacacaacucaaccuggcacuaugaugaugaaaaucccuauaaaacuugggccuaccauggaaguuaugagguaaaggcgacgggcagcgcgucgagcaugaucaauggaguaguaaaacuacuuacaaagcccugggauguugugcccaugguuacgcaaauggcuaugacggacacaaccccauuuggacagcaacguguuuuuaaggaaaaggucgauacgagaaccccuaggucuaugccaggcacgcgaagagugaugggaaucaccgcugaauggcuauggagaacacuuggaagaaauaagaaaccucgauuaugcaccagagaagaguucacuaagaaaguuagaaccaacgccgcuaugggggcaguuuuuacagaagagaaucaaugggauucagcaaaggcagcuguagaggaugaagacuuuuggaaguugguagauagagagagggaacuucacaaacucggaaaaugugguaguugugucuacaauaugaugggaaagagagagaagaaacuuggagaguucggaaaagcgaaaggcucaagggcuauuugguacaugugguuaggagcuagauaccuagaguucgaagcacuaggauuucuaaaugaagaucacugguucucccgagaaaacagcuacagcgggguagaaggggaaggauugcauaaguuaggauauauacuacgugauauaaguaaaaucccgggaggcgcuauguaugcagacgacacggccggcugggacacgcgaauaacagaggaugaccuucauaacgaagagaaaauuacacaacaaauggacccagaacaucgccagcuggcaaacgcaauuuuuaaauuaaccuaucaaaacaaagucgucaaaguucagcgaccuacaccgacaggcacgguaauggauauuauaucucguaaagaucagcgcggauccggucaaguugguaccuacggguuaaauacauucaccaauauggaagcacaacuuauaaggcaaauggagggugaaggcgucuuaagcaaagcugacuuagaaaacccucacuuaccagaaaagaaaauaacacaauggcucgagacuaaaggugucgagaggcucaagagaauggcaauaucgggcgacgacuguguuguuaaaccuauugaugauagauuugcuaaugcacuacucgcucuaaaugauauggggaaggugcgaaaagacauuccucaguggcaaccaucaaaaggauggcacgacuggcaacaaguucccuucugcucgcaccacuuucacgaauuaauuaugaaagacggacguaaacuuguggucccuugccguccacaagaugaacuaauagguagggcgagaaucucacaaggagcagguuggagucucaaagagacagccuguuugggcaaagcguaugcacaaauguggagcuuaauguacuuccacagacgcgaccuuagacuagcaucuaaugcaauaugcucggcgguacccguacauuggguaccuacgucuagaacaacauggucuauacacgcacaucaccaauggaugacaacagaagauauguugacuguuuggaacagggucuggauugaggauaauccguggauggaagacaagacuccaguaacaacuugggagaacgugccguaucuaggaaaacgagaggaccaauggugugggagucugauuggguuaacaagucgcgcaacuugggcccaaaauauaccaacagccauacaacagguaaggagucuuauaggaaaugaagaguuuuuagacuauaugccgucaaugaaacgauuucgaaaggaagaggaaucagagggcgccauaugguaa

SEQ ID NO: 23236 - RNA, 9873 nt, Artificial Sequence
  derived and/or modified CDS sequence (opt6) from DENV-3__JF937627__SS-prME
acaucuuugugccuaaugaugauacucccagcagcuuuagcauuucacuugacaagccgagauggagaaccacgaaugauaguaggcaaaaaugaaagaggaaaaucauuacuauucaaaacagcaucuggaaucaacaugugcacauuaaucgcaauggauuugggugaaaugugugaugauacgguuaccuauaaauguccacacauaacugaaguagaaccugaagauauugauugcugguguaaucugacaagcacaugggucacauauggcaccuguaaccaagcaggagaacacagaagggauaaaagaucgguagcuuuagcgccacauguugguaugggacuugauacuagaacacaaacuuggaugucagcagaaggagccuggcgucaaguagaaaaaguugaaaccugggcacuacgccauccuggauucacaauauuggcucuauuuuuagcacauuauauugggacaaguuuaacucaaaaaguaguuauuuuuaucuuacugauguuaguaacaccaucaaugacgaugcgaugugucgguguuggaaaucgagauuuuguagaaggacugucgggagcaacuuggguugauguuguacuugaacacggagguugugucacaacuauggccaaaaauaaacccacguuagacauagaacuucagaaaacugaagcaacacaauuagcgacauuacggaaacuauguauagaaggaaaaauaacgaacaucacaaccgauucaagauguccuacccaaggagaagcaacccugcccgaagaacaagaucaaaauuauguuugcaaacacacguauguagauagaggauggggaaacgguuguggacuuuucgguaaaggaagccuaguaacaugcgcgaaauuucaaugccuagaacccauagagggaaaagugguccaacaugaaaaucucaaauauacugugauaauuacagugcauaccggagaucagcaccaaguagguaaugagacacaggggguaacugcagaaauaacaccacaggcuucuacaacggaagcaauauuaccugaauauggaacacuaggucuagaauguucaccaaggacaggacuagacuucaaugaaaugauacuccuuacuaugaaaaacaaagccuggaugguccacaggcagugguuuuucgacuugccacuacccuggacgaguggcgcaacaacugaaaccccuacuuggaaccgaaaagagcuauugguaacuuucaaaaacgcgcacgcaaagaaacaggaaguuguagugcuaggaagucaagaaggagcaaugcacaccgcguuaacgggugcuacugaaauacaaaacucgggugguaccuccauuuucgccggccauuuaaaguguagacuuaaaauggauaaacucgaauugaaaggaaugucuuaugcuauguguacaaacaccuuuguacuuaagaaagaaguaagugagacacaacacgguacaaucuugauaaaagucgaguauaaaggagaggauguuccuuguaagauaccauuuaguacggaagauggccaggguaaagcacacaauggaagauuaaucacagcaaauccaguagucacaaagagagaagaacccguuaauauagaagcagaaccuccuuuuggugaauccaacauaguaauaggaauaggcgauaacgccuugaaaaucaacugguacaagaagggaucaaguauaggcaaaauguuugaagccacggcgcggggagcacguaggauggcuaucuuaggugauacugcaugggauuuuggaucgguaggaggaguauuaaacucuuuagguaaaaugguccaccagauauuugguagugcuuauaccgcacuguucucgggugugaguuggguaaugaaaauaggaauaggcguacuguuaaccuggauaggacucaacagcaaaaacacaucgaugucauuuaguuguauagccauaggaauaauuaccuuauaccuaggagcugucgugcaggccgacaugggauguguuauaaauuggaaaggcaaagagcuaaaauguggcucaggcauuuucgugacuaaugaggugcacacguggacugaacaauauaaauuucaggcugacuccccuaaacgauuagcuacugccaucgcaggcgcuugggaaaacggagugugugggauacgaucuaccacucgcauggaaaauuuacuauggaagcaaauugcgaaugagcuuaauuauauucugugggaaaauaauauaaaauuaacaguagucguaggugacauaauuggcguacucgagcaaggaaaacgcacuuuaaccccgcagccaauggaacuuaaauauucuuggaaaacgugggggaaagcuaaaauuguuacggcagagacacaaaacucaucauuuauaaucgauggaccgaauacuccagaguguccaagugugucaagggcuuggaacguuugggaaguggaagauuacggauucggaguuuuuacaaccaacauauggcucaaacuacgagaaguuuacacacaguuaugugaucaucgauugaugagugcugcgguaaaagaugagagagccguucaugcugauauggguuacuggauagagucacaaaagaacgguucuuggaaacuagaaaaggcuucgcuuauugaaguaaaaacauguacauggccgaagagucacacguuauggucuaauggaguauuagagagcgauaugaucauuccaaagucguuagcuggccccauaagccaacauaaccauagaccgggauaucauacgcaaacggcggguccguggcauuugggcaaacuagaacuagauuuuaauuauugcgaagguacuacagucguuauaacagagaauugcggcacuagaggaccuucucuuagaacgacaacaguuagcggcaaauuaauccaugaauggugcugucguaguuguacauuaccuccacugagauauaugggagaagaugguugcugguaugguauggaaauaagaccgauaagugaaaaggaagaaaacaugguaaagagccuaguuucagcugguucaggcaaaguagacaauuuuaccauggguguuuuaugucuggccauauuguuugaagaaguaaugcguggaaaguucgggaaaaagcauaugauugcaggaguauucuuuacguuuguacuacuacucaguggccaaaucacguggagggauauggcccacacacuuauaaugauuggaucgaaugcauccgaucgcauggguaugggagucacauaucuagcacucauugcaacauucaaaauucagcccuucuuagcauugggauucuucuuacgcaaauugacaagucgugaaaaccuacuucuuggaguagggcuagcuauggcgacgaccuuacaacuuccggaagauaucgaacagauggcaaaugggaucgcguuaggacuaauggcacuaaaguuaauaacacaguucgaaauauaucagcuguggacagcacuaaucucacugacuugcucaaacaccauauuuacacuuaccguagccuggagaacagcaacacuaauuuuagcgggcguuagcuugcuccccaugugucagucuagcucaaugcggaagaccgauugguugccgauggccguagccgcgaugggcguaccuccuuuaccauuauucauauuuucucucaaagacacguugaaacgccggucauggccccugaacgaagguguaauggcaguaggguuaguaucuauucucgcaaguucacuacuccgaaaugacguaccuauggcagguccccuuguagcagggggucucuugauugcauguuacguuauaaccggaacaucagcggaccuuacgguagaaaaagcugcugacaucacgugggaagaggaagcugagcagacaggaguaucccauaacuuaaugaucacgguagacgacgacgggaccaugcgcauuaaagaugaugaaacagaaaauauacuuacuguacuuuugaaaaccgcacuucuuaucgucagcggaauauucccguacucgauaccagcaacuuuauugguuuggcacacauggcaaaaacaaacacagagaaguggaguauuaugggacgugccaucgccuccugagacacaaaaggcagaauuagaggaagguguguacagaauaaaacaacaaggaauauuugguaaaacccaaguugggguugguguccaaaaggaaggaguguuccacacaauguggcaugugacucgaggagcaguguuaacauacaacgggaagagacuagaacccaacugggcaagugucaagaaagaccugauaucguauggagggggcuggcguuugucagcacaguggcaaaagggagaggagguucaggucaucgcuguugagccaggcaaaaaccccaaaaauuuccagacuaugccaggcacguuucaaaccacgaccggugaaauaggagccauugcucuugauuuuaaaccggggacuagcgguucaccgauaauuaauagagaagguaaaguaguggggcuauacggaaauggagucguuacaaagaauggcggauaugugaguggaauagcgcaaaccaaugcugagccagauggaccgacgccagaauuggaggaagaaauguuuaaaaagcguaacuuaaccauaauggauuugcacccaggaucuggaaaaacacgcaaguaccuuccagcgauuguuagggaagcuaucaaacgucgacuuagaacacuaaucuuggcccccacacgcgugguugcagcggaaauggaagaggcuuugaaagggcuuccaauacgguaccaaacaacagcaacaaagucagaacauacagggagagaaaucguagauuuaaugugucaugcaacauucacaaugagauuacugaguccaguacgaguuccuaauuauaauuugauuauuauggacgaagcacacuucacggacccugcgucgauagcugcccgaggauacauaucgacucguguagguaugggagaggcagcagcuauauuuaugacggccacgccaccgggcacagcggaugcuuuuccccaaucaaacgcuccaauucaagaugaagaacgagauauaccugaaagaagcuggaacuccgguaacgaguggaucacugacuucgccgguaaaacggucugguucguaccauccauuaaagccggaaaugacauugcuaauugccuccgcaaaaauggaaagaaaguaauucaauuaaguagaaaaacauucgacacugaauaccagaaaacaaaacugaaugacugggauuuuguuguuacaacugauaucucagaaaugggagccaauuucaaggcagauagaguaauagauccccguagaugccuuaaaccgguuauucuaacugacggaccagagagaguuauucuugcagguccaaugccgguaacugcugccagugcggcccaacgucgaggucgagugggaagaaauccacaaaaagagaaugaucaauauauuuuuacuggacaaccacuaaauaaugaugaagaucaugcacacuggacagaagccaaaaugcucuuagauaauauuaacacaccagaagguauaaucccugcguuauuugagccagagagagagaaaucggccgcaauagacggugaauauagacugaagggcgaaucacgcaagacauucguggaauuaaugcgcagaggugacuuacccgucuggcuagcacacaagguagcuagugaagguauaaaguacacagaucgaaaauggugcuuugauggucaacguaauaaucaaauuuuggaagaaaacauggaugucgaaauauggacgaaagagggagaaaagaaaaagcugcgacccagauggcuugaugcaaggacuuauucugacccacuagcucuaaaagaguuuaaagaauuugcagcgggucggaaaucaauagcccuugauuuagugacagaaauaggucgaguaccaagucauuuagcacauagaacgaggaaugcucucgauaaccuaguaaugcuucacaccucggaacaugggggcagagccuaucgacaugcuguagaagaauugccagaaacaauggaaacauuguuacugcuuggacucaugauacugcuaacgggaggcgcgaugcuauuucuaaucucggguaaggggauuggaaaaacaucaauagguuuaauauguguaaucgcuaguucagguaugcuauggauggcugagauuccccuacaauggauagcgucggcaauaguccuugaguucuuuaugauggucuugcuaauacccgaaccugaaaaacaaagaaccccucaggacaaccagcuugccuauguagucauagguauuuuaacgcuagcugcuauaauugcagcaaacgaaaugggacuucuugaaaccaccaaaagagauuugggcaugagcaaggaaccaggaguaguaucaccaacgucuuaucuugauguagaucuacaucccgcaucagcuuggacacuauacgcaguugccacgacuguaauaacuccuauguugaggcacacuauugaaaacuccacagccaacguaagucuagccgcgaucgcaaaucaggcuguuguccugauggguuuagauaaaggauggccaauaagcaagauggauuugggaguuccacuauuagcccuaggcugcuauagccaaguaaauccucuaacacuuacagcagcgguacucuuguuaauuacucacuaugcaaucauaggaccaggccuacaggcgaaagcgacacgagaagcacagaaaagaacggcagcaggaauaaugaagaacccuaccguugauggaauuaugacaauugaucuugacccggugauauacgacucuaaauucgagaagcaacuaggacaagugaugcuauugguuuuauguguaguccaacuuuuauuaaugcgcacuucuugggcucuuugugaagcacuaacacuugcaacagguccaauaaccacauuaugggaaggaagucccggaaaauuuuggaacacuacuauugcugucucuauggcaaacauuuucagagggucuuauuuagcaggagcagguuuggcauucucaauaaugaaaagcguaggaacugguaagcggggcacgggaagccaaggagagacauuaggggagaaauggaaaaagaaacuaaaccaacuaucucguaaagacuucgauuuguauaagaaaagcgggauaaccgaaguagacagaacugaagcuaaagaaggacuaaaacguggcgaaauaacacaucaugcaguaucacgcgguucugccaaauuacagugguucguugaacguaauaugguaauaccggaaggucgugugauagacuuaggaugugguagaggaggauggucauauuauugugcaggauugaagaaagucacagaaguaagaggauacaccaaaggagguccggggcacgaagaacccgugccuaugagcacuuauggguggaacaucguaaaauuaaugagcggcaaagaugucuucuaccucccucccgaaaaaugcgauacuuuauuaugcgacauuggagaaucgucuccgagccccacaguggaagaauccaggaccauacgaguauuaaaaaugguagaaccauggcucaaaaauaaucaauuuuguaucaagguacugaauccuuacaugccaacaguaauugaacaccuggaacgucugcaacgaaaacacggaggcauguugguacgaaacccucugagucgaaauucuacacacgaaauguauuggauaucuaauggaacuggaaauauuguggcaucagugaauaugguuucaagguuguuguuaaacagauuuaccaugacacauagaaggccuacuauagaaaaagacguagaccucggggcgggaacaaggcacguaaacgccgagccagaaacaccaaauauggauaucauaggggaaagaauaaaacgaauaaaagaggaacauaacaguacuuggcacuaugacgaugagaaccccuauaagaccugggcguaccauggcagcuacgagguaaaagcuaccggaucagcuaguucgaugaucaacggagugguaaaauuacuuacuaagccuugggauguaguaccuauggucacucaaauggcaaugacagacacaacacccuuuggucagcagaggguauucaaggaaaaaguagauacgagaacuccacgaucuaugccuggcacaagaaggguaaugggaauaacggcagagugguuauggagaacuuuaggacgcaauaagaaaccuagauuauguacuagagaagaguucaccaagaaaguaaggaccaacgccgcaaugggcgccguuuuuacagaagaaaaccaaugggauagcgccaaggcugccguagaagaugaagauuucuggaaguugguaaauaaggaaagggaacuacacaaauugggaaaguguggcucauguguauauaauaugaugggaaaacgggagaagaaacuaggugaguuuggaaaagcaaaaggaucaagggcuauaugguauauguggcuuggugcucgauaccuagaguucgaagccuuaggauuuuuaaaugaagaucauugguuuucaagagaaaacaguuacaguggcguagaaggcgaagggcuucauaagcuaggauacauauugcgagauauaucaaagauacccggaggagcgauguacgcagacgacacggcaggaugggauacgcgaauuacagaagaugaccugcauaaugaagagaaaauuacgcaacagauggauccagagcauagacaauuggcaaaugcgauuuucaaacucacauaccaaaacaaagucguaaaaguacaaagaccgaccccaaccggaacagucauggacauaauuagccguaaggaccaacgcgguucuggucaagugggaaccuacggguuaaauacauucacaaauauggaagcucaacuuauucggcaaauggaaggagaaggaguauugucgaaagcggauuuggagaauccucaccucccagagaagaaaauuacacaauggcuggagacgaaaggugucgaacgauuaaaaaggauggcaauuagcggcgaugauuguguaguaaaaccaauugaugaccgauucgcaaacgcguuguuagcauuaaaugauaugggaaaaguacgcaaggauauaccacaauggcaaccgagcaaagguuggcaugacuggcaacaaguuccguuuuguagucaucauuuucacgagcuaauaaugaaagauggcagaaaacuuguaguuccauguagaccucaagacgaacuaauaggacgagcaagaauaagucaaggagcagguuggucauuaaaagaaaccgcaugucuaggaaaagcguacgcccaaauguggagcuugauguauuuccacaggagagaucuacguuuagcgagcaacgcaauauguucugccguacccguacacugggugccuacgaguagaacuacuuggaguauucaugcacaucaucaauggaugacaaccgaagacauguugacaguuuggaauagaguuuggauagaggauaauccauggauggaggauaaaacaccaguaacgacaugggaaaacgugccauaucuaggcaaaagagaagaucaaugguguggauccuuaauuggacuaaccucacgugccaccugggcucaaaauauuccaaccgccauucaacagguuagaagucucauaggcaacgaagaauuuuuagauuacaugccgucgaugaaaagauucagaaaagaggaagaaucagaaggagcuauaugguaa

SEQ ID NO: 23237 - RNA, 9873 nt, Artificial Sequence
  derived and/or modified CDS sequence (opt6) from DENV-3__KF973476__SS-prME
acaucuuuaugccuaaugaugauccuaccagcugcauuagccuuucaucuaacgagucgagauggagaaccgcgaaugauaguagggaaaaaugaacgagguaaaaguuuguuauuuaaaacagcaucuggaauaaauauguguacguugauugcgauggaucuaggagaaaugugcgacgauacuguaacauacaaaugcccucauauaacugagguggaaccagaagauauagacuguugguguaauuugacgucgacauggguuacauacggaacuuguaaccaagcuggagaacaucgacgugacaaacgcucagucgcacuugcaccgcacguggggaugggauuagacacaaggacccaaacuuggaugagcgcagaaggugccuggagacaaguagaaaaaguagaaacaugggcauuaagacacccaggguucacaauucuagccuuguucuuagcacauuauauaggaacaucucuaacgcaaaaaguugucauuuuuauauuacuuaugcuagugaccccuucgaugacaaugaggugcgucgguguaggaaaucgagauuuuguagaaggcuugucaggagcaacuuggguagauguuguacuugaacauggaggguguguuacgacuauggcuaaaaauaaaccaacacuagacaucgaauugcagaaaacggaagcgacacaacuugccacuuuacggaaacuuuguauagaaggaaaaauaacgaacaucacuacugauucacgguguccgacucaaggcgaagcgacacuuccugaggaacaagaccaaaacuacguauguaaacacacguauguagaccguggcugggguaauggauguggauuguucggcaaaggaucacucguuacgugugcuaaauuucaaugucuugaaccaauagaagggaaaguaguccaauaugaaaaucucaaauacacggugauaauaacaguacacacaggugaucaacaccaaguaggaaaugaaacacaagggguaacagcggaaauaaccccacaagcgagcacaacagaggcaauucuaccggaguacggaacacuaggauuagaauguuccccacgaacaggauuagacuucaacgagaugaucuuauugacaaugaaaaacaaagcguggaugguacacagacagugguucuuugaucuaccccucccuuggacaucaggagcaacgacagagacgccaacauggaaccgaaaagaacuacuggugacauuuaaaaaugcucacgcaaagaaacaggaaguaguaguccuagguagccaggagggcgcaaugcacacagcuuuaacaggugcuacugaaauucaaaauucaggaggaaccucuauauucgcaggccaucuaaaaugucgacuaaaaauggacaaacuagaguuaaaaggcaugagcuacgcaaugugcaccaauaccuuugugcucaagaaagaaguaucugaaacacaacauggaacaauacuaauaaaaguggaauacaaaggagaggaugugccauguaaaauuccguuuagcacagaagacggacaaggcaaagcgcacaauggcagacugauaacagccaauccagucgugacuaagaaagaagaaccaguaaacauagaagcugaaccaccuuuuggugaauccaauaucgugauuggaauaggcgacaaugcacuuaaaauuaacugguacaagaaagguucgucaauagguaaaauguuugaagcaacugcucguggagcacgcagaauggcgauucuuggugauacugcaugggacuucgggucagucggaggaguccuaaacagccucgguaaaaugguacaucaaauauuugggucggcuuauaccgcucuauuuuccggugugaguuggguaaugaaaauaggcaucggaguguugcugacuuggauuggucuaaacaguaagaacacuagcaugagcuuuaguugcaucgcaauaggaauuauaacccucuacuuaggcgcagugguacaagccgauaugggauguguuauaaauuggaaagguaaagaacuaaagugcggaagcgggauauucgucacaaaugaggugcauacguggacugaacaguauaaguuucaagcagauaguccaaagagauuagccacugccauagcaggagccugggaaaaugggguaugugggaucagaucaacaaccagaauggaaaaccucuuguggaaacagaucgcaaacgagcugaacuacauauugugggagaacaacauaaaauugaccgugguugucggugauauaauuggcguccucgaacaggguaaaagaacacuaacaccgcaacccauggaacucaaauacaguuggaaaacaugggguaaagcaaagauaguaaccgcagagacccaaaauucaucauucaucauagauggacccaauaccccagaaugcccuucagucucaagagcuuggaauguuugggaaguggaggauuauggguucggaguauucaccacgaacauuugguuaaaauugcgugagguuuauacacaacuuugugaccaucgguugaugucggccgcagugaaagaugaacgcgcaguucacgcugauaugggguauuggauagagucccagaaaaauggaaguuggaaauuagaaaaggcuucacugauugaaguaaaaaccugcacguggccaaaaagucauacacuguggucgaacggaguacuugagucugauaugauaauaccuaaaagucuggcaggcccuauuagucaacauaaccaccggccagguuaccauacucaaacagcaggacccuggcauuuagggaaacuagagcuugauuuuaauuauugugaaggaaccacggucgucaucacugagaauuguggaacaagagggccuucacuuaggacaaccacuguuucaggaaaauuaauccaugaaugguguugucgcuccugcacacucccaccguuacgauacauaggggaagacggcugcugguauggaauggaaauuagaccaauaucggaaaaggaggaaaacauggugaaaucauuggugucugcagggaguggaaaaguggacaauuuuacgauggguguguuauguuuggcgauauuauucgaggagguaaugaggggaaaguuuggcaagaaacauaugaucgcaggggucuuuuucacuuucguccuacuacuaucgggacaaauaacuuggcgagauauggcucacacuuugauuaugauugguuccaaugcaagcgaccgcaugggaaugggcgucaccuaccuugcgcuuauagcaacguucaaaauccagccauuccuagcacuuggauucuuuuuaagacgucuaacuucuagagagaaucuuuuauuagggguugguuuagcuauggcuacaacuuuacaacuaccugaagacauugaacagauggcaaaugguaucgcccucggacugauggcgcuaaaauuaaucacucaauuugagacguaucaacuauggacugcacugauuucacuaacauguucaaacacaauuuuuacccucacugucgcauggagaacagcuacguuaauauuagccggugucucacuguuacccguuugucaaucaucgucaaugcgaaaaacugacugguuaccaauggcggucgcggccaugggaguuccaccauuaccauuguuuauauucucguuaaaagauacacugaaacgacggucauggccuuugaaugaaggagugauggcggucgggcuuguaucaauuuuagcuucaaguuuauuaagaaaugacgugccgauggcaggacccuuaguagcaggaggacuacuuauugcauguuacgucauuacgggaacaucggcugaccuaacaguagaaaaagccgcugauaucacaugggaagaagaggcugaacaaacgggcguaagccauaaucuaaugauaacaguugacgacgacggaacgaugagaauaaaagaugaugaaacagaaaauauauuaacaguacuucuaaaaacagcacuguuaaucguuuccggaauuuucccauauaguauuccagcgacacuccuagucuggcauacauggcaaaagcaaacacaaagaagugggguacugugggauguaccaucuccaccagaaacccaaaaggcugaauuggaagaggguguauauagaauuaagcagcaagguauuuucggaaagacgcaaguagguguaggugugcaaaaggagggggucuuccacaccauguggcacguaacucgcggugccgugcugacuuauaacgggaagcgccuagaaccgaauugggcuucagugaaaaaggauuugauuucauacggaggaggauggagacugucagcacaauggcaaaaaggagaagagguacaaguaaucgcagucgagccagguaaaaauccuaaaaacuuucaaaccaugccaggaacuuuucaaacaacaacuggugagauaggcgcaauugcacuugauuuuaaaccagguacuucuggaaguccgauuauaaauagaggcgggaaagucguuggacuuuauggaaauggugucguaacaaagaauggaggguauguaagcggaauagcccaaacgaaugcagaaccugauggucccacaccugaacuggaagaagagauguucaagaaacggaaucugacaauaauggaucuccauccugguucugguaaaacaagaaaauaucuaccagccauagucagagaagcgauaacaagaagauuaaggacucuuauauuggcucccacaagaguaguggccgcagaaauggaggaagcauuaaaaggauuaccaauuagguaucaaaccaccgcaaccaaaucugagcauaccggaagggaaauaguggaccucaugugccaugcuacauucacaaugagauugcucucaccaguacggguuccaaacuauaaccucauaauaauggacgaagcacauuucacugaccccgcuagcaucgcugcacgaggcuacauaucuacaaggguuggaaugggagaggcugccgcaauuuuuaugaccgcgacuccaccaggaacugcggacgcuuuuccucaauccaaugccccaauacaggacgaagaaagagauauaccagagaggagcuggaacuccgguaaugaauggaucacugacuuugcuggaaaaacuguaugguucguccccucgauaaaggcggguaacgauaucgcaaauuguuuacgcaaaaauggcaagaaaguaauacagcuaucuaggaagacauuugauacugaauaucagaaaacuaaacuuaaugacugggacuuuguagugaccacagacauuagcgaaaugggugcgaacuucaaagcagauagagucauagauccgagaagauguuugaaaccggugauauuaacagacgggccugaacgcgucauauuggcggguccaaugccaguaaccgcugcuagcgcugcccaaagacgggggagagucgggagaaauccgcaaaaagaaaacgaccaauauauauucaccggccaaccuuuaaauaaugacgaagaucaugcccacuggacugaagccaaaaugcuguuggacaauauuaauacuccagaaggcaucauuccugcacuauucgagccagaaagagagaaaagcgcagcaguagauggugaauaccgauuaaagggggaaagcaggaagacguucguagaauuaaugaggcgaggugacuuaccaguuuggcuugcacacaaaguagcgucugaaggaaucaaguacacagaucgaaaaugguguuucgacggacaacggaauaaccaaauuuuggaagaaaauauggacguggaaauauggacaaaagaaggcgagaagaagaaacuuagaccaaggugguuagacgcgcgaacuuauagugacccauuggcacuuaaagaauuuaaggaauuugcagcgggaaggaaaucaaucgcauuagaucuuguaaccgaaaucggaagaguaccgucacaucuagcucaucgcacuagaaaugcuuuagacaaccuaguuaugcuacauacaagugaacacggugggcgagcuuacagacaugcaguagaagaguuaccagaaacgauggagacauuacugcuauuaggguuaaugauacuacucacaggaggggcaaugcuauuccuuauaucuggaaaagggauagguaaaacaaguauuggucuuaucuguguuauagcaagcuccggaaugcuguggauggccgaaauaccgcuucaguggaucgcgucugcuaucguccucgaguucuuuaugaugguccuucucauuccugaaccggagaagcagcgcacgccgcaagauaaucagcuagcauacguaguaauaggaauuuugacgcuagcugcgauaauagcggcaaacgaaaugggacuauuagaaaccaccaagagagaucuaggaaugucgaaggaaccgggaguaguaagcccaaccaguuauuuagauguggaucuacauccugcaucugcguggacauuauaugccguagcuacaacgguuauuacaccgaugcuacgacauacaauagaaaauucaaccgcuaacgugagccuugcugccauagcaaaucaagcaguaguguuaaugggacuggacaaaggguggccuauuagcaagauggaccugggaguuccuuugcuagcauuaggauguuacucgcaggucaacccguuaacccuuacugcugcaguauuauuacucauuacacauuacgcaaucaucgggcccggcuuacaagcgaaagcaaccagggaagcucaaaaacgaacugccgcagguauaaugaagaacccaaccguagacggaauaaugacaauagauuuagaucccguaauauaugauaguaaguuugagaaacaacuaggacaaguuauguuacucguucuaugugcuguccaguuacuauuaaugcguacuagcugggcacucugugaagcauuaacucuugcaacaggcccuauaacaacauuaugggaaggaucgccaggcaaauuuuggaauacuacuauagcagucaguauggcaaacauauuuaggggauccuaucuggcaggggcuggcuuggcuuuuaguauaaugaaaucgguuggaacgggcaaacgcggaacugguucacaaggagaaacauuaggggaaaaauggaaacggaaauuaaaucaacuaaguagaaaagacuuugaucuguauaagaaaucagguauaacagagguagauagaacagaagccaaagaggguuuaaagcguggagagaucacucaucacgcaguaucaaggggcucagcuaaauuacagugguuuguagaacguaauaugguuaucccagaagguagaguaauugaccuugguuguggaagaggagguuggaguuacuacugugcaggauugaagaaaguaaccgagguaaggggauauacaaaaggcggaccuggacacgaagaaccaguuccaauguccacauacggauggaacauaguaaaacuaaugucuggaaaagacguauuuuaccugccaccggaaaaaugugauacacuucuuugcgauauaggagaaucaaguccuaguccaacaguagaagaaaguagaacuauacgcguauuaaaaaugguagaacccuggcuuaaaaauaaccaguuuuguauuaaaguacuaaauccguauaugccuacgguaauagaacaucuggagcgacuccaaagaaaacauggugguauguuagugagaaaccccuugucgcguaauaguacucaugagauguacuggauuaguaacgggacugguaauauuguggccagcguuaacauggucucgagacuccuguuaaaccgguuuacgaugacacaucgccggccuaccaucgagaaggauguugaucucggcgcuggaacacggcauguaaaugcagaacccgaaacuccuaacauggauguaauaggggaacgcauuaagaggauuaaggaagaacacaauucgaccuggcacuaugaugacgaaaacccuuacaaaaccugggcguaucauggaaguuacgaaguuaaagcgacagggucagcaaguucgaugauuaauggagucguuaaauuauuaaccaaaccgugggaugucguuccuauggucacucaaauggccaugacagauacgacaccguuuggccaacaacgagucuuuaaagaaaaaguugacacacggacgccacggagcaugccaggaacaagaagagucauggguaucacagcugaaugguuauggaggacacugggaagaaauaagaaaccucgacuguguacgcgagaagaauuuaccaagaaaguucgaacaaaugcagcaaugggugcagucuuuacggaagagaaucaaugggauagugccaaagcugcuguagaagacgaagacuuuuggaaacuuguggauagagaaagagaacuacacaaacuaggaaaaugugguucaugugucuauaacaugauggguaaaagggagaaaaagcucggagaguucggaaaggcuaaaggaagccgagcaauuugguauauguggcuuggagcaagauauuuagaguuugaagcacuaggauuuuuaaaugaagaccauugguuuagccgugaaaacucauauuccggcguggaaggcgaaggacuccacaaauugggauauauccucagagauauuucaaagauuccaggcggagccauguaugcugacgauaccgccggaugggauacacgaaucacagaagacgacuuacacaaugaggagaagauuacacaacagauggauccagagcaccggcaacuggcaaacgcaauauuuaaauuaacauaucagaauaaaguaguuaaaguucaaagaccaacuccuaccgguacaguaauggacauuaucagcagaaaagaucaaagagggucaggacaaguaggaacguauggauuaaauacuuuuacaaauauggaagcgcaauuaauccgccagauggaaggggaaggaguccuuucaaaagccgacuuagaaaacccauaccuaccugagaagaaaaucacucaauggcuggaaaccaaaggaguugaacgucugaagcgaauggccauuucaggagaugauuguguugucaaaccaauagaugaucgcuuugcuaacgcacuacuugcauuaaacgacaugggaaaaguccguaaagauauaccucaauggcaacccucaaaagguuggcaugauuggcaacaaguaccuuucugcagucaccacuuucaugaacuaauuaugaaagacggucgaaagcuagucguaccuugccgcccacaggaugaauuaaucggcagagcacgcauaucacaaggagcuggcuggagcuuaaaagaaacagcuuguuuaggcaaggccuaugcacaaauguggagcuuaauguacuuucacagacgugaucuuagacucgcaagcaaugcuauuugcucagcuguuccuguacauuggguaccaaccucgcgaacgacauggucaauacaugcucaucaucaauggaugacuacagaagacaugcuaaccguauggaaccgugucuggauugaagacaauccauggauggaagacaaaacaccaguaaccacaugggaaaacguuccauauuuaggcaaacgagaagaccaaugguguggaucuuuaauuggauugaccagcagagcgaccugggcacaaaacaucccaacagcaauucaacaagugagaucuuuaaucggaaaugaagaguuucuugacuacaugccuagcaugaagagauuucgaaaggaagaagaaagcgaaggugcgauuugguaa

SEQ ID NO: 23238 - RNA, 9873 nt, Artificial Sequence
  derived and/or modified CDS sequence (opt6) from DENV-3__KF973478__SS-prME
acaucguuauguuuaaugaugauauugccggcagcacuagcauuccaccuaacuuccagagacggugaaccaagaaugauaguaggcaaaaaugaacgcgguaaaagucuucuuuuuaaaacagcaagcggaaucaauaugugcacauuaauugcuauggacuuaggcgaaaugugcgacgauacuguaaccuauaaaugcccgcauauuacggaaguagagccugaagacauugauuguuggugcaacuuaacgagcacuugggugaccuacggcacuuguaaccaagccggugaacacagacgagauaaaaggagugucgcgcuagcuccacacguugguaugggucuggacacgagaacacaaacguggaugucugcugaaggagcauggcgucaaguugaaaaaguugaaacgugggcacuacgacacccagguuucacgauacuagcgcuauuucuagcccauuauauagguacaaguuuaacccaaaaaguaguaauuuuuaucuuguuaaugcuaguaacuccuucuaugaccaugagauguguaggaguaggaaacagggauuucgucgagggacucuccggagcaacauggguugaugugguuuuagaacacgguggaugcgucaccaccauggcuaaaaauaaaccaacucuagauauugaauugcagaaaacagaagccacacaauuggcgacuuuaaggaaacuuugcauagagggaaaaauuacaaacaucacgaccgacucucgauguccaacgcagggugaggcaaccuuaccagaagaacaggaucaaaauuaugugugcaaacauacauauguagauagaggauggggcaacgguuguggucucuuugguaaaggaagccuagucacaugugcaaaauuccaaugucucgaaccuauugaggggaaaguaguucaacaugaaaauuuaaaauauacaguaauaaucacaguacauaccggggaucaacaucaggucgguaacgaaacacaaggaguuacagcugaaauaacaccgcaggcgagcacuacugaggcuauauuaccugaauaugggacuuuaggucuagaauguucuccgcgaacaggauuagacuuuaaugaaaugauacucuuaacgaugaaaaauaaagcguggaugguacaccgccaaugguucuuugaucugccgcuuccauggacauccggggcaaccacagagaccccaacuuggaaccgcaaagaguugcuuguaacauucaaaaacgcacaugcaaagaaacaagaaguaguaguucuaggaagucaggagggugcaaugcauacagcuuuaacuggugcaaccgagauacagaacucaggaggaacuucgauuuucgcaggacacuuaaagugucgacugaaaauggauaaauuggaguuaaaaggaaugucuuacgcuaugugcacaaauacuuucguauugaagaaggaaguaucggaaacacaacacggcacaauauuaauuaagguugaauauaaaggagaggauguuccauguaaaaucccguuuucgacagaagauggacaaggcaaagcccauaauggcagauuaauaacugcaaauccgguagugacuaagaaagaggaaccaguaaacauagaagcagaaccucccuuuggagaaagcaauauaguaauugggauuggugauaaugcacuaaaaauaaauugguacaagaaggguaguagcauuggaaagauguuugaagcgacggcucguggugcccggagaauggcaauacucggagacaccgcaugggauuucgguagugucgggggcguacuuaacagucugggcaaaaugguacaucaaauuuuuggaagcgcauauacagcccuauuuucggggguaagcugggucaugaaaauagguauugguguacuguuaaccuggauuggacucaauaguaaaaacaccaguaugucauuuucaugcauugccauaggcauaauaacauuauaucuaggagcuguuguucaagcagacaugggcuguguaauaaacuggaaggguaaagaauuaaaaugcggaagcgguauuuucguuacaaacgaaguucacacauggaccgaacaguacaaauuucaggcugauucacccaagcgcuuagccacagcaauugcuggugcaugggaaaacgguguuuguggaauuagguccacuacacguauggaaaacuuacucuggaaacaaauugcaaaugaguuaaacuacauccuuugggaaaauaauauaaagcucacuguuguuguuggagauauuauaggaguacuugagcaaggaaaaagaacacuaacaagucagcccauggaacuuaaauacuccuggaagacauggggcaaagcaaaaauagucacugcggaaacccaaaacucauccuuuauaauugauggcccaaacacgccugagugcccauccguaagucgggccuggaaugucugggagguagaagauuauggauucggagucuuuacuacaaauaucugguuaaaauuaagagaaguguauacgcaacuaugcgaccauagguugaugagugccgccgugaaagaugagcgcgcuguucaugccgauauggguuauuggauagagucacagaaaaauggaagcuggaaguuagaaaaggcgucucugaucgaggugaaaaccuguacuuggccuaaaagccauacgcuauggucaaaugggguucuggaaucagauaugauaauacccaaaucgcuagcagguccaaucucacagcauaaucauagaccuggguaccauacacaaacagcugguccguggcaucucggaaaguuggaauuagacuucaauuacugcgagggaacuacgguuguaauaacugaaaauugugggacaagggguccaucauuaagaacuacaacaguaucuggcaaacuuauacacgaauggugcugccguucauguacccuaccaccacuaagguauaugggcgaagaugguugcugguauggaauggagaucagacccauuucggaaaaagaggaaaacaugguaaaaaguuuggugucugcagggagugguaaaguggacaacuuuacuaugggcguauuaugccucgccauccuuuucgaagagguuaugcgcggaaaauucggcaagaagcacaugaucgcgggcguauucuuuacguucgucuugcuacucagcggucagauuaccuggagagacauggcgcacacccugaucaugauagguaguaaugcaagugauagaaugggcaugggaguuaccuauuuagccuuaaucgccacguucaaaauacagccauuccuggcucucggcuucuuuuuaagaaagcuaacgucgagggaaaaucuauuacuagggguaggccuugcaauggccacuacacuucaacuaccggaagacaucgagcaaauggcgaacggcauagcucuaggcuuaauggcacucaaauuaauaacucaguuugagacauaucaauuauggacggcguugauuucuuuaaccuguaguaauacuauuuucacgcucacugucgcuuggcguacugcgacguuaauuuuagcagggguuucauuacuaccaguaugucaaagcucgucgaugcgaaaaacagacuggcuaccgauggcaguugcagcgaugggcguaccuccgcuuccuuuauuuauauuugguuuaaaagacaccuugaaacgaaggucauggccauuaaaugagggaguaauggcagucggacuggucaguauucuugcgagcucauuacuucgaaaugacguuccaauggcaggaccacugguggcgggcggauuguugauugcguguuacguaaucaccggaaccucggcagaccuaacuguugaaaaagccgcggacauuacaugggaagaggaagcggagcaaacaggcgugucacauaaucuuaugaucacaguggacgaugacgguacaaugcgaauuaaggaugacgagacagaaaauauacuuaccguacuuuuaaaaacagcuuuacugauaguuaguggaaucuuucccuacaguauuccagccacguuacuuguauggcauaccuggcaaaagcaaacacagcggagugggguccugugggacguaccauccccaccugaaacucagaaagcggaguuggaggaggguguauauagaauaaaacaacaaggcauuuuuggcaaaacacaggucgggguugguguacaaaaggaaggugucuuucacacaauguggcauguuacacgaggagcuguauuaacauauaacggaaaacgcuuagaaccuaauugggcgucugucaagaaagaucucaucucuuacggcggcggcuggagacuuucagcgcaauggcaaaaaggcgaagaaguucaggucauagcaguagagccagggaaaaaucccaaaaauuuccaaaccaugccggggacauuccagacgaccacaggcgagauuggggcaauugcuuuagauuuuaaacccggaacauccgguuccccaauaauaaauagagaagggaaagugguuggccuuuauggcaacggcguuguuacuaaaaauggaggguacguaucaggcauagcgcaaacaaaugcagagccugacggaccuacgcccgaguuggaggaagaaauguuuaagaaaaggaauuugacuauaauggacuuacacccagggucaggcaagacacgaaaauacuuaccagcuauagugcgggaagcuaucaagagaagacuaagaacacuaauuuuagccccuacacgaguaguagcagcagaaauggaagaagcucuuaagggacuccccaucagguaucagaccacggcgacaaagagugagcacacaggacgggaaauaguugaccuaaugugccaugcaacauuuacaaugcgccuuuuaaguccaguacggguaccaaauuauaaccuuauaaucauggacgaagcgcauuuuacagauccagcguccauagcagcaagaggcuauauaaguacaagaguugguaugggagaagcagccgcaauuuucaugacagcuaccccaccgggaacagcagacgcuuuuccucaaucaaaugcgccuauucaagacgaagaaagagacauacccgagcguucguggaacucagggaaugaguggaucacagauuuugcgggaaagacgguaugguucgucccgucuauaaaagcuggaaacgacaucgcaaauugcuuacgcaagaauggaaagaaaguaauacaguuaaguagaaagacuuuugacacggaguaucagaaaacgaaauugaaugacugggacuuuguaguaacaacagauauuucagaaaugggcgcuaauuuuaaagcugauagagucaucgauccucguaggugccuuaaaccuguaauacucacagauggaccagaacgggucauacuagccgggccuaugccuguaacagcagcgagugcugcucaacguagaggaagaguaggacgaaauccacaaaaagagaaugaccaauacauuuuuacgggacagccccuuaauaaugacgaggaccacgcacauuggacagaagcaaaaauguuauuggacaacauaaauacaccagaagguauaauacccgcgcuauucgagcccgagagagaaaaaucagcagcuauagacggggaauaucgauuaaagggagaaucgcgaaaaacuuuuguagaguugaugcgcagaggagacuuaccggugugguuagcgcauaagguagcauccgagggaauuaaauauacggaucguaaauggugcuucgacggccaaaggaacaaccagauauuagaagaaaauauggauguagagauauggacaaaagaaggagagaagaagaaauuaagaccuagguggcuugacgcaagaacauauagugauccacuugcacucaaagaguuuaaagaauuugcagcaggacguaaauccauagcauuagaucucguaacagagauaggacgaguuccuagucauuuagcccaccgaaccaggaaugcacucgauaaccuaguaauguugcacacaagcgaacacggaggucgagccuauagacaugcaguugaagaacuaccugaaacaauggaaacacuuuuauugcuuggauuaaugauauuacuaacaggaggagcuaugcuauuuuugauaagcgggaaagguauagggaagaccuccauuggauuaauuugugucaucgccagcuccgggaugcuguggauggcagagauaccucuacaauggauagcaagcgccaucguuuuagaauuuuucaugaugguacuuuugaucccggaacccgagaagcagcgaaccccucaagacaaucaacucgcuuacguugugauugguauccucacucuugcugcaaucauugcagcuaaugaaaugggacuucuagaaacuacgaaaagagacuuagggauguccaaagaaccagguguaguuucgccaacuucguaucucgacguagacuuacaccccgcaucagcuuggacacuauacgcugucgcuacuaccguaaucacaccaauguuaagacauacaauagaaaacuccacagcuaacguuucauuagccgcaauagcaaaucaagccgucguccucaugggcuuagacaaaggauggccuauaagcaagauggaucuaggcguaccguuauuagcucuagguuguuacagccaaguaaacccccuuacucucacagcagcaguauuauugcuuauuacacacuacgcuauaauaggaccaggacuacaggccaaagcgaccagggaagcacagaagcgaacggccgccgggauaaugaaaaauccuacuguagacgggauuaugacaaucgauuuagaccccgucaucuacgacaguaaguuugaaaagcaauuaggccaagucaugcuccuuguacucugugcagugcaauuacuacuaaugagaacaaguugggcgcuaugugaagcgcuaacauuagcuacuggcccaauaacgacccuaugggagggaucaccugguaaauuuuggaauaccacgauagcaguguccauggcaaacaucuuuagggguucuuaccuugcuggcgcgggacucgccuuuagcauaaugaaaucaguggggaccggaaagcguggaaccggaucacaaggggagacccugggugagaaauggaagaagaaauugaaucaauuaaguagaaaagauuuugauuuauauaagaaauccgguauaacggagguagauagaaccgaagcaaaagaagggcucaaacguggggagauaacgcaccaugcuguuagucgaggaucggcuaaacuacaaugguucguagaaagaaacauggucauaccagaaggaagagucaucgaccuagguuguggaagagggggauggaguuacuacugugcaggacucaagaaaguuacagaaguccguggguauacaaagggcggaccgggccaugaggaaccaguuccaaugucaacauacggauggaacaucguaaaacugaugaguggcaaagacguguuuuaucuaccuccagaaaaaugugacacguuacuaugugauaucggagaaagcagcccaucucccacuguagaggaaucgcgaacaauaagaguucuaaaaaugguugaaccuuggcuaaagaauaaucaauuuuguaucaaaguacuuaauccauauaugccaacuguaauugaacauuuagaacgcuuacaacgaaagcauggaggaaugcuagucaggaacccauuaucacguaauucaacgcaugaaauguauuggauuaguaacgguacagguaacauuguggcuagugugaauaugguuagcagauuacuuuuaaacagauucacgaugacucauaggcggccaacuauagaaaaggacguagacuuaggggcagguacgagacacguaaaugcagaaccagaaacgccuaauauggauguaauaggggagcgaauaaaaagaauaaaagaagaacacaacaguacuuggcauuacgaugaugagaauccguauaaaacaugggcauaucaugguagcuaugaagugaaggcuacaggaucggcaucaucaaugauaaaugguguggucaaacuacugacaaaaccaugggacguagucccuauggucacccaaauggccaugaccgacacgacgccauuugggcaacaacguguguucaaagaaaaaguagauacgagaacgccaaggucaaugccaggaacgaggagaguuauggguauaacagcugaguggcuguggcgaacuuuaggaagaaauaaaaagccuaggcuuugcacacgcgaagaauuuaccaaaaaggugagaacuaacgcugccaugggagcaguauucacugaagagaaccaaugggacucagcaaaagcggcgguagaagaugaagacuuuuggaaacuggucgaccgcgaaagagaacuacauaaauugggaaaaugugggagcugcgucuauaacaugauggguaaacgagagaagaaacuuggcgaauuugguaaggcuaaaggcagcagagcaaucugguacauguggcucggugcaagauaucuagaauuugaagcucucggauuccuuaacgaagaccauugguuuucaagggaaaauucauacagcgguguagagggcgaaggcuuacaccgucuagguuacauuuuacgcgauauaucgaaaauacccgguggcgccauguacgcagaugauacugcuggaugggauaccaggauaacagaagacgaucuacauaaugaggagaaaaucacccaacaaauggauccagaacauagacaguuagcuaaugcgaucuucaagcuaacauaucaaaauaaaguagucaagguacaaaggccaacaccgacggggacaguuauggauauuauaucaagaaaagaucaacgcggaucaggucaagugggaacauauggauugaauacauuuacaaacauggaagcacaguugauucgacagauggaaggcgaaggaguacuaucuaaagcagacuuagagaacccacauuuaccagagaagaaaauuacacaaugguuagaaacaaaggguguugaaagauuaaaacguauggccauuaguggagacgauuguguuguaaaaccuauugacgauagauucgcuaacgcccuauuagcacuaaacgauauggguaaaguacguaaagacauuccacaauggcaaccgucaaaaggcuggcacgauuggcagcaaguacccuuuuguagucaccauuuucacgaauuaauuaugaaagacggacgaaaacuuguaguccccugucguccucaggaugagcuaauuggucgagccaggauaagccagggcgcagguuggucuuugaaagaaacagcaugucuagggaaagcauaugcacaaauguggagucuaauguacuuucauaggagggacuuaagauuagcaucaaacgcaaucugcucagcuguacccgugcauuggguaccaacaucaagaacuacauggucuauacacgcucaucaucaauggaugacuacagaagauaugcuaacaguauggaaucgcguauggauugaagacaacccuuggauggaagauaaaaccccaguaacuacaugggaaaaugugccauauuuagggaaacgugaagaucaauggugcggaucacuaauugguuuaacgagucgugcgacuugggcccaaaacaucccuacagcuauucaacagguacgcucucuaaucggcaaugaagaguuuuuagauuauaugccuucgaugaaaagauuuagaaaggaagaggaaucugaaggcgcuauuugguag

SEQ ID NO: 23239 - RNA, 9873 nt, Artificial Sequence
  derived and/or modified CDS sequence (opt6) from DENV-3__KF973479__SS-prME
acuucucugugccugaugaugaucuuaccugcugcacuggccuuucauuuaacaagccgcgauggugaaccaaggaugauagugggcaaaaaugaaagagguaagagcuuauuguuuaaaaccgcauccgggaucaauauguguacucuuauugcaauggauuuaggugaaaugugugacgacacaguuacauacaaaugcccacacaucacugaaguagaaccugaagacauugacugcugguguaauuuaacuagcacgugggucacauauggaaccuguaaucaggccggagaacauaggagagacaagcgauccguugcccucgcgccucauguuggaaugggauuagacacucgaacacaaacuuggaugagcgcugaaggagcuuggcggcaaguagaaaaaguugaaacaugggcacuaagacauccaggauuuacaauucuagcacuauuucuagcucauuauaucggaaccucucuuacacaaaaaguuguaauauuuauauuauuaaugcuaguaaccccgaguaugacaaugcgaugcguuggagugggaaauagggauuucguagaaggacuaaguggugccacuuggguggacguagugcucgaacauggcgguuguguaacuacaauggcgaaaaauaaaccaacacuggauaucgaacuacagaaaacagaagcaacacaacuugcgacccugaggaaauuauguauagaaggaaaaauuacaaacauuacuaccgauagccgaugccccacucaaggugaagcaacucuacccgaggagcaagaucaaaacuacguaugcaaacauacuuauguagacaggggauggggaaauggcuguggauuauuuggcaaaggcagcuuaguaacaugugccaaauuucagugccuugaaccaauagaagggaaaguaguacaauaugagaaucucaaauauaccguaaucauuacagugcacacaggagaucaacaucagguaggaaacgaaacccaaggaguuaccgcagagaucacaccucaagccaguaccacagaagcaauuuuaccugaauauggaacguugggauuggagugcucuccucguacaggacuggacuucaaugagaugauucuuuuaaccaugaaaaauaaagcauggaugguucauaggcagugguucuuugacuuaccguuaccauggaccucgggagccacaacugaaacaccgaccuggaaucgaaaagaacucuugguaacauuuaaaaacgcucacgccaagaaacaagaagucgucguucucggaucccaagaaggcgcuaugcacacggcacuuacuggcgcuacugagauucaaaauuuaggggguaccuccauuuucgccggccauuuaaaaugucguuugaaaauggacaaauuggaguuaaaaggaaugucguacgcaauguguacaaacacguuuguauugaagaaagagguaucagaaacacaacauggaacaauuuuaauaaaaguggaguacaaaggagaagacgcaccauguaaaauacccuucaguacugaagauggucaagguaaggcacacaacggucgauugauaaccgccaaccccgugguuacaaagaaagaagaaccggucaauauagaagcggagccacccuuuggcgaauccaauauaguuauaggaauuggcgauaacgcacuaaaaaucaacugguacaagaaggguucaucgaucgguaaaauguucgaagcaacugcccgaggagcaagacgaauggcaauuuugggagacacagcaugggacuucgguucugugggcggugugcuuaauucguugggaaagaugguucaucagauuuucgguucagcguauacugcucuuuuuaguggaguaaguugggugaugaagauaggcauaggggucuuauuaacauggauuggauuaaauagcaaaaacacgagcauguccuucucauguaucgcaauagguaucauuacuuuguaucucggggcuguaguacaagcagauaugggcugcguuauaaacuggaaaggcaaggaauuaaagugcggaucagguauauucgugacuaaugagguucacacuuggacagaacaauauaaauuucaagcugacagcccaaaacgauuagccacggccauugcuggagcuugggaaaaugguguguguggaauuagaaguacuacucgaauggaaaacuuacuguggaaacaaaucgcgaacgaacuuaauuauauauugugggaaaacaacauuaaacugacaguaguugucggagauaucauaggaguacuagagcagggaaaacgaacacuuaccccgcaaccaauggaacuaaaauacagcuggaaaacuuggggaaaagcaaaaauagucacugcagaaacccaaaauucuucguucauaaucgauggaccgaauacaccugaauguccgucuguuagccgggcuuggaauguuugggaagucgaggauuacggcuuuggaguuuuuacuaccaacauauggcuuaagcuaagggaagucuauacgcagcugugugaccacagacucaugucagcugcaguaaaagaugagcgcgcagugcaugcggacaugggauacuggauagagucucagaagaauggcucauggaagcuagagaaagccaguuuaauagaagucaaaacauguacguggcccaaaucacacacacuauggaguaaugguguauuagaguccgauaugauuauuccaaagagcuuggcuggucccauaucccaacacaaucauaggccaggauaccauacucagacggcaggaccuuggcaucugggcaaacuagaguuggauuuuaauuauugugaaggaacaacuguugucaucacagaaaauuguggaacucggggacccagcuuaaggaccacuacaguuucgggaaaguuaauccacgaaugguguuguagaucaugcacuuuaccucccuuacgcuauaugggggaagauggcuguugguauggaauggaaauaagaccuaucagugaaaaggaagagaacaugguaaaaagucugguaucugcaggaucaggaaagguagauaauuucacgaugggcguguuauguuuggcgauucuguucgaagaaguaaugagggggaaguucgguaagaaacacaugauagcaggggucuucuuuaccuucguguuauuauuaucaggccaaauaacuuggagagacauggcccauacucuaauaaugauaggaucuagcgccagcgaucgaauggggaugggaguaaccuaccuugcacuaauugcaacguucaaaauacaaccuuuucucgcccugggguuuuucuuaagaaaguuaacuucgcgagaaaaccugcuacucggagucggacuagcuauggcuacaacuuuacaguugcccgaagacauagaacaaauggcaaacgggaucgcacuagggcucauggcguuaaaguuaauaacucaauucgaaaccuaucaguuauggaccgcguugaucucucuuacauguucuaacacgauauucacccuuacuguagccuggcgaacagccacccuaauacuggcuggcgucucgcuuuuaccagucugucaaucuagcagcaugcgaaaaacggauugguuacccauggcgguagcugcuauggggguaccaccacuuccacuauucauuuuuggauugaaagauacccuaaagcguagaagcuggccuuugaaugaaggggugauggcaguaggucucguaucuauucuggccaguucucuuuugaggaaugaugugccuauggcuggaccauugguugcaggaggguugcugaucgcuugcuacguuauaacggguaccucugcggauuuaacaguagaaaaagcagcugacauaaccugggaagaagaggccgagcaaacgggaguaagucauaaucugaugauuaccguggaugacgauggcaccaugagaauuaaagacgacgagacagagaacauucuuacaguguuacuaaaaacugcauuacucauugugagcgggaucuuucccuacuccauuccugccacacuacuuguauggcacacuuggcaaaaacaaacucaaagaagcgguguccuaugggauguuccgagcccaccugagacacaaaaagcagaacucgaagaagguguauauagaauuaagcagcaagguauauucggaaaaacccaaguagguguuggaguucaaaaagaggguguuuuccacacaauguggcauguaacacgcggugcaguucugacauauaauggcaaaagauuagaaccuaauugggcgucaguaaagaaggaucuaaucucuuauggcgguggauggagacuuuccgcgcaguggcagaagggcgaagaaguacaagucaucgcaguugaaccaggcaaaaauccuaaaaauuuccaaaccaugccaggaacauuucaaacaacaaccggagaaauuggagcuauagcauuagauuucaaaccaggaacaaguggcucuccuaucauaaaucgagaagguaagguaguaggcuuauacggcaacggugugguaaccaaaaacgguggguaugugucugggauugcacagacaaaugcagaaccggauggcccuacaccagaacuagaagaggaaauguuuaagaaaagaaaucuaacuaucauggaccuacauccugguaguggaaaaacaagaaaauauuuaccggccaucguaagggaggcgauaaaaagacgacuuaggacucucaucuuagcgccaacucgagucguugcggccgaaauggaggaggcuuugaaaggauuaccaaucagauaucagacaacggcaacgaaaagcgagcauacaggaagagaaauaguagaucuaaugugucacgcgacguucacgaugcguuugcugucuccuguucgaguacccaauuacaaccuaauuauaauggacgaagcccacuucaccgacccggcuagcaucgcagcaagaggauauauaucuacuagaguugguaugggagaagcagccgcaauauuuaugacggcaacgccgccuggcacggcagaugcauuuccacaaaguaaugcuccaauacaagaugaggaacgugacaucccagaaaggaguuggaacucaggaaacgaauggauuacggauuuugcuggaaaaacaguaugguucguccccucuauaaaagcugguaaugacaucgcgaacuguuugaggaaaaauggcaagaaaguaauacaauuaagcagaaaaacguuugacacagaguaucagaaaacaaaacuuaacgacugggauuuuguagugacuacugacauuagugaaaugggcgcuaauuucaaagccgacagagugaucgacccgagaagaugucuuaaaccaguuauccuaacagauggaccugagagaguuauauuggcaggucccaugcccguaacagcagcaagcgccgcgcaaagacgggguagagucgggcggaauccgcaaaaagaaaacgaucaguauauauuuacaggccaaccuuugaauaacgacgaagaucacgcucacuggacagaagcuaaaaugcuacuagacaauauaaauacaccagaaggaauaauccccgcuuuauuugaaccagaaagggagaaaagugcugccauugauggagaauaucggcuaaagggugaaucaaggaaaaccuuuguagaacuuaugcggagaggggacuuaccgguuugguuggcccacaagguagcuagcgaaggaauaaaauacacagauagaaaaugguguuucgacggacagaggaauaaccaaauauuagaagaaaacauggauguggagauauggacuaaagagggugaaaagaagaaacuucgcccuagaugguuagaugcacgaaccuauuccgauccgcuugcucuaaaggaauuuaaagaauuugcagcagguaggaaaucaaucgcacuagaccuugugaccgaaauagguagggucccaucgcauuuggcacauagaaccaggaaugcgcucgacaauuuaguuauguugcacacauccgagcaugguggcagagcauauagacacgccguagaagaacugccugaaacuauggaaacauuauuacuauuaggauuaaugauauuacuuacaggaggcgcaaugcuauucuuaauaucgggaaaagggauaggaaaaacaaguauaggacuuauaugcguuauagcaaguagugguaugcuguggauggccgagauaccgcuucaauggauugcauccgcaauugucuuagaguucuuuaugaugguacuguugauaccggaaccagaaaagcaacguacaccccaagacaaucaacuugcauauguaguaaucgguauuuuaacguuagcugcaauuaucgcugcaaaugaaaugggacuacucgaaacuacgaagcgagacuugggaaugagcaaagaaccagguguaguaagccccaccagcuaucuagacguugaccugcauccugcuagugcauggacacuauaugcaguagcaacgacugugauaacgcccaugcuaagacauacgauagaaaauucgacugcaaacgucucguuggcugcgauugccaaucaggcagugguuuuaaugggacuugacaaaggauggccaauaagcaaaauggauuuaggcguaccauuacuagcacucggauguuauucucaaguaaauccucuuacuuuaacugcagcagucuuacuauugauaacccauuaugcgauaauagggccgggucugcaggcaaaagcaacaagggaagcacagaaaagaaccgcugccgguauaaugaagaauccgacaguggauggaauaaugacuauugaucuggacccaguuauauaugauucaaaguucgaaaaacagcuuggccaaguaauguuauugguauuaugugcuguacaauugcuucucaugcgaacgucaugggcauugugugaggccuugacauuagcaacuggacccauaacuacgcuuugggaagguagcccgggcaaauucuggaauacaacaaucgcggugucaauggccaauauauucagaggaucauaccucgccggagcaggucuugccuuuagcauuaugaaaagugugggcacuggaaaacgcgggacuggaagucaaggugaaacauuaggggaaaaguggaagaagaaacugaaucaacuuaguagaaaagauuucgauuuauauaagaaaucaggcauaacugaaguugauagaaccgaagcaaaagagggucuuaaacgaggagaaaucacccaucacgcuguuuccagaggauccgcgaaauuacagugguuuguggaacggaacaugguuaucccagagggacgugugauugaucuuggauguggccguggaggaugguccuauuacugcgcuggacucaagaaaguaacagaaguccgugguuacacgaaaggaggaccaggacaugaagaaccuguuccaaugagcacuuacgguuggaacauuguaaaauugaugucagguaaggaugucuuuuauuuacccccugagaagugcgacaccuuacuuugcgacaucggagagagcagcccaucucccacgguggaagaaucaagaacaauacgaguucuuaaaaugguagaaccauggcuuaaaaacaaccaguucugcauaaaaguccuaaacccauauaugccaacaguuauagagcaccuagagagacuacaaaggaagcauggugguaugcuaguuaggaacccgcugagccgaaacaguacacaugagauguauuggauaucgaauggaacggguaauauaguagccucaguaaauauggucucacgauugcuguugaacagauuuacuaugacccacaggcggccaaccauagaaaaagauguagaucuaggagcgggaacaagacauguuaacgcagaaccagaaacaccaaacauggacgucauaggugaaagaauaaaaagaaucaaagaagaacacaauucuaccuggcacuacgacgaugaaaaucccuauaagacgugggcuuaucacgggucauacgaaguuaaagcaacaggaucggcuucgucgaugauuaacgggguagucaaacuacuaaccaaacccugggaugucguaccaaugguaacucaaauggcaaugacagauacgacuccguucggacaacaaagaguauucaaagagaagguugauaccagaaccccuagaaguaugcccggaacacgaagaguaaugggaauuacugccgaaugguuauggagaaccuuagggcgcaacaagaaaccaagauuaugcaccagggaagaguucacuaagaaaguaagaacgaacgccgcaaugggcgcuguguuuacugaagagaaccaaugggacagugcaaaagcugcaguggaagaugaggacuuuuggaaguugguugacagggagagagaacuccauaaauugggcaaaugugggucuugcguauauaacaugaugggaaaacgagagaagaaacucggagaauuugguaaagccaaaggcagccgugcgauaugguauauguggcucggugcacgauaucuggaauuugaagcauuaggauuuuuaaaugaggaucauugguuuucacgugaaaacucauauagugguguagaaggugagggccuacauaaacuugguuauauccucagagacauaaguaagaucccugguggcgcaauguaugcugacgacaccgcgggaugggacacgagaauaacggaggaugauuuacauaaugaagagaaaauuacacagcaaauggauccugaacaucgccaacuagcaaacgcuauuuucaaacuaacguaccaaaacaaaguaguaaaagugcagcgaccaaccccaacaggaacgguaauggauaucaucuccagaaaagaccaacguggaucaggccagguugggacauauggacuaaauacauucacgaauauggaagcccaauuaauccggcaaauggagggugagggugucuugagcaaagcggauuuagaaaacccccaucuuccagagaagaaaauaacgcaauggcucgagaccaaaggagucgagagguuaaagagaauggcuauaucuggagaugauuguguaguuaaaccuauagacgauagauuugcaaacgcacuacuggcucucaaugacaugggaaaaguaagaaaggauauaccgcaguggcaaccuucaaagggauggcaugauuggcaacaaguaccauuuuguucccaucauuuucaugaacucauaaugaaagacggacgaaaauugguaguccccuguaggccccaggacgaacuaauuggacgggcuagaaucagucaaggagcaggcuggucccuaaaagagacugcauguuugggaaaggcuuacgcgcaaauguggucacuaauguauuuucauaggagagaucuacgacuggcaucaaacgcuauauguagcgccguaccaguacauuggguaccaacuagcaggacgacgugguccauacaugcucaccaccaauggaugaccacugaagauauguugaccguuuggaacaggguauggaucgaagauaauccauggauggaagauaaaacucccguaaccacgugggaaaauguacccuauuuaggaaaaagagaagaucaauggugcgguucauuaauuggauugacaucacgugcaacgugggcucaaaauauaccaacugcgauacaacaaguacgcucauuaauagguaaugaggaauuucuugauuacaugcccucgaugaaaagguuucgaaaagaagaagaaagcgagggagcgaucugguga

SEQ ID NO: 23240 - RNA, 9873 nt, Artificial Sequence
  derived and/or modified CDS sequence (opt6) from DENV-3__KF973480__SS-prME
acuagcuuaugccuaaugaugauauuaccugcagcacuugcuuuucaucugacgucacgugauggcgaaccccgaaugaucguuggcaaaaaugaacgggguaaaucauugcuuuucaaaacagcaaguggcaucaauauguguacgcugauagcuauggacuuaggggaaaugugugaugacacagucacuuacaaauguccccauauuacagaaguagaaccagaagacaucgauuguuggugcaaccucacaagcacuugggugaccuaugggacuuguaaucaagcuggcgaacaucggagagauaaaagaagugucgcgcuugcgccccauguuggcaugggccuugacacuagaacacaaacuuggaugucugcagaaggagcauggaggcaagucgaaaaaguugaaacuugggcacuuagacacccagguuucacaauauuagcuuuauuccuagcacauuauauagguacgagucuaacgcaaaaaguagugauauuuacauuacugauguuggugaccccaaguaugacgaugaggugcgugggaguuggaaacagagauuuuguugaaggacuaagcggcgcaaccuggguagacgucgucuuagaacauggagguuguguaacuacuauggccaaaaauaaaccaacacuagauauugaguuacagaaaacggaggcaacccaacuugcuaccuuaagaaaacuauguauagagggaaaaauaacuaacauuacgaccgauagccgguguccaacacaaggcgaagcaacauuaccggaggaacaagaccaaaacuacgugugcaaacacacuuauguggacagaggaugggguaacggaugugggcuauucggaaaagguagucugguaacgugugcaaaauuccaaugcuuagaaccuauagaagggaaaguaguucaauacgaaaaucugaaauauacgguuauuauuacggugcauacaggugaccaacaccaagucggaaacgaaacacaaggaguaacggccgaaauuacaccccaagcauccaccacagaagcuauccuaccagaguacgguacucuagggcuugaauguucuccaaggacaggauuagacuucaacgaaaugauacuuuuaaccaugaaaaacaaagcauggaugguccaccggcaaugguucuucgaccuuccacuaccguggacaagcggugcuacuaccgaaacaccuaccuggaaucgaaaagaauuauuaguuacauucaaaaaugcccaugccaagaaacaagagguugugguuuuaggaucucaagaaggcgcaaugcacacggcauuaacaggggcaacugagauacaaaacucaggcgggacaucaauuuucgcagggcacuuaaaauguaggcuaaaaauggauaaacuugaauugaaaggcaugaguuaugcaaugugcacuaauacauucguccucaagaaagaagucagcgaaacacaacaugguacuauuuuaauaaaaguagaauauaaaggugaggacgucccguguaaaauuccauuuagcacugaagacggccaaggaaaagcgcacaauggacgauuaauaacagcuaacccaguaguuaccaagaaagaagaaccaguuaauauagaggcggagccaccuuuuggagaguccaacauuguaauaggaauaggagauaaugcguuaaaaauuaacugguauaagaaaggaucaucuauuggaaaaaucuuugaggcaacagcccgaggagcccggaggauggcuaucuuaggagacacggccugggauuucggaaguguaggagggguacuaaacucauuaggcaaaaugguacaccaaauauuuggaagcgcauacacugccuuguuuuccggaguuucgugggucaugaaaauagggauuggaguauuacuuacguggaucggccucaauuccaaaaacacaagcaugucauuuaguugcaucgcaaucgguauaauuacacucuacuuaggggcuguuguucaagcugacaugggaugugucauaaauuggaaaggcaaagaauuaaaaugcgggucggguauuuucgugacaaacgaagugcauacauggacagaacaguacaaauuucaagcagauaguccaaaaagauuagcaacggcuauagcgggggcaugggaaaacggaguauguggcauacguucaacaacccgaauggaaaauuuauuauggaagcagauagccaaugaguuaaauuauauauuaugggaaaacaacauaaaacuaaccguugucgucggagacauuaucggaguccuugaacaagguaaaagaacacuaacuccgcaaccaauggaauuaaaguauuccuggaaaacauggggcaaggcuaaaauugucacugccgaaacucaaaauucaaguuucauaauagauggcccaaauacgccugaguguccaagcguuagcagggcguggaauguaugggaggucgaggacuauggcuucgguguauuuacaacaaacauauggcuaaaauugagagaagucuauacccaacuaugugaccacagauuaaugucagcagcagucaaagacgaaagggcaguucacgcagauaugggcuacuggauagaaucacagaaaaauggaaguuggaaauuagaaaaagcgucucuuauugaaguuaagacauguacguggccaaaaucccauacguuauggucuaauggcguccuugaaucagauaugaucauaccaaagucuuuagcaggucccaucagccaacacaaucaucggccugguuaccauacccaaacugcugguccuuggcaucucgguaaacuagaauuggacuucaauuauugugagggaacuacgguuguaauaacagagaauuguggcacacguggccccagucuuaggacuacgaccguauccgggaaauuaauacaugagugguguugccgaucauguacucucccuccauugagauacaugggcgaagacggauguugguacggcauggaaauacguccgauaucagagaaagaggaaaauauggucaaaagccuaguaagugcaggcucggguaaaguagacaacuuuaccauggguguguuaugccuugccauccucuucgaagagguaaugagaggaaaauuugggaaaaagcacaugauagcagggguguuuuucacauuugcccuacucuuaagcggucagauuacauggcgcgauauggcacauacuuuaauuaugauaggaucaaaugcaucggaccgaauggguauggggguuacauaccuugcacuaaucgcaacauuuaaaauacagccauuuuuagccuuaggauucuuuuuaagaaaacuaacaucaagagaaaauuuauuauuaggagugggauuagccauggcaacaaccuuacagcuaccagaagauauagaacagauggcaaacggaauagcacugggccugauggcccuuaaacuuauuacucaauuugagacauaucaacucuggacggcauuaaucucacucacguguaguaacacuauuuuuacauuaacaguugccuggagaaccgcaacauuaauacuagccgguguauccuuauuacccgucugccaaucgucaaguaugaggaaaacugauugguuaccaauggcagucgcugcaaugggaguuccuccacuaccacuguuuauauucggguuaaaagauacacuaaagaggcgaucauggccuuuaaaugaagggguaauggcgguaggauuaguaaguauauuagccucuaguuuacuuagaaacgauguaccaauggcaggaccccuaguugcggguggauuacucauagcauguuaugugaucacaggaacgagcgcagaucucacuguagaaaaagcggcggacauuacuugggaagaggaagccgaacaaaccggugugagccauaaucuuaugaucacuguagaugacgacgguacaaugcgaauuaaggaugaugaaacagaaaacauauuaaccguucuauuaaagacugcauuacuuauuguauccgggauauuccccuacagcauaccagcaacucuuuuaguauggcauaccuggcaaaaacaaacucaaaggagcgguguucuaugggacgucccgaguccaccagaaacucaaaaagccgaguuagaagaaggagucuacaggauaaaacaacaaggaauauuugggaagacgcaagucggaguugguguacaaaaagaagggguuuuccacacaauguggcaugugacgaggggagcgguguugacauauaaugguaagagacuagaaccgaauugggcaagcgucaagaaagaccucauuucauacggaggaggauggaggcugagcgcccaauggcagaaaggugaggagguucagguaauagcagucgaaccuggaaagaauccaaagaacuuucagacuaugccuggcacauuccagacaacaacaggggagauuggugcaaucgcacucgacuuuaaaccugguacgucagguuccccgauuauaaauagagaggguaaagugguagguuuauacgguaacggcguaguaacuaaaaacggagguuaugugagcgguauagcucaaaccaacgcugaaccagacggaccaacacccgaacuagaagaagagauguucaagaaaaggaauuuaaccauaauggaucuucaucccggguccggaaaaacaagaaaguaccucccggcaauagugagagaagcuaucaaaagacguuuaagaacgcucauccuggccccuacacguguuguggccgcagaaauggaagaagcguuaaaggguuuaccuauccgauaccaaacaacugcaacaaaguccgagcacacgggucgugaaauaguugacuuaaugugucacgcaacauucacaaugagauuacucucaccgguuaggguaccgaauuacaacuuaauaauaauggacgaagcccauuuuacggacccugcgagcauagccgcucgcggauauauuucaacacgggucggcaugggggaagcugcagcuauauuuaugaccgcgacaccaccaggaacagcggacgcuuucccacaaagcaaugccccaauccaggacgaggagcgagauauuccagaacguucuuggaacucggguaaugaauggauaacagacuuugccggaaaaacggugugguucguaccaaguauaaaggcuggcaacgacauagccaauugucuaaggaaaaaugguaagaaaguuauucaguuguccagaaaaaccuucgauacugaguaucagaaaacuaaacuaaaugacugggauuuuguaguaaccacagauauuagcgaaaugggugccaauuuuaaggccgauagaguuauagauccgcgucggugucuuaagccgguuauauuaacagauggaccggagagagucaucuuagcaggaccaaugcccguaacagcagcaagcgcggcacaacguagaggucguguaggcagaaacccucaaaaagaaaaugaucaauacaucuucacaggccaaccucuaaacaacgaugaagaccacgcgcauuggacagaggccaaaaugcuucuagacaauauaaacacaccagaaggcaucauuccagcacuuuucgagccggaaagagaaaagucagcagcuauagacggagaguauagauuaaagggagagucuagaaaaaccuucguggaacucaugcggaggggagaucuaccaguauggcuagcacacaaaguggcuucagaagguauaaaauauacagaccguaaaugguguuuugauggucaaagaaauaaucaaaucuuagaagagaauauggacguggaaauauggacaaaggaaggagagaaaaagaaauuacgaccuagaugguuggaugcccgaaccuacagugauccauuggcgcuaaaagaguucaaagaauuugccgccgguagaaaaaguauagcacuagaccucguaacagaaauaggccgaguaccuucacaucuagcccaccggacacguaacgcucucgauaauuuaguuaugcuacacaccucagaacauggugguagggcuuaccgacaugccguugaagaacugcccgaaacaauggagacacucuuacuucuuggacucaugauucuauuaacuggaggggcuaugcuauuccuaauauccgguaaagguauuggaaaaaccucaauuggacuaauauguguuauagcguccagugguauguuauggauggcggagaucccucuucaauggauugcaagugccauaguucucgaguucuuuaugaugguuuuguuaauuccugaaccggagaaacaacguacuccucaagauaaccaacuugccuauguaguaauuggaauuuuaacacuagcagccauuaucgcagcuaaugaaaugggucuuuuagaaacgacgaaacgugaucuuggcaugucaaaagaaccaggaguaguaaguccuacaaguuaccuugauguagaucuccacccagccagugccuggacacucuaugccgucgcaacaacaguaauuacuccuaugcuaagacacacaaucgaaaauuccacugccaauguuaguuuagcagccauagcaaaccaagcaguuguacuaaugggguuagauaaggguuggccgauuucuaaaauggaccuugguguaccauuauuggcauugggauguuauucccagguuaauccgcucacacuuacugcagcaguccuacuacuaauaacucacuaugcuaucauuggaccggggcuccaagcaaaggcuacacgugaagcacaaaagagaacagcugcuggaauaaugaagaauccgacgguagacgguaucaugacaauagacuuagaucccgugaucuacgauagcaaguuugagaaacaguuagggcaagugaugcuacucgugcuuugugcggugcaguuauuacuuaugcggacaaguugggcgcucugugaggcuuuaacauuggcaacgggaccaauuacaacccuaugggaaggaagcccuggaaaauucuggaauacgacaauagcagugagcauggcaaacaucuucagaggcucauaucuugcuggggcaggucucgcauuuaguauuaugaaaucugucgguacaggaaaacgcgguacaggcagucaaggagaaacauugggugaaaaauggaagaagaaauuaaaucaauuaagucguaaggauuuugacuuauauaagaaauccggaauaacggaaguugaucgaacggaagccaaagaaggccugaaacgaggagaaaucacucaucacgcaguaucacguggaucugccaaauugcaaugguuuguagaacgaaauaugguaauaccugagggacgaguaauagaucugggauguggcagaggggguuggucauauuauugugcagggcuaaagaaagucacggaagucagaggauacacuaaaggggguccugggcacgaagaaccaguaccaaugucaaccuaugguuggaauauaguuaaauuaaugucgggaaaagacgucuucuauuugccgccagaaaaaugcgauacacuccuuugugacaucggggaaagcagcccaagcccaaccgucgaagaaucccggacaauacguguauuaaaaaugguugagcccuggcucaaaaauaaccaguucugcauaaaggugcugaauccuuacaugccuaccguaaucgagcaucuugagagauuacaaagaaaacauggaggaaugcuagucagaaaccccuuaagcagaaauucaacacacgaaauguacuggaucucuaacggaacgggcaacauaguagcaagcgucaauauggucucaagacuguuacuaaacagauucaccaugacgcaccggagaccuacuauagaaaaggauguagauuuaggggccgguacgaggcacguaaacgcagaaccugaaacaccuaacauggauguuaucggagagcguauaaaaagaauaaaggaagaacauaacaguacguggcauuaugaugacgaaaacccguacaaaacgugggcauaccaugguuccuaugagguuaaggccacaggaucagccucaaguaugauuaacgggguagugaagcuauuaacaaaaccuugggacgugguaccaauggucacgcagauggcgaugacugauacaaccccuuucgggcaacaaaggguuuucaaagaaaagguagacacacgaacgccaagaucuaugccaggaaccagaagaguaauggguauaaccgcggaaugguuauggcgcacauuagggagaaacaagaaaccccgauuguguacuagagaagaguuuaccaagaaaguccggacaaaugcugccaugggugcagucuuuacugaagagaaucagugggacuccgcaaaggcagccguagaagacgaagacuucuggaaauuaguagauagagagagggaacuccacaaacuuggaaaaugcgguagcugcguauauaacaugaugggcaaacgcgagaaaaaguuaggagaauuugggaaagcaaaaggaagucgggcaauuugguacauguggcuaggcgcucguuaccuagaauuugaagcccuagguuuccucaaugaagaucauugguucagucgggaaaacucguauucggguguagagggagaaggccuacacaaacuuggcuacauauuacgugauaucucaaaaauuccgggaggugcaauguaugcugaugauacagccggcugggacacgcgaaucacagaagaugaucuccauaaugaagagaagauaacucaacagauggauccagagcaccgacaauuagcaaaugcuauuuuuaagcuaacguaccagaacaaagucguaaagguacagagaccaacaccaacagguacagucauggauaucauuucacgaaaagaccagcgagggucgggacaaguaggaaccuaugguuuaaacacauuuaccaacauggaagcacaguugauuaggcaaauggaaggagaggguguacuaucaaaggcugauuuagaaaauccucaccucccagagaagaaaauaacacaauggcuagaaacaaaaggaguggagcgauugaagaggauggcaauaucaggagaugacugcgucguuaaaccaauugacgacagauuugcgaaugcguuauuggcacuaaaugauauggguaaaguacguaaagacauaccacaguggcaaccaagcaaaggauggcacgacuggcaacagguuccauuuuguagucaucauuuccaugaacuaauuaugaaggauggucggaagcugguaguaccguguagaccucaagaugagcuaauaggacgcgcgaggauaucacaaggugcagguuggucguuaaaagaaacagcuugccuggggaaagcauaugcacaaauguggucucuuauguacuuucacagaagggaccuacguuuagcgucaaaugcgauuugcuccgcagugccgguacacuggguaccaacaaguaggacaaccuggagcauccacgcacaccaucaauggaugacaacagaggacaugcuuacgguguggaauaggguauggaucgaggauaacccauggauggaggauaagacaccagugaccacaugggaaaauguuccuuauuuaggcaaacgagaagaccagugguguggaaguuuaauaggccugacuucaagagccacuugggcccagaauauaccaacagccauacaacaaguucggucucuaaucggcaacgaggaguucuuggauuacaugccgucuaugaaaagauuuagaaaagaagaagagucugagggggcuauaugguaa

SEQ ID NO: 23241 - RNA, 9873 nt, Artificial Sequence
  derived and/or modified CDS sequence (opt6) from DENV-3__KF973481__SS-prME
accagcuuaugcuuaaugaugauauuaccugcagcucuagcauuccaucuaacuucuagagacggagaaccucgcaugauaguagggaaaaaugaacguggaaaaucucuacuuuuuaaaacagcaagcggaauaaacauguguacauuaauugcaauggauuuaggagaaaugugugaugauacaguaacguacaaaugcccucacaucacugaagucgaaccugaagacaucgauuguugguguaauuugacgaguacgugggucacuuacggaacuugcaaucaagcgggcgaacaccgucgcgacaaacgaagcguagcacuagcaccacaugugggaaugggcuuagacacuagaacacaaaccuggauguccgcggaaggggcauggaggcaggucgaaaaaguagaaacaugggcauuacgucauccuggauuuacuauccuagcucuguuucuagcacauuauauaggaacuagcuuaacacaaaaaguuguaauuuuuauccuacuuauguuaguuacacccaguaugacuaugagguguguaggagucgguaacagagauuuuguggaaggauuaagcggggcaacuuggguugaugugguacuagaacacgguggauguguaacaacaauggccaaaaauaaaccaaccuuagacaucgaacuucagaaaacggaagcuacucaacuugcaacauuacgaaaacugugcauagagggcaaaaucacaaauaucacaaccgacagcagauguccaacucagggagaagccacuuugccggaagaacaggaucaaaauuacgucugcaaacacaccuacguugacagagggugggguaauggguguggccucuuuggaaaaggaucacugguaacaugugcaaaauuucagugccuagaaccuauagaaggaaaaguuguucaauacgaaaaucuaaaauauacuauaauaaucacaguccacacaggugaccaacaucaaguugggaaugaaacacaaggaguaacagcagagauaacuccccaagcgaguacaacugaagccauccugccugaauauggaacgcuuggucucgaauguaguccacgaacgggacucgacuucaacgaaaugauccuauuaacgaugaaaaauaaggcuuggaugguacaucggcaaugguucuucgacuuaccacuuccauggacgagcggugcaaccacugaaacaccaacuuggaaucgaaaagaacuauuaguaacuuuuaaaaacgcgcaugcuaagaaacaagaagucgucgucuuaggaagccaagaaggugcaaugcacacggcucugacuggugcaacagaaauacaaaacucaggcggcacaagcaucuucgccggacaccuaaaaugucgucuaaaaauggacaaacucgaauuaaaaggaaugucuuacgcuauguguacaaacacauuuguccuaaagaaagaaguuagcgagacccaacauggaacaauacuaauaaaaguagaauauaaaggggaggaugucccuugcaaaaucccuuucaguacggaagauggucaagguaaagcgcauaacgguaggcuuauaacugcaaauccuguaguaacgaagaaagaagaaccaguaaauaucgaggcggaaccaccguucggcgaaucgaauauaguaauugggauaggagacaacgcucuuaaaauuaacugguauaagaaagguucuagcauaggaaaaauguuugaagcgacugcuagaggagcgagacgaauggcaauccugggcgauaccgccugggauuuugguucaguugggggagugcugaauaguuuagggaaaaugguacaccaaaucuuugguagcgcuuauaccgcucuauuuucgggagucucauggguuaugaagauagguauagggguacuguugacuuggauaggacuaaauagcaaaaauacuucaauguccuucuccugcauagcaauugggauaaucacuuuauaccuuggggccgucguacaggcagauaugggaugcgugauaaauuggaagggcaaagaguuaaaguguggcucgggcauauuugucacaaaugaagugcacacuuggacagaacaauauaaguuucaagcagauagcccaaaaaggcuugcgacagcaauagcaggggcgugggagaauggcguuugugguauucggagcacaacucgcauggaaaaucuauuauggaagcaaauugcaaaugaauuaaacuacauauugugggagaauaauaucaaacuuacagugguuguaggagacaucauuggagucuuagaacaaggaaaaagaacuuuaacaccgcaaccgauggagcugaaauauucauggaaaacaugggguaaagcaaaaauuguuacagcugagacacaaaauuccaguuuuauaauugauggcccaaacacuccggaauguccgaguguaaguagggcguggaacgugugggaaguagaagauuaugguuucggagucuucacuacaaauaucugguuaaaacuucgagaaguauacacacagcuaugugaccacagguuaaugucagccgccguaaaagacgaaagagccguacacgcggauaugggauauuggauagaaagucaaaagaaugguaguuggaaauuggaaaaagcaaguuuaauugaagugaaaacauguacauggccaaagagucauaccuuauggucaaauggaguauuagagucagacaugauuauuccaaaaucucuagcaggucccauaagccaacacaaucauagaccaggauaucauacucagacugcagguccguggcauuuaggaaaacuagagcuagauuuuaacuauugugaaggcaccacaguagucauuaccgaaaacuguggaacgagagggccaucacuuagaacaacgacugugucugggaaacucauacaugagugguguuguagguccuguacucuuccaccccuaagauacaugggugaagacggauguugguacggaauggaaaucaggccaauaagugaaaaagaggagaauauggugaaaaguuuaguaagugcggguagcggcaaagucgauaacuucacaguaggcguacugugccuagcaauauuauucgaagaagucaugagaggaaaauucggcaagaaacacaugauagcaggggucuucuuuacauucguauuauuauuaucuggacagauaacauggcgagacauggcccauacccuuauuaugauaggaucaaaugcuagugaucgaaugggaauggggguaacauaucuugcacucaucgcaaccuucaaaauacagccuuuucuagcuuuaggauucuuccuaagaaaacucacaagucgagaaaaucuuuuauugggagucggauuagcgauggcaacgacauuacaguuacccgaagauauagaacaaauggcuaauggaauagcguuaggacugauggcauuaaaacuaauaacucaauucgaaaccuaccaacucuggacggcauuaauaucacuaacauguucaaauacaauuuucacauugacgguugcauggcgaacagcaacccuuauucucgcaggagucagucuuuuaccaguuugccaaucauccucaaugagaaaaaccgacugguuaccuauggcaguugcugcaaugggcgugccuccccugccucuauuuaucuuuggauuaaaagacacacucaaacgcagaucuuggcccuuaaacgaaggaguaauggcaguuggauuaguuaguauacuugcuagcuccuuauuacgaaaugauguacccauggccggcccauuaguagccgguggucuauuaauagcauguuacguaauaacagggacaagugcggaccucacuguagaaaaagccgcggauaucaccugggaagaagaagcggaacagacagguguaagucauaacuuaaugauaacaguggacgaugacgggacaaugcgaauuaaagaugaugagaccgagaauauacuaacagugcuacuuaaaacugccuuacugaucguuucaggaauuuucccuuauucaauacccgcuacacuucuaguguggcacacauggcagaaacaaacacaaagaucagguguucuuugggaugucccuucuccacccgaaacccagaaagcagagcuagaggaaggcgucuacagaaucaaacaacaagguauauuuggaaaaacucaagucggcguuggcgugcaaaaagaaggaguguuccauacuauguggcaugucaccagaggagcagugcuuacauacaacggcaagagacucgaaccuaauugggcaucagucaagaaagacuuaaucucuuacggcggugguuggcgacuaagugcacaauggcaaaaaggugaagaaguucaagugauagccguggaaccugguaaaaauccuaaaaauuuccaaacuaugcccggcacuuuccaaacgacgacuggggagaucggggcaauagcguuggauuucaagcccggcacaucuggaaguccgauaaucaaccgugagggcaaaguuguuggacuuuacgggaauggaguuguaacuaaaaacgggggauaugucagcgguauugcacaaacuaacgcagaaccagauggacccacuccggaauuagaagaggaaauguucaaaaagcgaaaucuaacaauuauggauuugcauccaggaaguggcaaaacaagaaaauacuugcccgcaauugugagggaagcaauaaaaagacgacuucgaacguugauccucgcuccaacaagagugguagcugcugaaauggaagaggcuuuaaaaggccuuccgauucgauaccaaacaaccgcgacaaaaagugaacauaccggaagagaaauuguugaccucaugugucaugccacauuuacuaugcgacuguuauccccugugcgaguacccaauuacaaucucauuauaauggaugaagcgcauuucacagacccagcaaguauugcagcucgcggcuauaucaguacaagagucggaaugggugaggcggcagcuauauuuaugaccgcaacaccuccuggaacugccgaugcauucccccaaaguaacgcaccaauacaggaugaagaaagggacaucccagagcggaguuggaauaguggaaacgaguggauaacugacuucgcagguaaaaccguaugguuugugccgucuauaaaggcuggaaaugacauugcuaauugccuucguaaaaaugguaagaaaguaauacaauuguccagaaaaacauucgauaccgaguaucagaaaacaaaguuaaacgauugggauuucguaguaacaacagacauaagcgaaaugggugcaaacuuuaaggcagauagaguaauagaccccagaagaugccucaaaccaguaauauuaacagacgggccagaaagaguuauacucgcagguccgaugccuguaacugcggcaucagcggcacaacgcagagggagagucggaagaaauccacagaaagaaaaugaucaauacaucuuuacaggucaaccuuuaaauaacgacgaggaucacgcgcacuggacugaggcaaaaauguuauuagauaauaucaacacucccgaaggaauaauaccagcccuauucgaaccagagagggagaagagugccgccauugauggggaauauagauuaaaaggagaaaguagaaaaacuuuuguugaauuaaugcgcaggggagauuuaccagucugguuagcacacaaaguugcaagugaaggcauuaaguacaccgaucguaagugguguuucgacggacagagaaacaaucaaauauuagaagaaaacauggacguugagauauggaccaaagaaggggagaagaagaaacugcgcccccgauggcucgacgccaggacguacagugauccauuggcucuuaaagaauuuaaagaguucgcagcaggaagaaaaaguaucgcacuugaucuaguaacagaaaucgggagagucccgucacauuuagcacaucgaaccagaaaugcacuugauaauuuaguuaugcuacacacuucggaacauggagguagggcauauagacaugcgguugaagaguugccagaaacaauggagacauuacuucuucuuggauugaugauccuacuaacgggcggcgcaaugcuguuuuuaaucagugguaaaggaaucgguaaaaccagcauuggcuugauauguguuauugccucauccgguauguuauggauggcagagauuccuuugcaauggauagcauccgccauuguuuuggaguucuucaugaugguucuguugauuccagaaccagaaaaacaaagaacaccucaggauaaucaauuagcauaugucguaauaggaauccuaacacuagcggcgauaauugcagccaaugagaugggacuacucgaaaccacgaaacgagauuuggguaugaguaaggagcccggugucguaucgccuacaaguuaccuagacguagaucuacaucccgcaagcgcguggaccuuauacgcaguggccaccacaguaauaacacccaugcuucgccauacgauagaaaacaguacugcaaauguaucucuagccgcgauugcaaaccaagcaguugugcucaugggauuggauaaaggcuggccuauaaguaaaauggaucuaggagugccuuuauuggcacuuggaugcuacagccaaguuaauccuuuaacauuaaccgcggcugugcuucuccuaaucacccacuaugcuauuauagggccuggacuccaagccaaagccacuagagaagcccaaaaacgaacagcugcggguauaaugaagaauccuacuguagauggcauaaugacuauugaucuugacccgguaauauacgauagcaaauuugagaaacaguuggggcaaguaaugcuauuaguauugugugcaguacaacucuuauuaaugcgaacaaguugggcacugugugaagcguuaacgcuugcaacuggacccauaacuacauuaugggagggcuccccggguaaauuuuggaauacgaccauagcuguaaguauggcaaauaucuuuagaggaaguuauuuggccggugcugggcuugccuucucaauuaugaaaagcguggguacaggcaaacggggaacugguucccaaggcgaaacgcuaggagaaaaauggaaaaagaaacuuaaccagcuuucaagaaaggauuucgauuuauauaagaaaucaggcaucacagaaguugauagaacugaagcaaaggaaggacuaaaaagaggggaaauaacacaucaugcugucucaagggguucagcgaaacuucagugguucguggaaaggaacaugguaauaccagaaggaagagugauugaucuuggaugcgguagaggagguugguccuacuauugugcaggcuuaaagaaagugaccgaaguaaggggauauacaaaggguggaccaggacacgaggaaccagucccuaugaguaccuauggauggaacauagucaaacuuaugaguggcaaagauguauucuaucuaccgcccgaaaaaugcgacacauugcuaugugacauaggugagaguucgccuagcccuacugucgaagaaucgcgaaccauaagaguuuugaaaaugguggaaccuuggcucaaaaacaaccaauuuuguauuaaaguacuuaauccuuauaugccgacggucauagaacaccuagagaggcuucaacgaaagcauggggguauguuaguuagaaauccauuaagcaggaacucgacucaugaaauguauuggauaucuaauggaacggguaauaucguugcuucgguaaauauggucucaagguuacuuuuaaaucgcuucacgaugacacacagaaggccaaccauugaaaaagacguugauuugggugcagguacgagacaugucaacgcagagccagagacuccgaauauggauguaaucggagaaaggaucaagcggaucaaagaggagcacaacuccacuuggcauuacgacgaugaaaauccauauaaaacaugggccuaccacgggaguuaugaaguaaaagcuacaggaucagccuccucgaugauaaaugguguugugaagcucuuaacaaaaccaugggauguaguccccaugguaacacagauggcuaugacugauacaacuccguucggacaacagcgcguauuuaaggagaaaguagacacucguaccccucgaaguaugccuggcaccagacgaguuaugggaaucacagcagaaugguuauggaggacacuuggccgcaauaagaaaccacgauugugcacacgugaagaguucacuaagaaaguuagaacaaaugccgcuaugggcgcgguauucacagaagagaaucagugggauucagccaaggcggcuguugaagaugaggauuucuggaaauuaguggauagagaaagagaacuacauaaauuagguaaaugcggaaguuguguuuacaacaugauggguaagagggagaagaaauuaggugaguuuggcaaagcaaagggaagcagagccaucugguauaugugguugggggcucgauaucuggaguucgaagcccuagguuuccuaaaugaggaucauugguucaguagagagaacucguauaguggcguagagggagaaggcuuacauaaacuaggcuacauacuucgugauauaucuaaaauaccgggaggggcuauguacgcagaugauacagcuggcugggauacuagaauaaccgaagaugaccuccauaaugaagaaaagaucacgcaacaaauggauccagaacaucgacaauuagccaaugcgauauuuaaauuaacauaucaaaacaaagucguaaaggugcaaaggccuacuccgacagguacaguuauggacauaauaaguaggaaagaccagagaggcuccgggcaaguugggaccuacggacucaacacguuuacuaacauggaagcacaauuaauuagacaaauggaaggagaagggguuuuaucgaaggcggacuuagagaacccgcauuuaccagagaagaaaaucacucaauggcuggagacaaaaggaguggaacggcuuaaacguauggcaauuucaggggacgauugcguggucaaaccuauagaugauagguucgcaaaugccuuauuagcucuaaacgauaugggaaaaguucgaaaggauauuccacaauggcaaccuucaaaaggauggcacgacuggcaacaaguaccuuucugcucccaccacuuucaugagcucauaaugaaggaugggcgaaaauuagucguaccuugcagaccacaagacgaauuaauuggacgagccagaauaucgcaaggggccggcuggucgcuuaaagaaacggcuugucuagggaaggcuuacgcgcaaauguggagcuuaauguauuuucaucgucgggauuugcgauuagcaagcaacgcuauuugcucggccgucccagugcauuggguaccuacaucgagaacaacuugguccauacaugcucaccaucaauggaugacaacagaggauaugcugaccgucuggaauagaguuuggauugaagauaauccuuggauggaggacaaaacgcccguaacgacgugggaaaacguuccuuaucuuggaaagagagaagaccaaugguguggcagcuuaauaggcuuaacuuccagggcaaccugggcacaaaacauuccuacagcuauucaacaggucagaagucuaauuggaaaugaggaauuuuuagauuauaugccuaguaugaaaagauucagaaaggaggaagaaagcgaaggggcaaucugguga

SEQ ID NO: 23242 - RNA, 9873 nt, Artificial Sequence
  derived and/or modified CDS sequence (opt6) from DENV-3__KF973482__SS-prME
accaguuugugcuuaaugaugaucuuaccagcggcccucgcauuucauuuaacuucgagagauggagaaccucguaugauaguaggcaaaaaugaaagagggaaaucucucuuauucaaaacggcuucgggaauuaauauguguacacuaauagcaauggaccuuggagaaaugugcgacgacacugucacauauaaauguccgcacaucacugaaguugaaccugaagauauagauugcuggugcaaccuaacgaguacguggguuacauauggaacaugcaaccaagcaggagaacaccgucgagauaaacguagcguugcacuggcaccccacguugguaugggccucgacacgcguacucaaacauggaugucggcggaaggagcuuggcgucaaguagaaaaagucgaaacuugggcacuaagacacccagguuucaccauuuuagcauuguuucuagcacacuacauuggaaccagccuaacacaaaaaguagucauauuuauauugcuaauguuaguaacgccaucgaugacgaugagaugcgugggagucggcaacagagacuuuguagaaggguuaagcggggcaacauggguugauguaguucucgaacaugggggaugugugacuaccauggccaaaaacaaaccgacccucgacauugaacuacagaaaacggaagcuacacaacuggccacccuaaggaaacuuuguauugaaggcaaaauuacaaacauuacaacugauagucgcugcccuacccaaggagaagccacauuacccgaagaacaagaucaaaacuauguuuguaaacauaccuacguugaucggggauggggcaacgguuguggauuguuuggaaaaggaucgcuggugacgugcgcaaaauuucaauguuuggaaccaaucgaaggaaaaguagugcaauaugaaaaccuaaaauacacaauuauaaucacuguucauacaggugaccagcaccaagucggcaaugaaacucaagguguuacggcagaaauaacaccccaggcuucuacaacagaggcaauucuaccggaauauggcacucuagguuuggaauguucaccccguacaggcuuagacuuuaaugagaugauuuuauugacgaugaagaauaaagcauggaugguucaccgacaaugguucuuugacuuaccacuacccuggacuuccggagcaacaacagaaacaccuacuuggaaucgaaaagaacuauugguuacauuuaaaaaugcccaugcgaagaaacaggaaguagucguauuaggaucccaagaaggcgccaugcacaccgcccuuacgggagcaacagaaauucagaauaguggcggcacaaguauauucgccgggcauuuaaaaugccgauuaaaaauggauaaauuagaauuaaaagguaugaguuacgcgauguguacaaauacauuuguccuaaagaaagaagugagcgaaacucagcaugggaccauauuaaucaagguugaauauaaaggagaggauguaccuugcaagaucccauucaguacugaagaugggcagggcaaggcacacaacggaagauuaaucacagccaaucccguugucaccaaaaaggaagaaccagugaauaucgaagcagaaccaccauucggugaaaguaauauaguaauuggcauaggggauaacgccuuaaaaauuaacugguacaagaaagguaguagcaucggcaaaauguucgaagcaacagcucguggggcuagacgaauggcaauacucggggauacagcaugggauuuuggaucugugggagggguucuuaauucguuaggaaaaaugguacaccaaauauucgggagugcuuauacagcacuauuuucaggcguaucuuggguaaugaaaauugguauagguguuuugcucacauggauaggccuaaauaguaagaauaccucgaugucauuuucuuguauagcaauaggaaucauuacccuuuauuugggcgccguuguucaagccgacaugggauguguaauaaacuggaaaggaaaagaacugaaaugugggucagguauauuuguaacaaaugaaguucacacauggacugaacaauacaaauuucaagccgauagcccaaaaagguuagccacagcaauagccggagcuugggaaaaugggguuuguggcaucagguccacgacacguauggaaaauuuguuauggaaacagaucgcgaacgaauuaaauuauauuuuaugggaaaauaacauuaagcucacgguagucgugggagacauuauaggaguacuagaacaaggaaagaggacuuuaacaccccaaccaauggaauuaaaguauucguggaaaacauggggaaaagcaaagauaguaacagcggagacucaaaacucgaguuucauaauagaugguccaaacacuccggaaugccccuccguuaguagagcuuggaacguaugggaagucgaagacuacgguuucgguguuuucaccacuaauauauggcuaaaguuacgagagguguauacacaauuaugcgaucacagacuaaugagcgccgcaguaaaagaugaaagggcuguccacgccgauauggguuauuggauagaaucucaaaagaauggaucauggaaacuggaaaaagcuaguuuaauugaggugaaaacaugcacauggcccaaaucgcauacguuauggucgaacggugucuuagaaucagauaugauuaucccgaaaucccucgcuggaccaauuucucaacacaaucaccgaccaggcuaucauacacagacugcaggacccuggcauuuagguaagcuagaauuagauuucaacuauugugaaggaacaacagugguaauaacggagaacuguggcacgcgggguccuagcuuaagaacgaccacagugaguggaaaauugauccacgaaugguguugccgaaguugcacgcuaccaccauuacgauacaugggcgaggauggaugcugguacggaauggagauucggcccauaucugaaaaagaagagaauauggugaagucucucgucucggcagguucggguaaaguagauaauuuuacaguuggcguucucuguuuagccauacuguuugaggaaguaaugcgugguaaauucggcaagaaacauaugauagcuggcguguucuucacuuuugucuuguuacuaucuggccaaauaacguggcgugacauggcccacacauuaauaaugauugggaguaaugcaagcgacagaaugggcaugggcgugacguaucucgcacuaauagcaacuuucaaaauucaacccuuucuagcucuaggauucuuucuccgaaaacuaacauccagagaaaacuuacugcucgguguaggucucgccauggcuacaacacuacaauuacccgaggacauagaacagauggcuaacggaaucgcauuagggcuaauggcacucaaauuaaucacucaauuugaaacuuaccaguuauggacagcacuuaucuccuuaacauguagcaauacaaucuuuacauuaacagucgccuggcguaccgcaacucuuauuuuggcaggaguuagcuuauuacccguaugccaauccucaaguaugaggaagacugacuggcuuccuauggcaguggcagccauggguguaccaccuuuaccauuauuuauuuuuggacugaaagacacguuaaagagacgaucuuggccauuaaacgaagguguuauggcaguaggauuaguuucgauucuggcuaguucguugcuccgaaacgacguuccaauggcggggccacuggucgccggcgguuuguuaauagcguguuacguaauaacuggcaccucagcugaucuuacaguggaaaaggcugcagauauuacuugggaagaagaagcugagcagacggguguuucacauaaccuaaugaucacuguagaugaugauggaacaaugcgaauuaaagaugacgaaacagaaaauauauugacuguucuacuuaaaacagcucuacuuauaguaucaggcauauuuccuuauaguauuccggcuacuuuauuaguauggcauacguggcagaaacagacacaaaggaguggcguguuaugggacguaccaucacccccugaaacacaaaaggcagaguuagaagaggguguguauagaauuaagcaacaagguauauucgggaaaacacagguaggagucgggguacaaaaggagggaguguuucauacaauguggcacguuacgagaggagcuguccugaccuacaaugggaaacgacuagaaccaaacugggcaucaguuaagaaagaccuuauuuccuacgguggagguuggagacuuagugcacaguggcaaaagggagaagaaguacaagucauugcgguagagccuggcaagaaucccaaaaacuuucaaaccaugccggguacauuccaaacuacuacgggugagauaggcgcaauugccuuagacuucaaacccggcacaucuggcucgccuaucauuaaucgggaagguaaaguuguuggcuuguauggaaacgguguuguuacaaagaauggaggguacgucagcggaauagcgcaaacaaaugcugaacccgauggcccaacuccagaacuagaggaagagauguucaaaaagaggaaucuaaccauaauggauuuacaucccggguccgggaaaacacgaaaauauuugccugcaauuguuagagaggcgaucaaaagacgccuacguacauuaauauuagcuccgacgagagugguugccgcagaaauggaagaggcucuuaaaggacuuccgauuagguaucaaacaacugccaccaaaucagaacauacaggucgagaaauaguagauuugaugugucaugcuacguuuacaaugcgucuauuaucucccguccguguaccgaauuauaacuugauuauaauggacgaggcacacuuuaccgacccagcaaguauagcugcgagagguuauauaaguacgcgugucgguaugggagaagcagcagcuauauucaugacagccacaccacccggaacagcagaugcauuuccucaaucaaaugcgccaauccaagaugaagaacgggauauaccugaaaggagcuggaacuccggcaaugaauggauaaccgauuuugcuggaaaaacggucugguucgugccuucuauaaaagccgguaacgacauagcuaacuguuuacgcaagaauggcaagaaaguuauucaacuaucaagaaaaaccuucgauacagaauaucagaaaacaaaacuuaacgauugggacuucguuguuaccacugauauaagugaaaugggggccaacuuuaaggcugacagagugauagaucccaggagauguuugaaaccgguuauucuuacagacgggcccgagagaguaauccucgcaggucccaugccuguuaccgcggcuagugcagcgcaaagacgcggaagaguagguagaaacccucaaaaagaaaacgaucaauacauauucaccggacaaccccuaaacaaugacgaagaccacgcccacuggacagaagcuaaaauguuacucgacaauaucaauacgccagaggguauaauuccagccuuauucgagccugaacgagagaaaagcgcagccauugauggagaauaucgucugaagggagaaucacgcaaaacauucguugaauuaaugagaagaggagauuuaccuguauggcuagcacauaagguagcaagugaaggaauaaaguacacugaucgcaaauggugcuucgacggucaacggaacaaucaaauccuugaagaaaauauggacguagaaaucuggacgaaagagggugagaagaagaaauuaagaccaagguggcuagacgcuagaacauauucugauccucuagcccuaaaagaguucaaagaguuugcugcaggaaggaaaagcaucgcauuagaccuugucaccgaaaucggucgcguacccucgcacuuagcacaccguacaaggaaugcccuagauaacuuaguaauguugcauacaucggaacauggcgggagggccuaucgacacgcaguggaagaacugccggaaacaauggaaacuuuacuuuuguuagggcugaugauuuuauuaaccggaggcgcuauguuauuccuuaucuccggcaaaggaauuggaaaaacaucgauaggacuuauauguguaauagccucuuccggaauguuauggauggcagaaauaccccugcaauggaucgcaucggcaauuguguuggaauuuuucaugaugguauuauugauucccgaaccagaaaaacagcgaacuccgcaagauaaccaauuagccuacguaguaaucggcauccuuacauuagcugcaauaauagcugcuaacgaaaugggacuccuugaaacaaccaaacgugaccuagguauguccaaagagccagguguuguuucaccuacgucuuauuuagauguugaucuacaucccgcgucagcuuggacauuauacgcagucgcuacuacaguuauaacaccuaugcuaagacacaccauagaaaacaguacugccaacguuaguuuagcugcgaucgcaaaccaggcuguugugcuaauggggcuggauaaaggauggccaauaucuaaaauggauuuaggaguuccacuguuagcccuggguugcuacagccaaguaaaccccuuaacacucacugccgccgucuuauuacuaauaacacacuaugcuauaauuggcccggggcugcaggcaaaagcuacgcgggaagcgcaaaaacguacugcagcagguauuaugaaaaaccccacaguggaugggauaaugacaauugaccuagauccuguaauauacgauagcaaguucgaaaaacaacuuggacagguaaugcuccuaguacugugugcaguacaauuacuucuuaugaggaccuccugggcucuuugugaagcgcuaacacuggcaacgggcccuauaacaacacuuugggaaggaucaccuggaaaauucuggaauacuacaauagcggugagcauggcgaacaucuuucgaggaucauaucuagccggagcaggucuugcauucaguauaaugaaaucuguuggaacgggaaaaagaggaacggguagucaaggagaaacacugggugagaaguggaagaagaaacugaaucaacuaucuagaaaagacuuugaccuauacaagaaaucuggaaucacagaaguggacagaacagaagcaaaggagggccucaaaagaggggaaaucacacaucaugcuguuucacguggcucagccaaacuucaaugguuugucgaacgaaauaugguaauuccugaaggccgggucaucgaucucgguuguggacgcggaggauggucguacuacugugccggccuaaagaaaguaacagagguucguggauacacgaaagguggaccaggacacgaagaacccguuccuaugucaacuuacggcuggaauauaguaaaacuaaugaguggaaaagacguauuuuaccucccaccggaaaaaugugacacccugcuaugugauaucggcgagucaucaccuucaccaacuguugaagagucaagaacuaucagagucuuaaaaauggucgagccuuggcuuaaaaauaaucaguuuuguauaaaaguuuuaaauccuuacaugccaacgguaauagaacaucuggaaagauugcaaagaaaacacggaggaaugcucguacguaacccauuaucacggaauaguacucacgaaauguacuggauaaguaacgguacuggaaauauugucgcuaguguuaacaugguuucucgacugcuuuuaaauagauuuacaaugacucaucgaaggccuacaauugagaaagaugucgauuugggcgcaggaacacgacauguaaaugcggaacccgaaacuccgaauauggauguuauaggugaacguaucaaaagaauuaaagaagaacauaauagcacauggcauuaugaugaugagaauccauauaaaacaugggcguaccaugguucuuaugagguuaaagcuacagguucugccucuuccaugacaaauggaguaguuaaacuuuugacaaaaccuugggauguaguaccuaugguaacgcaaauggcgaugacugauacaaccccuuuuggucaacaaagaguuuucaaagaaaagguagacacucgaacccccaggagcaugccuggcacgagaaggguuaugggaauaacugcugaauggcucuggcggacuuugggacguaacaagaaaccgagauuaugcacucgggaagaguucacuaagaaaguuagaacgaacgcggcgaugggagcaguuuucacagaagaaaaccaaugggacucagcaaaggcggcuguagaagacgaagacuuuuggaaauugguggauagagaaagagaauuacacaaauugggaaaaugugggucgugcguauacaauaugaugggaaaacgagagaagaaacuuggugaguucggcaaagcaaaaggaaguagagcuauaugguauauguggcuaggagccagguauuuagaauuugaagcccugggauuucuaaacgaggaucauugguucucaagagaaaacucuuauagugggguagaaggagaagggcugcauaaauugggcuacauacucagggacauuucaaaaauuccgggcggagcaauguacgcagaugauacggccggaugggauacccguauuacagaagaugaucuccauaacgaggagaaaauuacucaacaaauggacccagagcauagacagcuagcgaacgcgauuuuuaaacuuaccuaucaaaacaaaguagugaaaguccagcggccaaccccaacugggacuguuauggacauuauaucacguaaagaccaacgaggaucaggccaaguaggcacauacggauuaaauacguuuaccaacauggaagcucaacuuauucggcaaauggaaggagagggagucuuaucaaaggccgaucuugaaaauccacacuuaccagagaagaaaauaacgcaauggcuagagacaaaagggguggaacgacucaaaaggauggcuauauccggagaugauuguguuguuaagcccaucgaugacagguuugcuaacgcccucuuagcacugaacgauaugggaaaaguaaggaaagacauuccacaauggcagccgaguaagggauggcacgacuggcaacaaguuccauucugcucccaucauuuucacgaacuaaucaugaaagauggaaggaaacucguugucccaugcagaccgcaagaugaacuaaucgguagagccaggauaagucaaggcgcagguuggagucuuaaagaaaccgcuugucucggaaaggcauacgcccagauguggucauuaauguauuuccaucgaagggacuuaagacuagcgagcaaugcaauuugcagcgcgguaccuguucauugggucccuaccaguagaacaaccuggucgauucaugcacaucaccaauggaugacuacugaagacauguuaaccguauggaaucgaguauggauagaagacaacccuuggauggaagauaaaacaccgguaacaacaugggaaaauguuccauaucuagguaagagagaagaccaauggugcgguucauuaauaggccuaacaucuagggcuacaugggcccaaaauauaccaacagcaauccaacaaguaagaucgcuuauaggcaaugaagaguuccuugauuauaugccaagcaugaagagauuuaggaaagaagaggaaucagagggcgcuauaugguag

SEQ ID NO: 23243 - RNA, 9873 nt, Artificial Sequence
  derived and/or modified CDS sequence (opt6) from DENV-3__KF973483__SS-prME
acaagccucuguuuaaugaugaucuuaccagcagcauuagcauuucauuuaacgaguagagauggggaaccgcgaaugaucguagguaaaaacgaacgaggaaaaucauugcucuuuaaaacagcaagcggaauaaauauguguacacucauagcaauggaucuuggggaaaugugcgaugacacggugacguacaaauguccccacauaacagaaguugaacccgaagacauagacuguuggugcaauuuaacaucaaccugggucacauacgguaccugcaaccaggcgggggaacacaggagggauaaaagaucagucgcgcuagcaccucauguugggaugggacuugauaccagaacacaaacguggaugucggcggaaggagcauggaggcaaguugaaaaaguugaaacgugggcucuacggcauccuggauuuaccauauuagcacuguucuuagcacauuauaucggaacuucauuaacgcaaaaaguaguaauauuuauccuauuaauguuaguaacucccaguaugacuaugagaugcguagggguaggaaaucgugauuuuguagaaggacucucaggagcaacauggguagaugugguucucgaacauggcgggugcgucacaacuauggccaaaaauaaacccacuuuggauauugaauugcagaaaaccgaggcuacacaacuagcaacucuacggaaacuauguauagaggggaaaauaacuaauauaacaacugacaguagauguccaacacaaggugaagcuacacuaccagaggaacaagaucaaaauuacguuuguaaacauacauaugucgacagaggcuggggaaacgguuguggacuuuucgguaaagguucucuaguaacuugugcaaaauuucaguguuuagaaccaauugaaggcaaagugguucaauaugaaaauuugaaauacacaguaauaauuacagugcacacgggugaccagcaucaagugggaaacgaaacucaagggguuaccgcugaaauuacaccccaggcaaguaccacagaagcaauucuuccagaauacgguacucuuggacuagaauguucgcccagaacgggguuagauuuuaaugaaaugauccuauuaacaaugaaaaauaaagccuggaugguucauagacaaugguucuuugaucugccacugccuuggacaucgggagcaacgacagaaacaccaacauggaaucgaaaagaacuauuagucacauucaaaaacgcacacgccaagaaacaggaaguaguaguguuaggaagucaagaaggagccaugcacacagcacuaacuggagcaacggagauacagaacucuggcgguacuagcaucuucgccggacauuuaaaaugccgucuuaaaauggauaaacuggaauugaaaggaaugucauaugcaaugugcacuaacaccuucgugcuaaagaaagaggucuccgaaacucaacaugguaccauucuaauaaaaguagaauacaaaggugaggacgcuccuugcaaaauuccuuuuagcacggaagacggucaggggaaagcucacaauggaagauugauuacagcaaaucccguagucacuaagaaagaagaaccuguaaauauugaagcugaaccaccuuucggagaaucgaauaucguuauagguaucggcgacaacgcgcugaaaauaaauugguauaagaaagguucgaguaucggaaaaauguuugaggcaacagcacguggagcaagacgaauggcuauccugggagauacagcaugggacuucggguccguuggcggaguguuaaauucauuaggaaagaugguucaccaaauauucgggucagcuuauacagcccuuuucucugggguaucuuggguaaugaagauaggaauaggaguauuguuaaccuggauaggacuuaauucccgaaauaccucgaugucauuuaguugcauugcaauaggaauuaucacucucuauuuaggggcaguaguucaagccgacaugggauguguaaucaauuggaagggaaaagaacuaaaaugcgggagcgggauuuucguaacuaaugagguucacacguggacagaacaauacaaguuucaagcagacucccccaagcgcuuagcuacggcgaucguuggugcgugggagaacggcguuuguggcauacgaucuacaacaaggauggaaaaucuauuauggaaacaaauagcaaaugaguuaaauuacauauugugggaaaauaauauaaaacuaacagucguugugggagauauaauaggggugcuugaacaaggaaagagaacgcuaaccccucagccuauggagcuuaaguauucauggaaaacaugggguaaagcuaagauaguuacagcagagacacaaaauagcucauucauuauugacgguccaaauaccccagagugccccucgguaagccgagcauggaacguaugggaaguagaagauuauggauucgggguuuucacaacaaauauuuggcuaaaauugagagaaacguauacacaauuaugugaccaucgucucaugagugcagccgugaaagaugagagagcgguucaugcugacaugggcuacuggauagaaagccagaaaaauggaaguuggaaauuggagaaagcauccuuaauagaaguuaaaacuuguacauggccuaaaucacacacaauauggagcaacggaguauuggaaagcgauaugauaauuccaaagagucuagcggguccaaucucccaacauaaccaucgaccgggauaucauacucagacagccggcccauggcauuuaggaaagcuagaauuagacuucaacuacugugaagggacuacagucguaauuaccgaaaauuguggaacgcggggaccuagcuuacgaacuacaacagugaguggaaaacuaauucaugaaugguguugccgcagcuguacacugccuccacuacgauauaugggggaagaugguuguugguacgguauggaaauccguccgauuucggagaaagaggaaaauaugguaaagagcuuggucagcgcagguucggggaaagucgauaauuuuaccauggggguacuaugucuugcgauccucuuugaagaaguaaugagaggaaaauucgguaagaaacacaugauugccggagucuuccuaacguuuguuuuguugcugucaggacaaauaacauggagagauauggcucauacucuuaucaugaucggaaguaacgcuucugauaggauggguaugggaguuacuuaucuagcuuuaauagccacauuuaaaauacaaccauuccuugcgcuuggguucuuucuaagaaaguugacgaguagagagaacuuacuuuuaggaguagggcuagcgauggccacgacauugcagcuuccugaagauauagaacaaauggcaaaugguauugcguuaggucuuauggcucuaaaauuaaucacucaauuugaaacuuaccaauuguggacagcauuaauaucgcuaacuuguaguaauacaaucuuuacuuuaacaguagccuggagaacagcgacuuuaauacucgcgggggucaguuuacuacccguaugucaaagcucuagcaugagaaaaacugacugguuaccgauggcaguugcagcuaugggcguaccuccucugccacucuuuaucuucagucuaaaagacacauuaaagagacgguccuggccacuaaaugaggguguuauggcugucgguuuggucaguauucuggcuagcucacucuuaagaaaugaugugccaauggccggcccucuaguagccgguggcuugcucauagcaugcuauguaauaaccggaacaagcgcugaccuaaccguugaaaaggcggcagauauaacaugggaagaagaagcagaacaaacugguguaagucacaaucucaugauaacaguugaugacgauggaacaaugagaauuaaagaugaugaaacagaaaauauacucacagucuuauugaaaacagcccuguuaauugugagcgguaucuuuccauauucuauuccagcuacgcuguuaguguggcacacauggcaaaagcaaacacaaagaucuggaguacuuugggacguuccauccccuccugaaacccaaaaagcugaacuggaagaaggaguuuaccgaauaaaacagcaagggauauucggaaaaacacaaguagguguuggaguacaaaaagaagggguguuucauacaauguggcacgugacaagaggugcugucuugacuuacaauggaaaacgauuagaaccuaauugggcuagugucaagaaagaccuaaucagcuauggaggaggauggagguuauccgcacaguggcaaaaaggagaagagguacaaguaauagccguagaacccggcaaaaaucccaaaaacuuucaaacgaugccagguacguuccagacaacgacaggagaaauaggggcuaucgcacuggacuuuaagcccgggacgucaggcucccccauuaucaacagagaaggaaaaguuguaggcuuauaugguaauggaguuguaaccaaaaauggaggguaugucucuggaaucgcucaaacaaaugcagaaccagaugggcccacacccgaguuagaagaggaaauguucaagaaacguaaccucacaauuauggauuuacauccgggcucagguaaaaccagaaaauaccuaccagcaauuguacgagaggccauuaaaagacggcuaaggacgcucauauuagcaccaacgaggguagucgcagcagagauggaagaagcacugaaagggcuuccuauuagguaccaaacuacagcaacuaaaagugaacauaccggaagggagauagucgauuugaugugucacgcaacauucacgaugagacuacucagcccuguacgaguaccuaauuauaauuuaauaauaauggacgaagcacauuuuacagacccagccucuauagcggcgcgagguuacauaucaacuaggguaggaaugggggaggccgccgcaaucuuuaugacggcuacucccccgggaacagcagaugcuuucccucaauccaacgccccaauucaagaugaggaaagggauauaccagagagaucauggaauagugggaaugaauggauuacagacuuugcaggaaaaacaguaugguucguaccaaguauaaaagcuggaaaugacauagcuaacugucuaaggaaaaacgggaagaaaguaauacaauuaagucguaaaacuuucgauacggaauaccaaaagacgaaacuaaaugacugggauuucguaguaacaacugauauaagugaaaugggagcaaacuuuaaggccgauagaguaaucgauccgagacgaugucuaaaaccaguuauauuaacugauggcccagaacgaguaauauuagcaggaccaaugccuguaacugcggcaucagcagcacaacgcaggggacgcguaggacgaaacccacagaaagaaaaugaucaguauauauuuaccggccaaccucuaaauaacgacgaagaccacgcacauuggacagaagcaaagaugcuccucgauaauaucaauacuccagaggggaucauuccugcacuauuugaaccagaaagagagaaaagcgcggcaauugauggugaguaucgauugaagggcgaaucuagaaaaacauuugucgaacucaugcguagaggggaccucccaguguggcucgcccauaaaguugcuagcgaagguauaaaguacaccgauagaaaguggugcuucgauggccaacgcaauaaucaaauuuuagaagaaaauauggacgucgaaauuuggaccaaggaaggcgagaagaagaaacugagaccuagaugguuagaugcccgaaccuauucugaucccuuagcauuaaaggaguuuaaggaguuugcagcuggcagaaagagcauagcacucgaucuuguaacugagauuggccggguccccucacaucucgcacauaggacccgaaaugcgcucgauaaucuuguaaugcugcacaccucagaacauggaggacgcgcuuaucgacaugcgguggaagaacuaccagagacuauggaaacacuuuuacucuugggucugaugauauuacucacagggggcgcuauguuauucuuaauuuccgggaaggggauuggaaaaaccucuauaggacuaaucugcguaauagcguccagugguaugcuauggauggcagaaaucccucuccaauggauagccagcgcaaucguucuggaguucuuuaugaugguauuacugaucccagagccugaaaagcagagaacaccucaagauaaucaacucgcuuauguuguuauagggauacuaacuuuagcugccauaauagcagccaaugaaaugggacuacuggagaccacuaaacgugaccuagggauguccaaagaaccaggcguggugagcccaacgucauaucucgacguagaucuccauccugcuucugccuggacacuauacgcaguggcaacgacaguaauaacgccaauguuacggcacaccaucgaaaauagcaccgcaaauguuucauuagcggcaaucgcgaaucaggcagugguauugaugggguuagacaaaggcuggccuauaucaaagauggauuuagggguuccccuuuuagcacuuggguguuacucacaagugaaccccuuaacucucacagccgcuguacuauuauuaaucacucauuacgcaauuauaggaccgggccuacaagcgaaagcaaccagagaagcgcaaaagagaaccgcagcuggaauaaugaagaauccuacaguagacggaauaaugacuaucgaucuagacccggucauauacgacagcaaauuugagaagcaauuggggcaaguaaugcuccuaguacuaugugcuguucaguuacugcuuaugagaacuucgugggcauuaugugaagcccuuacucuagcaacgggccccaucacuacauuaugggaagguucacccgggaaauuuuggaauacgaccauagcaguuucaauggccaauauuuuucguggcaguuacuuagcgggugcuggguuagcuuuuagcaucaugaagucagucggaacaggaaaaagggguacuggcagccagggagaaacucuuggggaaaaguggaaaaagaaauuaaaccaguuaucuaggaaggauuuugauuuguauaagaaaucaggcauaacagagguugaccgcacggaagccaaagaaggacuaaagcggggcgaaauaacucaccaugcaguuagcaggggaagcgcuaaacuccaaugguuuguggaacguaacaugguaauacccgaagguagagucaucgauuuagggugcggccgaggaggauggagcuacuacugugcaggucugaagaaaguuacggaaguuagaggguacacuaaaggaggaccuggucacgaggaaccggugccaauguccacguacgguuggaacaucguaaaguugaugaguggaaaagacguuuucuaucuaccaccugaaaaaugugauacucucuuaugugauauaggagagucuaguccuaguccaaccguagaagagucgagaacaauccgaguauugaaaauggucgaaccauggcugaaaaacaaccaauuuugcauaaaagugcuuaacccauacaugcccacagugauugagcauuuagaaagacuacaaaggaaacauggagggauguuaguacgaaaccccuugucaagaaauucaacccaugaaauguauuggauuuccaacgguacggguaauauaguggcaucuguuaacauggugucaagauuauugcuuaaccgcuucacgaugacgcauagaaggccuacuauagaaaaagaugucgauuugggugcaggaacacgacauguaaaugcugaaccggaaacuccuaauauggauguuauaggugaaagaauuaagagaauaaaagaagaacauaacucuacuuggcauuaugacgaugagaauccuuacaaaaccugggcuuaccauggaucauaugagguaaaagcaacugggucggcaaguucaaugauaaacggaguugucaaacuccuaacaaaaccuugggauguaguucccaugguaacacaaauggcaaugacggauacuacaccauuuggacaacagagaguguuuaaagaaaagguggacacaaggacuccgaggaguaugccgggcacgcguagaguaaugggaauaaccgcagaguggcuauggcgaacacuuggaaggaacaagaaaccacgucugugcacacgcgaagaguucacuaaaaagguucgaaccaaugcagcaaugggagcaguuuucacagaagagaaccaaugggauucagcaaaggcagcgguugaggaugaggacuuuuggaaacuugucgauagggaacgcgaauugcacaaacuggguaaguguggcucuugcguauacaacaugauggguaagcgggaaaagaaauuaggcgaguucggaaaggcaaaaggaucuagagcaauaugguauauguggcugggugcucgguauuuagaguucgaagcauugggauucuuaaaugaagaccauugguuuaguagagaaaauaguuauucggguguagaaggagaaggacuacacaaauuaggcuauauacuucgagauauuaguaaaauuccaggaggagcgauguaugcugaugauacagcaggaugggacacacguaucacugaagacgaccuacacaacgaagagaaaaucacacaacagauggacccagaacacaggcaacucgccaaugcuauauucaaauugacuuaccaaaacaagguagugaaagugcaaagaccuaccccaacaggaacagucauggacaucauaucgaggaaagaccaacgggggucaggacaagugggcaccuauggauuaaauacauucacaaauauggaagcacaauuaauaagacaaauggaaggggaaggaguuuugaguaaagccgacuuggaaaauccucaccuaccggagaagaaaaucacucaauggcuagaaacaaagggugucgaaaggcugaaacgaauggcuauuuccggugaugauuguguagucaaaccaaucgaugacagauuugcaaaugcauuauuagcauugaaugacauggguaaaguacgaaaagauauaccacaauggcaaccaucuaaaggauggcaugauuggcaacaaguaccauucuguagucaccacuuccaugaacuaauaaugaaagauggccgcaagcuaguuguaccuuguaggccgcaagaugaguugaucggacgugccaggauuucucagggggcggguuggagccugaaggaaacugcaugucuugguaaagcauacgcgcagauguggagccuaauguauuuucacagaagggaccuaagguuagcaaguaaugcaauaugcagugcaguuccgguucacuggguaccaacaaguagaacuacguggagcauucacgcgcaucaccaauggaugacgacagaggacaugcucacaguguggaauagaguguggauagaagacaauccauggauggaagauaaaaccccuguuacgacaugggaaaacgugccauacuuagguaagagagaggaccaauggugugguucacuaauagggcuaacaucacgcgcaacaugggcgcaaaauaucccaacggcaauucaacaaguacgaucgcuuauuggaaaugaagaguuuuuagacuacaugccgaguaugaagagauuccggaaagaagaagaaagugagggcgcaauaugguga

SEQ ID NO: 23244 - RNA, 9873 nt, Artificial Sequence
  derived and/or modified CDS sequence (opt6) from DENV-3__KF973485__SS-prME
acuagcuuaugucuaaugaugauccuuccggcagcucuagcguuccacuugacaucuagagauggugaaccccggaugauaguagguaaaaacgaacguggaaaaagccuacuauucaaaacggcgucagguauuaauaugugcaccuugauagcuauggacuugggugaaaugugcgaugauacuguaacguacaaauguccccauauuaccgaagucgaaccggaagacauagauuguugguguaaccuuacaaguacauggguaaccuacgguacauguaaucaagcgggagaacaucgaagagauaaaagaaguguagcuuuagcaccacacguaggaaugggccuugauacacgcacacaaaccuggaugucggcugaaggugcauggcgccaagucgaaaaagucgaaacuugggcauuacgucaucccggcuuuacaaucuuagcguuauuucuugcacacuacauuggaacgucucuaacgcaaaaaguaguaauuuucauccuucuaauguugguaaccccgaguaugacaaugagauguguuggugucgguaaccgggauuuuguugaaggguugucaggggcuacuuggguagacguaguucuggagcaugguggaugugucacaacgauggccaaaaacaaaccaacucuggauauugaauuacagaaaaccgaagcuacacaguuagccacauuaagaaaacuaugcauagaaggaaaaauuacuaacauaaccacagacagcagauguccaacccaaggggaagcuacuuuaccagaagaacaagaccaaaauuauguaugcaaacacaccuauguagaucguggaugggggaauggcuguggauuauuuggaaaaggcagucugguaacaugugcgaaauuucaauguuuagaaccaauagaaggcaaagucguucaauaugagaaucuuaaauacacugucauaaucacaguccauaccggugaucaacaucaagugggaaaugaaacacagggaguuacagccgaaauaacgccacaggcuucaacaacagaagcaauacucccugaauacgguacauuaggguuagaaugcaguccucguacaggcuuggauuucaacgaaaugauuuuauuaacuaugaaaaacaaagcauggaugguucaccgacaaugguuuuucgaucucccacugccuuggaccucuggagccacuaccgaaaccccaacauggaacaagaaagaguuguuagucaccuuuaaaaaugcucacgccaagaaacaggagguaguuguuuugggaagucaagaaggagcuaugcauacugcucuaacgggggcgacagaaauacaaaauucaggcgggacaucuaucuuugcuggacaucuaaaaugcagauugaaaauggauaaauuagaacuuaaagggaugagcuaugcaauguguacuaacacuuuuguucugaagaaagaagugagugaaacacaacaugggacaauccuuauaaaaguagaauauaaaggugaagaugucccauguaaaaucccguuuaguacagaggauggccaagguaaagcacauaacgggcguuugauuacggcaaacccaguaguuacuaagaaagaagaaccgguaaauauagaagcagaaccacccuucggagagucaaauaucguaauagggauuggagacaaugcuuuaaaaauaaacugguauaagaaagguucgucgauugguaaaauguuugaagccacagcacgaggugcuagaagaauggcaaucuugggagauacugcaugggauuuuggaucaguaggaggaguauuaaacucacuaggcaaaaugguacaucaaaucuucgggagugcuuacacagccuuauucuccggagugucauggguuaugaaaauuggcauagggguuuuauuaacuuggauagggcucaauaguaagaacaccagcauguccuuuucuugcauagcaauagguauuaucacgcuuuauuuaggagcuguaguucaagcagacaugggauguguuauaaacuggaaagguaaagaacuaaaaugcggcucuggaauuuuuguuaccaaugaaguucacacauggaccgaacaauacaaauuucaagccgacuccccaaaacgauuagcaaccgcaauugcgggagcuugggaaaacgguguuugugguauaaggucuacuaccagaauggaaaauuuguuguggaaacaaauagcuaacgaacugaacuauauauuaugggagaacaauaucaaacugacuguaguuguuggugacaucauugggguauuagaacaaggaaagcgaacguuaacuccucaaccgauggagcuaaaauacagcuggaaaacguggggaaaagcaaaaaucguaacggcagaaacucaaaauagcucauuuaucauugauggacccaacacgccggagugccccucgguaucgagagcauggaauguaugggaaguagaagauuacggguuugggguauuuacgacaaacaucuggcucaaacuacgagaaguacacacucaacuaugcgaucauagacuaaugagcgcggccgugaaagaugaaagagcgguucaugcagauaugggauacuggauagaaagccagaaaaaugguucguggaaauuagaaaaggcgagcuuaaucgaggucaagacauguacuuggcccaaaagucauacccucuggucaaauggcguacuggaaucagauaugauuauaccuaaaucguuggccggaccaaucucucaacacaaucaccgaccuggcuaucacacacaaacugccgguccauggcacuuaggaaaauuggaauuggauuucaauuauugugaaggaaccacugugguuaucacagaaaacugcgguacacgagguccuucacuacgaacgacaacaguaagugguaaacuuauucacgaauggugcugcagaagcuguacauugccgccccugagguauaugggagaagacggaugcugguacgguauggaaauacggcccauauccgaaaaagaggaaaauaugguaaaaucacucguuagcgcugggucaggaaaaguggacaacuucaccauggggguccuguguuuggcaauccuuuucgaggaaguaaugagagguaaguuuggcaagaaacacaugauagccgguguauucuuuaccuuuguuuugcucuuaagcggacaaauaacuuggcgugauauggcgcauacacuaauuaugaucggauccaaugccucugauagaaugggaauggguguaacuuaccuggcauuaauagccacuuuuaaaauacaacccuuuuuagcgcuaggauucuuucugagaaaauugacauccagggaaaaucuacuauugggaguagguuuagcaauggcuaccacacuccagcuacccgaagauauugaacagauggcuaacggaauagcacuaggacuuauggccuugaaacuaauaacgcaauucgaaaccuaucaacuauggacugcacucauaagucuaaccugcucuaacacgauauucacccuuacaguagcauggagaacagcaacacucauccucgcaggcgugagucuuuuaccaguaugccagagcucgucaaugcgaaaaacagauugguuaccuauggcuguugcagcuaugggagucccuccucuaccacuauucauuuucggcuuaaaggacacucugaaaagaaggucauggccacuaaaugaaggaguaauggcugucggccuuguuaguauucuagccaguucgcuguuaaggaacgaugugccaauggcagguccucuaguagcgggaggccuauuaauagcuugcuaugugauuacgggcacaucagcagaccuaacgguagaaaaagcggcagauaucacaugggaggaagaggcugaacaaacaggugugucacauaaucucaugauaacaguagacgacgauggaacaaugagaauaaaagaugacgaaaccgaaaauauacuuaccguauuacuuaagacugcccucuuaauagucuccggaauauuuccauauucgauaccagcaacuuuauuaguguggcauacuuggcaaaaacaaacacaaagaagcgguguauuaugggaugucccaagcccaccagaaacacagaaggccgagcuagaagaaggcguuuacagaaucaaacaacaagguauuuucggaaaaacacaggucgguguggguguucaaaaagagggcguguuucauacaauguggcacguaacgagaggggcgguuuuaaccuacaaugguaaaagacuagagcccaauugggcuucugucaagaaagaucugauuaguuauggaggagguuggcgccugucugcacaguggaagaaaggagaagaaguucaaguuauugcaguggaaccagguaaaaauccgaaaaauuuucaaacaaugccggguacauuucaaaccacaacuggugagauaggagcaauagcguuagacuucaaaccuggaacgucaggaaguccaauuauaaacagggaagggaaagugguuggacucuauggcaauggagucguuacgaaaaaugguggauacguaucuggcauugcacagacaaaugcagagcccgaugggccuacaccugagcuggaagaagaaauguuuaagaaaagaaacuugacaauuauggauuuacacccaggaagcggcaaaacgagaaaauacuugccggcaauaguaagagaagccauuaaaagacgucuucgaacccucauauuggcaccgacacgcgucguggcagcggaaauggaggaggcacugaaaggcuuaccgauaagauaucaaacuacugcaacaaaaucagaacacacaggaagagaaauaguggaccugaugugucacgcuacuuucacaaugcgguuguuaucaccaguuagagugccaaacuacaaucuuaucauaauggaugaagcacauuuuaccgauccggcgucuauagcagcacggggcuauaucaguacacgggugggaaugggagaagcugcggcaauauucaugacugccacacccccaggcacagcggaugcauuuccacagaguaacgcgcccauacaagacgaagaaagagauauaccagagcgaaguuggaacagcggaaacgaguggauaacugauuucgcugguaagacaguuugguucguaccuaguauaaaggcgggaaaugacauagcuaauugucucaggaaaaacgggaagaaaguaauccaacuuucucgaaaaacuuucgacacggaguaccagaaaacaaaacuuaaugauugggacuuuguagucacuacggauauaucugaaaugggcgcaaacuuuaaagcggauagagucauagauccacgacggugcuuaaagccugugaucuugacagacggcccggaaagaguuauucuagcugguccgaugccuguaacgguagcuucggcugcacaaaggagaggacgagucggacggaacccacagaaagagaaugaccaguacauauucacuggucaaccccucaauaacgaugaagaccaugcgcacuggaccgaagcuaaaaugcugcuggauaauauaaauacuccagaaggaauaauaccagcacuauuugaaccugaacgcgagaaaucugcagcgauagauggcgaguaucgucuaaaaggggaaagccggaagacuuuugucgaacuaaugaggcguggugaccuaccagucuggcuagcacauaaggucgcaagugaagguaucaaauacacggaucgcaaaugguguuucgacggacaaagaaauaaucaaauucuggaggagaacauggauguugaaauuuggacuaaggaaggugagaagaagaaauuaagaccacgauggcuugaugcaagaaccuauucugauccccuugccuugaaagaauuuaaagaauuugccgcaggaagaaaaucuaucgcauuagaucuaguaacugaaauagguagggugccuucccaccuagcucacagaacacggaaugccuuagacaacuuaguaaugcuacacacaagugaacacggcgggagagcauacagacaugccguugaggaguuaccagaaacuauggaaacuuuguugcuacuaggcuuaaugauucuucuaacuggcggagcgaugcuauuucugauuagugguaaaggcauaggaaaaacauccaucggauugauauguguaauugcaucgagcggcauguuauggauggccgagauaccacuucaguggaucgcuucggccauaguucuagaguucuucaugaugguauuguuaauaccggaaccagaaaaacaacggacuccccaggacaaucaauuagcauacgucgucauuggaauccuaacgcuggcugccauuauugcugccaacgaaaugggacuuuuagaaacaacaaaaagggaccuaggaaugaguaaggaaccagguguaguaaguccaacuagcuaucuagauguagauuuacauccggcuucagcauggacacuuuaugccguagcaacaacaguuaucacuccaauguuacgccauacgauagaaaauucuacggcuaaugugaguuuagcagcaauagcgaaucaagcaguuguccuuaugggucuugacaaaggcuggccaaucagcaaaauggacuuagggguaccauugcuugcgcugggaugcuauucacagguaaacccauuaacccuaacggcagcugucuuauuacucauaacacauuaugccaucauaggaccuggguuacaagcuaaagcaacuagagaagcucagaagcgcacugcagcaggaauuaugaaaaauccaaccguugacgguauuaugacgauagacuuagacccagucauauaugauucaaaauucgaaaaacaguuagggcagguaaugcuucuuguuuuaugugucguacaacuucuauugaugagaacaagcugggcguuaugcgaagcauuaacucuggcuacagggcccauaacaacauuaugggaggguaguccuggaaaauuuuggaacaccacuauugcaguuagcauggccaauauuuuucgggguuccuaccuagccggagcaggcuuagcguucucaauaaugaaaaguguggggacuggaaaaagagguacaggaucucaaggagaaaccuugggugaaaaguggaagaagaaacuuaaucaauuaagccgaaaagacuuugauuuauacaagaaaaguggaauaacagaaguggaucggacagaagcuaaagaagguuugaaacguggugaaauaacacaucaugcgguuagucguggaucugcaaaacuucaaugguucgucgagagaaauaugguaauaccagagggucgagugauagaccucggauguggacgaggggguuggaguuacuacugugcgggcuugaagaaaguaacagagguaagaggauauacgaaaggcggaccagggcacgaagaaccgguacccaugucgacguacggcuggaauauaguuaaauugaugagcggcaaagaugucuucuaucucccgccagagaaaugugauacauuguugugugauaucggagaaaguuccccaucaccgacugucgaggagagccguacgauccgaguucucaaaaugguugaaccuuggcuuaaaaacaaccaguucugcauuaaaguauuaaacccauacaugccuaccguaauagaacacuuagaaagacugcaacgaaaacauggagguaugcuuguaagaaauccgcuaucaagaaacucaacccaugagauguauuggauaucuaacgggacuggcaauauuguagcuagcguaaauaugguaucaagacuacuacugaacagauuuacgaugacucaccguagaccaaccauagaaaaggacguagacuuaggagcuggcacgaggcacgugaacgccgaaccagaaaccccaaacauggagguuauaggagagagaauaaaacgaaucaaagaagaacauaauucaacauggcauuacgacgacgaaaauccauacaaaacaugggcuuaucaugguucauaugagguaaaagccacagguagcgcgucaagcaugauaaacggaguagugaaauuauugacaaagccuugggauauggugccuauggugacgcaaauggcaaugacagacacaacaccguuuggacaacaacguguauucaaagaaaaaguagacacacgaaccccaagaucuaugccugguacuagacguguuaugggaauaaccgcagaguggcuuuggaggacgcuuggucgcaauaagaaaccgcgacuauguacuagggaagaguucacuaagaaaguacggacaaaugccgcuaugggugcuguuuuuacagaggagaaucagugggacucagcaaaagcagccguggaggaugaagacuucuggaaacuugucgaucgugagagagaguuacacaaacucggcaaaugugggucgugcguauauaauaugaugggaaaaagagagaagaaacuaggagaguucggaaaagcaaaagguucacgagcaauaugguauaugugguuaggugcgagguaccuagaguucgaggcuuuagguuuccuuaacgaagaucacugguucaguagagaaaauucauacucgggaguugaaggugagggccugcauaaauuaggguacaucuugcgagauauaucaaaaauucccggaggugcaauguaugcagacgacacagcaggcugggauaccagaaucacugaagaugauuuacauaacgaagagaaaauuacucaacagauggacccagaacauagacaacuggcagaugcaauuuuuaagcugacguaccagaacaaagugguaaaaguucaaagaccuacgccuacagguacaguuauggacauaauuagucgaaaagaccaacggggcucaggacaaguagguacuuacgguuuaaauacauuuacuaacauggaagcacaauuaauucgucaaauggaaggagaaggaguauuaucgaaagcugaucuggagaauccucaucucccugagaagaaaauaacccaaugguuagagacuaagggaguggaaagguugaaaagaauggcaauuucuggugaugacugugugguuaaaccaaucgaugacagauucgcgaacgcguuauuggcguugaaugacauggguaagguaagaaaagauaucccucaguggcaacccagcaagggauggcacgauuggcaacaaguuccguuuuguucucaucacuuucacgaacuaauaaugaaggaugguagaaaacuggugguaccaugcagaccccaggacgaauugauagggagggcccggauuucacagggagcaggcuggagucuaaaagagacugcuugucugggaaaagcauaugcgcaaauguggucacuaauguauuuucacagaagggaccuaagacuagcaaguaaugcaauaugcucagcggucccuguacauuggguaccaacgucucgcacuacauggucaauacaugcacaccaucaauggaugaccacagaagauauguuaacagucuggaaccgcguauggaucgaagacaauccuuggauggaggacaaaacaccuguuacgacuugggaaaauguucccuaccuaggaaaacgagaggaccaauggugcgggagucuaauaggauuaacaucacgugcaacgugggcccaaaauauuccaacagcuauucaacaaguaagaucgcucauaggcaaugaggaguuccuagacuauaugcccagcaugaaaagauuuagaaaagaagaagagagcgaaggugcuauaugguag

SEQ ID NO: 23245 - RNA, 9873 nt, Artificial Sequence
  derived and/or modified CDS sequence (opt6) from DENV-3__KF973486__SS-prME
acaagucugugccucaugaugauacugccugcagcucuggcuuuucacuuaacaagcagagauggagaaccaagaaugaucgucggcaaaaaugaaagagguaaaucccuauuauuuaaaacugcgucagguauaaacaugugcacacucaucgcaauggaccucggagaaaugugugaugacacuguuacguauaaaugcccacauaucacagaaguagaaccugaagauaucgauugcugguguaaucuaacaucaaccuggguaacauaugguaccugcaaccaagcgggagaacacaggagagauaaaagaucagucgcauuagcaccucaugucgggaugggucuagauacgaggacgcaaacguggauguccgcagaaggugcauggcgucagguagaaaaaguggagacgugggcgcugaggcauccgggauuuacaauucuugcacuuuuccuagcucacuacauagguacaucauuaacacagaaagucgucauauuuauauuacuuaugcuugugacacccaguaugacuaugagaugcguagggguuggaaaccgagauuuugucgagggucugagcggugcaacauggguggauguaguuuuagaacauggugggugcguuacuacgauggccaaaaacaaaccuacauuagacauagaacuacagaaaacugaagcaacacaacuugcuacccuaaggaaauuauguaucgaaggaaaaauuacuaauauaaccacggauucucgcuguccaacucaaggugaagcuacgcuuccagaagaacaagaucaaaauuacguauguaaacacacauauguagacagggguuggggaaacggcugugguuuguucgguaaagguagcuuagugacgugugcuaaguuucagugccuugaaccaauagaggguaaaguaguacaauaugaaaaucuuaaauacacggugauuauuacuguacacacaggagaccagcaccaggucggaaacgaaacccaagguguuacugcagaaauuacaccucaggcuucuacgacagaagcaauacucccagaauacggaacgcuaggccuugaguguaguccucgcacuggucuggacuuuaacgaaaugauccuacuaacaaugaaaaauaaagcauggaugguucaccgccagugguucuuugaccuaccuuuaccuuggacaagcggcgcuacaacagaaacaccaacauggaaccggaaagaauuauuaguuacauuuaaaaacgcacaugccaagaaacaagaagucgucguuuuaggaucccaagagggcgcaaugcacacagcuuugacaggagcaaccgaaauacaaaacucagggggaacaucaaucuucgcaggacaucuaaaauguaggcuuaaaauggauaaauuagaacuaaaaggaaugagcuacgcuauguguacaaauacauuuguccugaagaaagagguaucugagacacaacauggcaccauccuaauaaaagucgaauauaaaggugaagauguaccauguaaaauacccuuuaguaccgaagacggccaggguaaagcacauaaugguagauuaauuacggcgaauccuguaguaaccaagaaagaggagccuguaaacaucgaagcagaacccccauuuggagaaucuaauauuguaaucgguauuggagacaacgcacucaaaauaaacugguauaagaaaggaucaagcauagggaaaauguuugaagcuacugcccgcggagcaagaagaauggccauacucggcgauacggcuugggauuuuggaucaguaggcgggguucuaaauucuuuaggaaagaugguccaucagaucuuugguucagcauacacagcacuauuuucgggaguaucuuggguaaugaaaaucggaauaggcguauuacuaacauggauuggccuaaacagcaaaaauacuagcaugaguuuuuccuguauugcaaucgggauuauaacacuuuaccuuggcgcagugguacaggcagauaugggcugcgucauaaacuggaaagggaaggaguuaaaaugcgguucggguauauucgucacaaaugaaguacacacauggacugagcaauauaaauuucaagcagacucaccaaagagauuggccacggcuauugcuggagcaugggaaaacggggucugugggauuagauccacgacaaggauggaaaauuugcuauggaaacaaauugcaaacgaacucaauuacauacuaugggaaaauaacauaaagcugacgguuguaguuggagauauuauuggagugcuagaacaggguaagagaacacuuacaccacaaccuauggaacuaaaauauucauggaagacuugggguaaggcgaaaauugugaccgcagaaacacaaaacucaucguuuauaauugauggacccaacacaccagaauguccuagcgugucgagggcguggaauguuugggaggucgaagacuacgguuucggcguuuucacaacaaacauuugguuaaaacuuagagaaguauauacucaacuaugcgaucauagauugaugagugccgccgucaaagaugaaagggcaguacaugcugauauggguuacuggauugagucgcagaaaaauggaagcuggaaacuggagaaagcaucacugauagagguaaaaacauguacuuggccaaaaagucacacguuauggagcaaugggguacucgaauccgauaugauuauuccaaaaucucuagccgggccaauaucucaacauaaccauagacccggauaccacacccaaacagccggaccauggcauuuagggaaacuagaacucgauuuuaacuacugcgaaggcacaacuguuguaauuacagaaaacuguggcacucgagguccuucucucaggacaaccacagucucagguaaacuaauccacgaaugguguugccgcagcuguacuuuaccuccauugagauauaugggugaagacggaugcugguacgggauggaaauccgaccaauaagugagaaagaagaaaauauggucaagucucuaguuagugccggaucagggaaagucgauaauuucacuaugggcguucuaugccuagcaauccuauuugaagaggucaugaggggaaaauuuggcaagaaacacaugauugccggcguauucuuuacauuuguauuauuacuaucuggacaaaucacauggcgugauauggcccauacuuuaauuaugauuggaucaaaugccagcgauaggaugggaauggguguuacauaucuagcucugauagcuacauuuaaaauucaacccuuuuuggcacucggcuuuuuccuucggaaacuuaccucccgggaaaauuuacuacuugguguaggccuugcuauggcuacaacguuacaacucccagaagauauagagcagauggcuaauggaauugcuuuaggccugauggcucucaaacuaauuacucaguuugaaacauaccagcuguggacugcauuaauaucuuuaacgugcucaaauaccauauuuacgcugacgguagcauggaggacagcuacauugauccuugcuggaguuucauugcugcccguuugucaaagcuccucgaugagaaaaacagacugguugcccauggcggucgcagcuaugggugugccuccuuugccacucuuuauuuuuggauuaaaagacacuuugaaaagaagaaguuggccucucaaugagggcgugauggcuguaggucugguaucaauacuggcuagcucauuacuccgcaaugauguuccaauggcuggcccguuagucgcaggggguuugcuuaucgcguguuacguuauaacugguacaucugccgaucuaacugucgaaaaagcagcggauauuacaugggaagaagaagcugaacaaacaggaguaucccacaaccuaaugauaacuguggacgacgauggaacuaugagaauaaaagacgacgaaaccgaaaacauuuuaacagucuugcuuaaaacggcguuacucauagucaguggaaucuuuccuuacagcauuccugcuacacuucuaguuuggcacaccuggcagaaacaaacacagagaucaggaguacuaugggacgucccgucuccgccagagacacaaaaagcggagcuugaagaggguguauaucgcauaaaacaacaagggaucuuuggaaagacacagguuggugugggaguccagaaagaagggguauuccauacaauguggcauguaacaagaggagccguccuaacauauaacggcaagcgacucgagccuaacugggcaucggugaaaaaggaccugauaagcuacgguggaggauggcgauuaucugcccaauggcaaaagggcgaagagguacaagugauugcaguagaaccagggaaaaacccaaagaauuuccagacgaugccgggcacuuuucaaacgaccacgggagagauaggagcaauugcacuagauuuuaaaccaggcacgucagguucaccaauaauuaaucgggagggaaaagugguaggucuguaugggaacggcgugguuaccaaaaauggaggauaugucagcgggaucgcacaaacaaacgcugaaccagacgguccaaccccagaauuagaagaagaaauguucaagaagaggaacuugacaauaauggacuugcauccagguucgggcaagacgagaaaguaccucccagcaauaguccgugaagcgauaaaacgaaggcuaagaacauugauuuuggcacccacuagaguaguagcugcugagauggaagaagcgcucaaagggcuaccgaucagauaccagacaacagcaacuaaaagugaacacacgggacgggaaauaguagaucugaugugucacgcaaccuucacuaugagauuacuaagcccuguacgcguaccaaauuacaacuuaauaauaauggacgaggcucauuucacggacccugccucaauugcagcaagaggauauauaaguacccguguuggaaugggggaagcagcagcaauuuucaugacagccacuccacccgggacagcugaugcauuuccccaaucuaaugcaccgauacaagaugaagaaagggauauccccgaaagaagcuggaacaguggaaacgaauggauaacagauuuugcgggcaagacgguaugguucguaccauccauuaaagcuggaaaugauauugcaaacuguuuaaggaaaaaugggaagaaaguuauacaacuuucaagaaaaacguucgauaccgaauaucaaaagacuaaauugaaugacugggacuucguggugacuacagauauuucagagaugggugcuaauuuuaaagcagacagaguaauagauccacggcguugucuaaaaccaguuauucuuacagauggcccagaaagaguaauacuggccgguccgaugcccgugacugcagcgagugcagcacagagaaggggaagaguaggccgaaauccucagaaagaaaaugaccaguauauuuucacaggacagccucugaauaaugaugaagaucacgcacacuggacggaggcuaaaauguuauuggacaacauaaauacgccagaagggauaaucccggccuuauuugaaccagaacgagaaaaauccgcagcuauagauggcgaauacagacuaaaaggagaaucacgaaagacguucguggaacuaaugaggaggggugauuuaccuguaugguuggcucacaaaguugcauccgagggaauuaaauacacggaccguaaaugguguuucgauggacaacgcaauaaucagauucuagaagaaaacauggacguagaaauauggacuaaagaaggugagaagaagaaacuccgaccccgaugguuggacgcccguacauacucagauccccuagcucuuaaagaguucaaagaauuugcugccggacguaagucuauagcccuagacuuaguuaccgaaauagggagggugccuucgcacuuggcucaucgcacgaggaaugcuuuagauaaucuuguuauguuacauacgagugaacauggaggacgcgcguacagacaugcgguugaggaacugccagaaacgauggaaacacuauugcuacuuggucuuaugauacucuuaacuggcggcgcuaugcuauuccugauaucuggaaaagggauuggcaaaacaucaauaggacuaauaugcguaauagcguccucaggaaugcuauggauggcagaaauaccacuacaauggauagcaucagcaauaguacuggaguucuuuaugaugguuuuacugauaccagaaccagaaaaacaaagaacgccacaagacaaucaauuagcuuacgucgucauuggcauacugacauuggcggccauaauagcagcgaacgaaauggggcuguuggaaacgaccaagcgugauuuagguaugaguaaagaaccaggugucguaucaccuacaucauaccuugacguagaucuacacccagcaucugccuggacacuguaugcugucgcaaccacaguaauuacuccaauguuacgacauacgaucgaaaauucuaccgcaaauguuucacuggcugccauugcuaaucaagcgguuguuuuaaugggauuagauaaaggauggcccaucucaaagauggaccuuggcgcaccgcuacucgcguugggauguuauagccaagucaauccuuuaacgcuaaccgcugccguccuacuauuaauaacucauuacgcaauaaucggaccaggauuacaagcaaaagcaacucgugaagcacagaaaagaacagcugccggaauaaugaaaaauccgacuguugaugggauuaugacaauugaccuggacccagucauauacgauucuaaauuugaaaagcaacucggacaaguuaugcuuuuaguguuaugugcaguacaacuacucuuaaugagaacaucaugggcguugugugaagcacuuacucuggcaacaggucccauuacuacuuuaugggagggcucccccggcaaauuuuggaauacuacuauugcaguuucaauggcaaauauauuccgaggcucauaucuugcuggugcuggauuggcauuuaguauaaugaagucaguugggacaggaaaaagagguacugguagucaaggagaaacucuuggagaaaaauggaagaagaaauugaaccaacuaagucguaaagauuuugacuuauauaagaaauccggaauuacugaaguugaccgaaccgaggcaaaagaaggauugaaacgaggagaaauaacacaucaugcaguuaguaggggcucugcaaaguuacaaugguuuguggaacggaacaugguaauaccggaaggacggguaauagauuuaggaugcggacgaggcggauggagcuauuauugugcaggccucaagaagguaacggaaguucgcggcuauacuaaaggaggacccggucacgaagaaccaguacccaugucgacauacgguuggaauaucguaaaacuuaugagcggaaaagauguauucuacuuaccuccugaaaaaugugacacauugcugugcgauauaggggaguccagcccaaguccaaccguagaggaaaguagaacgauacgggucuuaaagauggucgaaccgugguuaaagaacaaccaguucugcauaaaggucuugaauccauacaugccuacgguuauagagcaucuagaaagacugcaaaggaaacauggaggaaugcuuguaaggaacccuuugucacguaauaguacccaugagauguacuggauaagcaacggaacuggcaacauaguggcuaguguuaacaugguaagucguuuacuacuaaacagauucacuaugacacacaggaggccaacuauugaaaaagauguagauuugggugcugguacgagacaugugaaugcagaaccagaaacacccaacauggauguaauuggagagagaauaaaaaggauaaaagaggagcauaacagcacguggcauuacgaugaugaaaacccuuacaagacuugggcauaucauggaucauaugaaguaaaggcaacaggaucagcaucaagcaugauaaacggaguagugaaacuucuaacaaaaccaugggaugugguaccaauggucacccagauggccaugaccgauacgacacccuuuggacaacaacguguauuuaaagaaaaaguggauacaagaacaccaaggucaaugccugggacaaggcgcgucaugggcauuacggcugaaugguuauggaggacguuaggacgcaauaaaaagccgagacugugcacaagagaagaauuuaccaagaaaguccgcacaaaugcugcuaugggggcaguauuuacagaagaaaaucaaugggauucagcaaaagccgcuguugaggacgaagauuucuggaagcucguagaucgagagagggaguuacauaaacuuggaaaaugcgguaguuguguuuauaauaugauggggaaacgcgagaagaaauuaggagaguuugguaaagcgaaaggaucucgcgccauaugguauauguggcugggagcccgcuaucucgaguucgaagcauugggauuuuuaaaugaagaccacugguuuagccgagaaaacaguuauaguggcgucgaaggggaaggccuucacaagcugggauauauccuucgugauauaaguaagauaccgggaggagcuauguaugcggaugauacggcaggcugggauacucggauuacagaggaugaucugcacaacgaagaaaagauaacacaacaaauggaccccgagcauagacaauuagcaaaugccauauuuaaacuuacuuaccaaaauaaagucguaaagguucagcgcccgacuccuacgggaaccgugauggauaucauaucuagaaaagaucaaagaggaagcggccaaguaggaaccuauggauuaaauacuuucaccaacauggaggcccaauugauuagacaaauggaaggagaaggagucuuaaguaaagcagacuuggagaauccucauuuaccugagaagaaaauaacucaauggcuagaaacgaaagggguagagagacuaaaaagaauggcaaucucaggggacgauuguguuguaaaaccaaucgaugauagguucgcgaaugcacucuuagcuuugaacgacauggggaaggugaggaaagauauuccgcaguggcaacccaguaaaggauggcaugauuggcaacagguaccuuucugcucgcaccauuuucacgaauugauuaugaaagacgggagaaaauuaguaguuccaugucgcccgcaagaugagcucauaggccgagcuagaauuucucaaggggccgguuggucauuaaaggaaacagcaugccucggaaaagcguaugcacagauguggagucucauguacuuccauagacgcgaucucagacuggccucuaacgcaauaugcagugcuguccccguccacuggguuccuaccaguagaacaacuuggagcauucaugcacaccaccaguggaugacgaccgaggacaugcuuacaguauggaauagagucuggauagaagauaacccguggauggaagacaagaccccagucacgacaugggaaaaugucccauaucugggaaaacgagaagaucaaugguguggaagccuaaucggacuuacgagcagggcgacaugggcacaaaauauaccuacagccauucaacaaguuagaaguuuaaucggcaaugaggaauuucucgauuauaugcccaguaugaaaagauuucgcaaagaagaagaaagcgagggugccaucugguaa

SEQ ID NO: 23246 - RNA, 9873 nt, Artificial Sequence
  derived and/or modified CDS sequence (opt6) from DENV-3__FJ898458__SS-prME
acuuccuugugucuaaugaugauacuaccggcagcauuggcuuuccauuuaacaucuagagauggagaaccgcggaugauaguagggaaaaaugaaagagguaaaacauugcuuuucaaaacagcaucaggaauaaacaugugcacgcuuaucgccauggacuuaggagaaaugugcgaugacacugugacuuauaaaugcccucacaucacagaaguagaaccagaagacaucgauuguugguguaaccuaacgucaacuugggucacguacggaacauguaaccaagcgggggaacaccggagagacaaaagaucaguagcacuugccccgcauguggguaugggacuagacacacguacacaaacauggauguccgccgagggagccuggaggcaggucgaaaaaguagaaacuugggccuuaaggcacccuggguucacaauuuuagcccucuuucuagcacauuacauuggaacaaguuugacccaaaaaguaguuauauuuauauuguuaaugcuagucacgccaucgaugacgaugcgcugcguugguguuggaaaucgagacuuuguugaaggacuuagcggggcaacauggguagauguagucuuagaacauggaggaugugucacgacaauggcuaaaaauaaaccaacccuagacauugaacuccagaaaaccgaagcuacacaacuagcuacacuuaggaaacuaugcaucgaaggaaaaaucacaaauauaacuacagauaguagaugccccacacaaggcgaggcgguccuccccgaagaacaagaucagaauuauguguguaaacacacauauguggauagaggcuggggaaacgguugugguuuguucggcaaggguagucuagugacuugcgcaaaauuccaaugcuuagaaccaauagaaggcaaaguaguacaauaugaaaauuugaaauacaccguaauuauuaccguucacaccggugaucaacaccaaguugguaaugagacucaaggaguuacugcagaaauaaccccacaagccuccacaacagaagcuauacuaccugaguacgguacauuaggauuagaauguucaccuagaacgggguuagauuuuaacgagaugauacuauuaacuaugaaaaacaaagcauggauggugcacaggcagugguucuucgauuuaccacuucccuggacaaguggugcuacaaccgaaacaccgacauggaacagaaaagaacuacucguaacguucaaaaaugcacacgccaaaaagcaagagguuguaguacuaggaagucaagaaggagcgaugcauaccgcacuaacgggggccaccgaaauccaaaauagcggugggacgucgaucuuugcaggccacuuaaaaugucgccuaaagauggauaaauuagaauugaaaggaaugucuuaugcuauguguacaaauacuuuuguacuaaagaaagagguaucugaaacacaacacggaaccauacuaauaaaagucgaauauaagggcgaggacguuccaugcaagauuccauuuuccacggaagauggacaugggaaagcccauaauggaagauugauaacggcuaacccuguaguuacuaaaaaggaagaaccgguaaacauagaagcagaaccaccguuuggggaaucgaauauaguaaucgguauuggugacaaugcacuaaaaauaaacugguacaagaaagguucauccauaggaaaaauguuugaggcuacugcacggggcgcacgcagaauggcaauauuaggagauacggcgugggacuucgggucgguagguggaguacuaaacuccuuagggaagaugguccaccaaauauucgguagugcauacacggcucuauucucagguguaagcugggucaugaaaaucgguauaggcguacuccuaacuuggaucggacugaacucaaagaacacuagcaugucguuuagcuguaucgcaauaggaaucauaacauuauaccuaggcgcugucguacaagcagauaugggaugcguuauaaauuggaaagguaaagaacuaaaaugugguucaggaauauuuguaacuaaugaaguacacacuuggacggagcaauauaaauuccaagcugauaguccuaaaagauuagcgaccgcuauugcuggagcgugggaaaacgguguaugcgguauaagaucuacuacgcguauggaaaaccucuuguggaagcaaauagcuaacgaauugaacuauauacuuugggaaaauaacauuaaauugacgguagucguaggagacaucauuggaguuuuagaacaaggaaaaagaacgcuuacaccgcagccuauggaacuaaaauacagcuggaaaacauggggcaaggcaaaaauaguuaccgcagaaacacaaaauucuuccuuuauaauagauggcccaaauaccccagaauguccgucagccucaagggcuuggaacguaugggaggucgaagauuauggauuuggagucuuuacgacaaacauuugguugaaguuaagagaaguauacacucaacuaugcgaccacagauuaauguccgcugccguuaaagaugaacgcgcgguucacgccgauaugggcuauuggauugaaucgcagaaaaaugguagcuggaaguuagaaaaggcauccuuaauugaaguaaaaacauguacuuggccaaaaagucauacauuguggucaaauggagugcucgaaucugacaugaucaucccuaaauccuuggccggaccuauaagucagcauaaucaccgaccaggauaccacacgcaaacagcaggacccuggcacuuagguaaacucgaauuagacuucaauuauugugaaggcacaaccgucguuauaacugaaaacugcgguacaaggggucccucgcucagaaccacgacagucucuggaaaauuaauccaugaaugguguugucgaucuuguacccugcccccucuaagauauaugggcgaagacgguuguugguacgguauggaaauuagaccaaucucagagaaagaagagaauaugguaaaaucccuaguuucugcaggcucagguaaaguagacaauuucacaauggguguuuuauguuuagccauccuguucgaagaggugaugagagguaaguucggaaagaaacauaugauagccgguguguucuuuaccuuugucuuguuauuaaguggacagaucacauggagagacauggcacacacgcucaucaugauaggcucaaaugcgucagauagaaugggaauggguguuacauaccuugcauuaauugcaacauucaaaauacaaccauuucuugcucuuggauucuuuuuacguaagcuaacaucgcgugaaaaccucuuacugggaguaggauuagcuauggcaacaacacuucaauugcccgaagauauugaacaaauggcuaacggaauagccuuagggcuaauggcuuuaaaacuaauuacacaguucgaaacauaucaacuuuggacagcauuaauaucguuaacuugcuccaacacaaucuuuacauuaacaguggcuuggagaacugcaacguugaucuuagcaggaguaagucuccugccuguaugccaaagcaguaguaugcgaaaaaccgauugguuaccaaugaccgucgcggcaaugggaguaccgccgcuaccccuauuuauauuuucuuuaaaggacacucucaaaagaagaucauggccauuaaacgaaggugucauggcagugggcuugguaucuauauuagcgucaucuuuacuaagaaaugacguaccgauggcugggccguugguggccggugggcuguuaauugcguguuauguaauaacugguacaucagcagaccuaacaguggaaaaagcagcagacauaacaugggaagaagaagccgaacaaaccggaguaucacauaacuuaaugauuaccguugacgaugauggaaccaugaggauaaaagacgaugaaacggagaacauuuuaacaguucugcucaaaacggcacuacuaauagucaguggaauauuccccuacucaauucccgcaacauuguugguauggcauaccuggcaaaaacagacacaaagaaguggcguacuaugggacgugcccaguccaccagaaacacaaaaagcagaacuagaagagggaguauauagaaucaaacaacaagguauauucgggaaaacccaaguaggcguagggguucaaaaggaaggagucuuucauaccauguggcauguaacaagaggagcaguacucacauacaacggcaagagauuagaaccaaacugggcaagcgucaagaaagauuugauuucuuauggaggaggguggagauugucugcccaauggaagaaaggagaagaagugcaggucauagcaguggaaccgggcaaaaaccccaaaaacuuccaaacaaugccaggaacuuuucaaacaaccacaggugaaauaggcgcaauugcucuggacuuuaaaccagguacaucgggcucacccauuauaaacagagaaggcaaagugguaggguuauacggaaauggggucguuacaaagaauggaggauauguuagcggaauagcucagacaaacgcagaaccggauggucccacaccugaguuggaagaagaaauguuuaaaaagcguaaucugacaaucauggaccuacacccggggaguggaaaaaccagaaaguaccuacccgcgauuguaagggaagcaaucaaaagaagauugcggacgcuuauauuggcgcccacccgcguugucgcagcagaaauggaggaagcauuaaaaggcuuaccaauuagauaucaaacgacugcuacaaaaagcgaacacacuggacgagagauaguagaucucaugugccaugcuacguuuacaaugcgacuauugucaccugucaggguaccgaacuacaaucuuauaauaauggacgaagcucauuucacagauccagcaaguauagccgccaggggcuauauuucaaccagaguaggaaugggugaagcagcggcuauauuuaugacagcaacaccaccugggacggcggacgcauucccgcaaagcaacgcacccauccaagaugaagaaagagauauaccugaaagaucauggaauagugggaaugaauggauaacugacuuugcagggaaaaccgugugguucguaccuucgaucaaagcggguaacgauauagccaauuguuuaaggaaaaauggcaagaaaguaauucaacuuagccgcaaaacauucgacaccgaauaucaaaagacaaaacucaaugacugggauuuugucgucacaacugauauaucagagaugggagccaauuucaaagcagacagaguuauugacccacgaagaugccuuaagccaguaauacuaaccgaugguccugaaagagugauauuagcaggcccgaugcccguuaccgccgcaucagcagcacaaagaagaggucgaguagggcgaaacccacagaaagaaaaugaccaguacaucuuuaccggacaaccacuuaauaacgacgaagaccaugcucauuggaccgaagcaaaaauguuauuggauaacauaaauacuccagaaggcaucaucccagcacuauuugaaccggaaagggagaaaagugcagcuauugacggagaauaucgacuuaagggagaaaguagaaaaacauucguugaacuaaugaggcgaggagaccuaccgguguggcuugcucacaaaguggccucggagggaauaaaauacacagaccguaaaugguguuucgacggacaaagaaacaaucaaaucuuagaggaaaacauggacguggagauauggacuaaagaaggggaaaagaagaaacugcguccccgcuggcuggaugcacguacauauagugauccacuagcauuaaaggaauuuaaagauuucgcugccggucguaagucaauagcucucgauuugguaacagaaauaggaagaguuccuucucacuuagcacaccgaaccagaaacgcauuagacaaucuaguaaugcuacauacauccgaacacggaggcagagcuuaccgucacgccguagaggagcuaccugaaacgauggaaacccuauuacuuuuaggucugaugauacuuuuaaccggaggagcgauguuguuccuuauaaguggaaaaggaaucggaaaaacaucuauaggacucauuugugucauugcaucgagcggaauguuguggauggcagaaauuccgcuccaauggauagcauccgcuauuguguuagaauuuuucaugaugguacuauuaauacccgaacccgagaagcagcggacaccacaggauaaucaauuagcauacguaguaaucggcauucuuacccuagcugcuauuauagccgcgaacgaaaugggcuugcuugaaacaacaaaaagagaucuaggaaugucaaaagagccaggaguugucucacccacuucguaucuagauguagaucuucacccugccagugcuuggacgcuauaugcaguagcuacgacaguaauaacgccuauguugagacacacaauagagaacaguacagcuaaugucucccuagcagccauagcaaaccaagccgugguacuuauggggcuagauaaaggauggcccauaucaaaaauggacuuaggcguuccacuucucgcucuagguugcuauucucaaguaaauccuuugacacuuacagccgcugucuuacuguuaauaacccauuaugcaauaaucgggccuggucugcaggcaaaagcaacuagagaagcgcagaagagaacggcugcaggaauaaugaagaauccuaccguagaugggauuaugacuauagaccuggacccaguaauuuaugacagcaaguucgagaagcagcucggucaagugauguuacugguacuaugcgcgguacaacuacucuuaaugcguacaucaugggcuuuaugugaggcacuuacgcucgccaccggaccaaucacuacuuugugggaagggaguccuggcaaguuuuggaauacaacuauugcagugucgauggcaaauauauuuagggguagcuaucucgccggcgcuggauuggccuucucuauaaugaagucaguagguacuggcaaaaggggcacgggaagccagggugaaacauugggggagaaauggaagaagaaacuuaaucagcuaucgagaaaggaauuugacuuauauaagaagaguggaauuaccgaaguagauaggacugaagcaaaagaaggauuaaagagaggggagauuacccaccaugcgguuuccaggggauccgcaaaacugcaaugguuuguagaacguaacaugguaauuccugagggaagaguaauagaccuaggauguggucggggcggguggucuuacuacugcgcaggucuuaagaaagucaccgaaguuagaggcuacacaaagggugguccgggccaugaagaaccaguaccuaugaguacuuauggguggaauauuguaaaauuaaugucaggaaaagacgucuuuuaucugccaccggagaaaugcgacacacugcugugugauaucggcgaaaguucuccgagucccacuguagaggagagcagaacgaucagaguauuaaaaauggucgagccaugguuaaagaacaaccaguucugcaucaaaguuuuaaauccauauaugccuacaguaauagaacaccuagaacgauuacaacgcaaacacggugggauguugguucggaauccacuaagcagaaauucgacccaugagauguauuggauaucgaauggaaccgguaacauuguggcaucggugaauaugguaucuagacuuuuacugaaccgguuuacaaugacacaucgcaggccaaccauagagaaagacguggauuuaggugcuggaacacgucacguaaaugcagaaccagaaaccccaaacauggacguaauuggcgagagaauuaaacguauaaaagaagaacauaauucuacguggcauuaugacgacgaaaacccauacaaaacuugggcauaccaugguaguuacgaaguaaaggcaacuggcucggccucgagcaugauaaacgguguagugaaacuauuaacaaagccuugggauguaguacccaugguaacacaaauggcaaugacggacacaacaccauuuggacaacagcgaguguucaaagagaaaguugauacccguaccccacggucaaugccgggaacacgaagaguaauggguaucacagcugaauggcuguggcguacucuugggaggaacaagaagcccagacuaugcacaagagaagaauuuaccaagaaaguuaggacaaacgcagcuaugggcgcgguauucacggaggaaaaucaaugggacucagcuaaagcagcgguggaggaugaagacuuuuggaaacucguugauagggagcgugaauuacauaaacuuggaaaaugcgguucauguguuuauaacaugauggggaaaagagagaagaaacuuggcgaguuugggaaagcaaaagguuccagagccaucugguacaugugguuaggugcaagauaucuugaauuugaagcccuaggauuucuaaaugaggaucauugguuuagcagagaaaacucauauagugggguagaaggugagggacuacauaaauuaggauauauacuaagagauauuaguaagauacccgggggagcaauguacgcagaugauacugcaggcugggacacacgaauaacggaagacgauuuacauaaugaggagaaaauuacacagcaaauggauccagaacaucgacaguuagccaacgcaaucuuuaaauuaacauaucaaaacaaggugguuaagguacaaaggccaaccccgacaggcacaguaauggauaucauaaguagaaaagaccaacgcgguucaggacaagucggaacguauggacuuaacacauuuacaaauauggaagcacaauuaauaagacagauggaaggagaaggaguacuguccaaagcugauuuagaaaacccucauuuacccgagaagaaaauaacucaaugguuagaaacgaaaggaguagaacgacuuaaaagaauggcgauuucaggagaugauugcgucguaaaaccaaucgaugauagauucgcaaacgcgcuucucgcucuuaaugacaugggaaaaguacgaaaagauauuccucaauggcagccaucaaaaggauggcaugauuggcaacaagugcccuucugcucucaucauuuccacgaacuaauaaugaaagauggacgcaagcuaguaguuccauguagaccgcaagaugaacuuaucggacgagcucgcauaucacaaggugcaggauggagcuuaagagagacugcgugcuuagguaaagccuaugcucaaauguggagcuugauguacuuucauaggcgggacuuacgccuugcaucaaacgcuauauguucugccguaccaguucauugggucccuacgucacggaccacuuggucuauccacgcgcaccaucaauggaugaccacugaagauaugcuaacaguguggaacagaguuuggauagaggauaacccguggauggaagauaaaacccccguuacaacgugggaaaauguuccauaccuaggaaaacgggaggaucaauggugugguaguuuaauaggucuaacuucuagagcuacaugggcacaaaauauaccuacagcuauacaacagguuagaucauuaauagguaacgaagaauuucuagacuauaugccuaguaugaagcgauuuagaaaagaagaagaaucagagggagcaauuugguga

SEQ ID NO: 23247 - RNA, 9873 nt, Artificial Sequence
  derived and/or modified CDS sequence (opt6) from DENV-3__KJ189256__SS-prME
acaucuuuaugccugaugaugauauugccagcggcauuagcguuccacuuaacaucacgggacggagaaccucgaaugauaguuggcaaaaacgaacgagguaaauccuuauuauucaaaacagcaucaggaauuaacauguguacacuaauagcaauggacuuaggagaaaugugugaugauacagugacauacaaauguccgcauauuacggaaguugaaccagaagauauagacugcugguguaaccuaacuucgacuuggguaacuuacggaacguguaaucaagccggugaacauaggcgggauaaaaggucgguagcauuagcuccucaugugggcauggggcucgacacacgcacgcaaacauggaugucggcugaaggagcauggcgacaaguggaaaaaguagaaacgugggcauugagacacccaggcuuuaccauacuugcguuauuccuggcccauuauauaggcacaucucuaacgcaaaaaguaguaauuuuuauccucuuaaugcucgucacaccaucuaugacaaugcgcugcguuggaguuggaaaucgugauuuuguggaagggcuauccggggcaacauggguagauguaguauuagaacauggagguugugugacaacuauggcgaaaaauaaaccaacuuuggauaucgaacugcagaaaacugaagcaacccaacuagcaacauuacgaaaacuauguauagaaggaaaaauuacgaacauaacaacugauuccagguguccaacacaaggggaagcuguguuaccagaagaacaagaucaaaauuaugucugcaaacauacauauguagauagggggugggggaauggaugcggacucuucgguaaagggucauuggucacaugcgccaaauuccaaugucucgaaccaauagaagguaaagucguccaauaugaaaaucuaaaauacacugucauaaucacugugcauacaggagaucaacaucaagucggaaaugaaacucagggugugacugcagaaauuacaccacaagcaagcacaacagaagcuauauuaccugaauacggaacauuagggcuggaauguuccccacgaacugggcuggauuuuaaugaaaugauacuccucaccaugaaaaauaaagcauggauggugcaucgccaaugguucuuugauuuaccauugccauggacaaguggagcaacgacagaaacgccuacuuggaaccggaaagaauuguugguuacauuuaaaaaugcacacgcuaagaaacaagaagugguaguauuggguagucaagaaggggccaugcauacagcucuaacuggagcaacagagauacaaaacaguggugggacgaguauauucgcuggacacuuaaaauguaggcuaaaaauggauaaacuagaauugaaaggaaugagcuaugcaauguguacgaacacauucgugcuaaagaaagaaguuucugagacucaacauggaacgauuuuaauaaaaguagaguacaaaggugaggacguuccaugcaaaaucccguuuucaacagaagauggacacgguaaagcacauaacgggcguuuaauaacagccaauccaguagucacuaagaaagaagaacccgucaauauugaggcggaaccuccuuuuggggaaucaaacauuguaauagguauaggagauaaugcauugaaaauuaacugguauaagaaagggaguucaauuggaaaaauguucgaggcuacagcaagaggugcaaggagaauggcaauacuaggggacacggcaugggauuuuggcucgguuggaggagucuuaaauagccucggaaaaaugguucaccagauuuuuggcucagcauacacggcccuuuucaguggaguuaguugggugaugaaaauagggaucggaguacuccucacuuggauaggacucaacucuaaaaacacaaguaugaguuuuucgugcaucgcuauagguaucauaacccuauaccugggcgcuguuguccaagcugacauggguugugucauaaacuggaaagguaaagaacugaaaugcgggagcgguaucuucguuacgaacgaagugcauaccuggacggaacaguauaaauuccaagcggauaguccaaaaagguuagcuacugccauugcuggggcuugggaaaacgguguaugcggaauaagaucaaccacgcgaauggagaaucucuuauggaaacaaauagccaacgaacugaauuauauauuaugggaaaauaacauuaaacuaaccguaguagugggcgacauaauaggagugcuggagcaagguaaaaggacccuuacuccucaaccaauggaauugaaauauaguuggaaaacuuggggaaaagcuaaaaucguuacggcugaaacacaaaacagcucauuuaucauugacgguccaaacacaccggaauguccauccgcuucaagagcuuggaauguaugggaaguugaagacuauggauuugggguauucacaacaaauauaugguuaaaauugcgggaaguauacacacagcucugugaucaucgacuaaugagcgccgccguaaaagaugaaagggcagugcacgcugauauggguuacuggauugagucacagaaaaauggaucauggaagcucgaaaaagccucccuaauagaaguaaagacgugcacauggccgaaaucacauacacuguggagcaauggaguccuagaaagugauaugauaauaccgaagucguuagcugggccaaucucucaacauaaccaccgcccugguuaucauacccagaccgcuggaccauggcaucucggcaaacuagaguuagauuucaacuacugugaggggacaacaguugucauuacggaaaacuguggaacuagggggccaucccuccgaacaacaaccguuaguggaaaacuuauucaugaaugguguugucgcucauguacgcucccuccccugagguacaugggcgaagauggauguugguauggcauggaaauaagacccauaucagaaaaagaagaaaacauggugaaaucuuuaguuucagcagguucagguaagguggauaauuucaccauggguguuuuguguuuagcgauacuguuugaggagguaaugagagguaaauuuggaaagaaacacaugauagcgggagucuucuucacauuuguauugcuauuaucagggcaaauaacauggagagauauggcacauacgcucauuaugauaggaucuaaugcaagcgaucguauggguaugggugugaccuacuuggcacuaauugccaccuuuaaaauacaaccauuucuugccuuaggauucuuuuuaagaaaauuaacuucaagagaaaauuuauuauuaggaguuggucuagccauggcaacaacccuucagcuaccugaggacauugaacaaauggcaaauggaaucgcucugggucuuauggcucucaaauugauaacacaauuugaaacauaucaauuguggaccgcuuuaauaagucuuaccugcucaaacacaauauucacacuuacgguggcguggcggacagcaacccuaauacuugcuggaguaagccuguuaccuguaugucagaguucaucaaugaggaaaacugacuggcucccaauggcaguagccgcaaugggagucccaccacuaccguuauucaucuucucucuuaaagacacauugaagcgacguaguuggccacucaaugaaggaguaauggcaguaggauuagugagcauccuugcgagcagccuacuuaggaaugauguaccuauggccggaccuuugguagcagggggacugcugaucgcuuguuacguaauuaccgggacauccgcagacuugacagucgaaaaagcggcagauaucaccugggaggaagaagcugaacaaaccgggguaucgcacaaucuuaugauaacugucgaugaugacgguacaaugcgaauaaaagacgaugagacagagaacauccucacggucuuacugaaaacagcgcuguugauagugagcggaauauuucccuauaguauaccagcaacacuucucguuuggcauacuuggcaaaaacaaacgcaaagaagcggcgucuuaugggaugugccuaguccacccgaaacucaaaaggcagaauuagaagaaggcguauaccggauuaaacagcagggaauauuuggcaagacacaagucggugugggaguacaaaaagaagguguauuccacacaauguggcacguaacaaggggcgccguauuaacauauaauggcaaaaggcuggaaccuaacugggcuucagugaagaaagauuugauuucguacggaggcgguuggagguuaagugcacaauggcaaaaaggagaggaaguccaaguaauagcuguagaaccuggcaaaaaucccaaaaauuuucagacaaugccaggaaccuuccaaacaacgacaggggaaauaggcgcaauagcucuugacuucaagccaggcacuagcgguuccccgauuauaaacagagaaggaaaagucguuggacuguacgguaauggaguaguaacuaaaaacggaggauaugucucugguauugcacaaacgaaugcagaaccagauggaccaacaccagaacuagaagaagagauguuuaagaaaagaaacuuaacaauaauggaucugcauccaggauccggcaaaacuagaaaauaccuuccugcaauugugagggaggcaauuaagcgacgauuaagaacauuaauuuuagccccaacaagaguaguggccgcagaaauggaggaagcauuaaagggauuaccaauccgauaucaaacuacagcuacaaaauccgagcacacgggacgcgaaauaguggaccuaaugugccacgcaacauuuacaaugcgccuauuaucaccaguccgaguuccaaauuacaauuugauaauaauggaugaagcacauuuuacugacccugcaaguauagcggcaagaggauacauaagcacaagaguagguaugggugaagcagcugcaauuuuuaugaccgcaacacccccugggacagcugacgccuuuccccagaguaacgccccaauucaagaugaggaacgagauauucccgagcgaaguuggaacucuggaaaugaauggauuacggauuuugccgggaagacaguuugguuuguuccgucuaucaaagcagguaaugauaucgcaaacugucucaggaaaaaugguaagaaagucauccaacucucacguaaaaccuuugacacggaauaucagaaaacuaaauuaaaugauugggauuucguaguaacaacugacauuucagaaaugggcgccaauuuuaaagcugaccggguaaucgaccccaggagauguuuaaaaccgguuauuuugacugaugguccagaacgcguaauccuugccggucccaugccgguuacagcugcuagugcggcccaaagaagagggcgcguaggcagaaacccccagaaagaaaaugaccaauauauauucacuggacaaccuuuaaauaacgacgaagaucacgcgcauuggacagaagcaaaaauguuauuagauaauauuaacacgccugaaggaauuauaccagcccuauuugaaccugaacgcgagaaaagugccgcaauugacggagaauacagacuuaagggcgaaucucgaaaaacguucguagaacuaaugaggcgcggagacuuaccuguuugguuggcccauaaaguagcaucagaaggaauuaaguacaccgacagaaaaugguguuuugauggucaacggaauaaucagauauuggaagaaaacauggauguugaaauauggacaaaagaaggcgagaagaagaaacuacggccgagaugguuagacgccagaacuuauagcgacccucuagcccucaaagaauuuaaagauuuugccgcuggucggaaaucaauugcacuggaucucgugacugaaauuggaagaguaccaucgcaccuggcacaccgaaccagaaaugcacuagacaaccuaguaaugcuacauacaagugagcacggugggagagcguaucgacaugccguugaggagcuccccgaaacaauggaaacccuuuuauugcuaggacugaugauacuccuuacagguggagcuaugcuuuuucuuaucagcgggaaaggaaucggcaaaacaucaauuggauuaauaugcgucauagccuccagcggaauguuauggauggcagaaauaccuuuacaauggauagccagugcaauaguacuagaguucuuuaugaugguauuacuaaucccugaaccugaaaaacaacggacuccccaagauaaccaauuagcauacguuguaauugggauauuaacucuagcagcuauaauagccgcaaaugaaaugggucuucuggaaacaacuaaacgugauuuaggaaugaguaaagaaccggggguagucaguccgacuucauaucucgacguagaccuacacccagcuucugcuuggacacuauaugccguagcaacgacuguuauaaccccuauguuaaggcauaccauagaaaauagcacggcuaacguaucccucgcugcuaucgcaaaucaagcaguaguacuaaugggauuagauaaaggauggccuaucucuaaaauggacuuagguguacccuuauuagcauuggguuguuauucgcaagugaauccuuuaacauugacggcugcaguacuccuccuaauaacucauuacgcaauuauugguccaggacuccaagcaaaggcaacaagagaggcacaaaaacggacagcggcagguauuaugaaaaaucccacaguagacggcauaaugacuauugaccuagauccaguaauuuaugacaguaaauuugaaaagcagcugggucaaguuauguugcugguccugugugcaguacaguuauuacugaugcgaacaucaugggcccuaugcgaggcauuaacauuagccaccggcccuauuacgacacuaugggaaggaaguccagguaaguuuuggaauacgacuauagcaguuucaauggcuaauauuuuucgaggaucuuaucuagcaggagcgggauuggcuuuuaguaucaugaaaucagugggcacaggaaaaagaggcacaggaagccagggugagacccuaggagaaaaauggaagaagaaacuaaaucaauuauccagaaaagaguuugaccucuauaagaagucugguauuacugaaguggauaggacggaggcaaaggaaggcuuaaaaaggggagaaauuacacaccacgcaguaagccgaggaagcgcaaaauuacaaugguucgucgaacgaaauaugguaauuccagaaggacgcguaauugauuuaggaugcggucgaggaggauggagcuauuauugugccgggcugaagaaaguaacagaaguuagaggauacacaaaaggagggccaggacaugaagaaccagucccuaugucaacuuaugguuggaacauugucaaauuaaugagugguaaggauguauuuuaucugccaccugaaaaaugugacacguuauugugugauauuggggagagcucaccuucaccgacaguagaagagucgaggacgaucaggguguuaaagauggucgaacccuggcuaaagaacaaccaauucugcaucaaaguucuaaaccccuacaugccuacuguaauagaacacuuagagcgacuucagagaaaacauggagggaugcuaguccgcaauccacuaagcaggaauagcacccaugaaauguauuggauauccaaugguacagggaauaucgucgcaaguguuaacaugguuuccagauuacuacuaaaccgauuuaccaugacccaucggagaccgaccauagagaaagacguagauuugggagcuggaacaagacacguuaacgcggaaccagaaacuccgaauauggauguaauuggugaaagaauuaaaagaauuaaagaagaacauaauaguaccuggcacuacgacgacgagaauccuuauaaaacgugggcauaccauggguccuacgagguaaaagcaacgggaucagcaaguaguaugauaaauggcguaguuaaacuguuaacgaagccaugggacgucguuccaaugguuacucaaauggccaugacagacacuacuccguucggacaacaaagaguauuuaaggagaaagucgauaccaggacaccaaggaguaugcccggcacaagaagaguuauggggauaacagcagaaugguuguggagaacauuaggucgcaacaaaaagccacggcuuuguacgcgcgaagaauuuaccaagaaagucagaacaaaugcagcuaugggcgcaguuuucacugaagaaaaccagugggacucagccaaagcggcagucgaagaugaagauuuuuggaaauuaguggauagggaaagagaacuacacaagcucgguaaaugugggucuugcguuuauaauaugauggguaaaagagagaagaaauuaggagaauuugguaaagcuaaagguucaagggcgauaugguauauguggcugggugcccguuacuuagaauuugaagcacuaggauuuuugaaugaagaucauugguucaguagagaaaauaguuauaguggagucgaaggggaagggcuccacaaacuggguuauauauuacgugauauuuccaaaaucccagguggggccauguaugcagacgauacggcagguugggacacaagaauuacugaagaugaucuacauaaugaggagaaaaucacgcagcaaauggauccagagcacagacaacuagccaaugcaauauucaaacuaaccuaucaaaauaaaguaguuaaagugcagcguccaacaccgacugggacagucauggauaucaucucucguaaggaucagagagguuccggacagguagguaccuacggguugaacacuuucaccaacauggaagcucagcuaauuagacaaauggaaggugaaggaguacuaucgaaggccgauuuagagaauccacaccuaccagaaaagaagaucacacaauggcuagaaacaaaagguguggaaagacuuaaacgcauggcuauaaguggagaugacuguguagucaaacccaucgaugauagauucgccaaugccuuauuagcccuuaacgauaugggcaaaguuaggaaagacauaccgcaguggcaacccaguaaagguuggcaugauuggcagcaagucccauuuuguucccaccauuuucaugaacuaaucaugaaggauggcaggaaacucgucguaccaugcagaccucaagaugagcucauagggagagcuagaauuagucagggcgcaggcuggaguuugcgugaaaccgccuguuugggcaaagccuaugcccaaauguggagucucauguacuuccauagacgggauuuacgauuagcauccaacgcgauaugcagugcaguuccgguacauugggucccaacaagcagaacaacguggucaauacaugcacaccaucaauggaugacuacagaggauaugcuuacaguuuggaaccgcguauggaucgaagauaacccguggauggaagauaaaacaccaguaacaaccugggaaaauguuccauauuugggcaaaagagaagaucaauggugcggaucucucauugguuuaacaaguagggccacaugggcacaaaauaucccaacagcaauacagcaaguuagaagucucauagguaaugaagaguuccuagauuacaugccaagcaugaaacguuuucggaaggaagaagagucagaaggcgcuauuugguaa

SEQ ID NO: 23248 - RNA, 9873 nt, Artificial Sequence
  derived and/or modified CDS sequence (opt6) from DENV-3__KJ189257__SS-prME
acaagccuguguuugaugaugauacugcccgcugccuuagcauuccauuuaaccucaagagacggugaacccagaaugauuguaggcaaaaacgaaagggggaagucguuauuauucaaaacagcaucaggcaucaauauguguacauuaaucgcaauggaucuaggugagaugugcgaugacacugucaccuacaaaugcccccacauuacagagguugaaccagaagacaucgauuguuggugcaauuuaaccucuacguggguuacauauggaacauguaaucaagcaggggaacauagacgugauaaacgaaguguagcuuuagcaccacauguaggaaugggguuggauacccgaacacaaacuuggaugucggcagagggugccuggcgucaagucgaaaagguagaaaccugggccuugcgacaccccggguuuacaauccucgcuuuguuucuagcacauuauauagggacgagucuaacgcagaaaguaguaaucuuuauauuauugaugcuuguuacgcccagcaugaccaugagaugcguaggcgugggcaacagagauuuuguagagggacugagcggagcaacauggguagacguuguauuagaacacgguggcuguguaaccacuauggcuaagaacaaaccaacacuugauauagagcugcaaaaaacggaggcaacgcaacuggcaacauuaagaaaauugugcauagagggaaagauaacaaauauaacuaccgauagucgaugccccacacagggagaagcuguuuuaccagaagaacaagaccaaaauuaugugugcaaacacacauacguugaccggggauggggaaacggcugcggacuuuucggaaagggcagccuuguaaccugcgcuaaauuucaaugccuagaaccaauagaaggcaaagucguccaauacgaaaaucugaaauacacugucauuauuacagugcauacaggcgaucaacaccaaguagguaaugaaacacagggaguuaccgcggaaauaacaccacaagcgucaaccacugaagcuauauuaccggaguacggaacauugggauuagagugcagcccacggacaggccucgauuuuaaugagaugauacuauuaacgaugaaaaauaaagcguggaugguucacaggcaaugguuuuuugacuuaccuuuaccauggacaagcggcgcaacgacagaaacgcccacuuggaaucgaaaagaauuacuaguaacuuucaaaaacgcacaugccaaaaaacaagaaguagucguguuaggaucgcaggaaggggcaaugcacacggcgcugacuggagcuaccgaaauucaaaauaguggagguacuucaauuuucgcaggacaccuuaagugucgauuaaagauggauaaguuagaacuuaaaggaaugucauacgcaaugugcacaaauacauuugucuuaaaaaaagaaguaucugaaacucaacauggaacaauauuaauaaaagucgaauauaaaggcgaagacguaccaugcaaaauuccuuuuucaacugaagauggacaugguaaagcccauaacggacguuuaauaacagcaaauccgguaguuacaaaaaaagaagagccagucaauaucgaagcagaaccacccuucggcgaaaguaauauaguaauaggaaucggagauaaugcacuuaaaauuaacugguauaaaaagggcaguucuauagguaagauguuugaagcaacagcucgaggugcgaggagaauggccauuuugggagauacagcaugggauuuugguucuguaggaggaguccugaacuccuuaggcaaaaugguucaccagauauucggaagcgccuauacggcuuuauucaguggagucucguggguaaugaaaauuggcauuggaguucuauuaacuuggaucggauuaaacucaaagaauacuucaaugucuuucucauguauagcuauuggaauaauaacucuuuaccuuggagcgguuguucaggcagacaugggaugugugauuaacuggaaaggaaaagaacuuaaauguggcucugguauuuucguaacuaaugaaguacauacguggaccgagcaauauaaauuucaagcugauucgccgaaaagauuagcaacugcuauugcuggagcuugggaaaauggaguaugcggaauaagaaguaccacuaggauggaaaauuuguuguggaagcagauagcgaacgaauuaaacuauauauuaugggaaaauaauauuaaauuaacgguaguuguaggagacauuauagguguuuuagaacaaggaaagcguacuuuaaccccccagccuauggaguuaaaauauucguggaagacauggggaaaagcaaagauaguuacugcagaaacacaaaauaguaguuucauaauagauggaccaaacacaccagaaugcccuuccgcauccagagcuuggaauguaugggagguagaagacuacggguuugggguauuuacuacaaauauauggcugaaguuacgugaggucuacacccaacuuugugaccaccgacuuauguccgcagcaguaaaagacgagagggcagugcaugcagacaugggauauuggauagaaucccaaaagaauggauccuggaaacuagagaaagcuagcuuaaucgaagugaaaacuuguacauggccaaaaagucauacccuauggucaaaugggguacuagaauccgauaugauaauaccgaaaucacucgcaggccccauuucacaacauaaucaccgcccgggcuaccacacccaaaccgcgggaccauggcauuuggguaaacuugaauuagauuucaauuauugugaagggacaacaguaguaauaacggaaaauugcggaacaaggggaccaucucugcgaaccacaacuguuaguggaaaacucauacaugaauggugcugcaggucuuguacacuaccuccuuuaagauacaugggggaagacgguugcugguacgguauggaaauccguccuauaagugaaaaagaagaaaacaugguaaaaaguuuggugagugcaggaucaggaaaaguggauaacuuuaccaugggggugcucugccucgcuaucuuguucgaagaaguaaugagagguaaauucggaaagaaacauaugauagccggaguauuuuucacguuuguccuacuuuugaguggccaaauaacuuggcgggacauggcgcacacauuaauaaugaucggaucaaauacgagugacaggaugggaauggggguuaccuaccucgcacucauugccacauucaaaauucaaccuuuuuuagcucuaggguucuucuuacgaaaacuaacaucgagggagaaccuauuacuggguguuggucuggcaauggcaacgacauugcagcuuccagaggauauagagcaaauggcaaacggaauugcucucggccugauggcgcugaaauuaauaacgcaguuugaaacuuaccaauuguggacagcacuaauuaguuuaacauguucaaacacuaucuucacucuaacaguagccuggcgaacggcuacucuuauccuagcuggcguuucacuauuacccguaugccaaucaaguuccaugagaaaaacugauuggcuaccaauggcgguugcagcaauggguguuccaccauuaccccuuuuuauuuuuucauugaaggacacucuaaaaagaagaaguuggcccuugaacgagggaguuauggcuguaggauuaguuucuauauuagcgaguagccuauuaaggaacgauguuccaauggcuggcccauugguagcuggaggacuacuaauagcaugcuauguaauuacagguaccucagccgacuuaaccguagagaaagcagcagauaucacgugggaagaagaggcagagcagacugggguaagccacaaucucaugauaacgguggacgaugauggcacaaugcgaauaaaggacgaugaaacggaaaacauccucacagucuuacugaaaacugcacuucuaauuguaucugggauauuuccauauaguaucccagcgacccuuuuagucuggcacacauggcaaaagcaaacacaacgcucaggcguauuaugggacgucccaucuccaccagagacgcaaaaagcggaacuagaggagggcguguaucggauaaaacaacaaggaauuuuugggaaaacgcaggugggaguugguguacaaaaagaagggguuuuucauacaauguggcaugucacaagaggugcagugcuaacguauaacgguaagaggcuugaaccuaauugggcauccguuaaaaaagaucuuauaucuuacgggggaggauggagacuaagcgcccaauggcagaaaggagaagagguucaagucaucgcgguugaacccgguaaaaauccaaaaaacuuccagacaaugccgggcacauuccaaacuacaacaggagagauaggcgcgauagcucuugacuuuaaaccaggaacaucaggaagucccauaauaaaucgcgaagguaaaguuguuggacuauauggaaacggaguuguaacuaaaaaugguggguauguuaguggcauagcgcaaacuaacgccgaaccugauggcccaacacccgaacuagaagaagagauguucaaaaaaagaaauuugaccauaauggaucuucauccugguagugguaagaccagaaaauaucucccagcuauaguuagggaggccauaaaaaggcgccuacgcacauuaauacuagcaccaacaagaguggucgcagcugaaauggaagaagccuugaaaggucuacccauucguuaccaaacaaccgcaaccaaaagugaacauacugggagagaaaucguugaccuuaugugucaugcuacauuuaccaugagguuacuaucaccuguacggguaccaaauuauaacuuaaucauaauggacgaagcucauuuuacagauccagcaaguaucgcugcuagaggauacaucucuacgcguguuggaaugggcgaagcugccgcaauuuucaugacggcaacaccaccaggcacugcugacgcauuuccucagagcaaugcgccaauacaagacgaagaaagagacauccccgaacgaucauggaacagcgguaacgaguggauuaccgauuuugcaggcaaaaccguuugguuuguuccgucuauuaaagcgggaaaugacauagccaacugcuuacguaaaaacggcaaaaaagucauucaacuaaguaggaaaacauucgauaccgaauaccaaaaaacuaagcuaaaugacugggauuuuguaguaacaacugacauaucagaaaugggagcuaacuucaaagcagacagagugaucgaccccaggcgaugucugaaaccaguuauauuaacagauggcccagaaagaguuaucuuggcgggaccaaugccuguaaccgcagcuuccgcagcacagcgucgggguagagugggucguaacccucagaaggaaaacgaucaauauauuuuuaccgggcaaccucugaacaaugacgaagaccaugcucacuggacagaagcaaagauguuauuagauaauauuaauaccccggaagguauaauaccagcucucuucgaaccugaacgggagaaauccgcugccauagauggugaauacaggcuaaagggagaaucgagaaaaacguuuguggaacucaugagacggggagaccuuccaguuugguuagcacauaaaguugccucagaaggcauaaaauauacugauagaaaauggugcuuugauggacaacgcaacaaccaaauuuuagaagaaaacauggauguagaaauuuggacuaaggaaggggagaagaaaaaauuaagaccaagauggcuagaugcuagaacauauucagaucccuuagcguugaaagaauucaaagauuuugcggcaggaagaaaaucgauagcccucgacuugguuacugagauuggaagaguaccaucacaucuagcccauagaaccaggaacgcauuggacaauuugguaauguuacacacuagugaacacggaggaagagcauauaggcaugcuguggaagaauuaccugaaacgauggaaacuuuacuauuauuagggcugaugauucugcugacugguggcgcaaugcuuuuucucauaucugggaaaggcauaggaaaaacaagcauuggcuuaauaugcguuauagcuagcucaggaauguuauggauggcugagauaccauuacaauggauagcgagugcaaucguuuuagaauucuuuaugaugguccuacugaucccagagcccgaaaagcaacgcacaccgcaagauaaucaauuggcguacguaguaaucgguauucuuacauuagcggcuauuaucgcugcuaaugagaugggacuacuagaaacaacuaaaagagaucuuggaaugucaaaagaaccuggagugguaucaccaacaucauauuuagacguggaucuccauccagcuagugccuggacacuauacgcuguggcgacuacaguaaucacgccaauguugcgacauacuauagagaauucaaccgcaaacgugucacuagcugccauagcaaaccaagcggugguauuaaugggguuagacaaaggauggccaauaucgaagauggauuuaggagugccucuuuuggcccucggguguuauagccaggugaauccguugacacuaacggcagccgucuuccucuuaaucacacauuaugcgauaauuggcccgggguugcaagcaaaagccacaagagaggcacaaaagagaacugcagcggguauaaugaaaaacccuacuguagauggaauuaugaccauagauuuagauccuguuaucuacgacucuaaauucgaaaaacaacucgggcagguaauguuacuuguacuaugcgccguucagcuccuuuuaaugcggaccagcugggcuuugugcgaagcgcuaacacuagcaacgggaccaauuacuacacuaugggaagggucccccgguaaguuuuggaacacaacuauagcaguuucaauggcuaacauauucagagguucuuaucucgcgggcgcuggauuggccuuuaguauaaugaaaucaguugguacgggcaagcgagguaccgggucacagggagaaacuuuaggagagaaauggaaaaagaaacucaaccagcuaucuaggaaagaguucgaccuauauaaaaaauccggaauaacggaaguugauagaaccgaagcaaaagaaggacucaaacgaggagaaauaacacaucacgcagugaguagaggaagugcaaagcuacaaugguucguugagcgaaacauggucauaccugaaggacggguaauagacuuaggauguggccgugggggcuggucuuauuauugugcgggacuaaagaaagucaccgaaguccgaggcuauacaaaaggagggccaggacacgaggaaccagucccaaugucaacauacggauggaauauaguuaaauuaaugagugggaaggacguguucuaucuaccuccagaaaaaugcgauacgcuauuaugugauauaggugaguccucgccuaguccaacaguagaagagucacggacgauccgcguauugaaaauggucgagccauggcucaagaauaaucaguucuguauuaaaguacuaaacccauauaugccaacggucauagagcacuuagaaagacugcagcggaagcacggaggcaugcuuguccgcaacccacugucaagaaauaguacccaugaaauguauuggaucucaaauggcacagggaacauaguagcuagcgucaauaugguaagcagauuguuauugaauagauuuaccaugacacaucgucgaccuacuauugaaaaggauguagaccuaggggcuggcacacgccacguuaacgcugaacccgaaacacccaauauggauguuauaggcgagcguauaaaacgaaucaaagaagaacauaauucuaccuggcauuacgaugacgaaaaccccuacaaaaccugggcuuaucacgguuccuaugaagugaaagcuacgggaucugcuuccucuaugauaaacggagugguaaaguugcuuacaaaaccaugggacguaguaccaauggugacucaaauggcgaugacagauacaacacccuucggacaacaacguguuuuuaaggaaaagguggauacaagaacuccaagaaguaugcccggaacgcgaaggguuaugggaauuaccgcagagugguuauggagaacucuggggaggaauaaaaagccccgcuuauguaccagagaagaauucacuaagaaaguaagaacaaaugcagcaaugggcgcaguauucacggaagaaaaucagugggacagugcgaaagcagcggucgaagaugaagacuuuuggaaauugguugauagggagcgagaacuucacaagcugggaaagugugggucuugcguauacaacaugauggguaagagagaaaagaaauuaggcgaauucgguaaagccaaaggaucgagggcaaucugguacauguggcuuggggcgcgauauuuggaguuugaagccuuggguuuuuuaaaugaagaucacugguucucucgagaaaacagcuauuccggaguggaaggugagggucugcauaaacuugguuauauauuaagggacauaucgaaaauaccagggggugcaauguacgcagaugacacagcugguugggauacaagaauaacagaagaugauuuacauaacgaggaaaaaauaacacaacaaauggacccugaacaccgucaacuagcgaaugcuauuuuuaaacugacguaucaaaacaaaguaguuaagguucagagaccgacaccuacugguacuguuauggacaucauaucaagaaaagaucaacgaggcagcggacagguagggacauauggucugaauacguuuacuaauauggaagcacaauugauaagacaaauggaaggagaaggaguuuuaagcaaagcagauuuagaaaacccucaucuaccugagaaaaagauuacucaauggcuagaaacuaaggggguagaaaggcuaaaaaggauggcaauauccggagacgauugcgucguuaaaccuauugaugaccgguucgcaaacgcccuacuugcauugaaugacaugggaaaaguacgaaaagacauaccacaguggcaacccucgaaaggauggcaugauuggcaacaaguaccguuuuguucacaucauuuccacgaauugauaaugaaagacggucgaaaauuagugguaccauguagaccacaagacgaacuuauaggcagagcuagaauaagccaaggcgcuggauggucguuacgagagacggccugcuuaggaaaagcauacgcgcaaauguggucauuaauguauuuccaucgucgcgaccuuagacuggcguccaacgccaucugcucagccguaccgguacauuggguuccgacaucuaggacaaccugguccauucacgcacaccaccaauggaugacaacugaggauaugcuaacaguuuggaaucgagucuggauugaagacaaucccuggauggaggacaaaaccccggugacaacaugggaaaacgugccuuaucuaggcaagagagaagaccaaugguguggaucgcugauaggguugacaucgcgcgcgaccugggcacaaaauauaccaacagcuauucaacaaguaaggucccucauuggcaaugaagaauuccuagauuauaugcccagcaugaagagguuuaggaaagaagaagaaucagaaggugcaauuugguag

SEQ ID NO: 23249 - RNA, 9873 nt, Artificial Sequence
  derived and/or modified CDS sequence (opt6) from DENV-3__KJ189262__SS-prME
acaagucuuugccuaaugaugauauuacccgcugcauuagcauuucacuuaacgucuagggacggagaaccaagaaugaucgugggcaaaaaugaaagggggaaaucgcuguuauuuaaaaccgcauccgguauuaacauguguacccuaaucgccauggauuuaggagaaaugugcgacgacaccgugacauauaaauguccacauaucacugaaguagagccggaggauauagacuguugguguaacuuaacgucaaccuggguaacauauggcaccuguaaucaagcuggagagcaccggcgagauaaaaggucgguagcucuagcgccccacguaggaaugggauuagauaccagaacacaaacuuggaugagugcggagggagcauggcgucaaguugaaaaaguagaaacaugggcacuucgacauccaggauucacuauacucgcuuuauuucuagcgcauuauauaggaacaucccuaacucaaaaaguagucauauuuaucuuacuuauguuaguaaccccaagcaugacuaugagauguguagggguagguaaccgugauuuugucgaaggauuaucaggugcaacauggguagaugucguacuagagcauggaggauguguuacaacuauggcuaaaaacaaaccgacauuagauauagaauuacagaaaacagaggcaacgcaauuggcuacauugaggaaacuaugcauugaaggaaaaauaacgaauauuacgacagauagcagaugcccaacgcaaggggaggcuguacugccugaagaacaagaucaaaacuauguauguaaacauacauauguagaucgcgguuggggaaacggauguggacuauuuggaaaagguagucuaguaacaugugcaaaauuccaaugcuuagaaccaaucgagggcaaaguaguccaauaugaaaauuugaaauacaccguuauaauuacgguacacaccggcgaucagcaccaaguuggcaacgaaacccaaggcguaacagcggagauuacuccccaagccucuacaacggaagccauauugccagaauaugggacgcuaggucuagaaugcaguccuagaacgggucuagauuucaaugaaaugauccuccugaccaugaaaaacaaggcuuggaugguccauaggcaaugguucuuugaucucccacuuccuuggacaaguggcgcuaccacugaaacaccgacauggaaucgaaaagaacugcuggucacauuuaaaaacgcacacgcaaagaaacaagaaguagucguguuggguagucaagaaggagcaaugcacacagcucuuaccggcgcuacagaaauucaaaauucgggcggcaccucuauauuugcaggacaucuaaaauguaggcuaaaaauggacaaacuagaguuaaaaggcaugucguaugccauguguacgaacaccuuuguuuuaaagaaagaagucucagaaacacaacaugggacuauccugaucaaaguugaguacaaaggcgaagacgugccauguaaaaucccuuuuucgacugaggacggccacggaaaagcucauaacggaagacuaauaaccgcaaauccaguugugacgaagaaagaagaaccuguuaacauugaagccgaaccgcccuucggugaaucaaauauuguuauuggcaucggagauaaugcacucaaaauaaauugguacaaaaagggaucaagcaucgguaaaauguucgaggccacagcacgaggcgcacgcaggauggcuauccuuggagacacagcaugggauuucgggagugucggagggguuuugaacucauuaggaaaaaugguacaccaaauauuuggaagcgccuauacugcauuauucucaggagucaguuggguaaugaaaauaggaaucgguguguuauuaacuuggauaggcuuaaacaguaaaaauacaucaaugagcuucaguugcauagcuaucggaauaauaacucuuuaccucggugcgguuguacaggccgacaugggcugugugauaaauuggaaaggcaaagaauuaaagugcggaagugguauuuuuguaacgaacgaaguacauacauggacggaacaauacaaguuucaagccgauucaccgaaaaggcuugcaacagcgauagccggagcaugggaaaacgguguaugugguauccggucgacaacccguauggagaaccuuuuauggaaacaaauugcgaaugaacuaaauuacaucuugugggaaaauaauauaaaguuaaccguugucguuggugacaucauagggguacuagagcaagggaaaagaacacuaacuccucagccaauggaacuaaaauacuccuggaaaacaugggggaaagcuaaaauuguaacagcggaaacucaaaauaguagcuuuauaauagauggucccaacacgccagaaugcccuucugcgaguagagcauggaacgugugggaaguggaggacuauggcuucgggguuuucaccacaaacaucugguuaaaauuacgggaagucuauacucaacuuugcgaccauagguuaaugucagcugcugucaaagacgaacgugccguucaugcagauaugggauacuggauagagucacagaaaaacgggucauggaagcucgaaaaagcaucgcugauagaagugaagaccugcacuuggccgaaaagccacacccucugguccaaugguguuuuagaauccgauaugauaauuccaaagagccuagcgggaccuauaucucaacacaaucauaggccgggguaccauacgcaaacagcaggaccauggcauuuagguaagcuggaguuagauuuuaacuauugcgagggaacuacagugguaaucacggaaaauugcggaacgcggggcccgucacuccgcacaacuacaguuucugggaaauuaauacaugagugguguugucgaaguugcacacuaccaccacucagauacaugggagaagacggauguugguaugguauggagaucagaccaauuagugagaaagaagaaaacauggucaaaagucuugugucugcaggaagcgggaagguagauaauuucacgaugggagugcuaugccucgcaauucuauucgaagagguaaugagagguaaauuuggcaagaaacauaugaucgcuggaguauuuuucacguuuguacuacuacucucgggucaaaucacauggcgagauauggcccauacauuaaucaugauagguucaaaugcaucagauaggauggguauggggguaacauaucuagcacuaauagcaacauucaaaauucaaccguuucuagcguugggcuucuuucuaaggaaacuaacaagucgggaaaaccucuugcucggagugggucuagcaauggcuacgacuuuacaauuaccugaagauauugagcaaauggcaaauggaauagcguuaggauuaauggcccucaaacuaauaacgcaguuugaaacauaucagcuguggacagcauugaucucccuaacaugcucuaauacuauuuucacauuaacuguagcguggagaacagccacauuaauucuugcaggaguaucacucuuaccaguaugucaaagcagcaguaugcguaaaaccgauuggcuaccuauggcgguagccgcgauggguguuccuccacugccauuauuuauauuuaguuuaaaggacacacuaaagagacgaaguuggccacuuaaugagggcgucauggcaguuggcuuaguaagcauacuugcgaguucgcuccuuaggaacgacguaccuauggcaggcccucuuguagcaggaggccuccuaauugcuuguuauguaauaacagguacgagcgccgaccugaccguggaaaaagcagcagacaucacaugggaagaggaagcagagcaaacaggggugucacauaaucuuaugauaacaguggaugacgacggaaccaugcgaauuaaagacgacgaaacagaaaauauauuaacugucuugcucaaaaccgcacuauugauuguuagugguauuuuuccauacucgauccccgccaccuuacugguauggcauacguggcaaaaacaaacccaaagaagcggaguacuuugggauguuccaucgccaccagaaacucaaaaagcagaacuugaggaagguguuuaucggauuaaacaacaggggauuuuugggaaaacucaagucggugugggcguucaaaaagagggaguauuccauacgauguggcaugugaccagaggugccgucuuaacauauaacggcaagagguuagaaccaaacugggcaucaguuaagaaagauuuaauaaguuauggcggaggguggcgguuaagugcacaauggcaaaaaggggaagaaguacaaguaauugcaauagaacccgguaaaaaccccaaaaauuuccaaacaaugccugggacauuccaaacaacaacaggugaaauuggagccauagcacuggauuucaagccugguacuucagguucgccaauaauuaaucgcgagggaaaagucguaggacucuacggaaauggaguaguuaccaaaaaugguggcuauguaucgggaauagcucaaacaaacgcagaaccagaugguccaacuccagaacucgaagaagaaauguucaagaaacgaaacuuaaccauaauggauuuacacccagguucgggaaagacaagaaaauauuuaccagcaauagucagagaagcuauaaagcgcagguuacguacccuaauucuggcuccaacuagggugguagcagcggaaauggaagaggcuuuaaaggggcuaccuauucgcuaucagacaacagcgacuaaaagcgaacauacgggccgagaaaucguagacuugaugugucacgcaacguucacgaugcguuuauuaucucccguuagggucccaaacuauaaucucauaauaauggacgaagcucacuuuacggauccggcuucuauugccgcgaggggguacauuucaacaagggucggcaugggagaggccgcugcuauuuuuaugacagccaccccucccgguaccgcagacgcauucccacaaucaaaugcacccauacaagacgaggaaagagacauaccggaacgauccuggaauagcggaaacgaauggauaaccgacuuugcugguaaaacuguaugguuuguuccaaguauuaaagccgguaacgacauagcuaauuguuuaaggaaaaacggcaagaaagugauucaauuauccagaaagaccuucgauacggaguaccagaagaccaagcuaaaugauugggauuuugucguaacgacagauauaagugaaaugggggcaaauuuuaaggcagacagagucauagacccaagacguuguuuaaagccuguuauauuaacagacggcccagaaagaguaaucuuggccggaccaaugcccguuacggcggcaucggcagcccagcggagggguagaguaggaaggaacccccaaaaagagaaugaucaauacauuuucacuggucaaccauuaaauaaugacgaagaccaugcucauuggaccgaggcaaaaauguuacuggauaauauaaauacaccagaaggaauuauaccggcuuuauucgagccggagcgggaaaaaucugcugccauugauggcgaauaucgauuaaaaggggagucgaggaaaacguucguagaacuaaugaggcgaggggauuugccaguuugguuagcucacaaaguagcuucugaagguauuaaauauaccgaucgaaagugguguuucgacggacaacgcaauaaucagaucuuagaggagaacauggacguugaaauuuggacaaaggaaggcgagaaaaagaaacuacgaccaagauggcuugacgcucgaacguauuccgauccccuggcguugaaagaguuuaaagacuuugcagcaggaaggaaaucaauagcucucgaucuggugacugaaauaggaagaguuccaucccaucuugcucacagaacccguaaugcauuagauaaccuuguaaugcuucauacguccgaacacggagggagagcuuaucgacaugcuguugaggaacuuccagaaacuauggaaacauugcuucuucugggauuaaugauuuugcucaccgguggagccauguuauuucugauaagugguaaaggcauagggaaaaccucaauagggcuuauaugcgucauagcaucuucggggauguuauggauggccgaaaucccgcuucaauggaucgcuagugcaauuguacuugaguucuuuaugaugguacuguuaauaccagaacccgaaaaacagcgaaccccacaagauaaccaguuagcuuacguaguaauagggauacuaacauuagcugcgauuauugccgcaaaugaaaugggauugcuagaaacaacgaaacgugauuuagggauguccaaagaaccaggaguugugagcccuacaaguuaucuggacgucgacuuacaucccgcuagcgccuggacacuguaugcaguugcgacaacuguaauuacaccaaugcuacgccacacuauugaaaacucuacugcgaaugucagcuuggccgcuauugcgaaccaagccguagugcucaugggcuuggacaaaggguggccuauaaguaaaauggauuuaggagucccuuuacuugcguuaggauguuauucacaagugaauccacuaacccugacagcagcagugcuauuauuaauaacccauuaugccauaauagguccaggcuugcaagcaaaagccacaagagaagcucaaaagagaacugcagcagggauuaugaaaaaccccacuguggaugggauaaugacaauagaucuugauccaguuauuuacgauucaaaauuugagaaacaacuuggacaaguaauguuauuggucuuaugugcaguacaacucuuauuaaugaggacauccugggcccuuugcgaagcccucacccuagcuaccgggccaauaacuacauuaugggaagggucaccugguaaauuuuggaauaccaccauagcaguauccauggcaaacauauuccgaggcucauaucuagcuggggcugggcucgccuucucaaucaugaagucagucggcacuggcaagagaggaacagguagucaaggagaaacacugggcgagaaguggaagaagaaacuaaaucaacuuagucgaaaagaauuugaccuauacaagaaaagcgggaucacagaaguggacagaacugaagcuaaagagggauuaaagagaggcgagauaacucaucaugcaguaagucgugguucggcuaaacuucaaugguucguggaacgaaacaugguaauaccagaaggaagaguaaucgaucuuggcuguggaagaggcggcuggaguuauuauugugcagggcuaaagaaaguuacagaaguuagagguuacacuaaaggcgggccuggacacgaggaaccuguuccuauguccacuuauggauggaauauaguaaaauuaaugucgggaaaggauguauucuaccucccgcccgaaaaaugcgacacgcuacuaugugacaucggagaaaguucaccuagcccuaccguggaagaaagucguacaaucaggguauuaaaaaugguagaaccguggcucaaaaacaaccaauuuugcauuaagguacuuaauccuuacaugccaacaguaauugaacaucuggaaaggcuacagcguaaacaugggggaaugcuaguuaggaacccccuuaguagaaauucaacacaugaaauguauuggauaucuaauggaacugggaauaucguagcauccguuaauaugguaucgagauuguuguuaaauagguuuacuaugacacacaggcguccuacaauagaaaaagauguagaccuaggagcaggcacaaggcacguaaacgccgaaccugaaacuccuaauauggacguaauaggagaaaggaucaaacgaaucaaagaggaacacaauuccacuuggcacuaugaugacgaaaaccccuauaaaacuugggcuuaccauggcucauaugaagucaaggcuaccggaucugcaaguucuaugauuaacggggucguaaaguuauuaacaaagccgugggauguaguuccuauggucacgcaaauggcaaugacagauacaacaccauucggucaacagaggguauuuaaagaaaagguggacacaagaacuccaaggaguaugccagguacuagacgggugaugggaaucacagcugaauggcucuggcgaacgcucggucguaauaagaaaccucgguuauguacucgugaagaauuuacaaagaaaguaagaacaaacgcagcuaugggugcaguuuucacggaagaaaaccagugggacagcgccaaggcagcgguagaagaugaagauuucuggaaguuaguugaucgcgaaagagaacuccauaaguuggguaaaugugguaguuguguauauaauaugauggggaaaagagagaagaaacuaggugaguuuggaaaggccaaaggaucucgagcaauaugguauaugugguuaggcgcucgguaccuugaauuugaagcacuagguuuccuaaaugaagaucauugguucaguagggaaaauaguuacucaggaguggaaggugaagguuuacacaaacugggauauauucuaagggacauaucaaagauaccaggaggagcuauguaugccgaugauaccgcagggugggauacccgaaucacagaagaugaccuacacaaugaagaaaagauaacucaacagauggauccagaacauagacaguuggcaaaugcuauuuucaaacuuacauaccaaaacaaaguaguaaaaguccagcgaccuacaccaaccgguaccguuauggauauaauaucgagaaaagaccagagagguucuggacagguugguaccuacggacugaacacuuuuacaaauauggaggcucaacuaauaagacaaauggagggggaaggcguguugaguaaggcggauuuagaaaauccccacuuaccugagaagaaaaucacacaguggcucgaaacgaaagguguugaacgauugaaacggauggcuaucagcggugacgacuguguagucaaaccuauagaugauagauucgcuaaugcucuacuugcuuuaaaugacauggguaaagucagaaaagauauaccccaauggcaaccaagcaaaggauggcaugauuggcagcaagucccuuuuugcucacaucauuuccacgaacuaauaaugaaggaugggagaaaauuagucguccccuguaggccccaagacgaguugauagggcgagccaggaucucacagggcgcggguuggagucuacgagagaccgccugccuuggaaaagcguacgcacaaauguggucccuaauguauuuucacagacgugauuuaagauuagcuagcaaugcaauaugcucagccguuccaguacauuggguaccuacaagucggacaacauggaguauccacgcacaucaucaauggaugacaacagaagacaugcuuacuguauggaaccgcgucuggauagaagauaaucccuggauggaagauaagacaccuguuaccacuugggaaaacgugccguaccuaggaaagcgagaagaucaauggugugggucuuuaauuggauuaacaagucgagcuacuugggcucaaaauauaccuaccgcaauucaacaagugagaucccuuaucggaaaugaagaauuucuagauuacaugccaucgaugaagcgauuccgaaaagaagaagagucggagggagcuauaugguag

SEQ ID NO: 23250 - RNA, 9873 nt, Artificial Sequence
  derived and/or modified CDS sequence (opt6) from DENV-3__KJ189263__SS-prME
acgagcuuaugucuuaugaugauacugccagcagcgcuugccuuucauuuaacaucccgagacggagaaccuaggaugaucguagguaaaaaugaacgaggaaaaaguuuauuguuuaaaacagcuucaggaauuaacaugugcacacuaaucgccauggauuugggagaaaugugcgacgacacaguaacuuacaaauguccucauauaacugagguagaaccagaggauauugauugcugguguaauuuaacgucgacuuggguaacauauggaacaugcaaucaagcgggagagcauaggagggauaaaagaucgguggcacuggccccgcauguaggcaugggacuggauacaaggacacaaacauggauguccgcugaaggagcuuggagacaaguagagaaaguagaaacaugggcacuaagacauccuggguuuacuauuuuggcauuauuucuagcccauuauauagguacaucucuaacgcaaaaaguaguaaucuuuauauuacuaauguuagucacucccuccaugacuaugcgauguguuggaguaggaaauagggacuucguagaaggauugucaggggcgacauggguugauguaguuuuagaacacgguggcugcgugacuacaauggccaaaaauaaaccaacccuagacauagagcuacagaaaacugaagcuacacagcuugcaacucuaagaaaauuauguauagaaggaaaaauuacuaauauaacaacugacucuagauguccgacccaaggagaagcugucuuaccugaagaacaagaccagaauuacguaugcaaacacaccuacguugaucgaggauggggaaacgggugcgggcuauuuggaaaagguaguuuaguuacaugugcgaaauuucaaugccuagaaccuauagaaggaaaaguuguacaguaugagaaucucaaauauacuguaaucauuacaguucauaccggugaccaacaucaggucgguaacgagacacaagguguaacggcagagauuacuccgcaagcaucaacgacugaagcuacauugccugaauauggaacccugggauuagaguguucaccgagaacaggcuuagacuuuaaugaaaugauuuuacuaacgaugaaaaacaaagccuggauggugcacagacaaugguuuuucgauuuaccauuacccuggacuucgggagcgacaacagaaacaccgacguggaaccgcaaagaguuacucguuaccuucaaaaacgcacaugccaagaaacaagaaguaguaguccuaggaagccaagaaggggcgaugcauaccgcacuuacgggggcgacagagauacaaaauucagggggaaccaguaucuucgcaggacaucucaaauguaggcuaaaaauggacaaauuggaacugaaagggaugucauacgccaugugcacgaauacguuuguccucaagaaagaaguaucugaaacccaacauggcacuguucucauaaaaguagaauauaaaggugaagauguaccaugcaaaauacccuuuucaacagaggauggacaugguaaagcacauaacgggagauuaauaacagcgaauccaguaguuaccaagaaagaagaaccgguaaauauugaagcagaaccuccguuuggugaaagcaauauaguaauagguauuggagacaaugcauuaaaaauaaauugguacaagaaaggaagcucuauuggaaaaauguucgaggcaacggcgcgaggagccagaaggauggccauucugggagauacagcgugggacuuugguagugugggaggcguauuaaacucgcuggggaaaaugguacaccaaauauuuggcagcgcauauacugcucuuuucagcggaguauccuggguaaugaaaauugggauuggaguucuuuuaaccuggauaggacuuaacucgaaaaauaccucuaugucauucaguuguauagcaaucgguauuauaacguuauaucuaggagcugucguacaagcugauaugggaugcgugauuaacuggaaagguaaagaauugaaauguggaucuggaauauucguaaccaaugaagugcauacauggacagagcaauacaaauuccaagccgauaguccgaaacgauuagccaccgccauagcuggagcgugggagaauggggucugugggauucggucaacuacaagaauggaaaaccuacuguggaaacaaauagcaaaugaauuaaauuauauucuaugggaaaauaauauaaaacuaaccguuguggugggggauauaauuggcguuuuggaacaagguaaaagaacacuuaccccgcagccuauggaauuaaaauacuccuggaaaacuugggguaaagcaaaaaucguuacugccgagacccaaaauucaaguuucaucauugacggaccaaauaccccggagugcccuucggcaucaagggccuggaacgugugggaaguagaagacuacgguuuugguguauucacgacgaacauaugguuaagauuaagagaaguguauacacaauuaugugaucaccgcuugaugucggccgcagugaaagacgaaagagcaguucaugcggacaugggcuacuggauagagagucagaaaaauggauccuggaaauuagaaaaagcgucguuaauagaaguaaaaacaugcacuuggccuaaaucccacacccuuuggucaaauggaguacuggaaagcgacaugaucauuccaaaaaguuuagcggggccgauuucacaacauaaucauagacccggauaucacacacaaaccgcuggaccauggcaccuuggcaaacuugaacuggauuuuaauuacugcgaaggaacuacaguaguuauuacugaaaauugcgggacucgaggucccucacuucggacaaccacuguuagcggaaaacuuauccacgaaugguguugucgaucauguacacuacccccacuucgauacaugggagaggauggaugcugguauggaauggaaauuagaccgauuucagagaaagaggaaaauaugguaaaaagucuaguuucugcuggcagcggaaaagucgauaacuucacaaugggaguccuauguuuagcuauccuauucgaagaagugaugagagguaaguuugguaagaaacacaugauugcuggggucuucuuuacuuuuguacuuuuacuaucuggacaaauaaccuggcgugauauggcccacacauugaucaugauagguucaaaugcuagugauagaaugggcauggguguuaccuaucucgcacuuauugcaacauuuaaaauucaaccauucuuggcacuaggcuucuuuuugagaaaacuuacgagccgugagaaucuucuguuaggggugggauuggccauggcaacuacgcuacaacuaccggaagauauagagcaaauggcgaaugggauugcucuuggauuaauggcacucaaacuaaucacucaguucgaaauuuaucaacuauggacagcacuuauaucacuuacaugcucaaauacaauauucacucuaacaguagcauggcggacugccacccuaauacuugcggggguuagcuuacucccagucugucaaaguuccucgaugcgcaaaacggauuggcuaccaauggcagucgcggcaaugggcguuccuccauuacccuuauuuaucuuuagucucaaagauacgcugaaacguagaagcuggccgcuaaaugaaggcguuauggccguuggucuaguaucaauuuuagccucuucgcuucuuagaaacgacguaccuauggcaggaccgcuaguggcugggggucuacuaauagcaugcuaugugauuacgggaaccucagcggauuuaacaguagaaaaggcagcugauauuaccugggaggaagaagcagaacaaacuggcgucucacacaacuuaaugaucacagucgaugacgaugguaccaugaggauuaaagaugaugaaacagagaacauuuuaacuguuuuacucaaaacugccuugcuaauaguaaguggcauuuuccccuacuccauaccagcaacgcuccuaguguggcacacguggcaaaaacaaacacaacguucuggcguucuaugggacguaccaaguccaccagaaacccagaaagcagaauuagaagaaggaguguacaggaucaaacagcagggcauuuucgggaagacucagguaggaguaggugugcaaaaggaaggaguauuccacacaauguggcacgucacaagaggugcaguucucacguauaaugguaaaaggcuggaaccaaacugggcauccgucaagaaagaucuaaucagcuaugggggagguuggcggcuaagcacucaguggcagaaaggagaagaaguacaaguuauagcaguugaaccaggcaaaaaucccaaaaacuuucaaaccaugccaggaacuuuccagacuacgacaggagaaauuggggcuauagcucucgauuuuaagccuggaacgaguggaucuccaauaauaaauagggaagguaaaguaguagggcuauaugggaacggcguagugacuaaaaauggaggauauguuucaggaauagcacaaacgaacgcagaaccggaugguccuacaccagaauuagaagaagagauguuuaagaaacgaaauuuaacaauuauggaccuacacccuggaucagguaagacaagaaaauaucuuccugcuauaguacgugaagcuauaaagagacggcuacguaccuuaauauuagcaccaacaagaguaguugcugcugaaauggaagaagccuuaaagggacuacccauucgauaccaaacuacugcuacaaaaucagagcauacagguagagaaauuguugauuuaaugugucacgcuacuuuuacaaugcgguuacuaucacccguaaggguaccuaauuacaauuuaauaauuauggaugaagcucauuucacggauccggcaaguauagcugcaagaggauauaucaguacacgagugggaaugggagaagcagcagcaauauuuaugacggcgacaccaccugguacagccgaugcguuuccgcagagcaaugcaccaauacaggacgaagaacgagacauuccugagcgaucguggaacuccggaaaugaauggauaacagacuuugcagguaaaacggugugguuugugccgagcauuaaagcaggaaaugacauugcaaacugccuacggaaaaacggcaagaaagucauucaauuaaguagaaaaacuuuugauacagaauaucagaaaacgaaauuaaacgacugggauuucgucguaacaacugacauaucggaaaugggagcaaauuuuaaagcggauagaguuauugacccccggcggugucucaaaccgguuauccuaacugacgggccugaaagggucauauuggcgggccccaugccagucacggcugccagugccgcccaaagaagaggucggguaggaagaaauccccaaaaagagaacgaccaauauauuuuuacuggccaaccauugaacaaugaugaggaccaugcucacuggacagaagcaaaaaugcuauuggauaauauaaacacgccagaagggauaauuccugcauuguuugaaccggaacgcgaaaagagcgcagcgaucgacggggaauauagacuaaaaggcgagucgcgaaaaacguuugucgaauuaaugcgaaggggagaucuuccagugugguuggcacauaaggucgccagugagggaaucaaauacacagauaggaaguggugcuuugacggacagcgaaauaaucagauacuugaggaaaacauggauguugaaauuuggacaaaagagggugagaaaaagaaauuacgcccucgguggcuugacgccagaacguauagugacccuuuggcgcuuaaagaauuuaaagauuucgccgcaggaaggaaaaguauagcucuugaucuugugacugaaauaggaagagucccuucacaucuugcacaccguacucgaaacgcauuagauaaucuuguuaugcugcacacuuccgagcauggaggucgggccuaccgucaugcagucgaagaguugccugaaacaauggaaacucuacuccuccucggccucaugauucuauuaacugggggagcaaugcuuuuccugauuagcgggaaagggauagggaaaacaagcaucgguuuaauuugcgucaucgcaucaagugggauguuauggauggcagagauucccuuacaauggaucgcguccgcuauuguacuagaguucuuuaugaugguauuauuaaucccugaaccagaaaagcaacguacgccacaagacaaucaauuagcuuauguagugauugggauuuuaacguuagcugcuauaauugcugcaaacgaaaugggucuuuuagagacgacaaaacgagaccuaggaaugagcaaggagccaggugucguuucaccaacaucguacuuagauguggaccuacaucccgccagugcguggacacuuuacgcuguugcuacaacaguuauaacucccaugcuacgacauacuauagaaaauuccacggcaaauguuucccuagcggcaaucgccaaucaagcuguuguuuuaaugggacuagauaaaggauggcccauauccaaaauggacuuaggaguaccacuauuagcauuaggauguuacagucaaguuaauccguugacucuaacagcagcaguacuuuuauuaauaacccacuaugcuauaauaggcccaggauuacaagcaaaagcaacaagagaagcccagaaacguacagcagccggcauaaugaaaaauccaacgguugaugguauuaugaccauagacuuagacccaguuauuuaugauagcaaauucgaaaaacaguugggucaaguuauguuauugguuuugugugcugugcaacuacuccugaugcgaacaagcugggcgcuaugcgaggcacuaaccuuggcaacagguccuauuaccacgcuaugggaaggaagcccagguaaauucuggaauacuacaauugcuguauccauggcuaacauauucagagggucauacuuagcuggagcuggucuagcauuuagcauuaugaagucaguaggaacaggaaaacgagguacagguucgcaaggagaaacacuuggagagaaauggaagaagaaauuaaaucaauuaaguaggaaagaguucgacuuauauaagaaaagugggauuacugagguugauagaacugaagcuaaagaaggucuuaaaagaggagaaauuacucaucaugcaguaucccgagguagugcaaaauuacaaugguucguagagagaaacauggucauaccagaaggacgaguaauugaucuaggcuguggacgaggcgguuggaguuacuacugugcugggcucaagaaaguaaccgaaguacgagguuacacaaaaggagguccaggccacgaggagcccguaccaaugaguacuuaugguuggaauauagucaaauuaaugucaggaaaagauguauucuaccucccaccugaaaaaugugacacccuucuuugcgacauaggagaaaguucaccuaguccaacgguggaagaaucacgcacuauuagagugcucaaaaugguagaaccguggcucaagaacaaucaguuuuguauaaaaguauuaaauccauauaugccaacuguuauugagcaucuagaaagacuucagcgaaaacauggagguaugcucguucgcaauccucucucaagaaauaguacucaugaaauguacuggauaucuaacggaacaggaaauauaguagcaucaguaaacaugguauccagacuacuuuuaaacagauuuaccaugacccaucggagaccuacaauugaaaaagauguagaccuaggcgcaggcacaagacaugugaaugcagaaccggaaacgccuaauauggacguaaucggcgagcgcauaaaaagaauaaaagaagaacauaacucaacauggcauuacgacgaugaaaauccauacaagacuugggcuuaucauggaagcuaugaaguaaaggcgacagguucggcgucgucaaugauaaaugguguugugaaguuacuaacaaaaccuugggauguaguaccuauggucacccaaauggcgaugacggauacuacucccuuuggucaacaacguguuuucaaggaaaaaguugacaccagaacuccaaggucaaugccggggacacgaagaguuaugggcauaacugcggaauggcuauggagaacuuuagggagaaacaagaagccaagacuuugcacucgagaagaauuuaccaagaaaguccggacgaacgcggcaaugggugcgguguucacagaagagaaccaaugggacucagcuaaagccgccguagaagacgaagacuucuggaagcuaguugauagagaacgcgaacuacauaaacuggggaaaugcggcucauguguuuacaauaugaugggaaaacgagaaaagaaauuaggagaauuuggaaaggcuaaaggaagucgugcaauaugguacaugugguugggagcccguuaucuagaauuugaagcauuaggcuuucucaaugaagaccacugguuuucaagagaaaauagcuauuccggaguagaaggugaaggguuacauaaacuaggcuauaucuuacgugauauaagcaaaauaccuggaggagcgauguaugcagaugauacugcagggugggauaccagaauaaccgaagaugauuuacauaaugaggagaaaauaacgcaacagauggauccggaacaccgccaauuagcaaacgcgauuuuuaaguugacguaucagaacaagguugucaaaguacagaggccuacuccaacagggacagugauggauauuauuucacgaaaagaccaaagaggcucaggacaggugggaacuuacggucuuaauacauuuacuaacauggaagcucagcucauacgucagauggagggagagggaguauugucaaaggcugaccuagaaaacccacacuuaccggaaaagaagauuacgcaauggcucgagacaaaaggaguagaacgauuaaaacgaauggcaauaucaggagaugauugcgugguaaaacccauugaugauagguuugcgaacgcacuacuagcucuuaacgauaugggaaagguaagaaaagauauuccccaauggcagccuaguaaagguuggcaugacuggcaacagguaccauuuugcagccaccauuuccaugaacuuauuaugaaagauggccgcaaguuagucgugccgugucggccacaagaugagcucauuggcagagcacgcauaagucaaggagcaggcuggagccuccgagaaaccgcaugucuggggaaagccuaugcacaaauguggagcuuaauguauuuccaucgucgugaccugcggcuggccucuaacgccauauguucagcaguacccguacacuggguaccaacaucgagaacuacuuggucaauacacgcacaucaccaauggaugacgacugaagauaugcuaacgguauggaacagggucuggaucgaagacaaccccuggauggaagacaagacccccguaacgacaugggagaacguaccuuaucuagguaaacgagaagaucaaugguguggcucauuaauaggguuaaccaguagagcaacaugggcucaaaacauuccaacagcuauacaacaaguaaggagcuuaaucggaaaugaggaguuuuuagauuauaugcccucaaugaaaagauuucguaaggaagaagagagcgaaggggcaaucugguaa

SEQ ID NO: 23251 - RNA, 9873 nt, Artificial Sequence
  derived and/or modified CDS sequence (opt6) from DENV-3__KJ189265__SS-prME
accucauuaugccucaugaugauccuaccggcagcacuagcuuuucaucucacaucuagggauggagaaccuaggaugauuguagguaaaaacgaacgggguaaaucacuucuguucaaaacagcaucagguauuaauauguguacuuuaauagcaauggaucuuggugaaaugugcgaugacacgguuacauauaaauguccucacauuacagaagucgaaccagaagacauagauuguuggugcaaucuaaccucgacuuggguuacauauggaacaugcaaucaagcuggcgaacaucguagggacaaacguaguguagcccuagcaccacauguggggaugggacuggacacccgaacgcagaccuggaugucugcagaaggugcuuggagacagguagaaaaagucgaaacaugggcgcuacgucacccuggauuuacgauucuugcauuauuuuuggcacauuauauuggaacaagccuuacacagaaaguaguaauuuuuaucuuacuaauguuaguaacaccuaguaugaccaugcgauguguaggaguuggaaauagagauuuuguagaaggacuaucgggagcuacauggguggacguaguguuggaacauggaggauguguaacuacaauggccaaaaacaaaccgacacuugauauagaauuacagaaaacugaagcaacacaauuagcaacuuugcgcaaacucugcauagaaggcaaaauaacuaacauuacaaccgacucucgaugcccaacacaaggggaagcgguccuaccugaagaacaagaucaaaacuacguuuguaaacacacuuacguagacagagguugggggaacggguguggucuuuuugggaaagggucccucguaacaugcgcaaaauuccaauguuuagagccaauagaagggaaaguggugcaauaugagaauuuaaaauauacgguaauaauuacaguccacacgggugaucaacaucaaguuggaaaugaaacacaaggugucacagcagaaauaacaccacaggccuccacuacagaggcuauccuaccggaguacggaacauugggacuggaauguagcccccggacaggauuggacuuuaaugaaaugauauuauuaacuaugaaaaauaaagcauggaugguacaucggcaaugguuuuucgacuuaccgcugccuuggacgucuggugcaacgacagaaaccccaacuuggaauagaaaagaauugcuuguuacguuuaaaaacgcacacgcgaagaaacaagaaguaguaguuuuaggaagucaagaaggagcaaugcauaccgcucuaacuggagcuacagaaauccagaacucaggaggaacuucaaucuucgcaggacacuugaaaugccgguuaaagauggacaaacuagaacugaaaggaaugaguuaugccauguguaccaacacauucguacuaaagaaagaaguuucagaaacacaacaugggacuauauuaauaaaaguugaauauaaaggagaagauguacccuguaaaauaccauucucgacggaagauggacauggaaaagcucauaacggaaggcucaucacagccaacccgguuguaaccaagaaagaagaaccugucaauauagaagcggagccaccauuuggagaaaguaauauaguaauaggcauaggugauaacgcuuuaaaaauuaacugguauaagaaagggagcagcauuggaaaaauguuugaagcgaccgcaagaggagcacgaaggauggcgauuuuaggugauacagcaugggacuuuggaagcguugguggaguacuaaauuccuuaggcaaaaugguacaucaaauuuucggaucugcguacacagcucuguucucuggaguaucguggguuaugaaaauaggaauagguguauugcuuacuuggauugguuuaaauaguaagaauacaaguaugucuuucaguuguaucgcgauaggaauaauaaccuuauaucuaggcgcagugguacaggcagauaugggauguguuauaaacuggaaaggaaaggaacuaaagugugggagcgguauauuugucacgaaugaaguacacacuuggacagaacaauauaaauuccaagcagauucaccaaaaaggcuagcaacagccauagccggcgcaugggagaacggaguuuguggaauccguucaaccacaagaauggaaaaucuacuguggaaacagauugccaaugaacucaauuauauccuuugggaaaacaauauaaagcuaaccguaguagucggagauauuauagggguccuggaacauggaaaaagaacucuaacuccucaaccaauggagcuaaaauauaguuggaaaaccugggguaaggcaaaaaucguaacugcagaaacacaaaauucaaguuuuaucauugacggaccaaauacaccagaauguccuagcgcuucaagagccuggaauguaugggaaguugaggacuacggauuuggcguuuucacaacgaauaucuggcuaaaacucagggaagucuacacacaacuaugcgaccaucgacuaaugagugcagccguaaaagacgaaagagcaguucacgcagauaugggauacuggauagaaucacagaaaaacggaucauggaaauuagaaaaagccagcuuaauagagguaaaaacauguacauggccaaagucacacacucuguggucaaacggaguucuggaauccgauaugaucauaccaaaaucgcucgcgggaccaauuucacagcauaaccauagaccgggauaucacacacaaaccgcaggaccauggcaucuagguaaacuugaauuagauuuuaacuauugugaagguacuaccguugugauaacagagaauuguggaacgagggggccaagccuacguacaacuacuguaucugggaaacuuauacaugaauggugcuguaggucauguaccuugccucccuuaagguauaugggagaggauggaugcugguaugggauggaaauuagaccaaucagugagaaggaagagaauaugguaaaaucccuuguaucugcuggcucagguaaaguagauaacuucacgaugggcguccuuugccuagcuauccuuuuugaagaaguaaugagggggaaauuuggcaagaaacacaugauugcaggaguguuuuucaccuuuguucuccuccuuaguggucagaucacauggcgggauauggcucacacgcuaauaaugauagguucaaauacaucggacagaauggguauggguguuacuuaucuagcauugauagcuacauuuaagauucaaccuuucuuagcgcuuggcuucuuuuuacgcaaguuaacaucacgagaaaaucuucuauuggggguuggucuggcaauggcuacuacguugcaacuaccagaagauauagaacaaauggccaaugguaucgcucuugggcuuauggcgcucaagcuaauaacucaauucgaaacauaucaauuauggacugccuugauaucgcucaccuguucuaauacaauauucacacuaaccguugcuuggcgaacagcaacguuaauacucgcaggagugagcuuguugcccguuugucaaaguaguaguaugagaaaaacggauugguuaccuauggcuguagccgcuauggggguucccccacucccguuguucaucuuuucccuaaaggauacucuaaaaaggagaagcuggccuuuaaaugagggcgucauggcaguaggauuaguauccauauuggcaaguaguuuauugaggaaugaugugccuauggcaggccccuuaguagcaggaggacugcugaucgcaugcuaugugauaaccggaacaagugcugaccuaacuguagagaaagccgcgaauaucacaugggaagaagaagcagagcagacugguguuagccacaaucuuaugauuacaguugacgaugaugguacuaugagaauuaaagaugaugaaacggaaaacauauugacggucuuguuaaagacagccuuauuaaucguaaguggcauauuuccauauucgauaccagcgacguuacuuguuuggcacacauggcagaaacagacacagagaucggguguacucugggacgucccaucuccgcccgaaacacagaaggcagagcuagaagagggcguauacagaauaaaacagcaagggaucuuuggaaaaacucagguuggaguugguguacagaaagaaggaguauuucauacaauguggcacguaacuaggggcgcuguauugacguacaacggaaaacgauuagaaccaaacugggcuucgguuaagaaagaccuaauuaguuacggcggaggauggagauuaagugcacaauggcaaaaaggagaagaaguacaagucaucgcaguugaaccaggaaagaaucccaaaaacuuccaaacaaugccaggcacauuccagacaacaacgggcgaaauaggagcaauugcacuggauuuuaaaccugggacgagugguucuccuaucauuaaucgugaaggcaaggugguagguuuguauggaaacggcguaguaacuaaaaauggugguuauguaucagggauagcacaaacaaaugccgaacccgacggaccgacuccugaauuagaagaagagauguucaagaagagaaauuugacgauuauggauuuacauccagguucaggaaaaacgaggaaguacuugccagcaauuguuagagaagccauaaaacgaagacuaaggacgcuuauucuugcaccuacucgaguugucgcggcugaaauggaagaggcuuuaaaagggcuuccaauaagauaucaaaccacggccacgaaaagugaacauaccggacgugagauuguagacuugaugugucaugccacguuuacaaugagacuacugucaccugugagagugcccaauuacaaucucauaauuauggacgaagcacacuucacagaccccgcaucaaucgcggccagaggcuacauuagcacuagagucgggaugggagaagcugccgcaauuuuuaugacagccacaccuccaggcacggcugacgcguucccacaaucaaacgccccaauucaagacgaggaaagggacaucccagagcgcaguuggaacagcggaaacgaauggauuacggauuucgccgggaagacagucugguuugucccaagcaucaaggcuggcaaugauauagccaacugccucaggaaaaauggaaagaaagucauacaguuaucacguaaaacauucgacacugaguaucagaaaacgaaauuaaacgauugggauuuuguaguaacuacggauauuagcgaaaugggagcaaacuucaaagcugaucgggugaucgauccccgucguugucucaaaccaguaauacuuacagaugguccagaacgugugauccuagcaggcccaaugccuguaacagcggccuccgcagcucagagaagaggacgagugggaagaaauccucaaaaggaaaacgaccaauauauuuuuaccggucaaccuuuaaacaaugacgaggaucaugcacauuggacagaagcaaaaaugcugcuugauaauaucaacacucccgaagggaucauacccgcauuauucgaaccagaacgugaaaaaucggcggcaauagauggggaguaucggcucaagggagagucuagaaaaacauucguugaacuuaugcgaagaggggacuuaccugucuggcuugcgcacaaagucgcuucggaaggaauaaaguacacagacagaaaaugguguuucgacggacaaagaaauaaucaaaucuuagaagaaaauauggaugucgaaauuuggacaaaggaaggggaaaagaagaaacuucguccgcgauggcucgacgcccguacguauucggaucccuuggcacuuaaggaguuuaaggauuucgccgcaggaaggaaaucaaucgcacuagauuugguuacugagauuggacgaguaccuucgcacuuagcacacagaaccaggaaugcgcuggacaauuuagucauguugcacacaagugagcauggagguagagcauaccgacacgcaguagaagaauuaccggaaacaauggaaacuuuacuauuacuagguuuaaugauacuauuaacaggaggggccaugcuauuccugaucucaggaaaagggauagggaaaacaagcaucggacucauuugcguuauugcgaguaguggaaugcuauggauggccgagauaccucuacaauggauugccagcgcaauagucuuagaauuuuucaugaugguacuauuaauacccgagccugaaaaacaaagaaccccgcaagacaaucaguuagccuacguggucauagguauauuaacucuagcagcuaucauagcugcaaacgaaauggggcuuuuagagaccacaaaaagagaccuuggcaugucgaaagaaccuggcguagugucaccaacaucauacuuggauguagacuuacacccagccagugcauggacacuuuaugcugucgcaacuacuguaauuaccccgaugcuucgacauacuauugaaaauuccacugccaauguuagucuagcagcuauagcuaaucaagcaguaguacucaugggauuagauaaagguuggccaauuucgaaaauggaucuuggaguuccucuucuggcucuaggcugcuacagucagguuaacccgcucacuuuaacugcagcuguacuucuauuaauaacacauuaugcaauuauuggaccagguuuacaagccaaagccacacgagaagcacagaagcguacggcugcaggaaucaugaaaaauccaaccgucgauggaauaaugacaauugauuuagacccagugauuuacgauucuaaauucgaaaaacaacuuggacaaguaaugcuauuagugcuuugugcgguccaacuuuugcugaugagaacaucaugggcucucugugaagcacuaacgcuugcuacugguccaaucacuacgcucugggaggguuccccuggaaaguuuuggaauacuacuauugccguaucaauggcuaacauauucaggggaucauaucuugccggggcuggauuagcauuuucuauuaugaaauccguggggaccggaaaacgaggaaccgguagccagggggaaaccuugggcgagaaauggaagaagaaacucaaucaauuaaguagaaaagaguucgaucuauacaaaaagucaggcauaacugaaguggaccggacugaggcaaaagagggcuuaaaaagaggggaaauaacacaucaugccguaucaagagggagcgccaaauuacaaugguuugucgagcgaaauaugguaauacccgaaggcagagucauagacuuaggauguggacguggagguuggagcuacuauugugcugguuugaagaaagugacugaggugaggggauauacaaaaggagggcccggacacgaagaaccaguaccaaugucuacuuacgguuggaauaucguuaaacucauguccgggaaagauguauuuuaucuaccucccgaaaaaugcgacacauuacuuugugauauaggggagaguagcccaucuccaacggucgaagaaagcagaacaaucagaguguuaaagauggucgaacccuggcucaaaaauaaccaauuuuguauaaaaguacuaaauccauacaugccaaccguaauagagcauuuagagcgacugcagagaaagcacggcgguauguugguaaggaacccucuaucuaggaacagcacucaugagauguauuggauuucaaacgguacaggaaauauaguugcgucgguaaauauggucucaagacuacuacuaaaccgauucacuaugacgcacagacgcccaacaauugaaaaagacguugacuugggagcagguacacgacaugucaaugccgaaccagaaacaccgaacauggaugugauaggggaaaggauaaaaaggauaaaagaggagcauaacucuacguggcacuacgaugacgagaauccauauaaaacgugggcguaucaugguaguuacgaggucaaggcaacagguuccgcgucaaguaugauuaauggggucguuaaacuguuaaccaagcccugggauguagugccaaugguaacgcaaauggccaugaccgauacuacaccguuuggacaacagcguguuuuuaaggaaaaaguugacacucguacuccacgauccaugccaggaaccagacgaguaaugggaauuacugcagaguggcuauggcgcacauuaggcaggaauaagaaaccaagacuauguacaagagaggaguucaccaagaaagugaggacaaacgcagcaaugggagcaguuuuuacugaagagaaucagugggauuccgcuaaagcagccgucgaagaugaagacuuuuggaaguuaguggacagagaacgcgaacuucauaagcuaggcaaauguggaaguugcguguacaauaugauggguaagagagagaagaaauuaggggaguuuggaaaagcgaaagguagccgagcuauaugguauauguggcuaggugcuagauacuuggaguucgaagcucuaggcuuucucaacgaggaucauugguuuucacgcgagaacucauacucugguguagaaggcgaaggauugcacaaacugggauauauacuuagagauauuagcaagauuccagguggcgcuauguaugcagaugacaccgcaggaugggauacuaggauaacagaagaugacuuacacaaugaggagaaaauuacccaacaaauggaucccgaacaucgucaauuagcaaaugcaaucuucaaguuaacuuaucaaaacaagguggucaaagugcagcguccuacccccaccggaacaguaauggacauuauaucaaggaaagaucaaaggggcucagggcagguaggaacauauggauuaaacacuuuuacaaacauggaagcgcaacuuaucagacagauggaaggagagggaguccuaaguaaggcagaccuagagaacccacaucuaccagagaagaaaauuacccaaugguuagaaaccaaaggaguagaaagguuaaaacguauggccauaucuggagacgauuguguagucaaaccgauugacgacagguuugcuaacgcuuuguuagcgcuaaaugauaugggcaaggugagaaaagauauaccacaauggcagccaaguaaaggauggcaugacuggcaacaaguccccuuuuguagccaccauuuccaugaauuaauaaugaaggaugguagaaagcuaguuguuccguguagaccccaagacgaacuaauaggcagagccagaauaucccaaggugcaggauggagccuuagagaaaccgccugucuuggaaaggcuuaugcacaaauguggucucuaauguacuuccaucgucgagauuugagauuagcaaguaacgccauaugcuccgcuguaccuguacauuggguaccaaccucuagaacgacauggaguauacaugcccaucaucaguggaugacuacugaggauauguugacaguauggaaucgaguuuggauugaagacaauccauggauggaagauaaaacaccgguuacaaccugggaaaacgugccguaccugggaaaaagggaagaccaaugguguggcuccuuaaucggacuaacaucccgagccacuugggcccaaaacauuccuacagcuauacaacaagucaggagucugaucggaaaugaagaauuucuagauuauaugcccaguaugaaaagauuucgaaaagaagaagaaagugagggcgcaauuugguaa

SEQ ID NO: 23252 - RNA, 9873 nt, Artificial Sequence
  derived and/or modified CDS sequence (opt6) from DENV-3__KJ189266__SS-prME
acuucacugugucuaaugaugauucugccggcggcucuagccuuucauuugacaagucgagacggugaaccucgaaugauuguaggcaaaaaugaacggggaaaaagucuccuguuuaaaacugcuagcgguaucaauauguguacguuaaucgcuauggacuugggagaaaugugugaugauacuguuacauacaaauguccacacauaacagaaguagaaccagaggauauagauuguuggugcaaucugacaaguacauggguuacauacggaaccuguaaccaagcaggagaacauagaagggacaaacggagcgucgcgcuagccccacauguuggaaugggauuggacacgcggacacaaaccuggaugagcgccgaaggggcauggcgucaaguagaaaaaguggaaaccugggccuugagacacccaggguuuacaauccucgcucuuuuucuugcgcacuacaucggaacuucgcucacucagaaaguaguuauauuuauucugcuuaugcuuguuacuccaagcaugacaaugcgaugcguuggaguugggaauagggauuuuguugaagguuuauccggagcaacguggguugauguaguccuagaacacggaggauguguuacaaccauggcuaaaaacaaaccaacccuugauauugaauuacagaaaacugaggcaacacaauuagcaacauuaagaaaauuauguauagaagggaaaauuacuaauauaacaacggauaguagguguccaacucaaggugaggcaguucuaccggaagaacaggaucaaaauuaugucuguaaacauacuuauguagaucgaggaugggguaacggauguggacuuuucggaaaagguagccuaguuacaugcgcuaaauuucagugucuagaaccaauagaagggaaaguaguacaguaugaaaaucucaaauauacuguuauuaucacaguccauacuggugaucagcaucaagugggcaaugaaacacaaggagucacggcggaaauuacuccacaagccuccacuacggaagcaauacuuccugaauacggaacucucgguuuagaaugcaguccaagaacgggacuggauuuuaaugagaugauucuacugacaaugaaaaauaaggcuuggaugguacaccgacagugguucuuugaucuaccacuaccuuggacguccggagcgacgaccgaaacuccaacguggaaccgaaaagaacuuuuagucacuuuuaaaaaugcgcacgcaaagaaacaggaagugguuguacuaggcucucaagaaggugcaaugcauacagcucugacaggugcuacggaaauacaaaauaguggaggaacauccauauuugcaggacaccucaaaugcagauuaaaaauggauaaacuagagcuuaaaggaaugucuuacgcgauguguacgaauacauuuguucucaagaaagaaguuagugaaacgcaacauggaacaaucuuaauuaaaguagaauauaaaggagaagauguuccuuguaaaauaccuuuuucaacagaagacgggcacgguaaagcucacaaugguagacugauuacugccaauccagugguuacuaagaaagaagaaccuguuaacaucgaagcagaaccaccauuuggagagucgaacauaguaaucgguauaggcgauaacgcucuuaaaauuaauugguacaagaaaggcaguucgauagguaaaauguucgaggcgacagcaagaggagcgcgacgaauggcuauacucggcgacaccgccugggauuuuggaagcgucgguggugucuugaacagccuggggaaaaugguacaccaaauuuucggcagugcauacacagcacuauuuucaggaguuaguuggguuaugaaaauuggcauagggguacuauuaacauggaucggccuuaauucgaaaaacacaaguaugucuuuuucuuguauugcaauaggaauuauuacuuuauauuuaggagcaguuguccaagcagauaugggaugcguaauaaauuggaaagguaaagaauugaaaugcggaucaggaaucuuuguaacaaaugagguacacacauggaccgagcaguacaaauuccaagcggacuccccgaaacgguuagcaacugcuauagcaggagcaugggaaaauggugucuguggcauaagaagcacuacacggauggaaaaccuucucuggaaacagauugcuaacgaauuaaacuacauacuuugggaaaacaauauaaaacuaacugucguuguuggagauauuauaggaguacuagaacaaggaaaacguacacuaacaccacaaccuauggagcuuaaauauagcuggaaaaccuggggaaaagcaaaaauagucacugcagagacacaaaauucuuccuuuauaaucgauggcccaaauacaccggaguguccaucugcaucaagagcguggaacguuugggaaguagaagacuauggauuuggagucuuuacaacuaauauauggcucaaguugcgcgaaguuuacacacaauugugugaucacagauuaaugagugcugcugucaaagacgaacgugcuguucacgccgauaugggcuauuggauagaaucgcagaaaaacgguaguuggaaauuagagaaagcgagcuugaucgaaguaaagaccugcacuuggccaaaaucucauacuuuauggucuaacggcgugcucgaaucugacaugauuauaccgaaaucauuggcaggacccauaagccaacauaaucaucgcccaggauaucacacacaaacagcaggaccauggcaccucgguaaacuugagcuggauuuuaauuacugcgaaggaacaacggucguuauuacagaaaacugcgguacaagaggaccaagccuuagaacaacgacaguaucaggaaaguuaauucacgaaugguguugucgaaguuguacgcuaccaccacuacgauauaugggagaagacgguuguugguauggaauggaaauuaggccaauaucagagaaagaagaaaauaugguaaaauccuuaguuagugcagguucaggcaaagucgacaacuucacaauggggguuuuauguuuagcuauccuguuugaagaaguaaugcgagggaaauuuggaaagaaacacaugauugcuggaguauucuucacauucguccuucuccuuagcggucaaaucacuuggagggauauggcucacacacugauuaugaucggaucaaacgcaagcgaucguaugggaaugggagugacguaccuagcauugauugcgacuuuuaaaauucagccuuuucuagcccuuggcuucuuucuaagaaaacuaacgagucgugaaaaucuguuguuagggguaggauuagcuauggcaacgacuuuacaacuaccggaggacaucgagcaaauggccaaugguauagcccucggguuaauggcgcucaaauugauuacacaguucgaaacguaucaacuuuggaccgcgcuuauuuccuugaccuguucaaacacaauauuuacccuuaccguggcuuggcgaacugcgacauugauauuagcaggaguuucauuauuaccaguuugccaaucuuccucuaugagaaaaacggauuggcuaccuauggcugucgcugccaugggcguuccgccauugccacuauuuauauuuucgcucaaagacacacuuaaaagaagaucauggccauugaacgaaggugugauggcggucggacuugucaguauacuggcuucaucccucuuaagaaaugacguaccaauggcaggaccccuuguggccgguggacuucuaauagcgugcuauguaauuacaggaaccuccgcagauuuaacuguggaaaaagccgccgauauaacaugggaagaagaagcugagcaaacaggaguaagccauaaucuaaugauaacgguggaugacgacgguacaaugcggauaaaagaugacgaaaccgagaauauacuaacaguacuccuaaaaacagcauuguuaauaguauccgggauuuuuccauacucaauccccgcaacgcucuuggucuggcauaccuggcaaaaacagacacaaagaucagguguacuaugggauguucccucuccacccgagacucaaaaagcagaacuagaagagggcguuuacagaauaaaacaacaaggaauauucggcaaaacacaagucggagucggaguacaaaaagaaggaguguuccauacgauguggcaugucacaagaggcgcaguuuugacguauaaugggaaacggcucgaacccaacugggcaucagucaagaaagaucucauuuccuacgguggaggguggagguuaagugcacaauggcaaaaaggcgaagaagugcaaguaauugcaauagaacccgggaagaaccccaaaaauuuccaggcgaugcccgggacuuuccaaaccacaacuggugaaauuggugccauugcacuagauuucaagccuggcaccaguggcaguccaauaauaaauagagaagggaaaguuguaggccuauauggcaaugggguugucacuaagaacggcggauauguaucggguauugcgcaaaccaaugcugaaccagauggaccuacaccugaacuagaagaagaaauguucaagaaacguaaccuaacaauaauggaucuucacccuggcagugguaaaacaagaaaauaucucccagcaaucguccgugaagcaauaaaaaggagacugagaaccuuaauacucgcuccuacuaggguugucgcggcagaaauggaagaagcacuaaaaggacuaccgauaagguaucaaacuacagcaacgaaaucugagcauacgggaagagaaauuguagauuuaaugugucacgcaacauucacuaugagacuacugaguccgguuagagugccuaauuauaacuuaauaauaauggacgaggcacacuuuaccgauccugcgucaauagcugcacgaggauauauuucgacaagaguugguaugggcgaagcagccgcaauauuuaugaccgcuacaccuccagggaccgcagacgccuuuccacaguccaacgcgccaauccaagaugaagaaagggauauuccagaaaggucguggaacucuggaaaugaguggauuaccgauuucgccggaaaaacaguaugguuugugccuaguauaaaagcuggaaacgacaucgcaaauuguuugaggaaaaacgggaaaaagguaauucaauugucgcgaaaaaccuucgauacagaauaucagaaaacgaaacuuaaugauugggauuucguaguuacaacugauauaagcgaaaugggugcaaauuucaaagcagaucgggucauugacccgagacgcugucuaaaaccagugauacugacagacggacccgaaagagucauacucgcuggacccaugccagucacagcugcuuccgcagcacagcgacguggacgaguaggccgcaauccgcagaaggaaaaugaucaauauauauuuaccggacagccguugaauaaugaugaagaccacgcacacuggaccgaagcaaaaaugcuccuagauaauauaaauacaccagaagggaucauuccugcuuuauuugagccggaacgagagaaaagugccgcaauagacggggaauauagauugaaaggagaaucaagaaagacauucgucgaacuaaugagaaggggagaccugcccgucuggcuagcacauaagguggcaucugaaggcauaaaauauaccgacaggaaaugguguuuugauggucaacguaauaaccagauauuagaagaaaacauggacgucgagauauggaccaaagaaggcgagaagaagaaauuacgaccaagaugguuggaugcgcggacauauuccgauccucuggcccuaaaggaauuuaaggauuucgccgcaggccguaaguccaucgcauuggaucucgugacagaaaucggaagaguuccgucacaucuagcacacagaacgaggaaugcucuggauaaucuaguaauguuacauacaagugaacacggaggacgcgccuauagacacgccguugaggaguuaccagaaacgauggaaacacuacuucuauugggucucaugaucuuacuaacugguggagcgauguuauuuuugauuucuggcaaaggaauuggaaaaaccuccaucggucucauuugcguuauagcaucaagugguaugcuuuggauggcugaaauaccucuccaauggauagcuucggcaauaguucuagaguucuuuaugaugguacuguuaauaccugaaccagaaaaacaaagaaccccacaagauaaccaauuagcuuacguugucauagguauauuaacacucgcagccauaauagcagcaaacgaaaugggacuccuagaaacaaccaaacgagauuuagggaugagcaaagagccuggaguuguaucaccgacaagcuaucuugacguagauuuacauccagcaucagcauggacccuauacgcaguugcaacaacaguaaucaccccaaugcuaagacauacgaucgaaaacucaacggccaauguuucacuggcagcaauugcaaaccaagcuguaguacuaaugggucuagacaaaggcuggcccauuagcaaaauggaccugggagugccguuguuagcuuuagguuguuauucgcaaguaaauccguugacguuaacagcagcaguacuauugcuuauuacacacuaugcaauuaucgggccuggauugcaagccaaagcaacccgcgaagcccagaaaagaacagccgcagggauaaugaaaaauccuacugucgacgguauaaugacaauagauuuggaucccguaauuuaugauucaaaauuugaaaagcaauuaggccaaguaauguuacuugucuuaugcgcuguacaauuauugcucaugcgaacuagcugggcauugugcgaagcucuaacauuagcaacaggacccaucacuacccuuugggaaggcucaccuggaaaauucuggaauacaaccauagcaguaucaauggccaauauauuuagaggaagcuauuuagcuggagcgggucuggcguucagcaucaugaaaagugugggaacuggcaaaagagguacggguucacaaggagagacccugggcgagaaauggaagaagaaacugaaucaguugucaagaaaagaguucgaccucuacaagaaaucaggaaucaccgaaguagaucgaaccgaagcuaaagaaggccuaaaaagaggugaaauaacacaucacgcggucucgagagggagugcaaaacuacaaugguuuguagaaagaaacaugguaauaccagaagguagaguaauugaucugggaugugggagaggaggcuggaguuacuacugcgcaggacugaagaaaguaacagaaguaaggggauauacgaaaggaggaccaggacaugaggaaccagugccaaugagcacauauggauggaacauagucaaauuaaugucggggaaagaugucuucuaucuaccgccagaaaaaugcgauaccuuauuaugugauauuggggaaucuuccccgucccccacgguggaggaauccagaacuauuagaguauuaaaaaugguugaaccauggcuuaagaauaaucaauucuguauaaagguccuuaauccauauaugccgaccguuaucgaacacuuagaaaggcuccaaagaaaacauggugguaugcuuguaaggaacccacuuaguagaaauucaacacaugaaauguauuggauaucaaacgguacaggaaauauaguagcaagugugaacaugguaucaagacuccuacucaaucguuuuacuaugacccaccgaaggccuacgauagaaaaagauguagaucucggagcaggcacucgccauguaaaugcagagcccgaaacgccuaauauggacgucauuggagaaaggauaaagaggauuaaagaggaacacaacagcacauggcacuaugacgacgagaacccauauaaaacuugggcauaucacggaucauacgaagucaaagcaacagguucagcuaguagcaugauaaacggugugguuaaguuacuuacaaagccuugggacguaguaccgauggugacccagauggcaaugacagacacuacgccauuugggcaacaacgagucuuuaaagaaaaaguagacacgagaaccccgaggaguaugcccggcacccguagaguaaugggaauuacagcagaaugguuauggagaaccuugggaagaaauaagaaacccagacuuugcacuagggaagaguuuacaaagaaaguacgaaccaaugcggcaaugggugcuguauucacugaagaaaaccagugggauucagcaaaagcagccgucgaagaugaggauuuuuggaagcuggucgacagagaacgggagcuccacaaauuaggaaaauguggaaguugugucuauaauaugaugggaaagcgagagaagaaacugggcgaguucgguaaagcaaaaggcucuagagcuauaugguacauguggcucggggcucgauacuuagaauuugaggcuuuggguuucuuaaaugaagaucauugguucaguagagaaaacuccuauagcggaguagaaggugaaggauuacacaaacugggguauaucuugagggauauuucaaaaauaccaggaggcgccauguacgcagacgacaccgcgggaugggauacuagaauaaccgaggaugaucuacauaacgaagagaaaauaacccaacaaauggaccccgaacaucggcaacuugcgaacgccauauucaaacuaacauaucaaaauaaggucguaaagguucaaaggccaacgccaacaggaaccgucauggacauuaucucacgaaaagaucaaagaggaucggggcagguagguacguacggccuuaacacguuuacgaacauggaagcccagcugauucgacagauggagggagaagggguacuaaguaaggcagaucuagaaaacccucaucucccagagaagaaaauuacccagugguuagaaacaaaggguguugagcgccuuaaacguauggcaauuucuggagacgacugcgugguaaaaccaauagaugaucgcuuugcgaaugcauuacuagcacucaacgauauggggaaaguaagaaaagacaucccgcaauggcaaccuucaaaaggcuggcaugacuggcaacagguaccuuuuugcucacaccacuuucaugagcuaauuaugaaagauggaagaaagcugguugugccaugcaggccacaagacgagcuaauuggcagagcaagaauuucacagggggcaggauggucgcuccgagagacagcauguuuaggaaaagcauaugcccaaauguggagucuaauguacuuucacagaagagaccuucgccuagcuuccaacgcaaucuguagugcgguaccagugcauugggucccuacaucucguacgacuuggagcauccacgcacaucaccaauggaugacaacagaggacaugcuaaccguauggaauaggguauggauugaagauaauccuuggauggaagacaaaacgccagugacgacaugggaaaauguuccauaucuuggaaaaagagaagaucagugguguggaucgcugauagguuuaacaucccgagcaacuugggcacaaaacauaccaacagcuauucaacaaguaaggagccuuauuggaaacgaagaauuucuagauuacaugccgucaaugaagagauuuagaaaagaggaagagagcgagggugcgauaugguaa

SEQ ID NO: 23253 - RNA, 9873 nt, Artificial Sequence
  derived and/or modified CDS sequence (opt6) from DENV-3__KJ189268__SS-prME
acguccuuaugucugaugaugauacuccccgcggcuuuggcauuccacuugacaucacgcgacggagaaccaagaaugaucgucgggaaaaacgaacgaggaaaaagccuacuuuuuaaaacggcuucuggaauaaacauguguacauuaauagcaauggaucuaggugaaaugugugaugacaccguaacauacaaauguccucauauaacugaaguagaaccagaggauaucgauuguuggugcaaucuuacaaguacaugggugacuuaugggaccugcaaccaagcaggggaacaucgaagagauaaaagaucuguugcucuagcgccacacgucgguaugggucuagauaccagaacacaaacauggaugucggcagaaggggcauggcgacaaguugagaaagucgaaaccugggcuuuacgucauccuggauucacaauucuugcacuauuuuuggcgcauuauaucggaacaaguuuaacacaaaaaguagucaucuucauccuauuaaugcuagugaccccgaguaugacuaugagaugugucgguguggguaauagagauuuuguagaaggucucagcggagcaacguggguagauguggucuuagagcaugggggaugcguuacaacaauggcuaaaaacaaaccaacucuagacaucgaacugcagaaaacagaagcgacacaauuagccacuuugagaaaacucuguauagaggggaaaauaacuaauauaacaacagacagucgguguccgacccaaggugaagccguacuaccagaagaacaagaucaaaacuauguauguaaacauacuuauguggauagaggcuggggcaacggaugugguuuguucgguaaagggaguuuagugaccugugccaaauuccaaugucuagaaccgauugaggguaaagugguacaauacgaaaaccucaaauacacaguaaucauuacaguacacacgggcgaucaacaccaagucgggaaugaaacacaaggagugacugccgaaauaacaccucaagcaucaacaacagaagcaacgcucccugaguauggaacguuagguuuggaaugcucaccaaggacuggcuuggauuuuaacgaaaugauucuucuaacuaugaaaaauaaggcuuggaugguccacagacaaugguucuuugaccucccgcuaccuuggaccucaggagcgacgaccgagacaccuacuuggaaucgaaaagaauuauuaguuacauuuaaaaaugcacaugccaagaaacaagagguaguaguacuggguucacaagaaggggccaugcauacugcacuuacaggggcuaccgaaauucagaacucuggugggacaaguauauuugcuggccauuuaaaaugucgacuaaaaauggauaaacuugaauuaaaggggaugucauacgcaauguguacaaauaccuucguucuaaagaaagaaguauccgaaacacaacauggaacuauauugauaaaaguggaguacaaaggagaggaugcgccgugcaaaauaccguuuucaaccgaagauggacacgggaaagcacauaacgggagacugauaacggcuaacccuguuguaacuaagaaagaagaaccuguaaacauagaagcagagccucccuuuggggaaucaaacauaguuauuggaauaggagauaacgcacuuaaaauaaacugguauaagaaaggcagcucaauuggaaaaauguuugaagccacugcgcggggagcacgaaggauggcaauucuaggagacacugcgugggacuuugguucaguuggagggguacugaacaguuuggguaaaaugguucaucaaauauucggauccgccuauacggcuuuguuuucuggagugaguuggguaaugaaaauugguaucggaguauuguuaacauggauaggucuuaacagcaaaaauaccucuaugucguucucuuguauugcaauaggcaucauaacguuauacuugggagccgucguucaagcggauauggguugcgugauuaacuggaaagguaaagaacugaaaugugguaguggaaucuuuguuacaaaugaaguacauacauggaccgaacaauauaaauuccaagcugauucgccuaaaagauuggcgacagcaauugccggugcaugggaaaacggaguaugcgguauccguagcacaacacgaauggagaacuuacuuuggaaacaaauagcuaacgaauugaacuacauacucugggaaaacaauauaaaacuuaccguugucguaggggauauaaucgggguacuugaacaagggaaaaggacauuaacgccucaaccgauggaacuaaaauauucuuggaaaacauggggaaaagcaaaaauaguaaccgcagagacacaaaacaguagcuuuaucaucgauggucccaauacacccgaaugccccucagcauccagagcauggaauguaugggaaguggaagauuaugguuuuggcguauuuacaacuaauauaugguuacgauuacgagaagucuacacacaauugugugaucaucgccucaugucugccgcggugaaagaugagagagcaguacaugccgauaugggcuacuggauagagagucagaaaaacgggucauggaaacuagagaaggcuucucuuaucgaaguuaaaacauguacuuggccaaaaucccauacauugugguccaaugggguccuugaaagcgauaugauuauaccaaagagucuagcgggaccuauaucacaacacaaccauagaccuggguaucauacgcaaacugccggacccuggcaucuugguaaauuagaauuagacuuuaacuauugcgaaggaacaacagugguaauaacugaaaauuguggaacaaggggaccguccuuacggacaaccacgguuucagguaaacuaauucacgaaugguguuguagaucuugcacccucccuccauuaagauauaugggugaagauggaugcugguaugggauggaaauacgcccaaucagugaaaaagaagagaauauggucaaaucccuggugucggcuggcucgggaaaaguagacaauuucacgaugggaguccucugucuagccauccuuuucgaagaggucaugcgaggaaaguucggcaaaaagcauaugauagccggaguauucuuuaccuucguucuuuuauugagcggacaaauuacuuggagagacauggcccacacuuuaaucaugauagguucuaaugcuucggauaggaugggaaugggcguaacauaucuagcauugaucgcuaccuucaagauccagccauuuuuagcauuaggguucuuucuucggaaauuaacgucaagggaaaaucucuuauugggagucggacuggcaauggcaacaacuuuacagcuaccagaagauauagaacaaauggcuaaugggaucgcguuaggcuugauggcuuuaaaauuaauuacgcaguucgagacguaucaguuauggacggcauuaauaucgcucaccuguuccaacaccauauucacccuaacuguagcguggcgaacagcaacauuaauucuagccggugucagucuauuaccagucugucagucaucuucaaugcgaaaaacugauuggcugccuauggcagucgcagcuaugggcguuccuccauugccacuauucauauuuucauuaaaagacacauugaaacgaagguccuggccauuaaacgaaggagucauggcagucggcuuagucaguauucuagcauccucucuauuaaggaaugaugugccuauggcaggaccgcuaguggccgguggucuacuuauugcuuguuaugucauuacaggcacaucagcugaccuaaccguagaaaaagcagcggacauaaccugggaagaagaagcugaacaaacaggaguaucgcacaaccuuaugauuacaguugaugacgacggaacgaugcgaauuaaagacgaugaaacugagaauauacuaacggugcuacuaaaaacagcccuucucauuguaaguggaauuuuucccuauagcauacccgcgacauuacuuguauggcauaccuggcaaaagcaaacacaaaggagugguguccuaugggacguacccucucccccagaaacccagaaagcagaauuagaagaaggaguauacagaauaaagcaacaaggaauuuucggcaagacccagguugguguaggggugcaaaaagaaggugucuuucacaccauguggcauguaacgaggggagcuguauugacauacaacgguaagcguuuagaaccaaacugggcuucggugaagaaagauuugauaagcuauggagggggauggagacuaaguacgcaguggcagaagggugaagaagugcaaguuauagcaguagaaccuggcaaaaaucccaaaaacuuucaaacuaugccgggaaccuuccaaacaacuacaggcgagauaggugcaauagcgcuagacuucaaaccaggaacaucuggaucaccuauuauaaaccgugaaggcaaaguugugggacucuauggcaaugggguggugaccaaaaacgggggauauguuucggggauugcacaaacuaaugcugaaccagaugggccuacgccagaauuagaggaagaaauguuuaagaaacguaauuuaaccauaauggaucugcacccaggaucuggcaaaacucguaaguacuuaccagcgauaguccgagaggcaauaaaaagaaggcuacgcacucuaauccuagcgccaacuagagugguagcugccgaaauggaagaagcacuaaaaggucugccgauaagauaucaaacuacagcuacaaaaucugaacacaccggaagagaaauagucgaucuaaugugccacgcuacauuuacaaugcggcuucuauccccagugagagucccuaauuacaaccuaauaauuauggacgaagcucacuucacagaccccgcaucaauugccgcgagaggauauauaucgacuagaguaggaaugggagaagcugcggcgauauuuaugacggcuacgccacccggaaccgcggaugcguuuccacagucaaacgcgcccauucaagaugaagagagagauauaccagagcgaucguggaacucggguaacgaauggauuacggacuucgcagggaaaacaguaugguucguacccuccauuaaagcgggaaaugauauugcuaauugucuuaggaaaaaugguaaaaagguaauucaauugucgagaaaaacauuugacaccgaguaucagaaaacuaaauuaaaugauugggacuucguugucacaacagauauaagugaaaugggcgcuaacuuuaaagcagauagagucauagacccuagaagaugccucaaaccaguuauacuuacugacggccccgaacgaguaauccuugcuggcccaaugccagucacagcugcgagcgcagcacaaaggcguggacgaguggggcguaacccacagaaagaaaaugaucaauacauauucaccggccaaccacuuaauaaugacgaggaccaugcacacuggacagaagccaagauguuacuagauaauauaaacacaccugaagguauaauuccagcauuauuugaacccgagcgugagaaaagcgcggcaauagacggugaguacagacuaaagggagaaucaaggaaaacuuuuguggaauuaaugcguagaggugaccugcccguaugguuggcacauaagguagccucugagggaaucaaguauacagacagaaaaugguguuuugauggucaaagaaauaaucaaauauuagaagaaaauauggauguugaaauauggaccaaggagggggaaaagaagaagcuaagaccaagguggcuagaugcaaggaccuacuccgauccuuuagcacugaaagaauuuaaggacuuugcugcaggcagaaaaagcauagcauuagaccuaguaacugaaauaggacguguuccaucucauuuagcacaccggacuaaaaaugcauuagauaaucuaguaaugcugcauacuucagaacacggcggccgggcauacagacaugcaguagaagaacuuccagaaaccauggaaacguugcuucuauuaggacuaaugaucuuauuaacgggaggagcaaugcuuuuucuaauuagcggaaagggcauaggaaaaacaucuauuggauugauuuguguaauugcaucaaguggaauguuauggauggcagaaauaccucuccaguggaucgcaucagcuauaguguuagaauuuuucaugauggugcuucuuauaccugaacccgaaaaacaacgaacgccucaagacaaucaauuagccuaugugguuauuggcauauuaacacucgcugcuacuauagccgcaaaugagaugggucuacuagaaacgacaaagagagauuuagguaugaguaaagaacccgguguugugucaccaacaucguaccuugacguagauuuacauccugcuucggcauggacauuguacgcaguggcuacgacaguuauaaccccaaugcuaaggcauacaauagaaaacucuacagcuaauguaucacuagcagcaauugcaaaccaagcgguaguacuaaugggauuagauaaaggauggcccauuucuaaaauggacuuaggagucccacuacuugcguuaggaugcuacucgcaaguaaacccacuuacacugacagcagcgguauuauuacugauaacacacuaugcgauaaucgggccaggucuacaggccaaagcaacaagagaagcucagaaaagaacagcggcugguauuaugaaaaauccgacaguggaugguauuaugacgauugaccuggaucccgucaucuacgacucaaaguuugaaaaacaacuuggccagguuaugcucuuaguuuugugcgcuguacaauuacuucucaugagaacaaguugggcuuuaugcgaagcgcuaacuuuagcgacaggaccaaucaccacauugugggaaggcucaccuggaaaauuuuggaacaccacaauugcuguuucgauggcuaauauauucagggggucauaucuagcuggagcuggacuagccuuuucuauaaugaaaucaguuggcaccggaaaaagaggcacuggaucccaaggugaaaccuugggggagaaauggaagaagaaacuaaaccaauugucaagaaaagaauuugaucuauauaagaaaucugggauuacagaaguggacagaacagaggcgaaagaaggguugaaaaggggagaaauuacucaucaugcaguaucccgcggaucagcgaagcuacaaugguuugucgaaagaaauaugguaauuccggaaggaagaguaauagaucuuggaugcggcagaggaggcuggaguuacuauugcgcuggguuaaagaagguaacugaaguccgaggauauaccaaaggcggacccggucaugaagaaccaguaccgauguccacguauggcuggaauauuguaaagcucaugucggggaaagauguguuuuauuuacccccagagaaaugugauacgcuauuaugcgauauuggugaaagcagucccucaccaacaguggaggaaucucguacgauaagaguucuaaagaugguugaacccugguuaaagaacaaucaauucugcauaaaagugcuuaacccauacaugccgacaguaaucgaacacuuagaaagacuacagcguaaacauggaggaaugcuggucagaaacccuuugagccgaaauaguacgcaugaaauguacuggaucucaaacggaacuggcaauauagucgccagugucaauauggugucgcguuugcuguuaaaccgcuucacuaugacacauagaagaccgacuaucgaaaaagauguagaccuuggggcuggcacuagacauguaaaugcggaaccagagacucccaauauggacguuaucggggaaagaauaaaaagaauaaaagaggagcacaauuccaccuggcauuacgaugaugaaaauccauauaagacaugggccuaucacggaaguuaugagguuaaagcaacuggcucggccucaucuaugaucaacggggugguaaaacuauugacaaaacccugggacguugucccaauggucacgcagauggcaaugacggacacgacuccguuugggcaacaacgcguguuuaaggaaaaaguggauacacgcaccccgagaucaaugccagguacucgaagaguaauggguauuacggcagagugguuauggagaacacucggcaggaauaagaaaccgaggcugugcacuagggaagaauuuacuaaaaaggugcgcacuaacgccgcaaugggagcgguguucacugaggaaaaucaaugggauagugcuaaggcagcaguugaagacgaggauuucuggaagcuaguugauagagaaagagaacuacauaaacuaggaaaaugcggcucauguguauacaauaugaugggaaagagggagaagaaacuaggagaguucgggaaggcuaaagggucuagggcaauaugguauauguggcugggcgcacguuaucuggaauuugaggcacuaggauuuuuaaaugaagaucacugguucagccgugaaaauucauacuccggaguugaaggugaaggacuucacaaacuaggauauauucuuagagauauaucaaaaaucccaggaggagcaauguacgcugaugauacugcaggcugggauacaagaauuaccgaggaugaccuacauaacgaagagaaaaucacccaacagauggauccugaacauaggcaacuggcaaacgcaaucuucaaauuaacuuaucaaaauaaaguuguaaaaguccaaaggccaacaccaacaggaacugucauggauauaauuucacggaaagaccaaagagguucaggucaggucgggacuuaugguuuaaacacauuuacaaauauggaagcucaauugauaaggcaaauggaaggagaagggguacuaaguaaagcagaucuugaaaauccacaccuaccggaaaagaaaauaacccaaugguuagagacuaaaggagucgaaagguugaagagaauggcaauaaguggcgacgacugugugguuaaaccaauagacgauagguuugccaacgcucuuuuggcccuuaaugauauggguaaaguccgcaaagauauaccccaauggcaaccgagcaaagguuggcacgauuggcaacagguaccauuuuguucucaucauuuccacgagcuaauuaugaaggacggcagaaagcucguaguaccuugucggccgcaggaugaauuaauuggccgcgcaagaauuucacagggugccgguuggagccuacgagaaacugcuugccuagguaaagcguaugcucaaauguggucucuaauguauuuucaccgacgggacuugcgucuagcgucuaacgcuauuuguagugccguaccuguacauuggguuccaacaucuagaacaacauggagcauccacgcacaucaccaauggaugacaacagaagauaugcuaacaguuuggaaccgcguauggauagaagacaaucccuggauggaggacaaaacuccaguuacaacaugggaggacguaccauacuuaggaaagcgugaggaccaauggugugggagucuaauaggucugacuucaagggcgacaugggcccaaaacauuccuacugcgauccaacaaguaagaucgcucauugguaacgaagaauuucuggauuauaugccaucaaugaaacgcuuccgaaaagaagaggaaagcgaaggagcuauaugguga

SEQ ID NO: 23254 - RNA, 9873 nt, Artificial Sequence
  derived and/or modified CDS sequence (opt6) from DENV-3__KJ189271__SS-prME
acuucauugugucucaugaugauucucccagcggcauuagcauuucaucucacaaguagagauggagaaccaagaaugauaguagggaaaaaugaaagagggaaaucccuccuuuuuaaaacagccucaggcauaaauaugugcacacuuaucgcaauggauuuaggcgaaaugugugaugauaccguaacguauaaauguccucauaucacggaaguggaaccagaagauauugauugcugguguaauuuaacgagcacauggguuacauaugguacuugcaaucaagcaggagagcacaggcgagauaaaagaaguguagcacuugcaccucaugucgguaugggacuugauacccgaacucaaacuuggaugucggcagaaggagccuggcgucagguagaaaaagucgagacaugggcuuuacgucacccaggcuuuaccauccuggcauuauuucuggcucauuacauuggaacaucauuaacgcagaaaguugugauuuuuauacuccuuauguugguuacaccauccaugacaaugcgaugcgugggaguagguaauagagacuuuguagagggauuaucgggagcaacuuggguagaugugguauuggagcauggggguugugucacgacaauggcuaaaaauaaaccaacccuagauauagagcugcagaaaacugaggcaacacaacuugccacguuacgaaaauuguguauagaaggaaaaaucaccaauauaacuacagacaguagauguccgacccagggugaagcaguccuuccagaagaacaagaucaaaauuacguauguaaacauacauacguagaccgugguugggggaacggcugcgggcuauuugggaaaggaagucuggugacaugcgcaaaauuucaaugccuagagcccauagaagguaaaguugugcaauaugaaaauuuaaaauauacuguuauaaucacagugcacacuggcgaccaacaccaagucggaaaugaaacucaggguguaacagccgaaauaacgccacaggccucaaccacugaagcaacgcuaccugaauaugggacuuuaggauuggaaugcagcccccggacagggcuugauuuuaaugaaaugaucuuauuaaccaugaaaaauaaggcuuggaugguccaccgccaaugguucuuugauuuaccucucccauggacaucaggagccacuacagagacaccaacuuggaaucgaaaagagcuucuagugacuuuuaaaaaugcgcaugccaagaaacaagaaguuguuguacuaggaucccaagaaggagcgaugcauacugcgcuaaccggagcaacagaaauccaaaauucaggugguacgucaaucuucgcuggucaccucaaauguaggcucaaaauggauaaacucgaacuaaaaggcaugucauaugcgauguguacaaauacuuuuguucuuaagaaagaaguaucagaaacacagcacgguacaauacuuauuaaaguugaauacaaaggagaagaugcgcccugcaaaauuccauuuucaacugaagacggucacgggaaagcacacaacggccgucuaaucacggcaaaucccgugguaacuaagaaagaagaaccaguuaauauugaagccgaaccaccauuuggugaaaguaacauaguaauagguaucggcgauaacgcccuuaaaauaaacugguacaagaaaggaucaagcauaggcaagauguuugaggcaacggcaaggggugcccgacguauggcuauacuuggugacacagccugggauuuuggcucuguuggcgguguguuaaauucuuuagggaagaugguacaccaaaucuucggaagugcuuauacagcucuauucuccggaguauccuggguuaugaaaauaggcauaggcguacuauuaacauggauaggcuuaaauagcaaaaacaccaguaugucauuuaguugcauugcaaucggaauaauuacuuuauaccuuggagcagucguucaggccgauaugggguguguaauaaauuggaaagguaaagaauuaaaguguggaagcggaauuuuuguuacuaaugaaguucauacguggacagaacaauauaaauuccaagcagauagcccgaaacgacuggcaacagcuauagcaggagcuugggaaaauggagugugcggcauuagauccacgacaaggauggaaaaucuauuauggaaacagaucgcuaacgaacuaaacuauauuuuaugggaaaauaauauuaagcuaacgguagucgugggcgauauuauagggguacuggaacaaggcaaaaggacacugacaccucaaccaauggaacugaaauacucauggaaaacaugggguaaagcuaaaauuguaacagcugaaacucaaaacucgucguuuauaauagaugguccaaauacgccugaauguccuuccgcuucaagagcuuggaauguuugggagguagaagauuacggauucgggguuuuuacaacgaauaucugguuacgccuaagagagguauauacgcaguugugcgaucacagacugaugucggcggccgugaaagaugagagagccgugcaugcagacaugggcuauuggaucgaaagucagaaaaacggaucauggaaauuagaaaaagccaguuugauagaaguaaaaacuugcaccuggcccaaaagucacacuuuauggucgaacggaguucuggaaucugauaugauaaucccaaaaaguuuagccggaccuauaagucagcacaaucauagaccgggguaccauacucaaacagccggaccauggcaucucggcaaacuagaauuagacuuuaauuauugugaaggaaccacaguuguaauaacagagaauuguggaacuagaggaccgucuuuaagaacaaccacagucuccggcaagcuaauacacgagugguguuguagaucaugcacguuaccaccacuaagguauaugggagaagacgguuguugguacggcauggaaauaaggccgauaagugaaaaggaggaaaauaugguuaagagcuuaguaucagcugguucaggaaaaguagacaacuucacgaugggcguuuuaugcuuagcuauauuguuugaagagguaaugcggggaaagcuggguaagaaacauaugauagcaggaguauucuuuacuuuugugcuacuacuuagcggacaaauaacauggcgagacauggcacauacacuaauaaugaucggaagcaacgcuagcgauagaaugggaauggggguuacauaccucgcucucaucgcuacuuuuaaaauacagccauuccuagcccuaggauucuuucugcguaaacuaaccucccgagaaaaucuucuuuuagguguuggguuagcuauggcgacaacucuucaauuaccagaagacauugagcaaauggcaaauggaauugcucuaggacucauggcacucaaauuaauaacgcaauucgaaacuuaucaguuguggacggcauuaauaagucuuacaugcagcaacacaauauuuacauuaaccguagcauggagaacugcgacccugauauuagcaggcguuuccuuauuaccgguuugccagucaagcagcaugagaaagacugauuggcugccuauggcugucgcagcaauggguguuccaccucugccacuuuuuauauuuucccugaaagauacucuaaaacguaggucuuggccgcucaaugaaggcguaauggcaguugggcuuguauccauuuuagcaucaucucuccucagaaaugacguaccaauggcaggaccacuggucgcgggcggucuccuuauugcaugcuaugugauaacuggcacaagugcugaucuuacagucgaaaaagcagcugacaucacaugggaggaggaagccgaacagacuggaguaagucacaacuugaugauuacgguugaugacgacgguacaaugaggauaaaagaugacgagaccgaaaauauacucacaguucuccucaaaaccgcucuuuuaauaguuucggguauuuucccauacuccaucccugcuaccuuauuaguauggcacacauggcagaaacaaacucaaagaucgggcguauugugggacguucccagcccaccggaaacucaaaaagcggaauuagaagaaggaguauaucguauaaagcagcagggaauauuugggaaaacucaggucgguguggggguacaaaaagagggaguuuuucacacaauguggcacguuacaagaggagcuguccugacauauaacggaaagagacuagaaccgaauugggcaucaguaaagaaagaccucauaaguuacgggggcggguggcgacuuagcacacaauggcaaaaaggggaagaaguucaaguaauagcaguugaacccgggaaaaacccgaaaaauuuucaaacuaugccaggaacguuccagacuacaacgggugaaaucggcgcuauagccuuagacuuuaagccggggacaagugguagcccaaucauuaaccgggaaggaaaaguaguuggacuuuauggcaauggugucgugacgaaaaauggaggcuaugucucuggcauugcgcaaaccaaugcugaaccggacggucccacacccgaauuagaagaagagauguuuaagaaacgaaaccuuacuauaauggauuugcauccaggaagcggaaaaacacgaaaauauuuaccugcaauagugcgagaagccaucaagagaagacuacgcacucuuauauuagcucccacucggguaguagcggcagaaauggaagaggcacucaaaggacuucccauaagguaucagaccacagcaaccaagucagagcauacagguagagaaauugucgacuuaaugugccacgcaacauuuaccaugagauuguuaucuccgguaagaguuccaaacuacaaucuaauaauaauggacgaggcgcauuuuacagauccugcuucuauagcugcacgugguuauauaucuaccagaguaggaaugggcgaggccgcagcuauauuuaugacggccacaccuccaggaacagcugacgcguuuccucaaagcaacgcgccaauucaagaugaagaaagagacauuccagaaagaagcuggaacucugguaacgaauggaucaccgacuucgcaggaaagacaguaugguuugucccuagcauaaaagcuggcaacgacaucgcuaauugccucaggaaaaacgguaagaaaguaauucagcuaucuagaaaaaccuucgauacggaauaccagaaaaccaaauuaaacgacugggacuuuguuguaaccacagauaucagcgaaaugggugccaauuuuaaagccgauagaguuauagauccgaggcggugucuuaaaccuguuauacuaaccgacggaccagaaagaguuauccuagcagguccuaugccaguaacugcagcaucagccgcccaaaggcgaggccgugucggacgaaacccacaaaaagaaaaugaccaauauauuuuuacgggucaaccacugaauaacgaugaagaccacgcucauuggacagaggccaaaauguugcuagacaauauaaauacgccggaaggaauuauaccagcuuuauucgaaccagagagagagaaaagugcugccaucgauggagaguaccgacuuaagggggaaucaagaaaaaccuucguagagcuuaugcguagaggagauuugccaguuuggcuagcacacaaaguagcaagugaagguauuaaguacacugauaggaaaugguguuucgauggacagcgaaacaaucagauccucgaagagaauauggauguagaaauauggaccaaagaaggugagaagaagaaacuacggcccagauggcuagacgcccgcacuuacucagauccacuugcauuaaaagaauuuaaagauuuugcugcagguagaaagaguaucgcccuugaccuaguuaccgaaaucggacguguaccaucacaucuagcucaucguacuaggaaugcacuagacaacuugguaaugcuucauacaucagaacacggggguagagcauauagacaugcuguggaggaacuuccugaaacgauggaaacucucuugcuacuugggcucaugauauuguuaacagguggugcgauguuguuucuaauuucagguaaaggaauaggaaagaccucuaucggauugauaugcguuaucgcuagcaguggaaugcuauggauggcggagauaccguuacaauggauagccucagcaauuguauuggaguucuuuaugaugguuuugcucaucccugaaccugaaaaacaaaggacuccccaagacaaccaguuagcuuaugucguuauuggcaucuuaacauuagcugcuauaauagcagcaaaugaaaugggauuacuagagacuacgaaaagagaucucgggaugaguaaagaaccaggcgucgugucaccaacaucuuaccuagacguagacuuacauccggcaucagcuuggacauuauacgcuguagcgaccacugucauuacgccaaugcuuagacauacaauagagaauaguacggcuaacguaucucuugcagcgaucgccaaccaagcuguuguauugaugggacucgacaaagguuggccuauaucaaaaauggauuuaggagugccccuccucgcgcuggguuguuauucucaagugaacccacugacacuuacugcugcggucuuauuguugauaacacauuacgcaaucauaggaccaggguuacaagcaaaagcgacacgcgaggcacagaagaggacagccgcaggaauaaugaagaaucccaccguagauggaauaaugacuauugauuuggacccuguaauauacgacucuaaauuugagaaacaacuaggccaggucaugcuauuaguacuuugcgcaguucaguugcuauugaugaggacuucaugggccuuaugcgaagcacuaacauuagcgacagguccgaucacaacucuuugggaaggaucgccagggaaauucuggaacacuacuauugcggucucaauggcaaauauauuucgaggcucauauuuagccggugcaggucucgcguuuucaauuaugaagaguguugggacagguaaacgcggaacuggcucacaaggggaaacacuuggagaaaaauggaagaaaaagcugaaucaacuaucgagaaaagaauuugauuuauacaagaaaagcgguauaacggaaguugaccgaacagaggcuaaagaaggucuaaaaagaggagaaauaacccaucaugcuguuucaagaggaucagccaaauuacaaugguucguagaacgaaauaugguaauaccagaagguagaguaauugaccuuggaugcggcagaggcgguuggaguuacuacugugccggacuuaagaaaguuacagaagugagagguuauacaaagggagguccuggucaugaagaacccguuccgaugucaacuuauggauggaacauugugaaacucaugucaggaaaagauguauuuuacuuaccuccggaaaagugugauacccuucuaugcgacauuggugaaucuaguccuagcccuacaguugaagaaagucgaacgauucggguucuaaagauggucgaacccuggcucaaaaauaaccaauucuguauuaaagugcuaaauccauacaugccuaccgucauagaacaccuggaacgacugcaaagaaagcaugguggcaugcucguucgaaauccguuaucacgaaauucgacacacgaaauguauuggauuucaaaugguacagguaacaucguggccagcguaaacaugguaaguagguuacugcugaauagauuuacgaugacucauagaagaccuacaauugaaaaagauguggaccugggggcagguacucgucauguuaaugcagaacccgaaacaccgaauauggauguuauaggagagagaauaaaacguauuaaagaagaacauaacucaacuuggcauuacgaugaugagaaccccuacaagacuugggccuaucauggaucauacgaagugaaagcuaccggaucugcuucuagcaugauuaacggcgugguuaaacuacuaacaaaacccugggacgugguuccuaugguuacacaaauggcuaugaccgauacaacuccuuuuggucaacaaaggguuuuuaaggagaaaguagauacuagaacaccucguucuaugccaggaacucgaagaguaaugggaauaacagcagaauggcuuuggagaacgcuaggcagaaauaagaaacccagauuauguacaagggaggaguuuacaaagaaggucaggacaaaugccgcaaugggagcaguguuuacagaagaaaaccagugggauucagcaaaagcugcuguugaagaugaagacuuuuggaaguugguagaucgugaaagagaauuacauaaauuggggaaaugugguuccugcguguauaacaugauggggaaaagagagaagaaacuaggcgaauuuggaaaagccaaaggaucacgcgcaaucugguacauguggcuaggugcaagguauuuggaguuugaagcauuaggauuucuuaaugaggaccauugguuuucccgagagaauagcuacucggguguagaaggagaagggcuccauaagcuaggcuauauacuccgcgauauaucaaaaauacccgguggggcgauguaugcagaugacacugcaggaugggacacacgaauuacagaagacgacuugcauaacgaagagaaaauuacccaacagauggacccagaacauagacagcucgcuaaugccauuuucaaauuaacguaccaaaauaaaguaguuaaaguccaaaggccuacaccaacaggaaccguaauggauauaauauccagaaaagaccaaagagggucgggccagguuggcacuuauggucuaaacacguuuacuaauauggaggcacaauugauucgacaaauggaaggcgaaggcguauuaaguaaagccgaccuagaaaauccacaccucccggagaagaaaauuacucaaugguuagagacaaaaggaguggaacgacuaaaacggauggccauuaguggagaugauuguguaguuaaaccuauagaugauagguuugccaaugcuuuacuagcuuuaaaugauaugggcaaagucagaaaagauauaccacaguggcaacccucgaaaggauggcacgacuggcaacaaguaccauuuuguucucaucauuuccaugaguuaaucaugaaagacgguaggaaauugguugucccauguaggccucaggaugagcuaauaggacgcgcaagaaucucccagggcgccggauggucguuacgagagacagcaugucuuggaaaagcauaugcucaaauguggagucugauguauuuccacagaagagaccuucgacuagccuccaaugccauuuguucggccguaccuguacauugggucccuaccucaagaaccacauggucaauacacgcccaucaccaguggaugacgacagaagauauguugacuguauggaauagaguauggauugaagauaacccauggauggaagauaagacccccguuaccacaugggaagacgugccuuaucugggcaaacgagaagaucaauggugcgguucauuaauaggacugacaucucgagccacaugggcucaaaauaucccuaccgcuauacagcagguccguucuuuaauugguaaugaagaauuuuuggacuauaugccaagcaugaagagguuucgaaaggaggaagagucagaaggugcaauuugguag

SEQ ID NO: 23255 - RNA, 9873 nt, Artificial Sequence
  derived and/or modified CDS sequence (opt6) from DENV-3__KJ189272__SS-prME
acgagucuaugccuuaugaugauucuaccugcggcacuagccuuucaucuuacgucuagagauggagaaccgagaaugauuguagguaaaaacgaacgaggaaaaagucuccuauuuaaaacagcuucugggauaaacaugugcacguuaauugccauggacuuaggugaaaugugcgaugauacgguuacuuauaaaugccccuacauaacagagguggagcccgaagacauugacugcugguguaauuugacaaguacauggguuacauauggaacaugcaaucaagcaggagaacaucgucgggauaaacgaagcguugcccucgccccacauguuggaaugggucuugauacacgaacccagacauggaugucggcagaaggggccuggcgacaaguugaaaaaguagagacaugggccuugcgccauccuggauuuacaauucucgcauuauuuuuagcacauuacauuggaacaaguuuaacacagaaaguuguaauauuuauuuuacuaauguuaguaacacccuccaugacuaugagaugcguuggaguaggaaaucgugacuuuguugagggucuuaguggugcaacgugggucgacguaguacucgaacauggaggcuguguaaccacgauggcgaaaaauaaaccgacccuagauauagaguuacagaaaacagaagccacccagcuugccacauuacgaaaacucugcauugaaggaaaaauaacuaacauaacgacagacucucgauguccuacacaaggugaagcgguacuccccgaagaacaagaucagaauuacgucuguaaacauacguacguugaccgcgguuggggaaacggauguggacuguucggaaaagguagucuugucacaugcgcgaaauuccaaugcuuggaacccauagaaggcaaagugguacaguaugaaaacuuaaaauacacgguaauaaucacgguacacaccggcgaucaacaucaaguagguaacgaaacacaggguguaacggccgaaauaacaccacaggcuagcacuacagaagcaacacuacccgaauauggaacgcuuggacuggaauguucaccucguaccggcuuagacuucaaugaaaugauacuuuugacuaugaaaaauaaagcauggaugguacauaggcaaugguucuuugaccuuccuuugccguggacguccggcgccacuacugaaacuccaacauggaauagaaaagagcucuugguuacuuuuaaaaaugcacaugcuaagaaacaggaaguaguuguauuaggcagccaagaaggcgcaaugcauaccgcacucacaggugccacugagauacagaauaguggcggcacuagcauauuugcugggcaucugaaauguagguuaaaaauggauaaacuagaacugaagggaaugaguuacgcuauguguacaaacacauuugucuuaaagaaagaagugagugaaacgcagcauggaacaauucuaaucaaaguagaauauaaaggggaggaugcaccgugcaaaauucccuucucaacagaagacggacaugguaaggcacauaaugggaggcuuauuacugcaaauccaguuguuacaaagaaagaagaaccaguuuccaucgaagccgaaccuccauucggagaaucuaauaucgugaucgguauuggggacaacgcacuuaaaauaaauugguauaagaaaggaaguucuauuggaaaaauguucgaagcaacggcgcgcggagcuagaagaauggccauacugggagauacugcuugggacuuuggaucaguaggagguguuuugaacuccuuaggaaaaaugguacaccaaauuuucggaucagcauauaccgccuuauucucuggugugucauggguaaugaagauugguauuggaguauuauugacauggauugggcuaaauuccaaaaauacuucaaugucauucagcugcauagccauaggaauaauuacuuuauaucuaggagcagucguacaagcagauaugggauguguaauuaauuggaaaggaaaggaacucaaaugcgguucggguauuuucguuacuaacgaaguucauacuuggacagaacaguacaaauuccaagccgacucaccaaaaagguuggcaacugccauagcgggcgccugggaaaacggaguaugcggaauaagaucaacaaccaggauggaaaaccuauuauggaaacagauugccaacgaauugaauuauauucuaugggaaaauaacauuaaauuaacgguuguuguaggagacaucaucggaguucuggaacaggggaaaaggacacuuacuccgcaacccauggaauuaaaauauaguuggaaaacaugggguaaagcuaaaauagucacggcagagacgcagaacucaucauuuauaauagacggaccaaacaccccugaauguccgagugcuagucgugcuuggaacgucugggaaguagaagauuauggcuucgguguguucacuaccaauauauggcuaagauuaagagaaguauauacacagcugugugaucaucgucuuaugagcgcggcagucaaagaugagagggcaguacaugccgacaugggauacuggauagaaucgcagaaaaacgguucauggaaacucgaaaaagccucccugauugaaguaaaaaccugcacauggccgaaaucacauacauuauggaguaacgguguccucgaaucagauaugauaauaccaaaaucucuugcggggcccauuucacaacauaaccauagaccgggguaucauacucaaacugcaggaccuuggcacuuaggaaaguuagaacucgauuuuaauuacugcgaaggaaccacugucguaauaacagaaaauugcggaacgcgaggaccuaguuuaagaacgaccacggugagcgguaaacuuauacacgagugguguugccgcaguuguacccugcccccucuuagauacaugggugaggacggguguugguaugguauggagauuagaccuaucagugaaaaggaagaaaauaugguaaagucacuugucucugccgguaguggaaaaguggacaacuuuacaauggguguauugugccucgccauacuuuuugaagaaguaaugcguggaaaguucgguaagaaacacaugauugcuggaguauucuuuacauucguauuacuucuaucuggacaaauaaccuggcgggacauggcgcauaccuuaaucaugauuggaucaaacgcaucugauagaaugggaauggggguuaccuauuuagcucugauugcaacauuuaaaauucaaccauuccuugcauugggauucuuuuugaggaagcuaacaucuagggaaaacuugcuauuaggagugggguuagcuauggccacaacacuucaauuaccagaagacauagaacaaauggccaacggcauagcauugggauuaauggcuuugaaacuaauaacucaguucgagacauaccaauuauggacagcgcugauuucguugacuugcagcaacacaauuuuuacuuuaaccguugcauggcggacugcaacacuaauauuagccggaguaucacugcuucccgugugccaaucaucaaguaugcggaaaacugauugguugccuauggcaguugcagcaaugggugucccuccuuuaccuuuauuuauauuuucauuaaaagauacucucaaaagacguaguuggccacucaaugaaggaguaauggcugugggguuggugucuauucucgccucaucacuuuuaaggaaugacgucccaauggcaggaccuuuaguagcgggaggauuauugauagcauguuaugucauaacggguacaagugcagaucuaacaguagaaaaggcugcugacauaacgugggaagaagaggcugaacaaacagggguuucacacaauuugaugauaacgguagaugacgauggaacaaugcggaucaaagaugacgaaacggaaaauauuuugaccguacucuuaaagacggcuuuacuaauuguaucuggcauauuuccauacagcauaccagcgacuuuauuaguuuggcacacguggcaaaaacaaacgcaacggaguggagugcugugggacgucccuucuccgcccgaaacgcagaaggcagaauuggaagaagguguauauagaauaaaacaacaagggaucuuugguaaaacacaaguaggaguaggcguacaaaaagagggaguauuucauacaauguggcauguuaccagaggagccguucuuaccuauaacggaaaaagauuagaaccaaauugggcaucagucaagaaagauuuaauaucauacggugggggauggagacuuuccacacaauggcaaaaaggugaggagguacaagucauagcaguugaaccugguaaaaacccuaaaaauuuucaaacaaugccagguacauuccagacuacaacuggugaaauaggugcaauagcuuuagauuuuaaaccagguacaaguggaagcccuauuauaaauagagaagguaagguggucgguuuauacggaaauggggugguuacuaaaaauggagguuauguaucugggauagcucaaaccaaugcagaaccugaugggccuaccccagaacuagaagaggaaauguuuaagaaaagaaaucuaacuauaauggauuuacauccuggcucagguaaaacaagaaaauauuugccagcgauaguuagagaagcaauaaagaggagguuacggacacuaauacuugcuccaacacgcguuguagcugcagaaauggaagaggccuuaaaaggcuugccaauucguuaucaaacgacagcaacuaaaagugagcauaccgggagggagauaguagaccuaaugugucacgccacuuuuacuaugagacuucuuaguccagucaggguaccaaacuacaaucuaauaaucauggacgaagcucacuucacagauccggcaucaauugcugcgcgaggauauauauccacacgcgugggcaugggugaagcagcugcgauauucaugaccgcgacgccaccgggaacagcagaugcuuucccacagucgaacgcaccaauacaggacgaggaacgugauauaccagaaagauccuggaacaguggaaaugaauggauaacagacuuugccggaaaaacaguuugguuugugccaaguauaaaagcagguaaugauaucgcaaauugcuuacgaaagaauggcaagaaaguaauacaauuaucccggaaaacauuugauacugaauaccagaaaacuaaacuuaaugauugggauuucgugguaacaacagauauuucagagaugggugcuaauuuuaaagcggaccgagugauugauccgagacgcugucuaaaacccguaauucuuacagauggaccagaacgaguaauuuuggcaggccccaugccugugacagcagcgucagcagcacaacgcagggggagaguuggaagaaacccccaaaaagaaaacgaucaauauauauucacuggucaaccacuaaauaaugaugaagaccaugcccauuggacugaagcgaagauguugcucgauaacauuaauacaccugagggaaucauuccggccuuauuugaaccggaaagggaaaaaucagccgcuaucgauggggaauauagacucaagggagaaagccggaaaacguucguggaacucaugcguagaggcgauuuaccagucuggcucgcucacaagguugcgucagaagguauaaaguauacggauaggaaaugguguuuugacggucagcgaaauaaccaaaucuuagaagaaaauauggacguggaaauuuggacgaaggaaggggaaaagaaaaagcuccguccacguuggcuagaugcuaggacauauagcgauccucucgcccuaaaagaauuuaaagauuucgccgcuggaagaaagucuauagcgcuugauuuggucacggaaauagguaggguccccucgcacuuagcgcaucggacaagaaacgcuuuagauaacuuaguuaugcuacauacaagugaacauggugguagagcguaucgucaugcgguugaagaguugccagaaacaauggagacccuacuuuuacuuggguuaaugauacuauuaacuggcggugcaauguuauuccuaauaagugguaagggaauuggaaaaaccucuauugguuuaaucugcguuauagcaucgaguggcaugcuuuggauggcggaaauaccacuccaguggauagcuucggcaauuguguuagaguucuuuaugaugguccuauuaauaccagaaccagaaaaacagaggacuccgcaagacaaccaacuugcauacgucguaaucggaaucuuaacauuagcagcaauaaucgccgcuaaugaaauggguuugcuugaaacaacaaaaagagaucugggaaugucaaaagaaccggguguagugaguccaacaucuuauuuagacgucgaucuacauccagcuucugcauggacccuguaugcuguagccacuaccgucauaacgccgaugcuucgacauacuauagaaaacagcacagcgaacguaagccuagcagcaauagcgaaucaagcuguuguccuaaugggacuugauaaaggcuggccaaucaguaaaauggaucucggcguaccauuacuugcauuaggauguuauagucaggugaacccguuaacucuaacagcggcuguucuauugcugaucacgcacuaugcgaucauaggaccaggcuuacaagcuaaagcuacucgagaagcucaaaaacgaacagcugccggcaucaugaaaaauccgaccguagacggaauaaugacaauagaccuagaucccguuauuuacgacaguaaauuugaaaagcaacugggccaaguaaugcuguuagugcucugugcgguucaguuauugcuaaugaggacaaguugggcauuaugugaagcauugacacuggcgacaggaccaauaacuacacuaugggaaggaucaccagggaaauucuggaacaccacaauagcuguauccauggcaaacauauuccgaggaucuuacuuggcgggugccgguuuagcauuuagcauaaugaaaucaguggggacgggaaaaagaggaaccgggucacaaggcgaaacacuaggggagaaauggaaaaagaaauuaaaucaacuaucaagaaaggaauuugacuuguauaagaaaucaggcauuacagaggucgaccgaacagaagcgaaagagggacucaaaaggggagaaaucacacaccacgcagucagucgaggaucugcaaaacuacaaugguucgucgagagaaacauggucauacccgagggucgaguuauagacuuaggauguggcaggggaggguggucguacuacugugccgguuuaaagaaaguuacugagguuagagguuauacaaagggcggaccgggacaugaggagccaguuccgauguccacauaugguuggaauauaguaaaacuaaugaguggcaaggauguuuucuaucugccaccugagaaaugugacacacuguuaugugacauuggggaaucuucuccauccccuacuguggaggagucuagaacuauuagaguacucaaaaugguugagccuuggcucaaaaauaaucaauucuguauuaagguguugaacccauauaugccuacaguuauugaacaccuagaacgauuacaaagaaaacauggaggaauguuggucaggaauccacuaagcagaaauucgacucacgaaauguauuggauuagcaacgguaccgggaacauaguagcuaguguaaauaugguaagucgccucuuguuaaaucguuuuacaaugacacaucgaagaccuacgauagaaaaagauguagaucuaggagcgggaacgagacacguaaacgcggaaccagaaacaccaaauauggacguuauaggggagcguauaaaaaggauuaaagaagaacacaauucaacuuggcacuaugacgaugaaaaccccuauaaaacuugggcauaccacggcaguuacgaaguuaaagcuacuggaagcgccagcucaaugaucaaugggguaguaaaauugcuaacgaaaccgugggacguaguuccgaugguaacucaaauggcaaugacugauacuacgccuuuuggccaacaaaggguguuuaaagagaaaguugacaccagaacacccagguccaugcccgggaccagaagagucauggguauuacugcugaauggcuauggcgaacauuaggacgaaauaaaaagcccagauuaugcacuagagaagaauuuaccaagaaaguucggaccaaugcagcaaugggugccguauucaccgaagaaaaccaaugggauucagcaaaagcagcgguagaagaugaagauuuuuggaaauugguugaucgagagcgagaguuacacaaauuaggaaaauguggaaguugcguuuacaacaugaugggaaaaagagagaagaaacucggagaguucggaaaagcaaaaggaagcagggccaucugguauaugugguugggggcuagguaucuugaguuugaagcacugggcuucuugaaugaagaucauugguuuucgagagaaaauagcuauaguggcguggaaggggaaggacuccauaaacuaggauauauauugcgagacauaagcaaaauuccagggggugcaauguaugccgacgacacugcuggcugggauacucgcauaacagaagaugauuugcauaaugaagagaaaauaacacagcagauggaucccgaacaucgacaauuagcuaacgcaauauucaaauugacuuaucagaacaaaguugugaaagugcagaggccgacaccaacuggcacaguuauggacauaauuaguaggaaggaucaacgcggaagcggccaaguaggaacguacggcuugaacacauucacaaacauggaagcccaacucauaagacagauggaaggggaagguguauuaucuaaagcugaccucgagaacccgcaucuaccggagaaaaagauuacacaauggcuugaaacuaaagggguugaacgccuuaaaagaauggcaauuucuggggacgauugcgugguaaagccgauagacgauagauucgcuaaugcacuucuagcccuuaaugauaugggaaaaguuagaaaggacauuccccaguggcagcccucaaaagguuggcaugauuggcagcagguaccuuuuugcucacaccacuuucaugaguuaauaaugaaagacgguagaaaauuaguaguuccgugucggccacaggaugagcucauugggcgggcaagaauaucacaaggugcuggguggucgcuaagagaaacugccuguuuaggcaaagcguacgcacagauguggucucuuauguauuuucaucgacgagaucuaagacucgcauccaaugcuauaugcagcgcuguaccaguucacugggugccaacgucgcguacgacauggucuauacaugcucaucaucaauggaugacuacagaagauauguuaacugucuggaacagagucuggaucgaagauaauccuuggauggaggauaaaacaccgguuacgacaugggaagauguuccuuauuuagggaaacgagaagaucagugguguggaucacucauaggacucacgucaagagcuacaugggcacaaaauauaccuacugcuauucaacaagugagaaguuugauagguaacgaagaguuuuuggacuauaugccaagcaugaaacguuuuaggaaagaggaggaaagcgaaggagccauaugguaa

SEQ ID NO: 23256 - RNA, 9873 nt, Artificial Sequence
  derived and/or modified CDS sequence (opt6) from DENV-3__KJ189273__SS-prME
acaucucuaugucuaaugaugauccuacccgcggccuuagccuuucacuuaacaucccgcgauggugaaccgagaaugauuguaggcaaaaaugaaagaggaaaaagucuacuauucaaaaccgccagugggauuaacauguguacgcuaauugcaauggaucuuggugaaaugugcgaugacacagucacauauaaaugcccacacaucacugaaguugaaccggaagauauugauuguugguguaauuuaacaucaacaugggugacauaugguacuugcaaucaggcgggugaacaucgcagggauaaaagaucaguugcuuuagcaccacauguagguaugggacuggacacaagaacacaaacuuggaugucugccgaaggagcguggagacaaguagagaaaguugaaacaugggccuuacggcaucccggauuuacuauccuagcacucuuucuggcgcauuauauugguacgucuuuaacucaaaaaguaguuauauuuaucuugcucaugcuaguuacacccucaaugaccaugagaugcgucggaguuggaaauagagauuucguugaaggauugaguggagccacguggguagacgugguacuagaacacggugguugcguaacaacaauggccaaaaauaaaccaacacuggauauugaauuacagaaaacugaggccacacaauuagcuacuuuaaggaaacucugcauagaaggaaaaauaacuaacauuacaacugauucuagaugucccacgcaaggagaagcaguauugccagaagaacaagaccagaauuacguuugcaaacacacauauguggaucguggauggggaaacggauguggacucuuuggaaaagggucauuaguaacgugcgcaaaauuucaaugucuggagccuauagaagguaaaguuguucaauacgaaaaucugaaauacacaguaaucauaacgguacacacuggugaucaacaucaaguuggcaaugagacgcaaggaguaacugcagagauaacaccccaagcaucaacaacagagguuacguuacccgaauacggcacauugggacuagaguguucuccaagaacugggcuugauuucaaugagaugauauuguuaacgaugaaaaacaaagcauggaugguacaccgacaaugguucuuugaccuuccacugccauggaccagcggggcaaccacugaaacaccuacauggaaucguaaagaacuacuuguaacauucaaaaacgcgcacgccaagaaacaagaaguagucguauuaggcucucaagagggagccaugcacaccgcgcuuacaggugcaacagaaauacaaaauucagggggaacaucaauuuuugcuggacacuugaaaugccggcuuaaaauggauaaacuagaacuuaaagguaugucuuaugcaauguguacaaauacuuucguuuuaaagaaagaaguaagugagacccaacauggaacaauacucauaaaaguagaauauaaaggugaagacgcaccaugcaaaauucccuuuaguaccgaagacggacacggaaaagcccacaacgggcgccuaauaacugcaaaucccguaguaacuaagaaagaagaaccgguaaacauagaggcugaaccuccguuuggggaaucaaacaucgucauugggauuggggacaacgccuugaaaauaaacugguauaaaaagggaagcucaauagguaaaauguucgaagcgacggcgcguggugcaagaagaauggccauccugggagacacagcgugggauuucggaaguguugggggaguucucaauucccuggguaaaaugguacaucaaauuuucgguagcgcauauacugcacuguuuuccggaguuucuugggugaugaaaauugguauaggaguauuacuuacauggauuggcuuaaacaguaagaacacaucuaugagcuucuccugcauagcaauaggaaucauaacauuauaucuaggagcagucgugcaagcagacauggguugcgucaucaauuggaaagguaaagagcuaaagugcgguucagguaucuuugugacuaaugagguucacacuuggacggaacaauauaaauuccaagcagauucucccaaacgacuugcuacagcgauugccggggcuugggaaaauggcguuugugggaucaggucuacaacaagaauggagaaccuacuguggaagcaaaucgcaaaugaacuuaauuauauacuaugggaaaauaauauuaagcuaacgguuguuguuggugauaucauaggaguauuggagcaaggcaaaagaacucuuacgccccagcccauggagcuuaaauacucauggaaaacgugggggaaggccaagauuguaacagccgagacacagaauaguuccuucauaauagacggucccaacacaccagaguguccuucugcuucgcgcgcauggaaugugugggaaguugaagauuauggauucgguguguucacaacuaacaucuggcugcgccucagagaaguauauacacaguugugugaccaucgauuaaugucagcagcggugaaggaugaaagagcaguccaugcagauaugggauauuggauagaaagucagaaaaauggaucuuggaaacuagagaaagcaucucuaauagaaguuaaaacauguacauggccgaaaucgcauacauuguggaguaaugguguucuugagagugacaugaucauccccaaaucauuggcagguccaaucagccaacauaaucacagaccuggauaccacacacagacugcaggaccguggcaccuaggcaaacucgaauuagauuuuaauuauugugaagguacuaccguagugauaacagaaaacugugguacaagagguccaucacuucggacuacaaccgucagugggaaacugauacaugaaugguguugucgaagcugcacuuuaccaccuuuaagauauaugggagaggauggauguugguacgguauggaaauaagaccgauuuccgaaaaagaagaaaacauggugaaaucguugguuucagcugguucagguaaaguggauaauuucacgaugggcgucuuaugccuugcaaucuuauucgaagaagugaugagaggaaaauucgguaaaaagcacaugauugcaggcgucuucuuuacauucgugcuuuuguuaucuggacagauaacauggcgugacauggcacauacacuaauaaugauagguaguaaugcuagugacagaaugggcauggggguuacguacuuagcacuaauugcuacguucaaaauacaaccauuucuagcccugggauucuucuuaaggaaauuaaccucucgcgaaaaucuacuccuaggagucggccucgcuauggcaacaacacuccaguuaccagaagacauugagcagauggcaaaugguauagcauuaggacugauggcauuaaaacuuauuacucaauuugaaauauaccaacuuuggaccgcucugauaaguuuaacguguucgaacaccauuuucacacucacuguagcuuggagaacggcuacacuuauacucgcaggcguaucacuauuacccguuugccaaaguagcucuaugcguaagacugacuggcuaccaauggcuguugccgcgaugggcguaccaccacucccccuauuuauauuuucguuaaaagauacguuaaaacggaggagcuggccauuaaaugaagguguuauggcaguaggucuaguuagcauuuuagcuagcaguuuacuaagaaacgacgucccuauggcaggaccauuaguggcggguggacuacugaucgccugcuauguuaucacugggacaucagcugauuuaaccguagaaaaagcugcugacauuacuugggaagaagaagcggaacaaacuggagucucgcauaauuuaaugaucaccguagaugaugaugguaccaugagaauaaaagacgaugaaaccgaaaacauucuuacuguucuacuaaaaacagccuuauuaauugugucgggaauauuuccauauagcauaccggcgacccucuuaguuuggcauacuuggcaaaaacaaacacagcgauccggaguacuaugggacguaccaagucccccggagacccaaaaagcugaauuagaagaggguguguauaggauaaaacagcaagguauauucggaaagacccaggucgguguaggaguacaaaaggaaggaguauuucauacuauguggcaugugacuagaggcgcggucuuaacauauaacggcaaaagacuagagccuaauugggcaucagucaagaaagaccuuauaucauacggaggcggcuggagauugucuacccaauggcaaaaaggugaggaaguccaggucauagcaguugagccuggaaagaacccgaaaaauuuccaaacaaugcccggaacuuuucagacaacaacuggcgaaauuggugcgauugcucuugauuuuaaaccgggaacaaguggaagucccauaauuaacagagaagguaaaguuguaggucuauauggaaacggaguagucacuaagaacggaggauauguaagugggauugcucaaacaaaugcugaaccagacggcccgacuccugaacuugaagaggagauguuuaagaaacguaaccugaccauaauggacuuacacccagggaguggcaaaacaagaaaguaucuaccggcuauaguacgggaagcaauaaaacggcgacuccguacauugauucucgcuccuaccagaguuguagcugcggaaauggaagaagcucucaagggauuaccaauccgguaucagacaacagccacaaaaagcgaacacacuggacgagaaauaguagaucucaugugucacgcaacguuuacaaugcgguuacuuucuccaguuagagugccaaauuauaaccuaauaauaauggaugaggcgcauuucaccgaucccgcgaguauagcagcucgugguuacaucucaacaagaguaggcaugggcgaggcugcggcgauauuuaugacagcaacaccgccagguaccgcagaugcauucccucagucuaacgccccaauacaagaugaagaacgugacauaccagagagaucauggaacucaggcaaugaguggaucacugacuuugcagggaagacaguuugguuuguaccaucuauaaaagcggguaaugauauagcaaauugucuaaggaaaaaugguaagaaaguaauacagcucucucggaaaacauucgauacagaguaucagaaaacuaaauugaaugacugggauuuuguagugacaacagacauaucagaaaugggagcuaacuuuaaagcagacagaguaauugauccuagaagaugucuuaaacccguaauauuaacugaugguccagaacgggugauucuagcugguccaaugccaguuacagccgcuucagccgcccaaaggagaggaagagucgggaggaacccucagaaggaaaaugaucaauauauuuuuacgggucaaccacucaauaacgaugaagaucacgcacauuggacagaggcgaaaaugcuucuagauaacauaaauacaccagaagguauaaucccagcucuauucgaaccagaacgagaaaagagugcugcaauagauggcgaauacagauuaaagggagagucgcggaaaacauucguggaacuaaugcgccguggagacuuaccgguaugguuagcgcauaaaguagccagugaggguauaaaauacacagauagaaaauggugcuucgauggucaacgaaacaaccaaauauuagaggaaaacauggauguugaaaucuggacuaaagaaggggagaaaaagaaacucagaccgagauggcuugacgcgcguacuuacucagauccguuagcauuaaaagaauuuaaagauuuugcagcugggcgcaaaucaauugcgcuugaucugguuacugaaauaggacgaguaccaagucaucuagcgcauagaacaaggaaugcacuggacaaucuagucauguuacacacgagugagcacggaggcagagccuaucggcaugccguugaagaacuaccugagacaauggagacauuauuacuauuagggcuuaugauucuauugacagguggagcuaugcuguuccuaauuaguggaaaagguauuggaaaaacaucaauuggguugauaugcguuauagcuagcucggggauguuauggauggcugaaauaccccuacaguggauugcuucagcgaucguccucgaguucuuuaugaugguuuugcucaucccugagccagaaaaacaaagaacaccacaggauaaccaacuggcauauguaguaauuggcauucuuaccuuagcugcaauaauugcggcaaaugaaaugggccuacuugaaacgaccaagagggaccuuggaaugucaaaggaaccagguguaguaucaccaacgucauaccuagauguugaccuucaucccgcuagugcuuggacccuauacgcgguagcuaccacagucauuacaccuauguuaagacauacaauagaaaauucuaccgcaaacgugagucuugcggcuauagcuaaccaagcugucguccucaugggcuuagauaaaggauggcccaucaguaaaauggaccuaggaguuccacuacuggccuuagguuguuauucacaaguaaacccauuaacuuuaacagccgcgguuuugcuuuuaauaacgcauuacgccauuauaggcccagguuugcaggccaaagcaaccagagaggcacagaagcggaccgcagcaggaauuaugaagaaccccacaguagauggaauaaugacuauugauuuagauccugucauuuaugacucgaaauuugagaaacaauugggacaaguaauguuacugguucugugcgcgguacaauuauuacuaaugcguacuucaugggcguugugugaggccuuaacacucgcaacaggucccauaaccacgcuaugggaagggucuccugguaaauuuuggaauacgacuauagcuguaucaauggccaauauuuuucgcgguucuuacuuagccggggcaggacuagcuuuuucaauuaugaaaagcgugggcacuggaaaaagagggacuggaagccagggugaaacacucggugagaaguggaagaagaaacugaaucaacuuagcagaaaggaauuugaucuauacaaaaagucagggauaaccgaaguagauagaacagaagcaaaagaaggguuaaaaagaggcgaaaucacucaccacgcagucagucgagguucugcaaagcuccaaugguuuguagaaagaaacaugguaauuccggaaggacggguaauugaucuuggaugcgggagaggagguuggucuuauuacugcgcuggcuuaaagaaagucacugaaguuagaggguauacgaaagggggaccuggucacgaggaaccuguaccuauguccacuuauggcuggaacauaguuaaauuaaugucaggaaaagacguguuuuaucuacccccggaaaaaugugacacauuacucugugauaucggagaaucaaguccaagcccaacaguugaagaaagucggacgauacggguacuaaagaugguagagccauggcuaaagaacaaucaguuuuguauuaaaguuuuaaacccauauaugccgaccguaauugagcaucuagaaaggcuacaaagaaaacacggagggaugcucgucaggaauccucuaucccgaaauucgacgcaugaaauguacuggaucucaaacggaacaggaaacauaguagccucgguaaauaugguaucacgguugcuccuaaauagauuuacaaugacacacaggagaccgacaauugaaaaagauguagaccuuggagcaggaacuaggcacgucaaugcagaaccagagacaccuaauauggauguaauaggugaaagaauuaaacgaauaaaagaggaacacaacagcacuuggcauuaugaugaugaaaauccuuauaaaacaugggcauaucaugguagcuaugaaguuaaagcgacggggucagcauccucaaugauaaauggagucgugaaacuucuuacaaaacccugggauguaguuccuaugguaacucaaauggcuaugaccgauacaacuccguuuggccaacagcgaguuuuuaaggaaaaaguagacacaagaacaccucgcucaaugccugguacucguagaguaaugggaauuacagcagaguggcuauggcgcacacuaggucguaauaagaaaccacgacuaugcacgagagaagaauuuacgaaaaagguaagaacaaacgcugcaaugggugcagucuucacugaagaaaaucaaugggacucagcaaaagcggccguagaggaugaggauuucuggaaauuagucgaccgcgaaagggaacuacauaaauuaggaaaaugugguagcuguguauacaacaugaugggcaaacgggagaagaaacuaggugaauuuggaaaagccaaaggauccagagcaauuugguauauguggcugggggcacgauaccuagaauuugaagccuuagguuuccuuaacgaggaccacugguuuagucgagaaaacagcuacucgggagucgaaggugaagguuugcauaaguuaggauauauuuuaagagacauaucgaaaauaccaggaggugcuauguaugcugaugauacagccgguugggauacgcgaauaacagaggaugaucuccauaaugaggagaaaauaacacagcaaauggauccggagcauagacaacuugcaaacgcaauauuuaagcuaaccuaucaaaacaaagugguaaaaguucaacgucccacuccuacaggaacggucauggacauuauaagucggaaagaucagcgagguuccgggcaaguaggaacguaugguuuaaauacguucacaaacauggaagcacaacugauccgucaaauggagggggaaggaguauuaaguaaagcugaccucgaaaauccccaucugccagagaagaaaauuacacaaugguuggagacaaaaggaguugaaagauuaaaacggauggccauuucaggagaugauuguguagucaagccaaucgaugauagguucgccaaugcucuuuuagcgcuuaacgauauggguaaaguacgcaaagauauaccacaauggcaaccaucuaaaggguggcaugauuggcaacaagucccguuuuguucgcaucauuuucacgaacucauaaugaaagacggacgaaaguugguaguaccuugucguccucaagaugaauuaauaggccgagcacgaauuagccaaggcgccggauggucucuacgggaaacagcauguuuggguaaagccuaugcccaaauguggaguuuaauguacuuucaccgacgggacuuaagguuagcgaguaaugcuauuugcucugccgucccgguccauugggucccaacaaguagaacuacauggaguauacaugcucaucaucaauggaugacgacugaagauauguuaacuguauggaacagaguauggauagaagacaacccuuggauggaagacaagaccccagugacuacgugggaagauguaccauaccuugguaaaagagaagaucaauggugcgguagccuaauaggccuuaccucuagagcaacuugggcacagaacauuccgaccgcaauacagcaaguaagaagccuaauugguaaugaagaauuucuugacuauaugccauccaugaaaagauucaggaaagaagaagagucagaaggagccauuugguag

SEQ ID NO: 23257 - RNA, 9873 nt, Artificial Sequence
  derived and/or modified CDS sequence (opt6) from DENV-3__KJ189274__SS-prME
acgaguuuauguuugaugaugauauugccagcugcccuggcuuuccaucuuacaaguagagacggugaaccaagaaugaucgugggcaaaaaugaacgcggaaaaucuuuauuauucaaaacugcaucaggcauaaauaugugcacacuaaucgcaauggaccuaggagaaaugugcgaugacacugucacguauaaauguccucauauuaccgaaguagaaccugaagauaucgauugcuggugcaaucucaccucuacguggguuacuuaugggacauguaaccaagcuggagaacauagacgggauaaaagaucaguagcacuugcuccacacguagggaugggauuagauacucggacucaaacuuggaugucagcagaaggugcuuggagacaaguugaaaaaguagaaacgugggcacuacgacacccaggauuuacaauucuagcucuauuccuggcccauuauaucggcacaaguuuaacacaaaaaguuguuauauuuauauuacucaugcugguaacuccaucaaugaccaugagaugugugggcguggggaauagagauuuuguagaaggucugucuggggcaacguggguggaugucguauuagaacauggaggaugcguaacaacgauggcuaaaaauaaaccuacgcucgacauugaacuacagaaaacggaagcaacacaauuagcuacacuccgaaaauuauguauagaagguaaaauaacaaauauuacaaccgauaguagaugccccacgcagggagaagcaguucucccugaagaacaagaccaaaacuauguauguaaacacacuuauguagauagaggguggggcaaugggugcggcuuguuugggaaagguucucuuguuacaugugcaaaauuucagugucuagaaccuauagaaggaaaaguaguucaauaugagaaccuaaaauauacaguaauuaucaccguacacacaggugaucaacaucaaguaggaaacgagacacagggaguuacggcggaaauuacaccacaagcaaguaccacagaagcgacuuuaccagaguacggcacauuagguuuggaauguuccccucgaaccggauuggauuucaaugaaaugauccuacuaacuaugaaaaauaaagcauggaugguacauagacagugguucuuugaccugccacuuccguggacaaguggugcgacuaccgaaacuccuacuuggaaucgcaaagaauuacuggugacauuuaaaaacgcacacgcuaagaaacaagaaguaguuguauuaggaucgcaggaaggugcaaugcauaccgcuuuaacaggagcgacagaaauucagaauagcggcggaacaaguauuuucgcuggacaucuuaaaugcagacugaaaauggauaaacuagaauuaaaaggaaugucuuacgccauguguacuaacacuuucgugcuaaagaaagaagucuccgaaacacaacacggaacaauuuuaaucaaaguggaauauaaaggagaagacgccccuuguaagauuccuuucucgacugaggauggccauggcaaagcucacaauggaagacuuauaacggcaaacccaguaguuaccaagaaagaagaacccguaaauauagaagcagaaccgccauuuggugagucuaacaucguaauugguauaggcgauaacgcgcugaaaauaaacugguacaaaaaggggaguagcauuggaaaaauguucgaggcaacagcccgcggugcgcgaagaauggccauauuaggagauacagcuugggacuuuggaucuguugguggcgucuugaauagcuuaggcaaaaugguucaucagauuuucgguagugccuauacugcucucuuuagcggaguauccuggguaaugaaaauaggaauagguguauuacuaacauggauuggauuaaauaguaaaaauaccucuaugucuuuuucuuguaucgcuauaggcauuauaacccuauaucuaggugcaguuguacaagcugauaugggauguguaauuaacuggaaaggaaaagagcucaaauguggcagcgguauuuucguuacgaaugaaguucacaccuggacggaacaguauaaauuccaagcagauaguccaaaaagauuagcaacugcaauagccggugcaugggaaaaugguguuugugguauaagaucaacuacaagaauggaaaaucuauuauggaaacagaucgccaacgaguuaaauuauauucuaugggagaauaauauaaaauugacgguaguugucggcgauauuaucggaguuuuggaacagggaagaagaacacucacgccacaaccgauggaauuaaaauauucuuggaaaacaugggguaaggcaaaaauagugacugcagaaacacaaaauuccaguuucaucauugacgggccaaauacaccugaauguccaagugccucacgugcuuggaacguaugggaggucgaggauuauggguuugguguauucacaacaaauauaugguuacgacuacgggaagucuauacucaguuaugcgaucacagacuaaugagcgccgcuguaaaagacgaaagagcuguucacgccgauaugggauacuggauagaaagccagaaaaauggaucauggaaauuggaaaaagcuagccuuauagaaguuaaaacauguacuuggccuaaaucucacacucucuggucaaaugguguacuagaaagugauaugauaauacccaagagcuuagcaggaccuauuagucaacauaaccacagaccuggguaucauacacagacagcaggaccguggcaccuagguaaacuugaacuugacuuuaacuacugcgaaggcacgacuguaguuaucacugaaaauuguggaaccagagguccgucgcuuaggaccacuaccgucagcggcaaauuaauucacgaauggugcugucguucgugcacacuuccaccauuaagguacaugggugaagauggcugcugguaugguauggagauaaggccaauaucugaaaaagaagaaaacaugguaaaaagucuuguaagugcagggagcgguaaaguagauaacuuuacgaugggaguuuuauguuuagcaaucuuauuugaagaaguuaugcgagguaaauuuggcaagaaacauaugauugcgggcguuuucuuuacuuuuguucuacugcuaucgggacaaaucacauggcgggacauggcacauacucuuauaaugauugguaguaacgcuucagacagaauggguaugggaguaacauauuuagcacuaauugcaaccuuuaaaauucaaccuuuucuugcucugggauuuuucuuacgaaaacuaacaucaagagaaaauuuacugcucggaguuggccucgccauggcaacaacauuacaauuacccgaagacauagaacaaauggccaacgguauugcauuagggcuuauggccuuaaaauuaauuacacaauucgaaauauaucaacuauggaccgcauugauuuccuuaacauguuccaauacgauauucacucuaacggucgcguggagaacugccacucucauacuggccggagucucauugcuucccgugugucaaucaaguucuaugcgaaaaacagacugguuacccauggccguugcagcaaugggggugcccccacuaccccuuuuuauuuucaguuuaaaagauacgcuuaaaagaagauccuggccacuaaaugaagguguuauggcuguggguuuagugucaauucuugcgagcagucuccugcgcaaugacguuccgauggcuggaccucuagucgcuggcggacuguuaauagcuuguuauguuauaacuggaacgucggcugaucugacuguugagaaagcagcugacauaacuugggaagaagaggcggaacaaacgggaguaucacacaauuuaaugauaacuguggacgacgauggaacaaugaggaucaaagaugaugaaacugagaauauccuuacaguauuauuaaaaacugcauuacuaauuguuuccggaauuuucccauauaguauaccagcaacauuauuaguauggcauaccuggcagaaacaaacccaaaggucagguguacuaugggauguaccuucaccuccagaaacgcagaaggcugaguuagaagaaggaguuuaucguauaaaacaacaggguauauucggcaagacucaaguagguguagguguacaaaaagaaggaguauuccacacaauguggcacguuacaagaggagcuguccugacauacaacgguaaaaggcuagaacccaauugggcaucggucaaaaaggaccucauaaguuacggggguggcuggagacuuucgacccaauggcagaaaggggaggaaguacagguuauagccguugagccgggaaagaaucccaaaaauuuucaaaccaugccagguacguuccaaacgacaacuggcgaaauaggagcuauagcauuagacuuuaaaccaggcacaagugguucuccgaucaucaacagagaaggaaaaguaguuggcuuauacggaaacggaguagucacuaaaaauggcggauaugugucagguauagcgcagaccaaugcagaaccagacggccccacucccgaauuggaggaagaaauguuuaagaaaagaaaccuaacaauaauggauuuacacccggguagcggaaagacgagaaaauacuuacccgcgauaguucgagaagccauaaaaagaagauuacguacguuaauacucgcucccacacgagugguugcugcugaaauggaagaagcauugaaaggauuacccauaagguaccaaacaacagcaaccaaaucggaacacacgggcagagagaucguugacuuaaugugccaugcaacuuuuacaaugcgauuguuaucuccaguaaggguaccuaacuauaauuuaauaaucauggaugaggcucauuuuacugaccccgcuagcauugcugcgcgcggguauaucucaacaagaguagggaugggggaagcagccgcuauauucaugaccgcgacucccccaggaacagcugacgcauucccgcagaguaacgcgccuauacaagacgaagaaagagauauaccagaaaggaguuggaauagugguaacgaguggaucaccgauuuugcaggaaaaaccguaugguuuguaccgaguauaaaagcgggaaaugauauugccaauugccugaggaaaaauggcaagaaaguuauucagcuaucuagaaagacauuugauacugaauaucaaaagaccaaacuaaaugauugggacuuuguaguaacaacugauauaucggaaaugggagcaaauuuuaaagcagaucggguaauagacccacgucgcuguuuaaagccagucauauuaacagaugggccggaaaggguuauacuugcaggcccuaugccuguuacugcagccagugcugcucagcgcagggguagaguagguagaaauccacaaaaggagaacgaucaguacaucuuuacagggcaaccuuuaaacaaugacgaagaccaugcacauuggacggaagcaaaaauguuauuagacaacauuaacacuccagaaggcaucaucccugcauuauuugaaccagagagagagaaaagcgcagcaauugacggcgaauauagacuaaaaggagaaaguaggaaaacauucguagagcucaugaggcguggggaucucccgguaugguuagcgcauaaaguugcgucagagggaauaaaauauacagaccgcaaguggugcuucgaugggcagcggaacaaucagauauuggaagagaacauggauguagaaauauggacaaaagagggugagaagaagaaacugcguccuagaugguuagaugcaagaaccuacagugacccccuagcacuuaaagaauuuaaagauuuugccgcugggcgaaaaucaauugcacuugaucuagucacugaaauuggacgugugccuucacauuuagcucaccggacuaggaacgcccuugacaaccucguaaugcuucacacaucagaacauggaggacgugccuacagacacgcagucgaggaacuaccugaaaccauggaaacgcuacucuugcuaggauuaaugauacuccuuacagggggugccaugcuauuccuaaucaguggaaaaggcauagguaagacgucaauagguuugauuugcguaaucgcaucuucugguauguuauggauggcugagauaccacuacaauggauugcgagugcuauaguacucgaguucuucaugaugguuuuacuaauacccgaaccugagaagcaaaggacuccacaagauaaccaauuagcuuauguagugauaggaauuuuaacauuagcggcgauaauugcugccaaugaaauggguuuacuagagacaacaaaaagagaccugggaaugucgaaggagccaggugucgugagccccacaucuuauuuggauguagaccuccauccugcgagcgcauggacauuauaugcggucgcaacaacgguaauuacaccaaugcuuaggcacacgauagaaaauucuacggcaaauguaucucuagccgccauagcaaaccaggcuguugucuuaaugggacuagauaaaggguggccaauaagcaagauggaucuaggcguaccgcuauuggcguuggggugcuauagccaaguaaacccuuugacccucacugcagcgguauuacuauugauuacgcacuaugcuauaauaggacccgguuuacaggcuaaagcgaccagggaggcacaaaagcgaacugcggcugggaucaugaaaaaccccaccguugacgguauuaugacgauagauuuagaccccguaauuuacgacagcaaauuugagaagcaguuagggcaaguuaugcugcucgucuuaugugccgugcaauuauuauugaugagaacaucgugggcguugugugaagcucucacuuuggcaacugggccuauuacuacccuaugggaaggcucaccuggaaaauuuuggaauacaacaaucgccguaucaauggcaaauauauuuagaggaaguuaucucgccggugcaggacuagcuuuuucaauuaugaaaucggucgguacuggcaaacgagguaccggcagucaaggcgaaacacuuggcgaaaaauggaagaagaaauugaaucagcuaucgagaaaggaguucgaccuauacaagaaaagcggaaucacagaagucgacagaacagaggcuaaagaaggucuaaaacgcggagaaauaacccaccacgcuguuagccgcggaagugcuaaacugcaaugguucgucgaacggaauaugguuauaccugaagggaggguaauagaucucgguuguggaagaggcggcuggaguuauuacugcgccgguuugaagaaaguaacugagguacgaggcuauacgaagggugguccagggcacgaagaaccuguuccaaugucaacauacggcuggaauauuguaaaacuaaugagugggaaagauguuuucuauuuaccaccagaaaagugcgauacucuacuaugugauauaggagaaucaucucccucacccacgguagaagaaaguagaaccauaagaguauugaaaaugguagagccuuggcucaagaauaaucaauuuuguauuaaagugcuaaacccuuacaugccaacaguaauugaacauuuagaaagacuucagcguaagcauggaggaaugcuggugcgaaauccuuuaucaagaaacagcacacacgagauguacuggauaucaaauggaacgggaaauauaguagcaaguguaaauauggugucucgucuacuucugaaucgauucacaaugacccaccguagaccaaccauagaaaaagacguggacuugggugcagguacacggcacguuaaugcagagccggaaacacccaauauggacgugauaggcgaacguauuaaaagaaucagggaagaacacaacucaaccuggcauuaugaugacgaaaauccguauaaaacaugggcauaccauggaaguuaugaaguaaaagcaacuggcucagcuucauccaugauaaacggugugguaaaacuauuaacuaagccaugggaugugguaccaaugguuacccagauggcuaugacugacaccaccccguuuggacaacaacgugucuuuaaagaaaaaguagauacuaggacacccagauccaugccuggcacacguagaguaauggguaucacagccgaguggcuuuggcgaacauugggaaggaacaagaaacccagguuguguacucgcgaagaauuuacuaagaaaguacguacgaaugcagcuaugggcgccguuuuuacugaagagaaucagugggauagcgcuaaagcagcaguagaggaugaagacuuuuggaaguuagucgacagagaacgagaacuacacaaacuugguaaauguggaucauguguuuacaauaugauggguaaaagagagaagaaauuaggggaauuugguaaagccaaagggagucgagcaauaugguauauguggcuaggagcuagguaucucgaguucgaggcacucggguuucuaaacgaagaccacugguuuucgagagaaaauaguuacuccggaguagagggcgaaggucuacauaaguuaggcuauauuuugagagauaucagcaaaauaccuggcggcgcaauguacgcagacgauaccgcagguugggauacaagaauaacugaggaugaucugcauaacgaagagaaaaucacgcaacaaauggacccggaacauagacaauuagcaaacgcaauuuucaaauugacuuaucaaaauaaaguugucaaaguacagagaccgacgcccacaggcacgguaauggauaucaucagucguaaagaucaaagaggguccggacagguaggcacauauggcuuaaauaccuuuacuaauauggaggcccaguuaauccgacaaauggaaggugaaggaguucucaguaaggcugauuuggagaacccccaucuaccggagaagaaaaucacucaauggcuagaaacuaaagguguagaaaggcucaaaagaauggcuauaucgggagacgacugcguaguaaaaccuauagaugaucgcuuugcuaaugcauuacuagcacuaaaugacauggggaaagugagaaaagauauuccucaauggcaaccuucgaaaggauggcaugacuggcaacagguaccuuucugcagccaucacuuccaugaguuaauaaugaaagacgguaggaaacugguaguuccuugucgaccgcaagacgaacucauaggacgugcgagaauaucccaaggggcagguuggucucuaagagaaaccgcauguuuggguaaagcauaugcacagauguggucgcugauguacuuucaccggagggaucuucguuuagcaucuaacgcaaucugcucggcuguaccaguacauuggguuccgacauccagaacaacuuggucaauucacgcucaucaccaauggaugacaacggaagauaugcuaaccguauggaacaggguauggauagaagauaauccauggauggaagacaagacuccaguaacgacaugggaggacguaccguaucucgguaaaagagaagaccaguggugugggucacucaucggucuuacuucuagggccacuugggcacaaaauauaccgaccgcaauacaacaaguuagaaguuuaaucggaaaugaagaauuucuagacuauaugccauccaugaagagauuccgaaaagaggaagaaucagagggagcaauuugguag

SEQ ID NO: 23258 - RNA, 9873 nt, Artificial Sequence
  derived and/or modified CDS sequence (opt6) from DENV-3__KJ189275__SS-prME
accucucugugucuuaugaugauauugccagcugcacuagccuuccaucuuacaucacgugacggcgagccucgaaugaucguugggaagaaugaacgaggaaaaucccuuuuguuuaaaacagcaucggggauaaacaugugcacauuaauugcaauggaccuaggggagaugugugacgauacggucacguauaaguguccccauauaacagaagucgaaccugaagauaucgacugcugguguaaucuaaccucgacauggguuacuuacgguaccugcaaccaagcuggugaacaucgaagagauaaacgcuccguagcauuagcaccucauguaggcaugggacuagauacaaggacacagacauggauguccgccgaaggagcuuggcgucagguugaaaagguugaaaccugggcauugcgucauccuggauuuacgauacuggcacuauuuuuagcccacuauaucggaacgaguuuaacacagaaaguaguaaucuucauuuuauuaaugcuaguaacuccaaguaugacgaugagauguguuggggugggcaauagagacuucguggagggauuauccggcgccacauggguggauguugugcuugaacacgggggcugugugaccacgauggcgaaaaacaaaccaacauuagauauagaauuacaaaagacugaagcaacacaacuggcuacauuaagaaaguuaugcauugagggaaaaauaaccaacauaacaacagauucaaggugcccaacucaaggcgaagcggugcugccggaagagcaagaucaaaacuauguauguaaacauacguacguugauagaggauggggaaauggguguggccuauucgggaaaggcagucuaguaacaugcgcaaaauuccaauguuuggagccaauagaaggaaaaguagugcaauaugaaaaucugaaauacacagucauuauaacagugcacacaggugaucaacaucaaguuggaaaugagacgcagggcguaacugcugaaauuacgccgcaagcuaguacaacagaagcaacacuaccugaguaugguacguuagguuuggagugcucaccucgaacuggcuuagauuucaacgaaaugauauuacugacgaugaagaauaaagcuuggaugguccaccgacagugguucuuugaccucccccuaccauggacaucaggugcaacuacggagacaccuacauggaaccgaaaagaacucuuaguuacuuuuaagaaugcgcacgcgaaaaaacaggaaguuguaguucuugguucacaagagggggcgaugcauacagcuuugacuggagccacugagauccaaaauagcggugguacaucuauauucgcagggcaucuaaaauguagacuaaagauggauaaacuugaacuaaaaggaauguccuacgccaugugcacuaacacauucguauuaaaaaaagaagugucggaaacgcaacacgguacaauucucauaaaaguugaauacaaaggcgaggacgcaccguguaaaauaccguucagcacugaagacggacaugguaaggcacacaauggacguuuaauaacugcgaaccccguaguaacaaagaaagaagaaccggugaauauagaagccgaaccgccauuuggcgaguccaauauaguaauuggaauaggagauaaugcccucaaaauaaacugguauaaaaaggggucuagcaucggaaagauguuugaagccaccgccaggggggcuagacguauggcaaucuuaggagauacagcaugggauuucggaagcgucggaggaguucuaaacuccuuagggaagaugguacaucaaauauuuggaucagcauauacugcuuuguuuagcggcgugucuuggguaaugaaaauugggauuggaguacuuuugacguggauaggguuaaauucuaaaaacacuucaaugagcuuuagcuguauagcaauugguaucauaacauuguauuugggagcuguuguccaggcagacaugggguguguaauuaacuggaaggggaaagagcuuaaaugcgguagcggaauauuuguuacaaaugaaguacauacguggacagagcaguacaaguuccaggccgacucacccaagcgucucgcaacagcaauugcgggagcaugggaaaauggggucugugggaucagaucuacgacacgaauggagaauuuacuauggaaacaaauugccaacgaauuaaacuacauucuaugggaaaauaacauaaaacuuacagugguaguaggugauauuauaggaguuuuagaacagggcagacggacuuuaacaccacaaccaauggagcuaaaauacucauggaaaacauggggcaaagcgaaaaucguuacagcagaaacgcaaaauuccagcuuuauuauugauggcccgaacacuccagaauguccuucagcgucaagggcuuggaacguaugggagguggaagauuacggauuuggcguguuuaccaccaauauuuggcugagacuaagagaagucuacacccaauuaugugaucauaggcuaauguccgccgcaguaaaagaugaacgcgcagugcacgcagauaugggguauuggauagagagccaaaaaaauggaucauggaaauuagaaaaagcgagcuuaaucgagguaaaaacaugcacuuggccaaaaucucauacacuauggaguaauggugugcuggaaagcgacaugauaauaccuaaaucccucgcuggacccaucucgcaacauaaccaccguccagguuaucauacacagacggcuggcccuuggcauuugggaaagcuugaacuugauuuuaauuauugugaagggacaacaguuguuauaacagaaaauuguggaacucgcggcccauccuugaggacuacaacggugucaggcaaacucauacaugaaugguguugccgguccuguacacuaccuccucuacgauacaugggcgaggauggaugcugguauggaauggaaauucgacccauuucugagaaagaagaaaauauggugaagucauuaguaagcgcaggaucaggcaagguugauaacuuuacaauggguguccuuugcuuagccauauuguuugaagagguaaugagaggcaaauucgggaaaaaacauaugaucgcugguguauuuuuuacuuucguuuugcuguuaagugggcaaauaaccuggagagacauggcacauacucuaauuaugauaggaucaaaugcaagugacagaaugggaauggguguaacauaccuagcucuuauugccacguuuaaaauacagcccuuucucgcuuuggguuucuuucuacgaaaguuaacgucaagagaaaaucuacuacucggaguagguuuagcuauggccacuacuuuacaacugccagaagauaucgaacaaauggccaauggaauugcuuuaggcuugauggcgcugaaacuaaucacacaauuugaaaccuaucaauuauggaccgcucucauauccuuaacuuguagcaacacuauauuuacguuaacgguagcauggcgaaccgcaacgcuuauacuggcuggcgugagucuauugccuguuugccaaaguucauccaugcggaaaacagacuggcuaccgauggccguugcggcaauggguguacccccauuacccuuauuuauuuuuucuuugaaggauacacuaaagagacguaguuggccgcuaaacgagggagucauggcaguaggacuaguuucuauauuggcuagcagcuuguuaaggaacgauguaccuauggcaggccccuuaguugccggcggcuuacuuauagcauguuauguuauuacaggcacuucagcggaucuaacuguugagaaagcagcggauauaacaugggaggaagaagcagaacaaacugguguaagucauaaccugaugaucacgguugaugaugauggcacuaugcgaauuaaggacgacgaaacggaaaacauacuaacgguacuuuugaagacggcuuuauuaauuguaucaggaauauuuccauauucaauaccugcgacgcuucugguauggcauacauggcaaaaacaaacgcaacgaagcgguguauuaugggauguuccgucaccaccagagacucaaaaagcagagcuagaggaggguguauacaggauaaaacaacaagggauauuugggaagacucagguaggcgugggaguucaaaaggaggguguguuucauaccauguggcauguaacaagaggggcuguacuaacuuacaaugguaaacgucuagaaccaaauugggcaucaguaaaaaaagacuuaauaucuuacggagguggcuggcgacugucaacacaauggcaaaaaggagaagaaguacagguaaucgcaguagagccugggaaaaauccaaaaaauuuccaaaccaugccugggaccuuccaaaccacuacgggggaaauuggagcaauugcacucgauuucaagccgggcacuaguggaucuccuaucauuaauagagaagguaaaguuguuggauuauacgguaauggaguagugacaaaaaacggaggcuauguuucuggaauagcucagaccaaugccgagccagacggaccaacacccgagcuugaagaggaaauguuuaaaaaaaggaaccucacaauuauggaccugcaucccggcuccggaaaaacacgaaaauaucucccagcaauuguccgagaagcaauuaaaagaagacugcgaacauuaauacuggcccccaccagaguuguagcagcugagauggaagaggcauuaaaaggccuaccaauaagauaccagacaacggccaccaaaagugaacauaccgggagagaaaucguagauuuaaugugccaugcaacauucacuaugcgauuacuaagcccaguccguguacccaauuauaaucuuauaauaauggacgaagcacauuuuacugaucccgcaucaauagcugcuagaggauauaucaguacuaggguaggcaugggcgaagccgcugccauauuuaugacagcgacacccccugggacggccgacgcauucccccaguccaacgcuccuauucaggacgaagagagagauauaccagaaaggucauggaauucagguaaugaauggauuacggauuuugcggggaagaccguaugguuugucccgaguauaaaagcgggaaacgacauagccaauugucuacgaaaaaacggaaagaagguaauacaauuaagcagaaaaacguuugacaccgaauaccagaaaaccaaacuuaacgauugggacuuugugguuacaacggacauuagugaaaugggagcgaauuuuaaagcagauaggguaauagauccucggagaugucuaaaaccagucauuuuaaccgacgguccggaacgugucauacucgcaggcccaaugccagugacggccgcaagugcagcucagcgacgagguaggguggguagaaauccgcaaaaagaaaaugaccaguacauauuuacaggacagccacuaaacaaugaugaagaucaugcacacuggacagaggccaaaauguuacucgacaauauaaacacaccugaaggaauaaucccggcucuguuugaaccugaaagagaaaaaucugcagcaauagauggagaauauaggcuaaaaggugaaucaagaaaaaccuuuguagaacuaaugagaagaggagauuuaccugucugguuagcacacaagguagcuagugaagguauuaaguacacagaucgaaaguggugcuuugacggucaaagaaauaaccaaauauuggaagaaaacauggauguagaaaucuggacaaaggaaggcgaaaaaaagaaacuaaggccacgcugguuggaugcucgcacauacagugacccgcuugcccucaaagaauuuaaagauuuugcugccgguagaaagaguauagcacuagauuugguuacagagauagguagagugccaucucauuuagcacacaggacuagaaacgcauuagacaauuuaguuauguuacauacaagugagcacgggggcagagcauacagacacgcgguagaagaacucccugaaacaauggaaacauuauuauuacuuggucuuaugauacuuuugaccggaggugcgaugcucuuuuuaauaaguggaaaaggaauuggcaagacgagcauuggacuaauaugcgucauagcuagcucgggaaugcuauggauggcggaaauaccgcuucaauggaucgcuucagcgauaguacuugaguuuuuuaugauggucuuacuaauaccagagccagaaaagcagcgcacgccacaagacaaccaacuggcauacgugguaauaggaauauuaacgcuugcagcaauaauagcugcuaacgaaaugggucuucuugagacgacaaaaagagacuuaggcaugucgaaagaaccaggagucgugaguccgacaucuuaucuagacguugauuuacauccugccagcgccuggacccuuuacgcgguagcaacuaccgucauaaccccaaugcuucgccauacuaucgaaaacaguaccgcaaauguaagccuggcugcaauagccaaccaagcuguaguucuuaugggacuagacaaggguuggcccaucaguaagauggaucucggagugccacuacuugcacugggcuguuauagccaagugaacccauuaacauugacugcugccguuuuauuguuaauaacacauuaugcuauaaucgguccaggucuacaagcuaaagccacacgagaggcacaaaaaagaaccgcugcaggcauuaugaagaauccaacuguagaugggaucaugacgauagaucuugacccaguaauauacgacuccaaguuugaaaaacaguuaggucaaguuaugcuauuaguccuaugcgcaguacaacuacucuuaaugagaacuuccugggcacuuugcgaagcgcuuacacuugcaacaggaccaauaacaacacuaugggaagggucgccagggaaguuuuggaacacuacaauugcggucucgauggcaaauauauuuagaggauccuaucuagccggagcuggcuuggcauucuccauuaugaaaucgguagguacgggaaaaagggggacaggaucacaaggcgagacgcuaggagaaaaauggaaaaaaaaauugaaccaauuguccaggaaagaauuugacuuauacaagaaauccggcauaacagaaguagaucgcacagaagcaaaggaaggucuaaaacgaggcgaaauaacacaccaugcaguuuccagaggauccgcuaaauuacaaugguuuguagagcguaauauggucauaccugaagguagggugauagacuugggcugcggccgaggaggguggagcuauuacugugcugguuugaaaaaggugaccgaaguacgaggguacacuaaaggagguccugggcacgaagaaccaguaccuaugaguacauauggauggaacauaguaaaacugaugucggggaaagauguauuuuaucuuccgccagaaaaaugugauacacuucugugcgacauuggagaaagcagcccaaguccaacuguagaagaaucgcgaacuauuagagugcuaaaaaugguugaaccuugguugaaaaacaaccaguuuugcauuaaaguucuaaaccccuauaugccaacgguaaucgaacaucuagaacgacugcaaaggaaacacgguggaauguuaguaagaaacccucuaagccgcaauaguacccacgaaauguacuggauaaguaauggaacaggaaauauuguugcaucggucaacaugguaucgaggcucuuauugaaucgauucaccaugacucaccguagaccaaccaucgagaaagauguagauuuaggugcuggcacacgccacgucaacgcagaacccgaaaccccuaacauggauguuauuggggaaaggauuaaaagaauuagagaagaacauaauucuacuuggcacuaugacgaugagaaucccuauaaaacaugggcuuaccauggcuccuacgaaguaaaggcuacuggaucugcaucaaguaugauaaacgggguggugaaguuauugacaaaacccugggauguuguuccaauggugacgcaaauggcaaugacagauacuaccccguuuggacaacagcgaguauuuaaggaaaaaguagacacaagaacuccaagauccaugccagguacgagaaggguuauggguauaacagcagaaugguuguggcgaacccucggccgcaacaaaaaaccgagauuguguacaagagaagaguuuacaaaaaaaguucgaacgaaugcggcaaugggugcaguguucacagaagaaaaucagugggacagugcgaaagcugcuguugaagaugaagacuuuuggaaacucguagacagagagagagaauuacauaaacugggcaaaugugguucgugcguuuacaauaugauggguaaaagagaaaaaaagcuaggagaauucgggaaagcgaaagguucaagagcuaucugguacauguggcugggggcacgauacuuagaauucgaggcuuuagguuuucugaaugaagaucacugguuuucuagggagaauaguuacucaggcguggaaggcgaaggucuccauaaguugggauauauccuacgagauauuaguaagaucccaggcggugcaauguaugcagaugacacugcgggaugggauacgagaauaaccgaagaugauuuacauaacgaagagaagaucacgcaacagauggaucccgaacauagacaacuagcaaacgcaaucuuuaaauugacuuaucaaaacaaaguuguaaaaguucaaagaccaacaccaacaggaacgguuauggacauuaucucacguaaagaucaaagagguuccggccagguaggaacauacggccuaaauacauuuacaaauauggaggcccaauuaauacgccagauggagggugaggggguauugucuaaagccgaucuugagaauccacaucuuccugaaaaaaagaucacgcaauggcucgaaacgaaaggagucgaaagauugaaaaggauggccauaucuggagaugauugcguaguaaaaccgauugacgaccgauuugcaaacgcacuucuggcguugaaugauauggggaaaguccggaaggacauuccgcaauggcaacccucaaaagguuggcacgacuggcaacaagucccauuuuguagucaucauuuccaugaauuaauuaugaaagauggucgaaaauuaguggucccuugcaggccacaagaugaacuuauaggaagggcuaggauuagucaaggcgcugguuggagccugagggaaacagccugccuaggcaaagccuaugcccaaauguggucauugauguauuuccacagaagggacuugagguuggccagcaaugcgauuuguucagcuguaccagugcacuggguuccaacaagucgaacaacguggucgauacacgcucaccaccaauggaugacaacagaggauauguuaacaguauggaaucgcgucuggauugaagauaacccuuggauggaggacaagacacccguuacuacaugggaagauguaccuuacuuagguaaacgagaagaucaaugguguggcagccuuauuggccuaacaucgcgagcaacaugggcacagaacaucccuacagcaauccagcaaguaagaucgcuaaucgguaacgaggaauuucucgauuacaugccauccaugaaacguuucagaaaggaagaagaaucugaaggcgcaauuugguaa

SEQ ID NO: 23259 - RNA, 9873 nt, Artificial Sequence
  derived and/or modified CDS sequence (opt6) from DENV-3__KJ189276__SS-prME
acguccuuauguuuaaugaugauauugccugcugcuuuggcuuuucauuuaacuucuagggacggggaaccgagaaugauagugggcaaaaaugaacgcgggaaaagccuacuauucaagaccgcuagcggaauaaauauguguacauugauugcuauggacuuaggugaaaugugcgaugauacuguaacauauaaguguccacauaucacugagguugagccagaggauaucgacuguugguguaauuuaacaaguacuuggguaacauauggaaccuguaaucaggcgggcgaacacagacgcgauaagaggucgguagcucuagcaccccauguaggaauggguuuggauacaaggacccaaacguggaugucagccgaaggagcguggcgccagguagaaaagguugagacuugggccuuacgacauccugguuucacgauacucgcuuuguuucuggcacauuauauaggaacuucauuaacacaaaaaguagugauuuuuauucuacucaugcuuguaacaccaucuaugaccaugagauguguugguguuggaaauagagauuucguggagggauuaagcggagccacauggguugauguuguacuagagcauggcggaugugucacaacaauggccaaaaauaaaccaacacuugacauagaguugcaaaagacugaagcuacucaauuagccacucucagaaaacucuguauagaagguaaaauuacuaauauuaccacagauagucgauguccaacacagggugaagcuguacugccugaagaacaagaucagaauuauguauguaaacacacauacguugacaggggcugggguaauggcuguggccuauucgguaagggaagcuuaguuacuugcgcuaaguuccaaugucuagagccuauagaagguaaggucguucaauaugagaacuuaaaauauacaguaaucauaaccguucauacaggagaccagcaucaaguggggaacgaaacccaagggguaacugcagaaauuacuccucaagcaucuacuaccgaagccacauuacccgaauauggaacguuaggguuacaguguuccccaaggaccggcuuagacuuuaaugaaaugauccuacuaacaaugaaaaauaaagccuggaugguucaucgacaaugguucuuugacuuaccccuaccauggacuaguggagcgaccagcgaaacaccaaccuggaaucgaaaagaauuauuaguaacuuucaagaaugcacaugcaaagaaacaagaaguuguuguacucggaucacaagaaggcgcgaugcauacagcacuaacaggcgcaacggaaauacagaauucggguggaacaucaauauuugcuggacaucucaaaugucgauuaaaaauggacaaauuagaguuaaaagggauguccuacgccauguguacaaauacuuuuguccuaaaaaaggaaguaucagagacacaacacgguacgauccuuauuaaaguagaauauaaaggcgaagaugcgccaugcaaaauaccauucaguacugaggauggacauggaaaagcacauaauggaagacuuauuacugccaacccaguugugacaaaaaaggaggagccagucaacaucgaagccgagccaccuuucggagagagcaauauuguaauuggcauuggggauaaugcuuuaaagauaaacugguauaaaaaagggaguuccauaggcaaaauguuugaagcuaccgcacgcggagccagaagaauggcaauacuaggugauacagcgugggauuuuggaucgguaggaggcguacugaacucgcuuggcaaaaugguacaccagaucuucggaagugcauauacagccuuguuuucuggugucucaugggucaugaagauagguauagggguccuucuaacauggauuggauuaaauucaaagaauacaucgaugaguuucucauguauagccauaggaauaauaacauuauauuugggagcuguaguacaagcagacaugggcuguguaauuaauuggaaaggaaaagaguuaaaauguggaucugguaucuuugucaccaacgaaguacacacguggacagagcaauacaaauuucaagcugacagucccaaacgucucgcgacggcaauugcuggcgcaugggagaacggagucuguggaaucagaaguacaacuagaauggaaaaucuucuauggaagcagauagcuaaugagcuaaacuauauuuuaugggaaaauaauaucaagcuaaccguuguagucggugauauuauagguguacucgagcaagggaaacgaacauugacgccacagccuauggaauuaaaguauucguggaaaacaugggggaaagcaaaaauugucacagccgagacacaaaauaguucguuuauaauugauggaccaaacacgcccgaguguccaagugcuucaagggccuggaacguaugggaaguugaggacuaugguuuugguguauucacaacgaauauaugguugagacuacgugaaguuuauacacaauugugcgaucauagguugaugagcgcugcuguaaaagacgaaagggcaguacaugcggauauggguuacuggauagagucacagaagaauggaucauggaagcuugagaaggcaaguuuaaucgaagucaagaccugcacauggccaaaaucacacacgcuauggagcaacggaguccuagaaagcgacaugauaauuccgaaaagucuagcaggaccaauuagccaacacaaucacagaccaggguaucacacccaaacugccgggcccuggcaucuaggaaaauuagaacuugauuucaacuacugugaaggcacgacggucgucauaacagaaaauugugguacucgcggucccucucuaaggacaacaacgguaucugggaaacuaauacacgaaugguguugcagaaguuguacucuuccuccacuucgguauaugggagaagacggaugcugguacggaauggaaauuaggccaauuucagaaaaagaagaaaauauggucaaauccuuagucucggcugggaguggaaaaguugauaauuuuacuaugggaguauugugccuugcaauauuauuugaagaaguaaugaggggcaaauucggaaagaaacauaugauagcuggcguuuuuuucaccuuuguccugcuccuuuccggucaaauaacauggagggauauggcacauaccuuaauaaugauaggaucaaaugcgucugaucgaaugggcaugggaguaacuuaccucgcgcucauugcuacauucaagauucaaccauuuuuagcauuagguuucuuccuaagaaaauuaacaucucgcgaaaauuuacuuuuaggggugggccuagccauggcaacuacucuacaauuaccugaagauauugaacaaauggccaauggaauugcauuaggauuaauggccuuaaaacuaaucacucaguucgaaacuuaccaauuauggacagcuuugaucucauuaacaugcucaaacaccaucuucaccuugacgguagcauggaggacagcuacauuaauacuagcuggugugagccuucugcccgugugccaaaguucgucaaugagaaaaacagauuggcuuccuauggcuguagcagcuaugggggucccaccccugccucuguucauauucucauuaaaagauacccuaaaacgacgaucauggccccuaaacgaaggaguuauggcaguaggauuaguaagcauacucgcguccucguuauugcgaaacgauguacccauggcaggaccgcuaguagcuggagguuugcuaauugccugcuacguuauaacggguacaagcgcagaucuuacagucgaaaaagcugcagauauaacuugggaagaagaggcagagcaaaccggaguaucacacaaucuaaugauaacaguugaugacgaugguacaaugcgaauuaaagaugacgagacagaaaacauccuaacggugcuguuaaaaacugcucuucuaauuguuucugguauauuucccuauucaaucccagcuacgcuucuaguauggcacacauggcagaaacaaacacagcgauccgguguauuaugggauguaccauccccacccgagacucaaaaagcagaacuggaagaaggcguuuauaggauaaaacagcaaggcauauuuggaaaaacucaggucggaguaggugugcaaaaagaagguguuuuucacacuauguggcaugugacacguggagcaguccuuacauacaaugggaaacgauuagagccgaacugggcuuccgucaagaaagacuuaauuucuuauggaggcgguuggagauuaaguacucaauggcaaaaaggugaagagguacaagucauagcugucgaaccugguaaaaauccuaaaaauuuucaaacaaugccagggacuuuccaaacaaccacgggcgaaauaggcgcgaucgcccuugacuucaagccagguaccuccgguucaccaaucauaaacagggaagggaaagucguggggcuauauggaaacggagugguaaccaaaaauggagguuauguuuccgggauagcacaaacaaaugcagaaccugacggcccaacgcccgagcuugaggaagagauguuuaaaaaaaggaaccuaacaauaauggacuugcacccagguucagggaagacccggaaguacuuaccagccauagucagagaagccauaaaaagacgacugcgaacccuaauauuagccccaacucggguagucgcggcagagauggaagaagcguuaaaaggauugccgaucagauaucagacuaccgcuacuaaaagugaacauacuggaagagaaauagucgaucucaugugccacgcuacauucacaaugcgauuguuaaguccaguuagaguccccaacuacaacuuaauuauuauggaugaagcccauuuuacugacccagccucgauugcagcucggggauacaucaguacacggguuggaaugggagaggcggcagccauauuuaugacagcaacucccccagggacagcugaugcuuuuccacaaucaaaugcuccgauucaagacgaagagcgagacauaccagaaagaaguuggaauagcgguaacgaauggauaacggacuucgcuggaaagacgguaugguucguaccuucaauuaaagcgggcaaugacaucgcuaacugcuuacgaaaaaauggaaaaaaaguuauucaacuuucacgaaagacauuugacacugaauaccagaaaacaaagcucaacgacugggacuuuguuguuacaacagauauaagugaaaugggggcaaauuuuaaggcugaccggguaauagacccgaggagaugucuuaaaccugucauauuaacggauggaccagaaagaguaauucuagcagguccaaugccugucacagcagcaagugcugcucaacgcagaggaagggucggacgaaauccgcagaaagaaaacgaccaguacauuuucacaggucagccccucaacaacgaugaggaucacgcccauuggacggaagcaaaaauguuacuugauaauauaaauacaccagaagggauaauaccggcccucuucgagccggagagggaaaaaagugccgcuauagauggggaauaucgcuugaagggcgaaucaagaaagacauuuguggaauuaaugagacggggggaucucccuguauggcuugcgcauaaaguugcuagcgaaggaaucaaauacacagaucgaaaauggugcuuugauggucaaagaaacaaccaaauacuggaggaaaauauggacguugaaaucuggacaaaagaaggggaaaagaaaaaacugcggccacguuggcucgacgcucgaacauacucugacccauuagccuuaaaagaauucaaggauuuugcugcggguaggaaaucuauagcucuagaccuuguuacugaaaucggaaggguaccaucacaccuagcccacaggacuagaaaugcccucgacaaucuggucaugcuucacacuagcgaacacgguggacgugcauaucgucacgcuguagaagaacuuccagaaacuauggagacuuugcucuuacuuggauuaaugauauuacuaacagguggagcaaugcuuuuuuuaauaucugguaaggggaucgggaaaacaucgauaggccuuaucugugucaucgcuucauccgguaugcuuuggauggcagaaauaccguuacaauggauagcguccgcuauaguccuugaguuuuuuaugaugguauugcugauaccugaaccagaaaaacaaagaacaccacaagacaaccaacuagcauauguaguaauuggaauacuaacacuugcagcaauuauagccgcaaacgaaauggggcugcuagaaacaacaaaaagagaccuuggcaugaguaaggagccuggugucguguccccgacaucuuaucuugacguggacuuacauccagccucagcguggacccucuaugcgguugcaaccacaguuaucaccccaaugcugagacacacaauagaaaacucaacagcuaacgucagcuuagcugccauagcaaaucaggcggucguccuaaugggacuagauaaaggauggccgauaucgaaaauggaccugggaguaccauugcuggcucuaggaugcuauagucaaguaaacccccugacauuaacagcagcugugcucuuacucauaacacacuaugcaaucauaggaccugguuuacaagcgaaagcaacgcgagaagcacaaaaaagaacagcagcgggcaucaugaaaaaccccaccguggacggcauaaugacgauagauuuggauccaguaauauaugacucaaaauuugaaaagcaauugggucaggucaugcuacuagugcucugugcugugcaacuuuuauuaaugcgaacaucgugggcgcuuugugaggcucuaacccuugccacaggcccaauaaccacacuaugggaaggaucgccagguaaguucuggaacaccacaauugcaguaucuauggcaaacauauuucgcggcucuuauuuagcaggugcuggcuuagcauucucaaucaugaaaucugucgggacuggaaaacgaggaacaggcucgcagggagagacauuaggagaaaaguggaaaaaaaagcuuaaucaauuaucacggaaagaauuugaucuauacaaaaagagugguauaacugagguagaucguacagaagcuaaggaaggccuuaaaagaggagaaaucacucaucacgccguuucuagagguucagcaaaauuacaaugguucguggaaagaaauaugguaauucccgaaggacgggucauagacuuaggauguggaagaggcgguuggucuuacuauugcgcaggucuaaaaaaggucacagaagugagaggcuauacaaagggaggaccuggucaugaagaacccguaccuaugucuacuuauggauggaauauaguuaaacuaaugagugggaaagauguguuuuaccuaccuccagagaaaugcgauacccucuuaugcgacaucggggaaucaucaccaaguccgacagucgaagaaaguaggaccauaagaguccugaaaauggucgaaccuugguuaaagaauaaucaauuuuguauaaaaguucuaaacccauacaugccaacgguaauugaacaucuggagagauugcaacgaaaacauggggggauguuagugagaaacccacuuucaaggaauucuacccacgagauguauuggauaaguaacggaaccggaaauauaguggcauccgucaacaugguaagcagacuucuguuaaauagauucacgaugacgcauaggcggccgaccauagagaaagacguugaccuaggagcuggcacuagacacgucaaugcugaaccagaaacaccgaacauggauguaauaggagaaaggauaaaaagaauaaaagaagaacauaacaguacauggcacuaugacgaugagaauccauauaaaaccugggcguaccaugguaguuaugaagugaaagcaacagguucagcuucaagcaugaucaauggaguuguaaaacuuuuaacgaaaccaugggacgucguuccgaugguaacacaaauggcaaugacugauacaacaccuuuuggacagcaaagaguauucaaagagaaaguugauacccgaaccccgagaucuaugccagggacgcgacgugucauggguauaacugcagaguggcuauggagaacucuggggagaaauaagaaaccacgcuuauguacacgcgaagaauuuacaaaaaaaguuagaacaaaugcagcuaugggugcaguauuuacagaagagaaccaauggaauagugcaaaagccgccguugaggacgaggauuuuuggaaauuaguggaucgugagagggaauuacacaaacugggcaaaugcgggaguugcguguauaauaugaugggcaaaagagaaaaaaaauuaggggaauuugggaaagcaaaagggucuagggcaaucugguacaugugguuaggugcaagauaucuagaauuugaagcucuaggcuuuuuaaaugaagaccacugguucucucgagaaaacucuuacuccggaguugaaggcgagggauugcauaaguuaggauauauccuacgagauauuucgaagauaccuggaggcgcaauguaugcagacgacacagcaggaugggauacuagaauaacugaagaugaucuucauaaugaggagaaaauuacccaacaaauggacccggagcauaggcgauuagcgaaugcaauauucaaauuaacuuaucaaaacaaagucgucaaaguacagcggccuacaccaaccggaacaguaauggacauuaucucccgaaaggaucagcgugguucaggacagguuggaacauacggacuuaacacauucacuaacauggaggcucaacuuauuagacaaauggaaggagagggcguccuuagcaaggcugacuuagagaacccacaccuaccagaaaaaaaaaucacacagugguuagaaacaaaaggaguugaacgauuaaaacgaauggcaauaucuggagacgacugcguuguaaagccuauugacgaccgguucgcaaaugcucuauuagcauuaaaugauaugggaaaaguaagaaaggacauaccucaauggcaacccucaaaaggauggcacgauuggcagcaagucccuuuuugcucucaccacuuucacgaacuaauuaugaaggacgggaggaaauuagugguuccgugucgaccacaagacgaauuaauuggcagggcgcgcauuucacaaggagcgggauggagccuccgagagacugcuugucuaggaaaagcauaugcacaaauguggagucuaauguacuuucauagaagggauuugcgauuagcaucgaacgcuauaugcagugcaguaccaguccauugggugcccacaagcagaacaacauggaguauucacgcgcaccaccaauggaugacuacagaagauaugcuaacaguauggaaccgaguauggauagaagacaacccuuggauggaagacaaaacgccaguaaccacaugggaagaugucccguacuuagggaagagagaagaucaauggugugguagccuaauaggauuaaccagccgagcgacgugggcccaaaacaucccaacagcaauucagcaagucagaucacuaauuggaaaugaggaguuuuuagacuacaugccaaguaugaaaagauuuaggaaagaggaggaauccgagggagccauuugguag

SEQ ID NO: 23260 - RNA, 9873 nt, Artificial Sequence
  derived and/or modified CDS sequence (opt6) from DENV-3__KJ189277__SS-prME
acuucauuguguuuaaugaugauuuuaccagcagcguuggcguuccaucuaacaagcagagacggugaaccgagaaugauuguaggcaaaaacgaaaggggaaaaucucuacuguuuaaaacugcaucagggauuaauauguguacguugauagcaauggaucuaggagaaaugugcgacgauacuguaacauauaaauguccucacauuacugaaguagaacccgaagauaucgauuguugguguaaucucaccaguacuuggguaacauaugggaccuguaaccaagccggugaacaucggagagauaaacgaucaguugcguuagcaccucauguagguauggguuuggauacacgcacucaaacguggaugucagcagaaggagcguggaggcaaguagaaaaaguugaaacaugggcauuacgacacccgggauucacaauauuagcuuuauucuuagcgcauuauaucgguaccucucuaacgcaaaaaguugugaucuucauauugcucaugcuaguuacaccuagcaugacaaugagauguguuggagucggaaaccgagacuuuguugaaggauuaagcggcgccacguggguagacguaguccuagaacacggugguugugugacaacgauggccaaaaauaaaccaacuuuagacaucgaauugcagaaaacagaagccacccaauuggcaacuuugcggaaacucugcauagaaggcaaaauuacaaauauuacaacugauucuagaugucccacgcaaggcgaagcgguguuaccggaagaacaggaucaaaacuauguuugcaaacauacauauguagaucgaggaugggguaacggcugcggguuguucgggaaaggcucccuaguaacaugugcuaaguuucaauguuuagaaccgauagagggaaaaguggugcaauacgaaaaccuaaaauacacaguuauaauaacaguucacacaggagaucaacaucaagucggaaacgagacccaaggaguuacggcagagauuaccccgcaggcaaguacaacggaagcaacgcugccggaauaugguacucuaggccugcaaugcucuccaaggacugggcuagauuuuaaugaaaugauucuacuaacgaugaaaaauaaagcauggaugguacauagacaaugguucuuugacuuacccuugcccuggacauccggggcuaccucagaaacccccaccuggaacagaaaagaguuauuaguuacuuuuaaaaaugcacaugcaaagaaacaagagguaguaguguuagguucacaagaaggggcuaugcacacagcacuuacuggggccacagaaauucagaacagcggagggacgucgauuuucgcagggcaccuaaaauguagauugaaaauggauaaacuugaauuaaaaggcaugucauacgcuauguguacaaauacuuucguacucaagaaagagguaucugagacgcaacacggaacaauauuaauaaaaguagaauacaagggcgaagaugcgccauguaaaauaccauuuucuacugaagaugggcaugguaaagcacauaauggccgucugaucaccgcuaaucccgugguaacgaagaaagaagaaccagucaacaucgaagcggaaccaccuuuuggagaaagcaauauaguaauaggaauuggagauaaugcccucaaaauuaauugguauaagaaagggucuaguauugggaaaauguuugaagcaacagcacggggugcucguagaauggccauuuuaggagacaccgcaugggauuuuggaucaguaggaggagugcucaauucacucgguaaaaugguacaccaaauuuucgggucagcauauaccgcauuauucaguggaguaucuuggguaaugaaaauagguauuggagugcuacuaacauggauuggauuaaacagcaagaauacuucaaugucguucucauguauugcgauaggcauaauaaccuuauauuuaggugcugucguacaggcggacaugggcuguguuaucaacuggaagggaaaagaacuaaaauguggaagcggcauauuuguuacaaaugaggugcauacauggacugaacaguauaaguuucaggcagacucucccaaaagguuagcgacagcaauagcaggagcuugggaaaauggagugugcggcauaagaagcacgacgcguauggaaaauuuacuauggaagcaaauagcgaacgaacucaacuacauuuuaugggaaaacaauauaaaacuuaccguugucguuggagacauuauaggaguauuagaacagggaaagcguaccuuaacgccucagccaauggaacucaaguauucguggaaaaccuggggaaaagccaaaauaguaaccgcugaaacacaaaacagcaguuucaucauugacgguccgaauacucccgagugccccagugcaucacgugccuggaacguuugggaagucgaagacuacggauuuggcguauuuacgacaaacauauggcuaagacuaagggaggcuuacacgcaguugugcgaucacagauuaaugagugcagcgguuaaagaugagagggcaguacaugccgauaugggguauuggauagagagucagaagaacgggucuuggaaacucgaaaaggcuucacuuauagaaguaaaaaccugcacauggcccaagucacauacauuauggagcaacggaguacucgaaucagauaugauaauaccuaagagcuuagcagggccuauaucacaacauaaccauagacccgguuaccacacacaaacugcagguccguggcauuuaggcaaauuagaauuagacuucaacuacugcgaggggacgacaguugucauaacagagaacugugguaccaggggaccgucacuaagaacaacuacaguuuccggaaaacuuauacacgaguggugcuguagaaguuguacacuaccaccauuaagauacaugggagaagauggauguugguacgggauggaaauccgaccuauaucugaaaaagaagaaaacaugguuaagaguuuaguuagugccgggagcggcaaaguagauaacuuuacgaugggaguuuuauguuuagcgauauuauucgaagaagugaugagagggaaauuuggcaagaaacauaugaucgccgguguauucuucacguucguuuuacuacuauccggucagauaacguggagagauauggcacauacucuuaucaugaucgggaguaaugcguccgaccguaugggaauggguguaaccuaucuugcauuaaucgcaacauucaaaauacagccauuuuuagcauuaggauucuuuuuaagaaaacuaaccagccgagaaaaucuauuacuaggaguagggcuggcaauggccaccaccuuacaguuaccggaagauauagagcaaauggcaaauggaauagcucuagggcuuauggccuuaaaacugaucacccaauuugagacauaucaauuauggacagcccuaaucagcuuaacauguaguaauacaauauuuacacuaacaguagcuuggcgcacagcaacgcuaauacuagcugguguaagccuacuuccagugugccaaucuaguucgaugaggaaaacugauuggcuaccaauggcagucgcugcuaugggagucccgccgcuaccauuauuuauauucucauugaaggauacucuaaaaagaaggagcuggccgcuuaacgaaggcguaauggcagugggcuuaguuaguauccuagcuaguucucugcuaaggaaugacgugccaauggccggaccgcuagucgcuggaggucuacuuauagccugcuacguaaucaccgguacaagcgccgaucuuaccguugaaaaagcagcugacauuacgugggaggaagaagccgaacaaacuggcguuagucacaaccugaugauuacaguagacgacgauggaacaaugagaauaaaagaugaugagacggagaauauauuaacuguccuacuuaaaacagcguuauuaauaguaucaggcauauucccauacucuauaccggcaacccucuuaguuuggcacacauggcaaaaacaaacccaacgaucaggugugcugugggauguaccuuccccuccugagacucaaaaagcggaauuagaagaagguguguaccgcauuaagcaacaaggaauauuuggaaagacucaaguggguguagguguacagaaagaaggaguauuucacacaauguggcauguaaccagaggagcuguccucacguacaaugguaaaaggcuugaaccgaacugggccucugugaagaaggaccuuaucucauaugguggaggauggagacuaaguacgcaauggcaaaaaggagaggaaguccaggugauagcuguagagccgggcaaaaaucccaaaaauuuucaaaccaugccaggaaccuuucaaacaacuacuggcgaaauaggagcaauugcauuggauuuuaaaccaggaaccuccggcucaccaauuauaaauagagaaggaaaggucguaggguuauacggaaauggugucgucacuaaaaacgguggauauguaagcggaauugcccaaacaaacgcagaacccgauggaccgacgccugaguuagaagaggaaauguucaagaagagaaaucugacaauaauggaucuacauccggguucggguaaaacacgaaaauaccuacccgcaaucguacgugaagccauuaagagaagacuuagaaccuuaauccuagcuccuacccggguuguagcagcugaaauggaggaagcauuaaaagggcuuccgauaagguaccaaacaacggcuacaaagagugaacauacaggccgagagaucguugaccuaaugugucacgcuacuuuuaccaugcgccuauuaagcccaguucgaguucccaauuauaaccuaaucauuauggacgaagcucauuuuaccgacccagccaguauugcugcgcguggcuauaucucaaccaggguaggaaugggugaagcagcugcuauauuuaugacagcaaccccuccuggcacugcagacgcguucccacaaagcaaugcaccgauccaagacgaagaacgagauauaccagaacgaaguuggaacucaggaaaugaauggauaacagacuuugccggaaaaaccgucugguuuguuccgucuauaaaagcaggaaaugauaucgccaauugucuuaggaaaaacggcaaaaagguuauacaguugucaagaaagaccuuugauacugaauaucagaaaacaaaauugaaugacugggauuucguagugacaaccgauaucagugaaaugggagcaaacuuuaaggcagaucgaguaauugauccaagaagauguuuaaaaccggugauauuaacagacggacccgaaagagucauucucgcagguccaaugccggugacagcagcuuccgccgcgcagcgucggggacgaguagguagaaauccucaaaaggaaaacgaccaguacauuuucacaggacagccauuaaacaacgacgaagaucaugcucauuggaccgaagcaaagaugcuauuggauaacauaaauacgccagagggaauaaucccugcuuuauuugaaccagaacgagagaaaagugcggcaauagauggcgaauacagguuaaagggggaaucuaggaaaacauuuguugaacuaaugcggagaggggaucuuccaguauggcuugcccacaagguugcaucugagggcaucaaauauaccgauaggaaauggugcuucgauggacaaagaaacaaucaaauacuagaagaaaauauggauguagaaauuuggacaaaggaaggagaaaagaagaaacuaaggccaagguggcucgaugcucgaaccuauucagauccgcuagcgcuaaaagaauuuaaagacuuugcagccgggcgcaaaaguaucgcacuggaucuggucacugaaauaggacgagugccgagucacuuagcacaccgaacuaggaaugccuuggauaaucuggugaugcuacacaccucggagcacgggggacgagccuacagacaugccguagaagaguuaccagaaacaauggaaacgcuauuacuacugggauuaaugauauuacugacaggaggugcaaugcuuuuccuaauauccggaaaagguauaggaaaaaccucaauagguuuaauauguguuaucgcuaguuccggcauguuauggauggcugaaaucccgcuacaauggauugcaagcgccauaguucuagaguucuuuaugaugguucuauuaauccccgaaccugaaaaacaacgcacaccucaggacaaccagcuugcuuacgucguuauuggaauauuaacucuugcugcaauuaucgcagcuaaugaaaugggccuacuugaaaccacaaaacgagauuuagggaugaguaaggaaccaggcgucguaucuccaacuucuuacuuggauguugauuuacauccggcaagugccuggacacuauaugcuguggccacuaccguaauuacgccgauguuaagacacacaauugaaaauucuaccgcgaauguuagcuuggcagccaucgccaaccaagccgugguccuaauggggcuugauaaaggauggccaaucagcaaaauggauuuaggaguaccauuauuggcauugggauguuacucacaagucaacccacuuacgcugacagccgcaguucuucuucuaauuacacauuaugcaauuauuggaccaggauugcaagcgaaggcgacuagggaagcacaaaaacggacagcagcaggcauuaugaagaacccaacgguggaugguauaaugaccaucgaccuagaccccguaauuuaugauaguaaauucgaaaaacaauugggucaaguaaugcuacugguccuuugugcugugcagcuacucuuaaugagaacaucaugggcacuaugugaggcuuuaacccuugcgaccggaccaauaacaacccuuugggaaggaagcccaggaaaguuuuggaauacaacuauagcagucaguauggcuaauauauuuagagggucauaccuagcgggagcuggauuagcuuuuucgauuaugaaaucuguggguaccgggaaaagaggaacaggaagccaaggugaaacucugggggagaaguggaagaagaaauuaaaucaacucagccgaaaggaauuugaccuguauaaaaagaguggaauuacagaaguggaccgaaccgaggcaaaagaaggacugaaaaggggagagaucacacaucaugccguuucuagagggucagcaaagcuacagugguucguagagagaaacaugguuauacccgaaggaagagugaucgaucuggguuguggacguggaggauggaguuacuauugcgcuggacuaaagaaagucacagaggugagaggauauaccaagggaggcccaggucaugaagaaccuguuccaaugucaacauacggauggaauauaguaaaauuaaugucagggaaagacguauuuuauuugccaccugaaaaaugugacacuuuacucugugauaucggagaaagcucgccgaguccaaccguagaggaguccagaacgauacguguauuaaagauggucgaaccuuggcucaaaaauaaucaauuuugcauaaaagugcuaaaucccuauaugccaacgguaauagaacauuuagaaagauuacaaagaaaacauggagggauguuaguaaggaacccauuaucgagaaauucgacacacgagauguacuggauaaguaauggcacaggaaauauuguggcuucugugaauaugguaaguagguuacuacugaaucgcuucaccaugacccaccgacgaccaacuauagaaaaggauguugacuuaggagcgggaacaagacacguaaaugccgaaccagaaacuccuaacauggacguaauaggugaacggauuaagagaaucaaagaagaacacaauucgacauggcacuaugaugaugaaaauccuuacaaaacgugggcauaccaugggagcuacgagguaaaagccacugguagcgcuucaaguaugaucaacggaguggucaaacuauuaacgaaaccaugggacgucguuccgaugguaacacagauggccaugacagacacgacaccauucggucagcaacguguauucaaagagaaggucgacaccaggacuccuaggucaaugccaggcacccgaagggugauggguaucaccgccgaaugguuauggcgcacccuugguagaaauaaaaagccuagacuguguacacgagaagaauuuacuaagaaagugaggacgaaugcugcaaugggagccguuuucacagaagaaaaucaauggaauagugcuaaggcagcgguggaggacgaagauuucuggaaauuaguugaucgggaacgugagcuacauaaauugggcaaaugcggaucauguguguacaacaugaugggcaaaagagagaagaaacugggcgaguucggcaaagcaaaggggucccgugcuauaugguacauguggcuaggugcuagguaucucgaauuugaagcgcuaggauuuuuaaaugaagaucauugguucucaagagaaaacucguauaguggaguugaaggagaaggauuacacaaguuaggguauaucuugagggauauaucuaagauaccaggaggagcaauguaugcagaugacacagcaggcugggauaccaggauaacugaagacgaucuacacaaugaagaaaagauaacacaacaaauggauccagaacacagaagacuggcaaaugcuauauucaaacuaaccuaucaaaacaaaguuguaaaaguacaacggccuacgccaacaggaacugugauggacauaauaagccggaaagaucaaagagguagcggccaaguugggacguacggauuaaauaccuuuacaaauauggaagcucaacuuauaaggcagauggagggcgagggaguacucaguaaggcagaccuggaaaauccgcaucuaccggagaagaaaauuacccaaugguuggaaacuaagggggucgaaagguugaaaagaauggcaauuuccggggaugauugcguuguuaaaccuauugaugacagauuugcgaaugccuuacuugcuuugaaugacaugggaaagguaaggaaagacaucccacaguggcaaccauccaaaggauggcaugacuggcaacaggucccauuuugcucacaccauuuucaugaacugauaaugaaggacgggaggaaguuagugguaccaugcagaccucaagaugaguugauagggcgagcgcgaauaagucaaggagcaggcuggucacuacgugagacagcaugcuugggaaaagcguacgcgcaaauguggucacucauguacuuucacaggcgcgacuugagacucgccaguaaugcaaucugcagugccguaccugugcacugggucccaaccucgagaacuacuuggucuauccaugcucaucaccaauggaugaccacggaggacauguuaacaguuuggaaucgcguuuggauagaagacaacccauggauggaagacaaaaccccugugacaacaugggaggacguaccauauuuagggaagagagaagaucaauggugcggaagucugauaggucugacaagcagagcaacaugggcucaaaacauaccaacugcaauucaacaagugcguagcuuaaucggcaaugaggaguuucuagacuauaugcccaguaugaaaagauuccguaaggaagaagagucagaaggagcuauuugguga

SEQ ID NO: 23261 - RNA, 9873 nt, Artificial Sequence
  derived and/or modified CDS sequence (opt6) from DENV-3__KJ189278__SS-prME
accucuuugugucuuaugaugauacuaccagcugcucuugcuuuucaucuaacaucacgugauggggaaccccgaaugauuguaggcaaaaacgaaagaggaaaaucauuacuauuuaaaaccgcuuccgguacaaauauguguacgcuuauagcaauggauuuaggggaaaugugugaugacaccguuacauacaaaugcccucauauuaccgaaguagaaccagaagauauagacuguugguguaaucuaacgucaacgugggucaccuaugggaccugcaaucaagcaggagaacauaggcgagacaaaagaagugucgcguuagcgccacacgucggaaugggauuggacacacgaacucaaacguggaugagugcugaaggugcuuggaggcaagucgaaaaagucgaaaccugggcucucagacauccaggguuuacaauacuugcucuauuuuuagcgcacuauaucgggacaucauugacacaaaaagucguuauuuuuauuuuacugaugcuaguaacuccuucgaugacuaugcguugugugggaguggguaaccgugacuucguugaaggacuuucgggggcaacauggguagauguaguauuggaacacggaggaugugucacaacaauggcuaaaaacaaaccaacacucgauauagaauuacagaaaacagaggccacgcaauuagcaacacuccguaaacuaugcauugaagguaaaaucaccaacauuacaaccgacucaagauguccaacgcaaggugaggcagugcuacccgaagaacaggaucaaaauuacguauguaaacauacguacguagaccguggaugggggaauggaugugggcuauucggaaaaggaucauuaguaacgugcgccaaauuccaaugccuggaaccgauagaaggaaaaguaguacaauaugaaaaucuaaaauacacaguuauaaucaccguccacacuggagaucaacaucaaguagguaaugaaacgcaagguguuacagcggaaaucacuccccaggcaaguacuacagaagcgacccuaccagaauacgggacucugggcuuagaauguagucccagaaccggacuagauuuuaaugaaaugauauuauuaacaaugaaaaauaaggcuuggauggugcaucgacaaugguuuuucgaucugccccuuccauggacaucuggugccacuacggaaacaccaaccuggaauagaaaagagcuccuagucacauuuaaaaaugcgcacgccaagaaacaagaaguaguggugcucggaagucaggaaggcgcaaugcauacagcauuaacuggagcaacugaaauccagaauagcggcgguaccagcauauucgcagggcauuuaaaauguagguuaaaaauggauaaacucgaauugaaagguaugagcuaugcuauguguacaaacacuuucguacuuaagaaagaaguuuccgagacucaacacgguacaauacugauaaaaguugaguauaaaggugaggaugcgccauguaagauaccauuuucuacagaggaugggcaugguaaagcacauaacggaagacugauaacggcaaacccagugguaacgaaaaaggaggagccaguaaauaucgaagccgaaccacccuuuggugaaagcaauauuguaauagggauuggagacaacgcauuaaaaauuaauugguauaaaaagggaucgaguauagguaaaauguuugaagcuacagcucgaggagcucguaggauggcuauacuaggggacacagcaugggauuuugggagcgugggagguguccucaacucccugggcaagauggugcaucaaauauucggaagcgccuauacagcacuuuuuagcgguguaucuugggucaugaaaauagggaucggcguacuacuaacuuggaucggcuuaaacucgaaaaacacaucuaugucauucucauguauagccauuggaauaaucacguuauaucuaggagcaguaguacaagcagauaugggaugcguuaucaauuggaagggcaaagaguuaaaguguggaagcgguaucuucguuacgaacgaaguccauacauggacagaacaauauaaauuucaggccgacucaccaaaacggcuagcuacggcuaucgcuggugccugggagaauggcgucugcggcauaagaagcacuacaaggauggaaaaccuguuguggaagcagauugcaaacgaguugaacuauauacuuugggaaaauaacguaaaguuaacagucguagucggagacauaauaggaguauuggaacaaggaaaaaggacgcuuaccccucaaccaauggagcuuaaauauuccuggaaaacaugggguaaagcaaagauaguaacagcagaaacacaaaauucaucauuuaucauugacgguccgaauacgccagaauguccaagcgcgagcagggccuggaauguuugggaagucgaagacuacggguuugguguguuuacuacaaacauauggcuacgauugagagaaguguauacgcaauuaugugaucaucguuugaugagugccgcuguuaaagacgaaagggcuguacaugccgacaugggcuacuggaucgaaucucagaaaaauggcaguuggaagcuggagaaagcuagucuuauugaaguuaaaacaugcacauggccgaagucucacacacuuuggucuaaugguguucuggaaagcgacaugauaauucccaaaagccuagcaggaccuauaucacaacauaaucaccgaccagguuaccauacucagacagcuggaccuuggcauuuagguaagcuagagcucgauuucaauuacugcgaaggaacgacugugguuauuacugaaaauugcgguacaagaggcccgucucuaagaacaaccacaguuucgggcaaacuaauucaugagugguguuguagaucuuguacucuucccccgcuaagguauaugggagaggaugguuguugguacggaauggaaauucgccccaucuccgagaaagaagaaaauaugguuaaaucccuggucucagcgggaagugguaaaguugauaauuuuacaaugggcguauuaugucuugccaucuuguuugaggagguuaugagagggaaauucggaaagaaacauaugauugcaggagucuuuuucaccuucguucuuuuauuaucaggacaaauuacauggagagacauggcacacacgcuuaucaugauuggaucuaacgcaagugauaggauggggaugggcgugacguauuuagcauuaauagcaacuuuuaaaauucaaccuuucuuagcauuaggcuucuuucuacgaaaacuuacauccagggagaacuuacugcuaggcguuggucucgcuauggcuacuacauuacaauuaccagaagauaucgaacaaauggccaaugggauugcguuagguuuaauggcuuugaagcuaaucacgcaauuugaaacuuaucaacucuggacugcucuaaucucguuaacuuguaguaacacgauauucacauuaacaguugcauggaggacugccacucuuauacuagcgggcguaucacucuuaccaguaugucaaagcaguucuaugagaaaaacugacuggcuucccauggcuguggcagccaugggcgugccgccuuuaccguuauuuauauuuagccuaaaagauaccuuaaagagaagaucuuggcccuuaaaugagggaguaauggcagugggccuaguuaguauuuuagcaucgagucuacuccguaacgacguaccgauggcugggccucucguggcaggcggauuacucauugcguguuaugucauuacuggaacaucagcugaucucacaguagaaaaagccgcagacauaacaugggaagaagaagcagaacaaacggggguaucccauaaucugaugauuacaguggaugaugauggcacgaugagaauaaaagaugaugaaaccgaaaacauucuaaccguccuccuaaaaacagccuugcuuaucguaucaggaauuuuuccguacucaauaccggcgaccuuauuagucuggcauacguggcaaaagcaaacacaaagaucugguguuuuaugggauguacccucacccccggagacacaaaaagcagaauuagaagaaggagucuaucgaaucaagcaacagggaauauuuggaaaaacucaaguuggcguaggaguacagaaagaggguguauuucacaccauguggcacguuacacgcggagcuguguuaacauacaaugguaagagacuugaaccuaauugggcgucaguuaagaaagaucuaauuucauauggugggggauggcgguuaaguacucaauggcaaaaaggagaagaagugcagguaauagcaguugaaccagguaaaaaccccaaaaacuuucaaacgaugccaggaaccuuccaaacuaccacuggagaaauaggagcaauugcacuugacuuuaaacccgguaccuccggauccccaauaauaaaccgagaagguaaaguuguuggucuauacggcaacggagugguaacgaaaaacgguggauaugugaguggaauagcgcaaacuaaugcagagccagacggcccuacaccugagcucgaagaagagauguucaagaaaagaaauuugacaauuauggacuuacaucccggaucagggaagaccagaaaauaucucccggcaauaguacgagaagcuauuaaacgccggcuuagaacccuaauauuagcaccaacaagagucguugcagcagaaauggaagaagcccuaaagggacucccgauaagauaucaaacaacagcaacuaagucggaacacaccggaagagaaaucguugaccuaaugugucacgcuacauucacaaugcgucuauugucaccugugaggguucccaacuacaaccuuauaaucauggaugaagcccauuuuacagauccagcuaguauugcugcgagagguuauauuucuacuagaguagguaugggcgaggcugcugcuauuuuuaugacggcgaccccaccagggaccgcagaugcguucccacaaucaaaugcacccauucaagacgaagaaagagauauuccagagcguucauggaacuccggaaacgaauggaucacugauuuugcagguaaaacaguuugguucguaccuaguauaaaagcaggaaaugacauugcaaauugccucaggaaaaauggcaagaaaguaauacaguuaucacgcaagacuuucgacaccgaauaccagaaaacaaagcucaacgauugggacuucguagucacgacagauauaagcgaaaugggagcaaauuucaaggcagaucgcgucauagauccaagacgcugcuuaaaacccguaauauuaacugauggacccgaaagaguaauccuagcagggcccaugcccgugaccgcagcauccgcugcucaaagacgagggcgagugggaagaaauccacaaaaggaaaaugaucaauauauuuuuacgggucaacccuuaaauaaugacgaagaccaugcucacuggacagaagcaaaaauguuacuugauaacauaaacacaccagaaggcaucauaccugcucuauuugagccugaaagagaaaaauccgccgcaauagacggagaguaucggcugaagggugagagcaggaaaaccuuuguagaacuaaugcgaagaggcgaucuaccagugugguuagcgcacaagguggcgucagaagguauaaaauauacugacagaaaguggugcuuugauggccagagaaacaaucagauauuggaagaaaacauggacguugagauauggacaaaggaaggugagaaaaagaaacuaagaccacgguggcuagaugccagaacguacucagauccacuggcauuaaaagaauuuaaagacuuugcagccggcagaaaaucuaucgcacucgaccucguaacagaaauagguagaguuccuagccauuuagcgcaccgcacacguaaugcucuagauaaccuugucaugcugcauacaagugagcauggagggagagcuuacagacaugcaguagaagaacuuccagaaacaauggaaaccuuacuacuauugggacugaugauacucuuaacuggaggggcuauguuguuuuuaauaucagggaaagggauuggaaaaaccagcauaggauuaaucugcguuauagcaagcucggggaugcuauggauggcugaaauuccucuccaauggaucgccagugcuauuguauuagaguucuuuaugaugguacuauugauuccagaacccgagaaacaaaggaccccucaagauaaucagcuagccuacgugguaauugggauccucacauuagcugcuauaauagccgcaaacgagaugggauuacuagaaacaacgaaacgagaucuaggcaugagcaaagaaccgggaguaguaaguccgacaucauauuuggauguagaucuacauccagcgucggcauggacgcuguaugcgguagcaacaacugucaucacgccaauguuaagacauaccauagaaaauuccacagccaauguaagccuugcugcuauagcuaaccaagcugucguauuaaugggauuagauaaaggauggccaauuaguaagauggaccuuggaguaccccuucucgcuuuaggcugcuauagccaaguuaacccacugacacuuacagcagcgguacuuuuauugauaacucacuacgcuauaauuggccccggauuacaagcgaaagcuacgcgugaagcccagaaaagaaccgcagcgggaaucaugaaaaacccaacaguagacggcauuaugacuauugaucucgaccccgucauauaugacuccaaauuugagaaacaguuaggacaaguaauguuguuagugcucugcgccguccaauuauuauuaaugaggacgaguugggcauuaugugaagcauuaacauuggcaacugguccaauuacaacacuaugggaaggaucgccgggaaaauucuggaacacaacaauagccguuaguauggcuaauaucuucagagguucguacuuagccggagcaggcuuagcauucaguaucaugaaaagcguaggaacuggaaagagaggaacuggaucucaaggcgaaacucuaggagagaaauggaagaagaaacugaaucaauugucgaggaaagaauuugauuuauauaagaaaagcgguaucacagaaguagacagaacagaagccaaggaaggguuaaagagaggagagauaacucaucacgcaguuagucgcggaagcgcuaaacuucaaugguuugucgaacgaaacaugguuauuccugagggucgagugauugaucuggguugcggucgcggcggcuggucuuauuauugcgcaggacucaagaaaguaacagaaguaagaggauauacgaaaggcggaccaggacacgaggaaccaguaccgaugucaacauauggguggaacauaguuaaacuuaugagugguaaagauguuuucuauuuaccgccagaaaaaugugauacauugcugugcgacaucggcgagagcucaccuaguccgacaguugaggaguccagaaccauuagagucuuaaaaaugguagaaccgugguugaagaacaaccaauuuugcauaaaaguuuugaaucccuacaugccaacugugauagaacaucuggaacguuuacagcgaaagcaugggggaauguuaguucggaauccuuuaagucggaacucgacucaugaaauguacuggauuagcaaugguacugguaauauugucgcaaguguaaauaugguaucaagacuacuccucaaccguuucacuaugacgcauagaagaccaacgauugaaaaagauguagaucuaggugcaggcacucgacacguuaacgcugagcccgaaacaccaaacauggaugucauaggagaacggauuaaacgcaucaaagaggaacauaacaguaccuggcauuacgaugaugaaaauccauauaaaaccugggcauaccacgguucuuaugagguaaaagcuaccgggagugcaaguuccaugauaaaugggguaguaaaauuauuaacuaagccaugggacguaguaccaaugguaacacagauggccaugacagauacaacuccuuucggucaacagaggguauucaaggagaaaguugauacucgaacgccacgaucaaugccuggaacaaggcguguuaugggaauaacagcggagugguuauggaggacuuuggggcgaaauaaaaagccuagguuaugcacgcgcgaagaauuuaccaagaaagugagaacuaaugcggcuaugggagcuguauuuacugaagagaaucaaugggacagcgcaaaagcugcaguagaagaugaggacuuuuggaaauuagucgaucgcgaacgcgaacuucacaaacuaggcaaaugcggcucaugcguguauaauaugaugggcaaaagggagaagaaauuaggggaauuuggaaaggcaaaaggauccagagcaaucugguacauguggcuaggagcaagauacuuagaguucgaagcgcuggguuuucuaaacgaagaucauugguuuaguagagagaacucguacagugggguggaaggagagggauuacauaaacuuggcuacauucuuagggauauaagcaagauuccaggaggugcuauguaugcagaugauacagcaggaugggauacacgcaucacagaagacgaucuacacaaugaggagaaaauaacacagcaaauggaucccgaacaccggcaacuagcaaacgcuauuuuuaaauuaacuuaucaaaauaaagucguaaaaguacaaagaccaaccccaacgggaacggucauggauauaauaucucguaaagaccagagaggaaguggccaggucgguacauauggauuaaauaccuucacuaauauggaagcacaacuaaucaggcagauggagggugagggaguauugucaaaagcggaucuagaaaacccucacuuaccugaaaagaaaauaacccaauggcuagaaacuaaaggugucgaaagguugaagcgaauggcuaucucaggugaugauuguguaguuaaaccaauagaugauagguucgcaaaugcacuucuggccuuaaacgauaugggaaaaguccgaaaagauauuccacaguggcagcccaguaaaggauggcaugacuggcaacaagugccuuuuuguucacaccacuuucaugaauuaauaaugaaagauggacgaaaauuaguggugccuuguagaccucaggaugaacucauugguagagcccguauuucucagggugccggcuggaguuuacgggaaacagccugccuaggcaaggcauaugcucaaauguggagucuaauguauuuccaccgaagagaucuacguuuagcgucaaacgcaauuugcucggcggugccaguucauuggguaccgacaagcagaaccacauggucaauacacgcgcaucaucaguggaugacuacugaggauauguuaacaguauggaaucguguguggauagaagauaauccuuggauggaagacaaaaccccuguuaccacgugggaagaugucccauaccucgguaaaagagaggaccaguggugugguucauuaaucggacuuacaucacgcgcuacuugggcucaaaacauucccacugcgauacaacaagucagaaguuuaauaggaaacgaggaauuucuagacuauaugccuucgaugaagcgauuucgaaaagaagaggagucugaaggugcaaucugguag

SEQ ID NO: 23262 - RNA, 9873 nt, Artificial Sequence
  derived and/or modified CDS sequence (opt6) from DENV-3__KJ189279__SS-prME
acuagcuuaugccuuaugaugauacucccugcagcuuuggcauuccacuuaacaagucgagauggagaaccgaggaugauuguggggaaaaaugaaagaggaaaaucuuugcucuuuaaaacagcuagcggaauaaauaugugcacauuaauagcaauggauuuaggggaaaugugugaugauacugucacguauaaauguccgcauauuacugaaguugaaccugaggacaucgauugcugguguaauuugaccucaacuuggguuacauaugguacauguaaucaagccggcgaacacagacgcgauaaaagaucuguagcacuugcgccucacguugguaugggacuugauacacgaacccaaacguggauguccgcagaaggcgcuuggagacaaguugaaaaaguagaaacaugggcccugagacacccaggauucacaauucuggcauuauucuuagcucacuauaucggaacgucacugacacagaaaguaguuauauucauauuguuaaugcuagucacacccucaaugacgaugagaugugugggaguggggaauagggacuuugucgagggacucuccggagcaacguggguugaugucguuuuagagcacggagggugcguaacaacaauggcgaaaaacaaacccacauuagacauagaacuucagaaaacugaggcuacacaauuagcuacauuaaggaaauuguguauagagggaaaaaucacgaacaucaccacagauagucgcuguccgacgcaaggagaagcaguucuuccagaagaacaagaccaaaacuaugugugcaaacauacuuacguugacaggggauggggcaauggcuguggcuuauucggaaaagguagcuuagucacuugugccaaauuucaauguuuagaaccuauugaaggaaaagucguacaauacgaaaaucuaaaauauacugucaucauaacaguacacaccggagaccaacaccaaguuggaaaugaaacccaaggaguaacagcggaaauuacuccgcaggcaaguacaacagaagucacuuuaccagaguaugggacauuggggcuagaauguagcccaagaacagguuuggacuucaacgaaaugauacuguuaacaaugaaaaacaaagccuggaugguacacagacagugguuuuucgacuuaccucugccuuggacaaguggcgcuaccacggaaacaccuacauggaacagaaaagaacuauuagugacuuuuaaaaaugcgcaugcuaagaaacaagaaguagugguccuagguucucaagagggugcgaugcacacagcucuaacgggagcaaccgagauacaaaauucugggggaacaucaauauucgcaggucacuuaaaaugcagauugaaaauggacaaauuagaacucaaaggaaugucauaugcaauguguacaaauaccuucguauugaagaaagaaguaucagaaacacaacaugguacaauauugauaaaaguugaauauaaaggagaagacgccccguguaaaauaccauucucaacagaagacgggcauggaaaagcacauaacggcagacucauuaccgcaaacccaguaguaacuaagaaagaagaaccagucaauauagaagcugaaccaccauucggagagaguaacauagucauaggaauuggagauaacgcacuuaaaauaaauugguacaagaaaggaagcuccaucggaaaaauguuugaagcaacagcaagaggagcccgcagaauggcaauauuaggcgauacagcuugggacuuuggaagcgugggagggguuuugaacucacuugggaaaaugguacaccaaauuuucggaagcgcguauacugcuuuauuuaguggcguuucguggguaaugaaaauaggaauaggaguguuacucacuuggauaggacuuaacagcaaaaacacuuccaugucauucuccuguaucgccauuggaauaaucaccuuauaccuuggggcaguugugcaagcugauaugggaugcguuaucaacuggaaagguaaagaacuuaaaugcggaagugggaucuucguaacaaaugaaguacauaccuggacagaacaguauaaauuucaggccgauucaccaaaaagacucgccacugcuauagccggagccugggagaauggaguauguggcauuagaaguacgacacgaauggaaaaucuacuuuggaaacaaauugcuaacgaauugaauuauaucuuaugggaaaacaauaucaaacuuaccguggucgucggggauaucauuggaguccuagaacagggaaaacgcacguuaaccccacaaccaauggaacugaaauauagcuggaaaacuugggguaaagcgaagaucguaaccgcagaaacucaaaacagcucauucauuauagacggaccaaacaccccugaauguccgagugcaaguagagcauggaauguaugggaaguagaagauuacggauuuggagucuuuacgacaaacaucugguuaagauugcgagaaguguauacucaguuaugugaccaucgauuaaugucagcagcuauaaaagaugagcgcgcaguacaugcugacaugggcuauuggauagagucacagaaaaauggaucauggaaacuagaaaaggcuucucuuauagaagugaaaacguguaccuggccuaaaagucauaccuuaugguccaauggggugcucgaaagugauaugauaauuccaaaaucucuagcgggcccaauuagccaacacaaccauaggccaggauaucauacacaaacggcaggaccuuggcaccuaggaaaauuagaacucgacuuuaauuauugugaggguacaaccguuguuauuacagagaauugcggaacaaggggucccucuuugcgaacuacuaccguaagugguaaacuaauucaugaaugguguugccgcucauguacucuuccaccccuccgauacaugggcgaagauggauguugguaugguauggaaauucguccaauaucagaaaaagaggaaaacauggucaaaucucucguaagcgcuggaucuggaaaaguagacaauuucaccauggguguccuaugucuagccauuuuauucgaagaaguuaugcgggggaaauucggcaagaaacacaugauugcuggaguauuuuucacuuucguacugcuacuaagcggacaaauaacguggagagauauggcacauacauuaauuaugaucggaucaaacgccagcgaucgaaugggaauggggguuacauaucuggcgcucauagcaacguucaaaauccaaccuuuccuugcgcucggauucuuucuuagaaaacuaacuucaagggagaauuuauuacuggggguaggguuagccauggcuacaacgcuccaacugccugaagauaucgagcaaauggcaaauggaauagcucucggucugauggcacuaaaacucaucacucaauuugaaaccuaucagcuguggacagcauugauuagucuaacauguuccaauaccauuuuuacuuugaccgucgcuuggcguacggcgacacucauacuagcgggugugucucuacuccccguaugccaauccaguuccaugcggaaaaccgacugguuaccgauggccguggcugcaaugggaguaccacccuuaccguuauuuauauucucauuaaaagauacccugaagaggagauccuggccgcuaaaugaggggguuauggccguuggucugguaaguauacuugcaaguuccuuauuaagaaaugacguaccaauggcuggaccccuuguagcgggaggucugcuuauugcaugcuacgugaucacagggaccagcgccgaucugacgguagaaaaagcagcggauauuacaugggaagaggaagcugaacaaacugguguuucucauaauuuaaugauaaccguagacgacgauggaacaaugcgcaucaaagaugaugaaaccgaaaacauuuuaacaguguuacuuaaaacagcucuccuaauuguaucaggaaucuuuccauauaguaucccagcgacauuguuagucuggcauacuuggcaaaagcagacccagcguagugggguccuaugggaugucccgucaccgccagagacacaaaaagcugaauuagaggagggcguauaccguauaaagcaacaggggauuuucgguaagacacaggugggagugggcgugcaaaaggaaggcguguuucacaccauguggcauguuacacgaggagcugugcuuacuuauaacggaaaacgacuugaaccaaacugggcuucugugaagaaagauuuaauaucauaugguggcgguuggagacugucaacacaauggcaaaaaggggaagaaguccaaguaauugcaguggaaccuggcaagaauccuaagaauuuccaaacgaugccuggaacuuuucagacaacuacaggugaaauaggugcaauugcucuggauuuuaaaccaggaacgagugguagcccaauaauaaauagagaagggaaaguugucggauuguacgggaaugggguaguuacuaaaaauggaggguauguaucggguauagcucaaacgaacgcggagccugacgggccgacaccagaauuagaagaagaaauguucaagaaacgcaaucugaccauaauggauuuacauccggguagugguaaaacccgaaaauauuuaccagccauagucagagaagcaaucaaaagaagacuucgaacauuaauuuuagcacccacaagaguuguagcugccgaaauggaggaagcccucaaagguuuaccaauaagauaucaaacaaccgcuaccaaaagugaacauacagggcgggaaaucgucgaucugaugugucaugcaacuuuuaccaugcgucuacuaaguccaguaagaguucccaacuacaacuuaauaaucauggacgaagcucacuuuacggauccagcuaguauagcugcgcgcggauauauaucgacgcgcgucgggaugggugaagccgcagcaauauucaugacugcuacaccgccugggacagcggaugcauuuccucaaagcaacgcuccaauacaagaugaagaacgggauauaccagaaaggagcuggaacagugguaaugaauggauaacagauuuugcgggcaaaacugucugguucgucccaucaauuaaagcaggaaacgacauagccaauugcuuacgcaaaaacggcaagaaaguaauacaacuuucaagaaaaacguucgauaccgaauaccagaagaccaaacugaaugauugggacuucguggucacuacagauauaucugagaugggggcaaauuucaaagcagacagggucauugacccacggcgaugccucaaaccaguaaucuuaacagaugguccggagcgcgucauauuagccggucccaugccgguuacugcugccagcgccgcacaaaggaggggacggguaggacgaaauccacaaaaagaaaacgaucaauacauauucaccggccagccauuaaacaacgaugaagaccacgcgcauuggacagaggcgaaaauguuauuagacaauauaaacacgccagaagguauuauuccugcuuuauucgaaccagagcgugagaaaucagcagcaaucgauggcgaauauaggcuaaaaggagagucacguaaaaccuucguagagcuaaugagacguggugaucuccccguaugguuggcacacaaaguggcaucagagggaauaaaauauacagauaggaagugguguuuugauggacagcguaacaaccaaauauuagaagagaacauggacguagaaauauggaccaaggaaggagaaaagaagaaacuaagaccucgcugguuagaugcacggacguauucagacccgcucgccuugaaagaauuuaaggauuuugcugcaggaaggaaaagcauagcacucgaccuaguaacagaaauaggucgcguaccaucucaccuagcccacaggacaagaaaugcuuuagauaauuuaguuaugcuccauacaucagaacacggaggaagggcuuaccgacacgcaguugaggaacuaccugaaacaauggaaacauuacuguuauugggguuaaugauacuauuaacugggggcgcaaugcuauucuuaauaaguggaaaagguauugggaaaacaagcauuggucugauauguguaauagcaaguucagggauguuauggauggcggaaauaccacuucaguggauagcaagcgcuaucguuuuagaguucuucaugaugguacuucuaauacccgaaccggagaaacaacgaacaccccaggauaaucaacuagcauacguaguaauaggaauuuuaacucuagcagccauaauagcagcaaacgaaaugggucuucuugaaaccacaaagagagaccuuggaaugaguaaagagccugggguugucaguccuacaucuuaucuugaugucgaucuccaucccgcguccgcauggacacuauaugcagucgcaacuacaguuauaacuccgaugcuuagacacaccauagaaaauucaacagcuaauguuagccuagccgcuaucgccaaccaagcuguaguccugauggggcuugacaagggauggcccauuucgaaaauggaucuaggggucccucugcuagcacuaggauguuacagccagguaaauccucuuacauuaacggcagcuguauuacuuuuaauuacccauuaugcgaucauagguccuggauuacaagccaaagcaacucgcgaggcacaaaagcggacugccgcugguauaaugaaaaauccaacgguugaugggauaaugacuauagacuuagauccagugauauaugauucaaaauucgaaaaacaacucggacagguaauguuacuuguccuaugugcaguucagcuauuacucaugcggaccucaugggccuuaugugaagcauugacuuuagcgacgggaccuauaacuacguuaugggaggggagcccaggaaaauuuuggaauacuacaauugcaguaagcauggcaaacauuuucaggggauccuaccuagcgggagcaggacuugcuuucagcaucaugaaauccguuggaacggguaaaagagguacaggcucacaaggugagacucugggugagaaauggaagaagaaauuaaaucaacucagucgcaaggaauuugacuuguacaagaaaucgggaaucacagaagucgauagaaccgaagcaaaagagggauuaaagcgcggagaaauuacgcaucacgccgucucuaggggcagcgccaaacuucaaugguucguagagcguaacauggucauuccagaaggccgagugauugaccuaggaugugguaggggaggauggucauauuauugugcagggcugaagaaaguaacagaagugagagguuacacuaagggcgguccaggucaugaagaacccgugccaaugagcacuuauggguggaacauaguuaaacucaugucaggaaaggacguauuuuaucuuccgccggaaaagugugacacacucuuaugcgauauaggcgagaguagcccaagucccacaguagaggaaagucggaccauacgaguuuuaaagaugguggaaccaugguuaaagaauaaccaauucugcaucaaaguauugaauccuuacaugccuacgguaauagaacacuuagagagacuacaaagaaagcauggaggaauguugguaaggaaucccuuaaguagaaauagcacacacgaaauguauuggauaaguaauggaacaggaaacauuguugcuucgguuaacauggucucccgccuacuucuaaacagauucaccaugacgcaucgaaggccaaccauugaaaaagauguugaccuuggagcagggacuagacauguuaacgcugaaccagaaacuccaaacauggauguuauaggugaaaggauuaaaaggauuaaggaggagcacaacucgacauggcacuaugacgacgagaacccuuauaagacuugggcuuaucacggauccuaugaagugaaagcuacaggaucagcuucuuccaugauaaauggcguugucaaacuacucacaaagccaugggacgucguaccaaugguaacacaaauggcaaugacagacacgacgccguuuggacaacaacgcguuuuuaaagagaaaguugacacccgaacacccagaucaaugcccggcacuagaaggguaauggggauaacggccgaguggcuguggcgcaccuugggacggaauaagaaaccaagguuaugcacaagagaagaauuuacuaagaaaguccggacuaaugcagcuaugggagcaguguuuacggaggaaaaucaaugggauagcgcgaaggcggcuguggaggacgaagauuuuuggaaacucguugacagggaaagggaauuacauaagcuagggaagugcgggaguugcgucuauaauaugaugggaaaaagagagaagaaauugggggaguucggaaaagcaaaagggucacgugcgauaugguauauguggcuaggagcacgguaucuagaguuugaagccuuaggguuuuuaaacgaagaucacugguucaguagagaaaauucuuauucaggaguagaaggagaaggacugcauaaacucggcuauauauuacgcgauauauccaaaauacccggcggagccauguacgcagaugacacagcaggaugggauacucggauuacugaagacgaucuacauaacgaagagaaaaucacucaacaaauggaucccgaacauaggcaauuggccaaugcuauauuuaagcuaacauaccaaaauaaagucgucaaaguacaacguccuacuccaacaggcacaguuauggauauaauaucacgcaaggaccaaagggguucaggacaaguagguacauaugggcuaaauaccuuuacuaauauggaagcacagcucauaaggcaaauggaaggggagggaguauuauccaaagcggauuuagaaaauccucaucugcccgagaagaaaauaacacaaugguuggaaacuaaggguguugaaagacugaagaggauggcaauauccggugaugacuguguaguaaaaccuauagaugacagauuugcuaaugcccugcuggcacuuaacgauauggguaaaguaagaaaagacauuccacaauggcagcccuccaaagguuggcacgacuggcaacaaguaccauuuugcucgcaucauuuucacgaauuaauaaugaaagaugggcgaaagcucguaguucccugcaggccacaagaugaauuaauaggacgagccagaauaagucagggagcggguuggaguuuacgugagaccgcaugccugggaaaagcguacgcucaaauguggucacuuauguacuuccacaggagagacuugcgcuuagcuagcaaugcgauaugcagugccguucccgugcauugggucccuacaagucgcaccacgugguccauacaugcucaucaccaauggaugacuacugaagacauguuaacuguuuggaaccgaguauggauugaagacaacccauggauggaagauaaaacacccguuacgacaugggaagaugucccguaucuaggaaaaagggaagaccaauggugcggaagccuuauuggauuaacgagcagggcaacuugggcacaaaacaucccuaccgcuauucaacagguuagaucacuuaucggaaaugaagaauuuuuagauuauaugccaaguaugaagcguuuucguaaagaggaggaaagcgaaggagcaauaugguga

SEQ ID NO: 23263 - RNA, 9873 nt, Artificial Sequence
  derived and/or modified CDS sequence (opt6) from DENV-3__KJ189280__SS-prME
acaaguuuaugucuaaugaugauuuuaccggcagcauuagcauuucaucuaacgucaagagauggagaacccagaaugauaguagguaaaaaugaaagagggaaaucguuauuauuuaaaaccgcaagcggaauuaauaugugcacauugaucgcuauggacuugggagagaugugugacgacacagugacguacaaaugcccccacauaacugaaguugagccggaggauauugauuguuggugcaauuuaacauccacauggguuacguaugggaccugcaaccaagccggugaacaucgaagagacaaaagaucuguagcacuugcaccgcauguaggaaugggguuagauacaagaacgcaaacuuggaugagcgccgaaggggcauggagacaaguagaaaaagucgaaacuugggcguugaggcauccaggguuuacaauacucgcgcuguucuuagcccauuauauuggaacuucgcuaacgcaaaaaguaguaauuuuuauuuuauuaauguuagugacuccaucaaugacgaugaggugcgucggagucggaaacagagacuuuguggaaggcuuaagcggugcuacauggguagaugugguauuggaacauggaggaugugucacuacaauggcuaaaaacaaaccaacccuugacaucgaauuacagaaaacugaggcuacccaauuggcaacguuacgaaaauuguguauugaagggaaaauaaccaauauaacaacagauucaagaugcccaacgcaaggcgaagcagugcuaccggaagaacaagaccaaaauuauguaugcaaacauacauacguagauaggggguggggaaauggcugugguuuauucggcaaagggagcuuagugacuugugcaaaauuccagugcuuagagccaauugaaggaaaaguagugcaauaugagaaucuaaaauauacuguaauaauuacaguccauacaggagaccaacaucaaguagggaaugaaacucaaggaguaaccgccgaaauuacuccgcaagcuagcacaacagaagcuacacugcccgaauacgguacccuaggacucgaauguaguccgagaacuggcuuagacuuuaaugaaaugauucugcugaccaugaaaaacaaagcauggaugguacauagacaaugguucuuugauuuaccacuaccguggacgaguggagcaacaacagaaacgccgacauggaaucgaaaagaacuauuggugacguuuaaaaaugcccacgcuaagaaacaagaaguuguaguuuuagggucccaagagggagcaaugcauacugcucucacuggagccacagaaauccaaaauuccggcggaacgucgauuuuugcgggucaccuuaaaugccgacuuaaaauggauaaauuagaacuuaaagguaugagcuacgcuauguguacaaauaccuucguacuuaagaaagaaguuagugaaacacaacacgguacaauccuuauaaaaguugaguauaaaggugaagaugcgccauguaaaauaccauucagcacagaagauggucaugguaaagcucacaaugggcgacuaauaacagcuaauccugucguuacaaagaaagaggagccgguuaacauugaagccgaaccaccuuucggagaaaguaacauagucauuggaauaggugacaaugcccuaaaaaucaauugguacaagaaaggcagcucaauugguaaaauguucgaagccacagcgagaggugcgcgccgcauggcaauuuuaggugauacagcaugggacuuugggagcgugggagguguucucaauaguuuaggaaaaaugguucaucaaauuuucggcagugccuauacagccuuauuuucggguguaucauggguuaugaaaauaggaauagguguacuucuaacuuggaucggccuaaauaguaagaauacaucuaugucuuuuucauguaucgcaauagguauaauuacuuuauaccuaggcgcaguuguucaagcagacaugggaugcguaauuaacuggaaagguaaagagcuuaaauguggaagcggaauauuugugacgaaugagguccauacguggacagagcaguauaaauuccaggcggauagcccuaaaagguuagcaacggcaaucgcgggagccugggagaacgguguuuguggaauuagaucuacuacaaggauggaaaauuuacuauggaaacaaauagcaaacgagcuaaacuauauucuaugggaaaacaacaucaaacuuacuguagucgugggugacauaauuggcgucuuggaacagggaaaaagaacacucacaccccagccaauggaguuaaaauacucauggaaaacaugggguaaggccaaaauugucacagcagaaacacaaaauaguuccuuuauaauugacggaccgaauacacccgaguguccuucagcuucacgagccuggaauguuugggaaguagaggacuacggauuuggaguauucacuaccaacauuuggcuacggcuacgagaagucuacacgcaacuuugugaccaucgccuaaugucagcagcaguuaaagaugagagggcaguccaugcagacaugggguacuggaucgagagucagaaaaaugguucauggaaacuggaaaaagcgucgcugauagaagucaaaacguguacauggccaaaaucacauacacucuggaguaacgggguucuagaaagcgacaugauuauuccuaaaagccuagcuggacccauaagucaacacaaucaucgaccugguuaccauacucaaacugcugguccguggcaucuagguaaacuugaauuggacuucaauuauugcgaagggaccacgguuguaauaacggaaaauuguggaacacgagguccaucauuaagaaccacaacaguaagcgguaagcucauacacgaauggugcugcagaaguuguacacuaccuccacuccguuacaugggagaagacggcuguugguacggaauggaaauucgacccauaucugagaaagaggagaauaugguuaaaucuuuagugucugcugggagcggaaagguugauaauuuuacuaugggaguacuguguuuagcgauccuuuuugaagaaguuaugcgugggaaguucgguaagaaacauaugauagccgguguauucuuuaccuucguacugcuauuaucuggucaaauaacauggagagauauggcccauacacuaauuaugauuggcagcaaugcguccgaucgaaugggaaugggcguuacauaucuggcacucauugcaacauuuaaaauccaaccuuuucucgcauuaggguucuuuuuaaggaaauuaacuucucgagaaaaccucuuacuuggugugggauuagcaauggcgacaacacuacaauugccagaagauauagagcagauggcgaacgguauugcuuuaggccuaauggcuuuaaaacuaauaacgcaauucgagacuuaccaauuauggacagcucugauaagccuaacaugcaguaauacaaucuucacgcugaccguugcuuggagaacagcaacauugauauuagcaggaguaagccuuuugcccgugugccagaguucuagcaugcguaaaaccgauuggcugccaauggcuguggcagcgaugggcgugccacccuuaccuuuauuuauauucucuuuaaaagauacauuaaagcgaagaucguggccacugaaugaaggagugauggcuguuggucucguaaguauacuugccuccucucucuuacgaaaugacguucccauggcugguccacucguggccggcggacugcuaauagcuugcuauguaauaaccggaaccucagcagacuuaacaguagaaaaggcugcugauauuacaugggaggaagaagcagaacaaacagggguuucucacaaucucaugauuacaguugaugacgauggaacuaugaggauuaaagaugaugaaacagaaaauauauuaaccguacuucuaaaaaccgcgcuucuaauugucucuggcauauuuccauacaguauaccagcaacucuccuaguguggcauacauggcaaaaacagacucaaagaucaggaguucuaugggauguaccuucaccaccggagacacaaaaagccgaacucgaagaagggguuuaccguauaaaacaacaagguauuuucggcaaaacucaaguaggcguaggaguccagaaagagggggucuuucauacaauguggcacguaacgagaggagcugugcuaacguacaauggaaaaaggcuagaaccuaauugggcuucaguuaagaaagaccuuauuaguuacggcggcggguggagacuuucgacccaauggcaaaagggagaggagguacagguaauagcaguugaaccagguaaaaauccuaaaaauuuccagaccaugccaggaacauuccaaacaaccacgggagaaauaggcgcuauagcacuagauuuuaaacccggcacuucaggaagccccauaauaaacagagaaggcaagguuguaggcuuauauggcaaugggguagucaccaaaaaugguggauacgucuccggaauagcccaaaccaacgcagaacccgaugguccaacgccagaguuagaggaggagauguuuaaaaagaggaaccuuacuauuauggaccugcacccagguucuggaaaaacccguaaguaucuacccgccauagugcgagaagcuauuaaacgaagauuaagaacacugauauuagcaccuacaaggguugucgcugcugaaauggaagaagcguugaagggcuugccaauaagguaccaaacaacagcaacuaaguccgagcauacuggucgagaaauaguggaccuaaugugccaugcaaccuucacuaugagacuuuuaucucccguaagagucccaaauuauaacuuaaucauaauggacgaagcccauuucaccgaucccgcaucaauugcagcaagagguuauauaucaacaagaguuggcaugggggaagcugcagcaaucuucaugacagcgacuccaccaggaacagcugacgccuuuccucaaagcaaugcucccauacaagaugaagaacgugacauuccagaaaggucauggaacuccggaaaugaauggauaacagauuuugcuggcaagacaguaugguuugugccaucaauaaaagcagggaaugauauagcuaauugucugaggaaaaacggcaagaaaguuauacaauugaguagaaagacguucgacacggaauaccaaaagacaaaauuaaacgauugggauuuuguuguuacgacggauauuagcgaaaugggagccaauuucaaagcugauagaguaaucgauccaagacgcugucuaaaaccagucauauuaacggacgguccugaaagaguuauacuggcagggcccaugcccgucacagcagcaagcgccgcacaaagacggggacgaguuggacgaaauccccagaaagaaaaugaucaguacauauucacaggucagccacuaaacaaugacgaggaucacgcccacuggacagaagcuaagauguuauuggauaauauaaacacuccugaaggaauaauaccugccuuguucgaacccgaacgagaaaaaucagccgcaauagauggagaguauagauuaaaaggcgaaucgcggaaaacauuugucgaauuaaugaggcgaggugauuugccuguaugguuagcacauaaaguaagcagugaaggaauuaaauauacggacagaaaguggugcuucgaugggcaacguaauaaucagauauuagaagaaaacauggauguugaaauauggacaaaggagggcgagaagaagaaacuuaggccacguugguuagacgcacguaccuauagugacccucuggcccuuaaagaauuuaaagauuuugcugcuggcagaaagaguauugcauuggaucuuguaacggaaauaggcaggguaccaucacauuuagcacaccgaacacguaacgcacuagacaaucuuguaaugcuacacacaagcgagcacgguggaagggcauauaggcaugcgguagaggaacuuccggaaacaauggaaacgcuuuuacucuuaggucugaugauauuguuaacagguggugcuaugcuguucuuaauaucgggcaaaggaauuggaaaaacuagcauaggacuuaucugcgucauugcuaguagugggaugcuauggauggccgagauacccuuacaguggaucgccagugccaucguacuagaauuuuucaugaugguacuacuaauaccugagccugaaaagcaaagaacgccacaagauaaucaacuagccuacguaguuaucggaauacuaacuuuggcugcaauaauugcggcaaacgaaaugggauuguuagaaaccacgaaaagggaucucggaaugucaaaagaaccgggaguaguaagcccuacuucuuaccuagauguggaccuucauccagcaucagcguggacuuuauaugcgguagcaaccacaguuauuacaccaaugcuacgucacacaaucgaaaauucgacagcuaacgugagucuagcagcaauagccaaucaagcaguuguccuaaugggguuagauaaaggauggccaauaaguaagauggaucuuggaguaccccuuuuggccuuaggcuguuauucucaggucaauccacucacucuuacagcagcuguacuguuauugauaacacacuaugccauaaucgguccaggccuacaagcaaaagcaacacgagaggcccaaaaacggacugcugcuggaauuaugaaaaauccaaccguggauggaauaaugaccauagaccucgaccccguaaucuacgacagcaaauuugaaaagcagcucggacaaguaaugcuacucguguuaugugcuguucaacuccuucuaaugagaacaucaugggccuuaugugaagcauuaacguuggcgacagguccaauaacaaccuuaugggaaggaucuccuggaaaauuuuggaauacuaccauugcgguaucaauggcuaauauuuuccgaggcaguuauuuagcaggagcaggacuggccuuuucuauaaugaaaagugugggaacuggaaagcgagguacugggucucaaggggagacccuuggagagaaauggaaaaagaagcugaaucaauuaucuaggaaagaauuugaucuguacaagaaauccgggauaacugagguggauaggacagaggcgaaagaaggacuuaagcguggagaaauaacucaucacgcaguaagcagagguucggcaaaacugcaaugguuuguagaaagaaacaugguuauaccggaaggucggguaaucgauuuaggaugugggcggggaggcuggucuuauuauugcgcuggauugaaaaagguaacagaaguaagagguuauacuaaaggaggaccgggccaugaagaaccagugccuaugaguacguacggcuggaacaucguaaaauugaugucagguaaagauguauucuaucucccuccugaaaaaugcgacacacuauugugcgauauaggcgaaagcucuccuagcccuacgguagaagagagccgaacuaucagaguccugaaaauggucgaaccaugguugaaaaacaaccaguuuuguauaaaaguccucaauccauauaugccuaccguaauagaacaucuugaaagguuacaacgaaaacauggcggcaugcuggugaggaauccacuaucacguaacuccacacaugagauguacuggauaucuaacgguacagguaacaucguagcauccguuaacauggugaguagguuguuauuaaaucgauucaccaugacacacagacgcccaacaauugaaaaagacguagaccuuggagcuggaacacgacaugucaacgcugagccggaaacgccgaauauggauguaauaggagaaagaauuaagaggauaaaagaggaacacaauaguacauggcacuacgacgacgaaaauccauauaaaacgugggccuaccacggcucauacgaagugaaggccacagguucugcgucauccaugauaaauggaguaguuaagcuauuaacaaaaccaugggaugugguaccgaugguuacacaaauggcaaugaccgauacaacaccuuuuggacagcaacguguguuuaaggaaaaaguagauacuagaacuccgcggucuaugccaggcacgcgaagagugaugggcauuacagcagaguggcuauggagaaccuuaggacgaaauaaaaagccucgccuaugcacaagagaggaauuuaccaagaaaguuaggacuaacgcugcaaugggagcaguauuuacugaagagaaucaaugggacagugcaaaggccgcugucgaagaugaagauuucuggaagcuagucgaucgagaaagagaacuucauaaacuagggaaaugugguucuuguguuuauaauaugauggggaagagggaaaagaagcucggugaauuuggaaaagcaaaaggauccagagcaauaugguacauguggcuaggagcacgcuaccucgaguuugaggcacucggauuuuugaacgaagaucacugguuuagccgagagaauaguuauucaggaguagaaggcgaagguuugcacaaacuaggauacauucuacgagauauaaguaaaauuccagguggcgcaauguacgcggacgauacggcaggaugggauacccgaaucacggaagacgaucuccauaaugaagaaaagauuacccaacaaauggaccccgaacaucgccaauuagcaaacgcaauauucaaauugacuuaccaaaacaagguaguaaagguccaacggccuacaccuacggguaccguaauggauaucauuucaagaaaagaucagcgcggaagcggucaagugggaacauauggauuaaauacguuuacaaacauggaagcucaacuaauaaggcaaauggaaggagaagggguacuauccaaagcagauuuggagaacccgcaucucccggagaagaaaauaacucaguggcuagaaacuaaaggaguagagagauuaaaaaggauggcuauaucgggugaugauuguguagucaaaccaauugacgaucguuucgcaaacgcuuuacucgcauuaaacgacauggguaaagucagaaaagauauaccucaguggcagccaagcaaagguuggcacgauuggcaacaaguaccuuuuuguagucaucauuuucaugaacuaauuaugaaagacggucgaaaacucgugguuccauguagaccccaggaugaauuaauagguagagcacgaaucagucagggugcggguuggucacuaagagaaacugcuuguuuggggaaggcuuacgcacaaauguggucuuuaauguacuuccaucgucgugauuuacggcuagccaguaaugcaauauguagcgccguaccgguacauuggguacccacaucacgaacaacauggagcauacacgcacaucaucaguggaugacaacugaagacauguuaacaguauggaauaggguauggauugaggauaauccauggauggaagauaaaacgccgguaaccacaugggaagacguaccuuauuuggggaaacgagaagaccaauggugcggauccuugauagguuuaacgucuagagcuacuugggcucaaaauauaccaacugccauacagcagguacggagucucaucgguaaugaggaauuuuuagacuauaugcccuccaugaaaagauuucguaaagaggaagaaucagaaggggcuauaugguaa

SEQ ID NO: 23264 - RNA, 9873 nt, Artificial Sequence
  derived and/or modified CDS sequence (opt6) from DENV-3__KJ189281__SS-prME
accagccuuuguuuaaugaugauauuaccagcagcauuggcauuucauuuaacuucgcgagacggugaaccuagaaugauugugggcaaaaacgaacgaggaaaaucucucuuauuuaaaacugccaguggaauaaauaugugcaccuuaauugcgauggaccucggugaaaugugugaugauacgguuacuuauaaauguccucauauaacggaagucgaaccagaagauauugauuguuggugcaaccuuaccaguacuugggucacuuacggaacauguaaucaagcgggagaacauaggcgugauaaaagaucgguagcuuuagcaccccauguaggaauggggcucgacacccgaacccagacauggaugucggcagaaggugcuuggcgucagguagaaaaaguugaaacgugggccuuaagacaccccggguucaccauauuagcguuauuuuuagcacauuauaucgggacaagucuuacucaaaaaguagugauauuuauucuuuuaaugcucguuaccccaucaaugacaaugagauguguugguguagggaaccgcgauuucguugaaggauuaaguggugcaacaugggucgacgugguacuggaacacggaggauguguaacuacgauggcuaaaaauaaacccacuuuagauauagagcugcagaaaacagaggcaacgcaacuugccacacuucgaaaacuaugcauagaaggcaaaauaaccaauauaacaacggacagucgauguccaacacaaggagaagcaguacuaccugaagaacaagaccaaaauuauguguguaaacauacuuacguagacagaggauggggaaacggguguggacuauucgggaaagguagccuagugacaugcgcuaaauuucaaugcuuagaaccaauagaaggaaaaguaguacaauaugaaaacuugaaauauacaguaauuauaacuguccauacaggugaucaacaucaaguagguaacgagacgcagggaguuaccgcagagauuacaccgcaagcgucaacuacggaagcgacauugccggaauacggaacuuuaggacuugaauguucuccgagaacgggacuagauuuuaaugaaaugauucuacuuacaaugaaaaacaaagcguggaugguacauagacaaugguucuuugauuuaccguuaccauggacuucaggcgcgacaacugagacaccaaccuggaauagaaaagaacuauuaguaacuuucaaaaaugcgcaugccaagaaacaagaagugguuguauuaggaagccaagaaggagcaaugcauacugcacucacgggagcuacugagauacaaaacuccgguggaacaagcaucuuugcgggacaccuuaaaugccgguugaaaauggauaaacucgagcuaaaaggcaugucguacgccauguguacgaacacauuuguccuuaaaaaggaaguuagcgaaacccaacauggaaccauacucauaaaaguagaauauaagggugaagacgcaccauguaagaucccauuuaguacggaagacgggcacggaaaagcucauaauggaagacuuauaacggcgaacccgguaguuacaaagaaagaagaaccuguuaacauagaagcagaaccucccuucggagaaaguaacauuguaauagggauuggagacaacgcauuaaagauuaauugguauaagaaaggaucaucaauuggaaaaauguuugaagcuacugcgaggggagcacgaaggauggccauccucggcgauacugcuugggacuucggguccguaggaggaguuuuaaacucccucggaaagaugguacaucaaauauuugggucugcguacaccgcucuauuuucuggggucucauggguuaugaaaauuggaauugggguauuguuaacuuggauugguuuaaacagcaaaaauacgucgaugagcuuuuccugcauagcgaucggcauuauuaccuuguauuuaggagcaguugugcaggccgauaugggaugcgucauaaacuggaaaggaaaagaacuaaaaugugggaguggcauuuuugucacaaaugaaguucauacauggacagaacaauauaaguuucaagcggacucccccaaacgccuggcgacagccauugcaggcgccugggagaaugggguauguggcaucagaucuacgacuagaauggaaaaucuacuauggaaacagaucgccaaugaguuaaauuauaucuuaugggaaaauaauaucaaguugacagugguaguaggagauauaaucgggguccuagaacaagguaaaaggacgcuaacaccccaaccaauggagcuaaaauacaguuggaaaaccugggggaaagccaagauaguaacugcggaaacacaaaauagcucauuuauuauagauggaccaaauacuccugagugcccuuccgcuucaagagcauggaaugugugggaagucgaagauuacggauuuggaguuuuuacaacuaacauuugguugcgauuacgcgaaguauacacccaacucugcgaccaucgacuaaugagugcagcagugaaagaugaaagagcuguccaugccgacaugggauauuggaucgaaagucagaaaaaugguucauggaaacuagagaaggcuucacugauagagguuaaaacguguaccuggccaaagagucauacgcuauggucuaauggagugcuugaauccgacaugauuaucccaaaaucccuagcuggaccuauuagucaacacaaccauaggccgggauaccacacacaaaccgcaggucccuggcaucuuggcaaauuggaacucgauuucaacuacugugaagguacuacggucguuauaacagagaauugcggaacucggggcccgucacuccgcacaacaacuguuaguggcaaacuuauacaugaaugguguugccgaucauguacuuuaccuccguuaagauacaugggggaagacggauguugguaugguauggaaauaaggccaaucucggaaaaagaggaaaauauggugaaaucauuagugagcgcgggaucaggcaagguagauaauuuuacuauggggguucugugcuuagccauucucuuugaagaaguuaugcgagggaaauucggcaagaaacacaugaucgcaggaguauucuuuacauucguacuuuuauugucugggcagauaacguggcgugacauggcucauacauugauuaugauaggaaguaacgcaagugaucgaauggguauggguguaacauacuuagcauuaauugccaccuucaaaauacaaccauucuuaguacuaggcuucuuuuugagaaaacugaccagucgugaaaauuuacuccuagguguaggcuuagcuauggccacaacuuuacaguuaccagaagacaucgaacagauggcaaauggcauugcacuaggacuuauggccuuaaaacugauuacccaauucgaaacguaccaguuauggaccgcgcuaauuucccuaacauguaguaacacaauauuuacacuaacuguagcauggagaacugcuacauugauacuugcuggaguaucccuacugcccgucugucaaucaucuaguaugagaaaaaccgauuggcuaccaauggcaguagcugcuaugggcguuccaccuuugccacuuuuuauauucucacuuaaagacacucugaagcgaaggagcuggccccuuaacgaaggugugauggcaguaggucuaguuaguauccuugcgaguucucuguugagaaacgacguccccauggcaggaccguuaguagcgggaggauuacuuauagcauguuacguaauuacgggaacaucagcagauuuaacuguagaaaaggccgcagauauaacaugggaagaggaggcugagcagacugggguuagucauaauuuaaugaucaccguugaugacgauggaacgaugagaauuaaagacgaugaaaccgaaaacauacuaacaguacuauuaaaaacggcacugcucauuguuucgggcauauuuccuuauucuaucccugcuacauuacuggucuggcacacuuggcaaaaacaaacccaaagaaguggaguccuaugggauguuccuuccccgccagagacacaaaaagcagaauuggaagagggaguauaccguauuaaacaacaagguauuuucggaaagacucaaguuggaguagguguccaaaaagagggaguauuccauacgauguggcauguuacuagaggggccgugcuaacguauaauggcaagagauuagagcccaauugggcaucagucaagaaagacuugauuucauaugguggcgguuggagauuaucaacacaguggcaaaaaggagaagaagugcaggucauagcuguagaaccagggaaaaacccaaagaauuuucaaacgaugcccgguacauuccaaacgacgacgggagagauuggcgcuauugcuuuagauuuuaagccugguacaucaggaucgccuaucauaaacagagaaggaaagguggugggauuguacgggaauggaguagucaccaaaaacgguggauaugugucgggaauagcacaaacuaacgcugaaccugacggaccuacaccagaacuggaggaagagauguuuaagaaacgaaaucuuacaauuauggaucuccauccaggaagugguaaaacaagaaaguauuuaccagcgauaguucgagaggccaucaaacgccgcuuaagaacguuaauuuuagccccaacacgcguagucgcggccgaaauggaagaagcucuaaaaggauuaccuauccgcuaccagacgacggcaacaaaaucagaacacacaggaagagaaauaguagacuugaugugucaugcaacauucacaaugcgucugcuaucuccagugcgaguuccaaauuauaauuugaucauaauggacgaagcccauuucacagacccagccucaauugcggcaagaggguauaucuccacaaggguugguaugggcgaagcagcggccauauuuaugaccgccacaccaccaggcacagcagacgcuuuuccgcagucaaaugcgccaauacaggaugaagaaagagacauaccagagagguccuggaacagcggaaacgaauggauaacagacuucgcaggcaagacuguaugguuugucccaaguauaaaagcuggcaaugacauagcaaauuguuuaaggaaaaacgguaagaaaguuauacaacuaagcagaaaaacguuugacacugaguaucagaaaacuaaguugaaugauugggauuuugugguaacuacagauauaagugaaaugggagcuaauuucaaggcugaccgcguuauugacccaaggagauguuugaagccugugauccucacagacgguccagaaagaguaaucuuggcagguccaaugcccgugacugcagccagcgcagcucaaaggagaggaaggguuggaagaaacccucaaaaggaaaacgaucaauauaucuucaccggccaaccauugaauaaugacgaagaucaugcucacuggacggaagcaaagauguuacuggauaacauaaauacaccugagggaauaaucccagcccuguuugaacccgaaagagagaaaagugcugcaauugacggugaauacagacugaaaggugaaucacgaaaaacuuuugucgaauugaugaggcgaggagacuugccagucuggcuggcacacaaagucgcaagugaaggaauuaaauacacggaucguaaauggugcuuugauggucaacguaacaaucaaauuuuagaggaaaacauggacguagaaauuuggacaaaagaaggagagaagaagaaauuaagaccgagguggcuagaugcgcgaaccuacagugaucccuuggcauuaaaggaauuuaaagauuuugcggcugggcgcaaaagcauagcccuggaucucguaacagaaauuggucgaguaccaucccaucuugcucaucguacacgaaacgcucuggacaaucugguaaugcuacauacaagugaacaugggggaagggcuuacagacaugcuguagaagaguuaccagagacuauggaaacgcuauuauuacucggcuuaaugauuuuacuuacuggaggugcgaugcucuuuuuaauaucaggaaagggaauagguaaaaccucuauuggcuuaauuugugugauagcgucaagcgguaugcuauggauggcagaaauaccacuucaauggauagcgagcgccauaguccuagaauuuuucaugaugguguugcuaauacccgaaccugaaaaacaacgaaccccgcaggauaaucaauuggcuuacgucguuauagguauccuaaccuuggcagcaauuauugcagcgaaugagaugggauuauuggagacuacuaaaagagacuuagggaugucaaaagagccggguguuguaagcccuacgucuuauuuagaugucgaucuccauccagcaucagcauggacacucuacgccguggcuacuacuguaauaacgccuauguuaagacacacaauagaaaacuccaccgcuaaugugucauuggccgcaaucgcuaaucaggcaguagugcuaauggguuuggauaaagguuggccaauaucaaaaauggacuuagggguaccguuauuagcauuagguuguuacagucaagucaacccccuuacacugacugcugcaguccuacuauuaauuacucacuaugcuauaauaggacccggauuacaagcaaaagcuacuagagaagcccagaaaagaacugcggcgggaaucaugaaaaaucccacuguugacgguauaaugacgauagacuuagauccagugauauacgacucaaaguuugaaaaacaauuaggccaagucaugcuauuaguacuuugcgcuguucaacuacuauuaaugaggacgaguugggcauugugcgaagcacuuacuuuagccacuggaccuauuacaacuuuaugggaagggagucccgguaaauuuuggaauacuacaauagcgguuaguauggccaacauauuuagagguagcuaucuggccggugcaggacuggcauuuucuauaaugaagucagucgggacgggaaaacgaggaacuggcucgcaaggggaaacguuaggagaaaaguggaagaagaaacugaaccaauuaucucguaaagaauuugaucuauauaaaaagucgggcauuacagaggucgacaggacagaagcuaaagaaggucuuaaacgaggagaaauaacacaucaugcaguuucacgugggagugcgaaauuacagugguucguugaaagaaacaugguaauccccgaagggcgaguuauagauuuaggcugcggccgggguggguggucauacuauugugcgggacuaaagaaaguuacugagguaagaggcuacacaaaagguggaccaggacacgaggaaccaguaccaaugucaacguacggauggaauauugucaaacuuaugucaggaaaagauguguucuauuugccacccgaaaaaugcgauacuuuguuaugcgauauuggagaaucuuccccuuccccaacuguugaagaaagcagaaccauucguguucuuaaaaugguggaaccauggcuaaagaauaaccaauuuuguauuaaaguguuaaauccuuauaugccuacaguuaucgaacaucuggaaagguuacaacgaaaacaugguggaaugcugguccguaacccucuaucacgcaauucuacucaugagauguacuggauuuccaaugggacagggaacauagucgccuccguaaauaugguaagcagacuauuacucaauagauuuacaaugacucaucgacgaccgaccauagaaaaagauguugaucuuggggcaggaacaagacauguuaacgccgaaccugaaacuccaaauauggauguuauuggggaacguaucaaacguauuaaagaggaacacaacucuacauggcacuaugacgacgaaaacccauauaaaacaugggcauaucacgguaguuacgaagugaaggcgacgggaucagcuucuucuaugauaaacggaguuguuaaacuuuugacuaaaccgugggacguuguuccuaugguaacucaaauggcaaugacagauaccaccccuuuugggcagcaaagaguuuuuaaagaaaaaguggauaccagaacaccgagaaguaugccuggcacucggagagugauggggauuacugcggaguggcuauggcgaaccuuaggucgaaauaagaaaccaagacugugcacacgagaggaauuuacuaagaaagugagaaccaacgccgccaugggugcagucuucacagaagaaaaccagugggacagugcgaaagccgcaguagaagaugaggauuuuuggaaguuggucgaucgcgaacgcgaauuacauaaauuagguaaauguggaaguugcguauauaauaugauggguaaacgagagaagaaacucggcgaauuugggaaggcuaaaggaucuagggcaaucugguauaugugguuaggugcucgauauuuggaguuugaagcccucggauuuuugaacgaagaccacugguuuucacgagaaaacaguuauucggguguagaaggugaggguuugcauaaacuaggauauauacuacgugauauaucgaaaauaccuggaggagcgauguacgccgaugacacagccgguugggauacucgaauaacagaagacgacuuacacaaugaagagaaaaucacacaacagauggauccagaacaccgacaauuagcaaaugcuauauuuaaacuaacauaucaaaauaaaguaguaaaagugcagcggccaacaccaaccggaacaguaauggauauaauaagcagaaaggaccaaagagggucgggucagguaggcacauacggucuaaauaccuucacgaacauggaagcacaacugauacgccaaauggaaggugagggaguuuugucaaaagcggaccuagaaaauccucacuuaccagagaagaagauaacacaauggcucgaaaccaaaggaguagaaaggcucaaacguauggcuauuaguggugaugauuguguagucaaacccauugaugaucgguuugcaaaugcacugcucgcauuaaaugauauggggaagguacgaaaagauauaccccaauggcagccaucaaaagguuggcaugacuggcagcaaguccccuucuguagucaccauuuucacgaauugauaaugaaagauggucguaaauuagucguaccuugcagaccucaagacgaauugaucggccgagccagaaucucucagggagcaggauggucccugcgcgaaaccgcgugucuagguaaggcuuaugcacagauguggucgcuuauguauuuucaucgaagagauuugcggcuugccaguaaugcaauuugcucagcaguccccgugcauuggguacccacuucgagaacgacuuggaguauccaugcacaccaucaauggaugacuacagaagauauguuaacaguguggaaucgaguguggaucgaagacaauccuuggauggaagauaagacaccagucacaaccugggaagauguuccauaucugggaaaacgcgaagaccaaugguguggaucacuaauaggacuaacaaguagggcgacuugggcacagaauauuccaacagcaauacaacagguacgaucucucauagguaacgaggaguucuuagacuauaugccaucaaugaaaagauuucgaaaggaagaagaaagcgaaggggcaaucugguga

SEQ ID NO: 23265 - RNA, 9873 nt, Artificial Sequence
  derived and/or modified CDS sequence (opt6) from DENV-3__KJ189282__SS-prME
acgagccuuugccuaaugaugauuuuaccugccgcuuuagcuuuccacuuaacaucacgagacggugaaccgaggaugauaguuggcaaaaaugaacgugguaaaagucuauuauucaaaacggcauccggaauaaauaugugcacguuaauugccauggauuugggagagaugugcgaugacacggucacauacaaauguccgcauauaaccgaaguggagccggaagauauagacugcugguguaaccuaaccagcacuuggguaacauacggcaccuguaaucaagcaggagaacacagaagagauaaaagaucuguggcucuggcaccacauguaggaaugggauuagauacgaggacucaaacauggaugucugcagaaggagcuuggagacaagucgagaaaguagaaacgugggcacuucggcauccaggauuuacuauauuagcacuauuuuuagcacacuauauaggaacuuccuugacacaaaaaguuguuauauuuauacuacucauguuaguuaccccaaguaugacuaugcggugcgugggggucggaaaucgagacuuuguugaaggccuaaguggcgcuacuuggguagacguugucuuagagcauggaggaugcguaacgacaauggccaaaaauaaacccacccucgauauugaauuacagaaaacugaggcaacacaacuagccacacuacgaaaacuguguauugaaggaaaaauaacuaacauuacuaccgauucccgguguccaacccaaggagaagcagucuuaccagaagaacaagaucaaaacuauguauguaaacacacauauguggacagagguugggguaauggauguggacuuuucgguaaagguagccuaguuacuugugcuaaauuucaaugucuagaaccaauagaaggcaaaguuguucaauacgaaaaccuaaaauacacggugauuauaacaguucacacaggggaccaacaccaaguagggaaugaaacacaagguguuaccgcagaaauaacuccacaagcuaguacaacugaagcuacguuaccugaguacggaacucugggccuagaauguuccccacgcacaggccuagauuuuaacgaaaugauauuacugacuaugaaaaauaaggcuuggauggugcaucgucaaugguucuuugauuugccacuaccauggacaucuggagcaacaacugagacuccuacuuggaauagaaaagaguuguuggucacauuuaagaacgcucaugcuaaaaagcaagagguaguuguacuuggaagccaagaaggagcuaugcauacugcauuaacuggagcgacugaaauccaaaauucaggagggaccagcaucuuugcggggcaccugaaaugucgauuaaaaauggauaaacucgaauuaaaagguaugucguaugcuaugugcacuaauacuuuuguguugaagaaagaagucucggaaacccaacaugggacaauauuaauaaaaguugaauauaaaggagaagacgcuccauguaaaaucccuuuuaguacugaggacggacauggaaaagcccauaaugguagacucauaacagcaaauccugucgucacuaagaaagaggaaccaguaaacauugaagccgagccaccuuuuggagagagcaauauuguaauaggaauaggugauaaugcacuaaaaauaaacugguacaagaaaggaucuucgauuggaaaaauguuugaagcaacagcuagaggugcccguagaauggcuauuuuaggagauacugcuugggauuuuggcucagugggaggaguauuaaauucauugggaaaaaugguacaucaaaucuucggaucagcauauacagcauuguuuagcggcguaagcuggguaaugaaaauugggaucgggguucucuuaacuuggauuggacuaaacucuaaaaacacaucgaugucauucucaugcauugcgauugguauaauaacacuauaucuaggugcaguaguacaggcugauaugggcuguguaauaaauuggaaaggaaaggaacugaaauguggcucagguauauuugucacaaacgagguucacacauggacagaacaguacaaauuccaagcagauucacccaaaagacuagcgacugcgaucgcaggagcaugggaaaacgguguauguggcauucguagcacuacgcguauggaaaauuuauuauggaagcagaucgcgaacgaauugaauuauauccuaugggagaacaauaucaaacuuacagucguaguuggagauauaauaggcauucuugaacagggaaagcgaacuuuaacaccgcaaccgauggaauugaaguauagcuggaaaaccuggggaaaagcaaaaauagugaccgcagagacacaaaacagcaguuuuauaauagauggacccaacacaccagaauguccaagcgcaucaagagcuuggaaugugugggaagucgaggauuacggauuuggaguauuuacaacgaauauaugguugagauuaagggaagcguacacacaacuaugcgaucacagacucaugagcgcugcaguaaaggaugagagagcagugcaugcggauaugggauauuggauugagucucagaaaaauggcucuuggaaauuagaaaaagcaagccuaauugaaguuaaaacauguacguggcccaaaucucauacacuuuggagcaacgggguacucgagucugauaugauuauacccaaaucauuagcagguccaaucagucaacauaaucacagaccaggcuaccauacacaaacggccgguccuuggcacuugggaaaacucgaacucgacuuuaacuacugcgaaggaaccacaguaguaauuacugagaacugcggaacgagggguccuagccugcguacuacaacaguaagcgguaaauuaauacaugaaugguguuguagaucauguacacuaccaccauuaagauauaugggugaagauggcuguugguaugggauggaaauucgucccauauccgaaaaagaagagaauaugguaaaaagccuuguuucagcgggaucagguaaagucgacaacuuuacuauggggguucuauguuuagcuaucuuauuugaagaaguaaugcgagguaaguuuggaaagaaacauaugauagcaggcguuuucuucacguuuguacuuuuauugucaggacaaauuacuuggagagauauggcgcauacauugaucaugauaggaucuaacgccagugauagaaugggaauggggguaacguaccuagcacuaauagccacuuuuaaaauacaaccauuuuuggcccuaggauucuuucuacgaaaauuaacgagccgcgagaacuuacuacuuggagucggauuagcaauggcuacaacacuacaauugccagaggauauugaacagauggcaaacggcauagcguuaggacuaauggcccuaaaacuaauaacacaauucgagacuuaucaacuauggacagcauuaaucaguuuaacuuguucgaacacaauuuucacccugacaguggcguggagaacagcgacgcucauucuagcuggaguaucacuacuuccagugugccaguccagcucuaugagaaaaaccgacugguugccaauggcaguugcagcaaugggaguuccgccccucccacuauuuauauucucauuaaaagacacgcuuaaaagacgaucguggccucucaaugaaggaguaauggccgucggauugguuaguauauuagcgucaucuuuauuacgcaacgacguaccuauggcaggaccuuuaguagcggguggcuuacuaauagcuuguuaugugauaacaggaacaucagcugaucuaacuguugagaaagcagcugauauaacuugggaggaagaagcagagcagaccggaguuagccauaacuuaaugauaacugucgacgacgaugggaccaugcguauuaaagacgacgagacggagaacauacuuacgguauugcucaaaacugcucucuuaauaguuagugggauuuucccauacucaauaccggcaacccuauuaguguggcauacuuggcaaaaacaaacacaaaggucaggaguauuaugggacgugccuucaccacccgagacgcagaaagcagaguuggaagaaggcguauacaggauaaaacaacaaggaauauuuggcaaaacacaaguuggcguggggguucagaaagagggaguauuucacacaauguggcauguaacgaggggcgcagucuuaacuuauaacgguaaacgacuugaaccaaacugggcuagcguuaagaaagaucuaauaagcuacggaggaggauggagacuaucuacacaauggcaaaaaggcgaagaagugcaagugauagcagucgaaccggguaaaaaucccaaaaauuuucagacaaugccugguaccuuccaaacuacaaccggagaaauuggugcuauugcauuagacuuuaagccuggaacgucaggaaguccaauaauuaauagggaagggaaaguaguaggguuguacgguaacggcguaguuaccaaaaauggggguuauguaagcgguaucgcacaaacaaaugcagaaccagacggcccaaccccggaauuagaagaagaaauguuuaagaaacggaaucuaaccauaauggauuuacauccaggauccggaaagaccagaaaauaucugccagcuauugucagagaagcaauuaagcgaaggcuaagaacucuaauucuagcgccgacaagaguggucgcggccgagauggaggaagcucucaaaggauuaccaauucgcuaucaaacaacagcaaccaaaucagaacauacgggacgagagauuguggaucuuaugugucacgcaacuuuuaccaugcgacucuugagucccgugcgcguaccaaacuauaacuuaauuauaauggacgaagcucacuuuacagauccagcuaguauagccgcucgaggauauauuucgacaagggucgguaugggagaagcagcugcaauuuuuaugacagcuacuccuccagguacagcugaugcuuucccgcagaguaaugcgcccauucaggacgaagaaagagacauccccgagcgaaguuggaacucaggaaacgaauggauaacagauuuugccggaaagacagucugguuuguuccuucaauuaaagccggaaaugauaucgcaaauuguuuaaggaaaaacggcaaaaagguuauccaauuaucccgaaaaacuuucgauacagaauaucagaaaacaaaguuaaaugacugggacuucgugguaacgaccgauauaucugaaaugggagcgaacuucaaggcagauagaguuauugaccccagacgcugccuaaagccaguaauuuuaaccgauggcccagaaagaguuauucuagcuggccccaugccggucacagcagcaagugccgcacaaagacgaggcagaguaggaagaaauccucaaaaggaaaaugaccaauacauuuucacaggucagccauuaaacaaugacgaagaucaugcucacuggacagaggccaaaaugcuguuagauaauauaaauacuccagaaggcauaaucccggcucuauuugaaccagaaagagaaaaaucugcugcgauagauggagaauaucgucucaaaggugaaagccgaaaaacauuuguggaacucaugcgucguggugaucugccaguguggcuagcacacaaagucgcaagugaagguaucaaauacacggacagaaaaugguguuucgauggucaacguaauaaucaaauacuagaagaaaacauggauguagagauauggacaaaagaaggugagaagaagaaacuaagaccuagaugguuagaugcuagaaccuauuccgauccauuagcacugaaagaauuuaaagauuuugcagcaggaagaaagucuauugcucucgauuuggugacugaaauuggccgagugccaagccaccuagcucauagaaccagaaacgcucuagauaaucuuguaauguuacauacguccgagcauggcggucgcgccuauagacaugcuguugaggaauuaccggaaacuauggaaacauuauuacuuuuaggucucaugauuuuauuaaccggaggagcgauguuguuccucauaucuggcaaagggauagguaagacaaguauaggccuuauuugcguuauagcaaguucaggaaugcuauggauggcggagauaccuuugcaauggauagccucagcgaucguauuggaauuuuucaugaugguauuacuuauaccugaaccagagaagcaaagaacaccucaggauaaucaauuggcuuacguagucaucggcauauuaacucuggcggcgauaauagcugcaaacgagaugggcuuacuugagaccacgaaacgugaucuugggaugaguaaggaaccgggaguagugagccccaccagcuacuuagauguugaucuucacccggcaucugcguggacucuauaugcgguagcaacaaccgugauaacgccaauguuacggcauacaauugaaaauucuacagcuaauguaaguuuagcggccaucgcuaaccaggccguuguacugaugggacuagauaaaggauggccuauuucuaaaauggauuuagggguaccccucuuagcacuuggguguuauucacagguaaacccucuaacccuuacagcagcaguuuuacuacucauuacccauuaugcaaucaucggacccggacuacaggcgaaagcgacgagggaggcacagaaaagaacagcugcuggaauaaugaagaauccaacagucgacgguauaaugacaauagaccuugauccuguaauauacgauaguaaguucgaaaaacaacugggccaaguaaugcuucucgugcucugugcaguucaguuguuacucaugagaacgucgugggcguugugcgaagccuuaacuuuagcgacagguccaaucacaacgcucugggagggaagucccgggaaauuuuggaacaccacgauagcugugucuauggcuaacauauuuagagggucuuauuuagcaggcgcuggacucgcauucaguauaaugaaaucagucgggacagguaaaagaggaacuggaagucagggcgagacacucggcgaaaaauggaagaagaaauuaaaccaacuaagcaggaaagaauuugaucucuacaaaaagucaggaauaaccgaaguggaucguacagaagcaaaagaaggcuugaaaagaggagagauuacucaucacgcagucucaagagggucugcaaaacugcagugguuuguagaacgaaacauggucauaccugaggggcguguaauugaccuuggguguggccgcggaggaugguccuauuauugugcggggcucaagaaagucacggaaguacggggauauacaaaagguggcccaggacacgaggagccugucccgaugucaacuuacgguuggaacauuguuaaacuaaugaguggaaaagauguauuuuauuuaccuccugaaaagugcgacacacuuuugugugacauuggugaaucgagcccuuccccaaccguagaagaaucuagaacuauccgagucuuaaagaugguugaaccuuggcucaagaauaaccaauucuguauuaaaguguuaaaucccuauaugccuaccgucauugagcauuuggaacgauugcaaagaaagcaugguggcaugcucguucgaaauccucuaaguagaaacucuacccaugaaauguacuggauuaguaaugguacggguaacauaguugcgucaguuaacaugguaucaagauuacuauuaaaucgauucacaaugacucacagaagaccaacuauagaaaaagacguggaccuuggugcagggacgcgacacguaaaugcagaaccagagacgccuaacauggauguuauaggugaaaggaucaaaagaauaaaggaagaacauaauuccaccuggcauuaugaugaugaaaauccauacaaaacuugggcauaucacgggucguaugaagucaaggcgacugggucggcaucuucuaugauaaauggagucgucaaacuucuaacaaaaccuugggaugugguucccauggucacacaaauggcaaugaccgauacgacacccuucggacagcaaagagucuuuaaagaaaaaguggauacccguacaccucguucaauggcggguacacguagaguaaugggaauaacagcagaauggcuauggcggacgcucggucgcaacaagaaaccgagauuaugcacucgagaagaauuuaccaaaaagguucguacaaacgcugcaaugggggccguauuuacggaggagaaucagugggauucugcgaaagccgcgguagaagacgaagacuucuggaaauuaguggacagggaacgugaacuacauaaacucggaaagugcggguccugugucuacaauaugauggggaaaagagagaagaaacuuggcgaauuugggaaagcaaaaggaagucgagcuauaugguacauguggcuuggugccagguaucuggaauuugaagcacuaggguucuuaaacgaggaucauugguuuucacgugaaaauucguacagugguguagagggugaaggccuucauaaauuagguuauauacuaagggauauaucaaaaauaccagggggagcuauguaugccgaugacacagcaggcugggauacgagaauuacagaagaugaucugcauaaugaggagaaaauaacacaacaaauggauccggaacacagacaauuagcaaaugcuaucuucaaauuaacauaucagaauaaagugguaaaaguacaaagacccacuccaacaggaacaguaauggauauuaucucccgcaaggaucaaagaggcucagggcaaguagguacuuacggauuaaacaccuucacaaacauggaagcacaguuaaucagacaaauggagggagaaggagucuuaucaaaggccgaccuagaaaauccgcaucugcccgagaaaaagaucacacagugguuagaaacaaaagguguugaacggcuaaaaagaauggcuauaagcggagacgauugcguagucaaaccuauugaugauagguuugccaacgcucuccuggcgcucaaugacauggggaaaguucgaaaagacauaccucaguggcaaccuaguaaagguuggcaugauuggcaacaaguccccuuuugcucacaccauuuccacgaguugauaaugaaagacggacgaaagcuaguuguccccugcaggccacaagacgaacuaauaggcagagcaagaauuucccaaggagcaggauggucacuucgagaaacggccuguuuagggaaggcuuaugcacaaauguggucccugauguauuuccacagacgugaccuaagacuagcaucaaacgcaaucuguucugcaguccccgugcacuggguaccgacaucuagaacaacguggucaauccaugcgcaucaucaguggaugacgacugaggauauguugacuguuuggaaccgugucuggaucgaggauaacccauggauggaagauaaaacuccaguuacaacaugggaggaugucccguacuuaggaaaaagggaggaccaauggugcggcagcuugauaggacuaacuucaagagcuaccugggcacagaauauaccuacagccauacaacaaguacgaaguuuaauuggaaacgaagaauuuuuagauuacaugccgucaaugaaacgguuccguaaagaagaagaaucagaaggugcuaucugguga

SEQ ID NO: 23266 - RNA, 9873 nt, Artificial Sequence
  derived and/or modified CDS sequence (opt6) from DENV-3__KJ189283__SS-prME
acuucauuaugucuaaugaugauccugccugcagcucuagcauuucauuuaacuucaagggauggagaaccucgaaugauagugggcaaaaaugaaagaggaaaaaguuuauuguucaaaacagcgucgggaaucaauaugugcacauugauagcaauggacuuaggagagaugugugacgauacgguaacauacaaauguccucauauaacagaaguagagccagaagacauugacugcugguguaauuugacaucaacguggguaacauaugguacuuguaaucaagccggugaacauaggcgggacaaacgcucaguugcauuagcaccucauguggguaugggacuggacacucggacccaaacauggaugucggcugagggugcauggcggcaaguagaaaaaguagaaaccugggcauuaaggcauccagguuuuacaauacuagcucuguuuuuagcacauuacauuggaacuucucuaacccaaaaaguaguaauauucauucuauugaugcuaguuacuccaucaaugacuaugaggugugucggagugggaaaucgugauuuuguagaaggucuaagcggugcgacaugggucgaugucguccuagaacauggcgguuguguaacaacaauggcuaaaaauaaacccacacucgauaucgaacuacagaaaacagaagcaacgcaauuggcaacacucagaaaauuaugcauagagggcaaaaucaccaacauuacaacugacucacgaugcccaacacaaggagaggcagugcucccagaggaacaagaucaaaacuacguaugcaaacacacuuacguagaccgcgggugggguaaugguugcggcuuauucgguaaggggagcuuaguaaccugugcaaaauuucaaugucuagaaccaaucgagggaaaaguaguacaauaugagaauuuaaaauauacuguaauuauaacgguucacacaggagaccaacaccaaguugguaacgagacacaaggaguaacugcagagauuacuccacaagcaucuacaacugaagccacacuuccagaauacggaacacugggauuggaauguaguccgcgaacugguuuagacuucaacgagaugauucuucuuacuaugaaaaauaaagccuggaugguacacagacagugguucuuugaccugccacugccuuggacgagcggcgcgacgacugaaacaccaaccuggaauaggaaagaguuauuggugacauucaaaaaugcucaugccaagaaacaggaaguugugguauuagguucucaagagggugcuaugcacaccgcgcuaaccggagcaacggaaauucaaaauagcggugguacgucaauuuuugcaggccauuuaaaauguaggcuuaaaauggacaaauuagaacuaaaagguaugucauacgcaaugugcaccaauacauuuguucuuaagaaagagguuucggaaacacaacacgggaccaucuuaauaaaagucgaauauaaaggcgaggacgcaccauguaaaauaccauuuaguaccgaagauggacauggaaaagcacauaauggccgguuaauuaccgccaacccuguaguuaccaagaaagaagaaccaguuaauauagaagcagagccaccauuuggagaaagcaauauaguaauagguauaggagauaaugcacuaaagauuaauugguauaagaaagggucaagcauuggaaaaauguuugaagccacggcuagaggugcacggagaauggcaauuuuaggggauacagcgugggacuuugguucagucgguggaguacucaauagccuaggaaaaauggugcaccagaucuuugguucagcauacacagcacuauuuucaggcguaucuuggguuaugaaaauaggaauuggcguacuacuaacuuggauugguuuaaauagcaaaaauaccuccaugucauuuuccugcauugcaauaggaauuauaacucuuuauuuaggggcuguagugcaagcagacauggguugugucauaaauuggaaggggaaagaacuaaaaugcggcagcggaauauuuguuaccaaugagguacacacguggacugaacaauacaaauuccaagcagacucuccgaaaagacuagcgaccgcuauagcuggcgccugggaaaauggaguuugcggaauccgcagcacuacuagaauggaaaaucuucucuggaagcaaaucgccaaugaauuaaauuauauauugugggaaaauaauauuaaauugacgguggugguuggugacauaaucggugugcuagaacagggaaaaagaacccuaacuccccaaccuauggaacugaaauauaguuggaaaacuuggggcaaagcaaaaauagugacagcugaaacucaaaauucuucauuuauaauugaugguccgaacaccccugaauguccgagcgcuucacgagcauggaacgucugggagguggaagauuaugguuuuggcguguucacuacgaauauuuggcuaagacuucgugaagucuacacacaacugugcgaccauaggcucaugucggcagcuguuaaggaugagagagccguccacgcugacauggguuauuggaucgaaucgcagaaaaacggaagcuggaaauuagagaaagcaucuuugauagagguuaaaacauguacauggccaaaaucacacacguuauggucaaacggcguacucgaaagugauaugauaauaccgaaaagccuagcgggccccauaucucaacacaaucacaggccaggauaccauacucaaacugcaggucccuggcauuuaggcaaacuagaacuugacuuuaauuauugugagggaacgacagucguuauaacagaaaauuguggcacccgaggaccuagucuaagaaccacaacugucucaggcaagcugauacaugaauggugcugcagaaguugcacacugcccccgcuacgauauaugggggaggacgguuguugguacggaauggaaauacgacccaucucggaaaaggaggaaaauauggugaaaucacuuguaagugcagguagcgguaaaguugauaacuuuaccaugggaguguuaugccuugcaauccucuucgaagaaguaaugagagggaaauucggaaagaaacauaugaucgcggguguuuucuuuacauucguuuugcuacuguccggacaaauuacguggcgugacauggcacacacguuaauaaugauuggaucgaaugccucugaucguaugggaauggguguaacguauuuagcauugaucgcuacguuuaaaauucagccauuuuuagcuuugggauucuuucuaagaaaacuaacaucaagagaaaauuugcuguuaggagucggcuuagcaauggccacaacacuccagcuacccgaggacauagaacaaauggcaaacggcaucgcccuaggauuaauggcacucaaauuaauuacacaguucgaaacuuaucagcuuuggacggcgcuaauaucuuuaacuuguucgaaaacuauuuuuacucuaacaguugccuggagaacggcuacucugauccuagcaggcguaucgcuauuaccgguuugucagagcaguucgaugagaaaaacugauuggcugcccauggcgguggcagcaaugggagugccaccguuaccacuuuuuaucuucucccuaaaagacacucucaaaagaaggagcuggccguugaacgaaggugucauggcaguaggauuaguaucgauacuggccucuucacuucuaaggaacgacguucccauggcgggaccgcuaguggcuggaggacugcuaauagcauguuaugucauaacggggacaagugcagaccuaacaguagagaaagcagcagacauaaccugggaagaagaagcugagcaaaccggaguaucacacaacuugaugauuacuguggacgacgauggaacaaugagaaucaaagaugacgagacugaaaauauacuaaccguccuuuugaaaacggcacuguuaauaguguccggaauauucccauauucaauuccagcgacccuguugguauggcauaccuggcaaaaacaaacacaacgaucugguguacuuugggacguaccaucgcccccggagacacaaaaagcagaacuugaagaaggaguuuaucgaaucaaacagcaaggaauauucggcaaaacacaaguagggguaggaguucaaaaagaagguguauuucacaccauguggcauguaaccagaggugcaguucuaacauauaacgggaagaggcuagagccgaacugggcaucugucaagaaagaucuaauaaguuauggaggcgguuggcgauuaucaacccaguggcaaaagggugaggaagugcagguuauagcaguagaaccuggaaagaaucccaaaaauuuccagacaaugccgggaacauuucaaacaacuacuggugaaauaggagcuauugcguuggauuuuaaaccaggaacauccggaucaccuauaauuaaccgagaagguaaagucgugggacuauauggcaauggcguuguuaccaaaaaugggggauacgucuccgguauagcacaaacaaaugcagagccggaugguccuacgccagaacuugaggaagagauguuuaagaaacgaaauuuaacuauaauggauuuacauccaggaucgggaaaaacaagaaaauauuuaccagcgauuguucgcgaagcaauuaaacgacgauuacguacacuaauauuagcuccaacacgcgucguugccgcugaaauggaagaagcacuuaaagggcuacccauaagauaucaaacuacugccacgaaauccgaacauaccggccgugaaauaguagauuuaaugugccaugcuacauuuacuaugcguuuacuaucaccaguucggguuccaaacuauaaccuaauaauuauggaugaagcacauuuuacagacccagccucgauagcagcaagaggauacauaaguacuagaguaggaaugggagaagccgcagccauauucaugaccgcaacuccaccaggaacugcugacgcauucccacaaucaaaugcaccaauccaagaugaagaacgggauauuccagaacguucguggaacuccgggaaugaauggaucacugauuucgcgggaaaaacuguaugguucgucccuaguauuaaagccgguaacgacauagcgaacuguuugcgaaagaacggcaagaaaguaauacaacuaaguagaaaaacuuucgacacggaauaucagaaaacaaaacuaaacgauugggauuuugucguuaccaccgacauaagugaaaugggcgcaaauuuuaaggcugaucguguaauagaucccagaaggugccucaaaccggucauccucacagaugguccagagagaguuauauuagcagggcccaugcccguaacagcagcuucagcggcccagcggaggggccgugugggacguaauccacaaaaagaaaaugaccaauauaucuuuacuggucaaccacuuaauaaugacgaagaccacgcacacuggacggaggcaaaaaugcuacuagacaauaucaacaccccagaaggaauaaucccagcacuuuucgaacccgagcgagagaaaagugcugccauagauggggaauaucgacuuaaaggugagucaagaaaaacauuuguagaauuaaugcgucggggagaucuaccagucuggcuggcccacaaagucgcaucugagggcauaaaguauacggauaggaaauggugcuucgauggccaaaggaauaaccaaauacuagaggaaaauauggaugucgaaauauggacuaaggaaggagagaagaagaaauuacgcccaagaugguuagacgcuagaacauacagcgauccacucgcucuuaaagaauuuaaagauuuugcagccgguaggaaaaguauagcccuagaucuggucacugaaaucgggagagucccgagccacuuagcacacagaacacguaaugcccuagauaaccucgugauguugcacacgucagaacaugguggaagggcuuacagacacgcugucgaagaauuaccggaaacaauggagacucuauuacuacuugggcuaaugauacuacucaccggaggugcaaugcuauuccuaauauccggcaaaggaauuggaaaaacgaguauagguuuaaucuguguaauagcuuccagugguauguuauggauggcagaaauacccuugcaauggauagcgucggccauuguccuagaguucuuuaugaugguacuucuuauacccgaaccugaaaaacaaagaaccccacaagacaaucaacucgcauaugucguaauagguauauuaacacuagccgcuauuaucgcugcaaacgaaaugggacucuuagaaaccacaaaacgggacuuagggaugagcaaagaaccagggguaguuuccccgacaucauacuuggauguagaccuacacccagcgucagccuggaccuuauacgcaguggcaacaaccguaauaacgcccaugcuacgacauacaaucgagaauagcacagcuaaugugagcuuagcagcaauagcaaaccaagcaguaguucuaaugggauuagauaaaggauggccaauaaguaaaauggaucuaggaguuccauuacuagcacugggaugcuacucucaagugaacccacugacuuuaaccgcugcagucuuacuauuaauaacucauuacgcaaucauagggccaggauuacaagcuaaggcgacacgagaagcgcaaaagaggacagccgcgggaaucaugaaaaacccgacgguugacggaauaaugacuauagacuuagauccugucauuuaugauaguaaauucgaaaaacaacucggacaaguuaugcuucuagugcugugugcuguacaguuacuguuaaugcgaacuuccugggccuuaugugaagcucuuacuuuagcuacgggaccuaucacaacacuuugggaaggcagcccaggaaaauucuggaacacaacgaucgcugugucaauggcuaacauauucaggggaucuuaucuagcuggggcgggauuagcauucaguauuaugaaguccguagggaccgggaaacgagguacuggaagucaaggagagacucuuggagaaaaauggaagaagaaauuaaaucaguugucaaggaaagaguuugauuuauauaagaaaucgggaauaacagaaguagaucguacugaggcaaaagaagggcucaaaagaggcgaaauaacacaucaugcagucucucgaggcucugccaaauuacagugguuuguugaacguaacaugguuauaccugaaggaagaguaauagaccuaggcugugggcggggcggcuggagcuacuauugcgcaggacuuaagaaaguuacagaaguaagagguuacacuaaaggagggccaggacacgaggaaccugugccuaugucaacuuaugguuggaacaucgugaagcugaugucaggaaaagacguauuuuaucuaccacccgaaaaaugcgauacguuacuuugugacauaggggaaucuagcccgucaccaacaguggaggaaucgcggacgauucgugucuugaaaaugguagaaccauggcucaaaaauaaucaauuuuguauaaaaguauugaacccguauaugccaacuguaauagaacaccuugaaagacuucaacguaaacacggagguaugcucguaagaaauccauuaaguagaaauaguacacaugaaauguacuggauaucuaauggaacaggaaauauaguugccucagugaauaugguaucccgacuauuacuuaauagauucacaaugacacauagacgaccaacaauugaaaaggauguugauuuaggggcagguacacgucaugucaaugcagagccagaaacuccuaauauggauguuauaggggagagaauaaaacgaauuaaagaggaacauaacagcaccuggcauuacgaugaugaaaauccauauaaaacuugggcauaccauggaagcuacgaaguaaaagcgacaggguccgcgaguagcaugaucaauggggugguaaaguuacucacuaaaccaugggauguaguuccuauggugacccaaauggcaaugacagacacaacaccguuugggcaacagcggguauuuaaagaaaaaguagacacaaggacgccacgaucaaugccggguacgaggcgcgugaugggcauaacagcagagugguuauggcguacucugggccgcaauaagaaaccuagauuauguacaagagaagaguuuacuaaaaaggugaggacaaacgcagcaaugggagcuguguuuacagaagagaaucaaugggacagcgcgaaggcugcuguagaggaugaagauuuuuggaaacucguagauagggagagagaacuccacaaguuagguaaaugugguagcuguguguacaauaugauggguaagagagagaagaaauuaggugaauuugggaaggcaaaaggaucacgugccauuugguauauguggcuaggugcuagauaccuggaguucgaagcccuugguuucuuaaaugaggaccacugguuuucaagggaaaacagcuacucgggcgucgaaggugagggauugcacaaacuaggauauaucuuaagagauauuagcaaaauaccuggaggggcgauguaugccgaugauacagcugggugggauaccagaauaacagaggaugacuuacacaaugaagagaagauaacacaacaaauggauccagaacaucgacaacucgcaaacgcaaucuuuaaauugacauaucaaaacaaggugguaaaaguacaacgcccuacaccaacgggaaccgugauggauauuauaucucggaaagaccaacgagguucuggccaagucggaacguauggguugaacacguuuacaaacauggaagcacaauuaauacgucaaauggaaggugagggaguacuaucaaaagcugacuuggaaaacccacauuuaccugagaagaaaaucacacaaugguuagaaacgaaggguguugaaagauuaaaaaggauggcaaucucuggcgaugacugcguuguaaaaccuauagacgauagauuugcaaaugcucuacuagcucuuaaugauaugggaaaaguaagaaaagacauaccccaguggcaaccuaguaaaggauggcaugauuggcagcaaguaccguuuuguagucaucauuuucacgaacucauaaugaaagacggaagaaagcuaguagucccaugucguccacaagaugagcucauaggcagagcgcgaauuucacaaggggcaggcuggucccuacgcgaaacagcaugccuggguaaagcguacgcacagauguggagucuaauguacuuucaccgcagagaccuccguuuagccucgaaugcaauuuguagugcuguaccggugcacuggguuccgacuucuagaaccacauggucaauacaugcucaucaccaauggaugacuacagaagauaugcucaccguauggaauagaguuuggauagaagacaauccauggauggaagauaaaacaccgguaaccacaugggaagacguuccguacuuaggaaaaagagaggaucagugguguggaagucuaauuggguugacaucacgggcaacgugggcacaaaauauuuuaaccgcgauacaacaaguucguucauuaauuggaaacgaagaguuccuugacuauaugccaucgaugaagcgauuuagaaaagaggaagaaagugaaggagcaauuugguga

SEQ ID NO: 23267 - RNA, 9873 nt, Artificial Sequence
  derived and/or modified CDS sequence (opt6) from DENV-3__KJ189284__SS-prME
acuuccuuauguuuaaugaugauccuacccgcugcucuagcauuucaccuuacuucuagggacggagaaccgcguaugaucguagguaaaaaugaaagaggaaaaucgcuucuuuucaaaacggcuucaggaaucaauauguguacauuaauugcaauggaccuaggagaaaugugugacgauacaguaacguauaaauguccacacauuacagaaguggaaccagaagauaucgauugcuggugcaauuugacaaguacguggguaacuuacgguacuuguaaccaagcaggcgaacacagaagggauaaaagaucuguagcuuuagcaccgcacguggguaugggauuagauacaagaacgcaaacauggaugucagcugagggcgcauggagacaaguggaaaaaguugagacaugggcacugagacauccgggcuuuacaauucuagcacuuuuccuagcucauuauauuggcacgaguuuaacacaaaaaguaguaauauuuauucuacuuauguuggucacgccaucaaugacuaugcgcuguguggggguuggaaauagagacuucguagaaggguugucuggugcaacgugggucgauguuguacuugaacaugguggaugugugaccacaauggcuaaaaacaaaccaacauuagauauagaauuacagaaaacugaagcuacucaacuugccacucugagaaaauuguguauugaaggaaaaauaaccaacauaaccacagauagccguugcccgacucaaggagaagcaguacucccagaagaacaagaccaaaacuacgugugcaaacacacuuauguagaucgagguuggggaaacggaugcggacuauucggaaaaggaucucuuguuacaugugcaaaauuucaaugucuugaaccuauagaaggcaaaguuguacaauacgaaaaccuaaaauacacuguaauaaucacgguccauacgggagaccaacaucaaguaggcaaugaaacccaagggguaacagcagaaauuacgccacaagcgucuacaacugaagucacacucccggaguauggaacacugggauuagaguguucuccccguaccggacuagauuuuaacgaaaugaucuuacuaacaaugaaaaauaaagcguggaugguccaucggcaaugguucuucgaccuacccuugccauggacaagcggugcaacaacggaaacuccuaccuggaaccgaaaagaguuauuaguaaccuucaaaaacgcgcacgccaagaaacaagaagucgucguacuaggaagccaagagggagcaaugcauacagcuuugacgggagccacggaaauacaaaauuccggagguaccagcaucuuugcaggacacuuaaaaugcagauugaaaauggauaaacuugagcuaaagggcaugucuuacgcuaugugcaccaauacauucguacuaaagaaagaagucagcgaaacucaacacgggaccauccucauuaagguugaguacaaaggugaagaugcacccugcaagauaccauuuucuacugaggaugggcauggaaaagcucauaauggaagacuaauaacugccaauccaguuguaacuaagaaagaagaaccagucaacauugaggcagaaccgcccuuuggagaauccaauauuguuauagggauuggagauaaugcauuaaaaauuaacugguacaagaaaggaucaaguauugguaaaauguucgaagcuacagcacguggagcacgaaggauggcgauacuaggugauacagccugggauuuugguagcguugguggaguccugaauaguuugggaaagaugguucaucagauauuuggaucugccuauaccgccuuguucucuggagugucauggguuaugaaaauagguauagguguauuguuaaccuggaucgggcuaaauagcaaaaauacaaguaugaguuucucauguauagcgauagguauaaucacacuuuaucuuggugcggucguucaagcagacauggguugugucauuaacuggaagggaaaagaacucaagugugguucaggaauauuuguaacaaacgaggugcauacuuggacugaacaauauaaauuucaagcagacucaccuaaaagauuagcgacugccauugcgggugcgugggaaaacggcguguguggaauacguaguacuaccagaauggagaaccuacuuuggaaacaaauagcgaacgaacuaaacuacauauugugggaaaacaacauuaaauugacaguaguuguaggugauauaauagggguauuggaacagggaaaaagaacucuaacaccgcaaccaauggaacuaaaauauucauggaagacaugggggaaggcaaaaauagugacagcugaaacccaaaacucaucuuuuaucauagaugggcccaacacaccugaaugucccagugccucacgagcauggaacguaugggagguagaagauuacggguuuggaguauucacaacuaacauaugguuaagacuucgagaagucuacacacaacucugugaucaccgacuaaugucugcugcuguaaaagaugaacgagcuguccacgcagacaugggguauuggauagaaucacagaaaaaugguaguuggaaauuggaaaaagcgucguuaauagagguaaaaacauguacauggccaaagagccauacccuauggucgaacggagugcucgaaucagauaugauaauuccuaagagcuuagccggaccaauaucucagcauaaccauagaccggguuaccacacacaaacugcagguccauggcacuuaggaaaauuagaguuagacuuuaacuauugugaagggacuaccguuguuauuacagagaauugcgggacacgagguccaucauuacggacaaccacaguaucaggaaaguuaauacaugaaugguguugucguaguugcacucucccuccucucagauauaugggcgaagacgggugcugguauggaauggagaucagaccaauaucagaaaaagaagaaaacauggucaaaagucucgugucagcaggaucugguaaaguugauaauuuuacaaugggaguucuaugccuagcaauccuguuugaagaagucaugagagguaaauuuggcaagaaacauaugaucgcaggaguuuucuucacauucgucuugcuacugucaggucagauaacauggagagauauggcacauaccuuaauaaugauagggucuaaugcaagcgaucguauggggauggguguaaccuacuuagcauugauugcaacauuuaagauacaaccauuccuagcauuaggauuuuuccuuaggaaguuaacaucgagagagaaccuacucuuggggguaggucuugcaauggcgaccacacuccaacuaccugaagauauagaacaaauggcaaacggaauagcacucggccuuauggcauugaagcuaauaacacaauuugaaacauaccaacuauggacugcacuaauuagucuaacuugcuccaauaccauauuuacauuaacagucgcauggcggacagcuacauuaauccuugcuggaguaucccuucugccaguuugucaaucaucaucaaugagaaaaacagacuggcuaccuauggccguagccgcaaugggaguaccgccucuacccuuauuuauauuuucauuaaaggauacauuaaagcgaagaaguuggccccuaaaugaaggagugauggcuguugguuuagugaguauccuagccucaucacuucuucggaacgauguuccuauggcgggacccuugguugcaggaggacuccuaauugccuguuaugugauuacaggaaccagcgccgauuuaacaguggagaaggcggcugacauaaccugggaggaagaagcugagcaaacuggagugucucacaaucuaaugauuacaguggaugacgacggaaccaugagaauaaaagaugaugagacagagaauauacucacaguguuacuuaaaacagccuuacugauuguaucuggcaucuuuccauacuccauuccggccaccuuauugguauggcacacauggcagaaacaaacacaaaggagcggaguauuaugggauguaccuaguccuccagaaacucaaaaagcggaguuggaagaaggcguauaucgaauuaaacaacaagguauauuuggaaagacucaaguuggaguuggaguacaaaaagaaggaguguuucauacaauguggcauguuacaagaggcgcagucuuaacauacaacggaaaaaggcuugaacccaauugggccuccgucaagaaagauuuaauaucuuacggagguggcuggagguuaucgacacaguggcagaaaggugaggaggugcaaguuauugcaguagaaccagggaaaaaccccaaaaauuuccaaaccaugccaggcacuuuucaaacuacaacuggagagauaggagcuauagccuuggacuucaagccgggaaccucgggguccccgaucauaaaucgagaaggcaaagucguggguuuauacggaaacggcguugugacuaaaaaugguggauauguauccggaaucgcccaaacaaaugcggaacccgaugguccaacgccagaguuagaagaagaaauguucaagaaaagaaaccuaacuauaauggacuuacauccagguaguggcaaaacacguaaauauuuaccagcaaucguaagagaagcuauaaaacgacggcuuagaacgcuaauccuagcaccuacaaggguuguagcagcagaaauggaggaagcauuaaaaggccuuccaauccgauaucaaacaacagcuacaaaaucugagcauacaggucgggaaaucguagaccuuaugugucacgcaacauuuacaaugcgauuacuaucucccguccgugucccaaauuacaaccuuauaauaauggaugaagcccauuucacugauccggcaagcauagcagcgaggggauacauaucuacuagggucggaaugggggaagcggcagccauauucaugacagccacgccacccgggaccgcugaugcauucccacaaucgaacgcaccgauacaagaugaagaacgagacaucccugagcgaucuuggaacucaggaaacgaauggauaacagacuuugccgguaaaacaguaugguucguccccuccauuaaggcuggaaacgacauagcgaauuguuuacgaaagaacgguaagaaagucauccaacuaagucgaaaaacauucgauacagaguaucagaaaacuaaguugaaugauugggauuucguuguuacaacugacauuucugaaaugggagcaaauuucaaggcggauagaguaauagaccccagaagaugucuuaaaccgguaauacugacagacgguccggaacgugucauucuggccgguccgaugccagucacagcggcaucggcagcacagagaagaggacgcguagggcgcaauccccaaaaagaaaaugaccaauauauauuuacaggucaaccccuaaauaaugaugaggaucaugcgcacuggacugaagcaaagaugcuguuagacaauauaaauacucccgaggggauaauaccugcacucuuugaaccagaacgcgagaaaagugcugcgaucgacggagaauaccgucuaaaaggagaaagccguaagaccuuuguagaauuaaugagaaggggugauuuaccgguuuggcuugcucauaaaguagcaucagagggaauuaaauauacagauagaaaguggugcuuugauggacaaagaaacaaccaaauccuugaagaaaauauggacguagaaaucuggacgaaagaaggagagaagaagaaacucaggccgagaugguuagacgcaagaacauauucugauccgcuugcucuaaaagaauuuaaagacuucgccgccggaaggaaauccauugcguuagaucuugugacagagauaggcagaguuccuucucauuuagcucauagaacaagaaacgcccuugauaauuugguuauguuacauacgucagaacacggagggagggcuuacaggcacgcgguugaggaacuaccugaaacgauggagacccuacuauuauuaggccuuaugauacuccuuacaggcggagcaauguuauuucucauauccggaaaaggcauaggaaaaacauccauuggauugauauguguaaucgcaaguucuggaauguuauggauggcggaaaucccauuacaauggauagcgagugcaaucguuuuggaguucuuuaugauggugcuauuaauaccagaacccgaaaaacaacggacuccgcaagacaaccaauuagccuauguagucauuggaauccuaacuuuagcugcuauaauagcugcgaaugaaaugggcuuacuagagacuacaaaacgugaccuuggcaugucaaaagagcccgggguaguauccccaacaaguuaucucgaugucgaccuacacccagcgucugcguggacgcuuuacgcaguagcaaccacugugauaacuccaauguugcgacacaccaucgaaaauucuacggcuaacgugucccuagccgcaauugcaaaucaagcuguagucuuaauggguuuggacaagggcuggccuauuuccaaaauggaccuaggaguaccacuguuagcucuaggcuguuauucucaaguuaauccauuaaccuuaacagcggcugugcuucuacuuaucacucauuacgccauuauuggcccgggccuucaagcgaaagccacucgagaagcucaaaagcguacugcggcggggauaaugaaaaauccaaccguagaugguauaaugacuauagaccuugaccccguuaucuaugauagcaaauuugaaaaacaguuaggccagguaauguuacugguucuuugcgccguucagcuucugcuaaugagaacgucgugggcucuaugcgaagcucuuacacuugcaaccggcccaauaacaacacuuugggagggaucuccaggaaaguuuuggaacacaaccauagcuguaucgauggcuaauauauuuagagguucguauuuagcaggcgcuggacuugcauuuucaauaaugaaaucagugggaacagggaagcgaggaacagguucacagggugaaacacuuggugagaaguggaaaaagaaacuuaaucaacuguccagaaaagaauuugaucuuuauaagaaaagcggaauaaccgagguagaucgaacugaggcuaaagaaggauuaaaaagaggcgagauaacacaucacgccguaagucgaggcuccgcgaaacuccaaugguuuguggagcguaauaugguaaucccagaagguagagugauagacuuaggauguggacgagggggauggucuuauuacugugcuggccucaagaaaguuaccgaggucagaggauauacaaaaggggguccgggucacgaggaacccguacccauguccacauacggauggaacauagugaaacuaaugucgggcaaggacguuuucuaucuaccaccagagaagugugauacacuguugugugacauuggugagagcagcccaucucccacgguggaagaaagccguacuauaagaguacucaaaaugguggagccaugguuaaagaacaaccaauuuuguauaaaagugcuaaaucccuauaugccaacggucauugagcaccucgaacgauuacaacgcaagcauggcgguauguuaguucguaacccuuugagccgaaauucuacacacgaaauguacuggauaaguaaugggacagguaacauuguugcauccgucaauauggucaguagguuacucuuaaacagauuuacuaugacacauagacggccaacuauagaaaaggacgucgaucuuggagcugggacgagacauguaaacgcggaaccugagaccccuaacauggauguaaucggggagcguaucaaacguauuaaagaagaacacaauaguacauggcacuaugaugacgaaaauccauauaaaacaugggcuuaccacggaaguuacgaagucaaagcgacggggucagccaguaguaugauuaaugguguaguaaaacuauuaacgaaaccuugggacgucguuccuauggucacacagauggcuaugacggacacaaccccauuuggacaacaaagaguauuuaaagaaaaagucgacaccagaacaccacggucuaugccaggaacucgaagagugauggggauuacugcugaguggcuauggcgaacuuuaggaagaaacaagaaaccccgccuauguaccagagaggaauuuacuaaaaagguccggaccaaugccgcaaugggugcuguauucacggaagagaaccaaugggauagcgccaaagccgcaguagaagacgaggacuuuuggaaacuuguugauagggaaagggaauuacauaagcugggaaagugugguucuugcguuuauaauaugaugggaaaaagagagaagaaauugggcgaauuuggaaaggcaaaaggaucuagggcaauuugguacauguggcucggugcgagauaccuagaguucgaggcacuuggauucuuaaaugaggaucauugguuuucgcgugaaaacucuuacagugggguugagggcgagggucuacauaaacuaggguauauucuucgagauauuagcaaaauaccuggaggagcaauguacgccgaugacacagcaggcugggauacaagaauuacggaagacgaucuacauaaugaagagaaaaucacucaacaaauggauccagaacaccgacaacuagcgaacgccauuuucaaacuuacuuaucagaacaaaguaguuaaaguacagagacccacccccacgggaacaguuauggacauuaucagucguaaggaucaaagaggaaguggccaaguagguacauauggccuuaacaccuuuacgaauauggaggcgcagcucauccgccaaauggagggugaaggcguccuaaguaaggcagauuuagagaauccacacuuaccugagaagaaaaucacacaaugguuagagacaaaagggguagagagacugaaacgaauggcaaucagcggagaugauugcguagugaaaccuauagacgauagauucgcaaacgcgcuauuagccuuaaaugauauggguaaaguuagaaaagauauaccucaguggcaacccucuaagggauggcacgacuggcaacaggucccauuuugcagccaucauuuccaugaauuaaucaugaaagauggcagaaagcuaguaguaccuugucgaccccaagaugaguuaaucgguagagcucguauuagccaaggcgcaggauggucauuaagggagaccgcaugucuaggaaaagcauaugcacaaauguggagccuaauguacuuucaucguagagauuuacgacuagcuaguaaugcaauaugcagugcggugccuguucacugggucccaacaagucgaacgacauggaguauucacgcucaucaucaauggaugacuacggaagauauguugacaguauggaaccguguauggauagaagauaauccuuggauggaagacaaaacaccggucacuaccugggaagacguucccuaucuuggaaaaagagaagaccaguggugcggcucccuuauaggacucacuagccgugcaacgugggcacaaaacaucccuacggcuauucagcaaguacggucguuaauagggaacgaagaauuuuuggacuacaugccaaguaugaaacguuuuagaaaagaggaggaaucggagggagccauaugguag

SEQ ID NO: 23268 - RNA, 9873 nt, Artificial Sequence
  derived and/or modified CDS sequence (opt6) from DENV-3__KJ189286__SS-prME
acgaguuuuugccugaugaugauauuaccggcagcguuggcuuuucacuuaacuucacgcgacggagaaccgcguaugauugugggcaaaaaugaacgggggaaaucacuccuuuuuaaaaccgcguccggaauuaauaugugcacauugauugcaauggauuuaggugaaaugugugaugauacggugacauauaaauguccucacauuaccgaggucgaaccugaggauauagacugcugguguaacuugacuagcacaugggucaccuaugguacuuguaaucaggcaggagaacacagacgagauaaacggucaguggcauuagcgccucauguaggaaugggucuagauacaagaacucagacauggaugagugcagaaggagcauggagacaagucgaaaaaguugagaccugggcuuugcggcauccaggauuuacaauauuggcacucuuucucgcacauuacauaggaaccagccuaacucaaaaaguaguuauauucauauuauuaaugcucgugacacccucaaugacgaugagguguguuggggucggaaaucgugauuuuguggaaggauuaucaggggcaacuuggguagauguaguauuagagcauggagguuguguaaccacgauggccaaaaauaaaccaacacuugauauugaauugcagaaaacugaagcaacccaacucgcaacacuuaggaaacuuugcauagaaggaaaaaucacuaacauuaccacagauucaagauguccgacacaaggugaagcuguguuacccgaagaacaagaucaaaacuauguauguaaacacacauacguggaccgcggaugggggaacggguguggauuauucggaaaagguagucucgugacgugugcaaaauuccagugucuagaaccaauagaagguaaaguaguucaguacgaaaacuugaaauauacgguuauaauaacuguacauacaggggaccaacaucagguuggaaaugaaacucaagggguuacugcugaaauaacgccccaagcgucaacuacagaggcaacauugccagaauaugguacauuggguuuggaauguaguccaagaacaggacuugacuuuaaugaaaugauccuacuaaccaugaaaaauaaggcuuggaugguucauagacaaugguuuuucgauuugccauuaccauggacaaguggagcuacuaccgagacacccacuuggaacaggaaagaauuauuaguaacauucaaaaaugcacaugcgaagaaacaagaggucguaguacugggaagucaagaaggcgcaaugcacacugcacucacuggugccacugagauacaaaauucaggcggcacauccauauuugcaggacauuugaaaugcaggcuuaaaauggauaaauuagaauuaaaagggaugucauaugcuaugugcacaaauacauucguacuaaagaaggaaguaagugaaacucaacauggaaccauauuaauaaaaguugaguacaagggagaagaugcuccuugcaaaauuccuuuuucaaccgaggauggacaugguaaggcccauaauggucggcugauuacagcaaaucccguaguaacaaagaaggaagaaccaguaaauauagaagcugaaccaccauuuggugaaaguaacauaguaauuggcauuggggauaacgcucuaaagauaaauugguauaagaaaggauccucuaucggaaaaauguucgaggcuaccgcaagaggagcuagacgaauggcaauauuaggugacacagcgugggacuuuggcaguguaggaggaguucuaaacagccuagggaaaaugguucaucaaauuuucggaucagcuuacaccgcauuauucagcggcgugaguuggguaaugaaaauugguaucggcguacuauuaacauggaucggacuuaauaguaaaaacacauccaugagcuucucuuguauugcaauugggaucauaacguuauacuuaggagccguuguacaggcagacaugggcugugugaucaauuggaaaggaaaagaacucaaaugcgggagcgguauauucguaacuaaugaaguacacacuuggacagaacaauauaaauuccaagccgauuccccaaaaagacuggcaacagcgauugcaggcgccugggagaauggaguauguggcauucgaucuacaacgagaauggaaaaucucuuguggaagcaaauagcaaaugaauuaaacuauauccugugggaaaauaauauaaaacuaacaguaguaguaggggacauuauugguguauuagaacaaggaaagagaacauuaacaccccaaccuauggaacucaaauauucuuggaaaacgugggguaaagcaaaaaucguaaccgcggaaacccaaaacagcucauuuauaaucgauggcccuaacacgccggaauguccuucagcgucccgagcguggaacguaugggaaguugaagauuacggcuucgguguauucacuacaaacauauggcuuaggcugagggaaguauacacgcaacuaugcgaucauaggcuuaugagugcugccgucaaggaugaaagagcaguacacgcagacaugggguacuggauugaaagucagaaaaaugggaguuggaaguuagaaaaggccucucuaauugaaguaaagacgugcacauggccaaaaagucauacccuguggaguaacggaguauuagagucagauaugauuauaccuaagagccuagccggaccgaucagucaacauaaucauagaccaggauaccauacccaaacugcaggaccauggcaucuaggaaaacuugaacucgauuucaacuacugugaagguacaacaguggucauaacagaaaauugugggacacgggggccgagucuuagaacaacgacgguaucuggcaagcugauccaugagugguguuguagaaguugcacuuugccaccauuacgauauaugggugaggauggauguugguacggaauggagauaagaccaauaucagagaaagaagagaauauggucaaaucauuagucagugcuggaucagguaaagucgauaauuuuacuauggguguccugugucuggcgauccuauucgaggaaguaaugagaggcaaauuuggcaagaaacauaugauagcgggugucuuuuucacauucguccuucuguuaucuggacagaucacauggagagauauggcccauacacuaauaaugauugggucaaacgccucagauaggaugggaaugggagugacauacuuagcauuaauugccacguucaaaauucagccguucuuagcacuaggauucuuucuuaggaagcuaacgagcagagagaaccugcucuuagggguugguuuggcuauggcaacuacucuccaauuaccugaagauauagaacaaauggcaaauggaauagcucuaggucugauggcgcuaaagcuaaucacgcaauuugaaaccuaccagcuuuggacagcacuaauaucgcuaaccuguucgaacaccaucuucacucugacagucgcauggaggacagcaacguuaauucuugcuggugugagcuuacuaccagugugucagaguucuaguaugaggaaaacagacugguugccuauggcuguagcugcaauggguguuccuccgcuaccacuauuuauuuucaaucugaaggauacacugaaacgaagaaguuggccucuaaaugaaggaguaauggcaguugguuuaguuaguauauuagcuucaucguuauuacgaaacgacgucccaauggcagggccucuuguugccgguggauuguuaauugcauguuaugucaucacagggacgagcgccgaccuaacuguagaaaaggcagcugauaucacgugggaagaagaagccgaacagacaggaguuucacacaaccuuaugauaaccguagacgacgaugguacgaugagaauuaaagaugaugagaccgaaaacauuuugacaguucuauugaaaacagcucuauuaauaguuucgggcauuuuuccauauagcaucccagccacauuacuuguguggcauaccuggcaaaaacaaacucagcguucagguguucuaugggauguaccgucuccgccugaaacacagaaagccgaauuagaagaaggcguauacaggauaaagcagcaaggcauauuuggcaagacccaaguuggaguugggguucaaaaagaaggugucuuccauacgauguggcauguaacuagaggagccguucuaacauauaauggaaaacggcuggagccaaauugggcaucuguuaagaaagaccugauuaguuauggaggugguuggcgacuaucuacccaauggcaaaaaggugaagaaguacaaguaaucgcggucgaaccaggaaagaacccuaagaauuuucaaacuaugccuggaacguuucaaacaaccacuggcgaaauaggugcuauugcguuagacuucaaacccggcaccagcgggaguccaauuauaaaccgggaaggaaaaguuguggguuuguauggaaauggaguuguaacuaaaaauggcgguuauguguccggaaucgcacaaacaaaugcagaaccugacggaccaacgccggaauuagaggaagagauguucaagaagagaaaucuaacgauuauggaucuucaucccgguagcggcaaaacacggaaauaucuuccagccauugugagggaagccauuaaaagaagauuaagaaccuugaucuuagcaccaacaagggucgucgcagcugagauggaagaagcccugaaaggucuaccgauacguuaucagacaacugccacgaaaagcgaacauacugguagagagauaguagaucucaugugucaugcaacauuuacuaugaggcucuuaagccccguuaggguuccuaauuacaaccuaaucauuauggaugaagcgcauuuuacagacccugcuucuauugcugcuagaggguacauuaguacacgaguagggaugggggaagcagcagccauauuuaugacagcaacaccaccagggacagcugaugcauuuccucaaucaaacgcacccauacaggaugaagaacgagauauacccgaaagaucauggaauagcgguaaugaauggauuacggauuucgcugguaaaaccguaugguuuguaccuucaaucaaagcagguaaugauauugcaaauugucuacguaagaaugguaagaaagugauacaacuaaguagaaaaacauuugacaccgaauaccagaaaacaaaacuaaaugauugggauuucguugugacaacugauauaagugaaaugggagcuaacuuuaaggcggaucgaguaaucgacccacggcgcugcuugaaaccgguaauauuaacagacgguccagagagaguaauuuuagccggaccaaugccaguaacagcagcaagugcagcacaacggcgaggaagaguagggcgaaauccgcaaaaagagaaugaucaauauauauuuacaggccagccuuuaaauaacgaugaggaccaugcucauuggacagaagcgaagauguugcuugacaauauaaauacgccagaaggcauaauacccgcucuuuuugaaccggaacgcgagaaaagugcagcgaucgacggagaauacagacuuaaaggugaaagucgcaaaacauucguagaacuuaugcgaagaggggauuuaccagucuggcuugcccacaagguugcaucagaggguaucaaauauacggauagaaaaugguguuuugauggacaaagaaauaaccagauccuggaagagaacauggauguagaaauauggacgaaggaaggagagaagaagaaauuacgaccccggugguuagacgcaagaacguacucggacccguuggcccucaaagaauuuaaagauuuugcugcagguaggaaaagcaucgcccuagaucuaguuacagaaaucggaagaguaccaucgcacuuggcucacagaaccaggaaugcauuggacaaccuuguuaugcuacacacuucugaacaugguggacgggcguacaggcacgcuguugaagaguugccagaaacuauggaaacgcuucuauuauugggucuaaugauucuguugacuggaggcgcuaugcuuuucuuaaucaguggaaagggaauagguaaaacauccaucggucucaucuguguuauagcaucaucagguauguuauggauggccgaaauuccuuuacaguggauugcauccgcaauaguccuugaguucuuuaugaugguacuucuaauaccggaaccugaaaaacagcgaacaccccaggacaaccaguuagccuacguugugauuggaauauugacacuggcagcgauuauagccgcaaaugaaaugggauuacuagaaaccacuaagcgcgaccuaggaaugagcaaagaacccggaguaguuucaccaacauccuaucuggauguagaccuucacccagcaucagcauggacuuuauaugcaguagcaacgacaguaauaacaccgauguuaaggcacacaauagaaaacucuaccgcuaauguuagucuugcagcuauagcaaaucaggcgguuguauuaaugggauuggauaaaggauggccaauuaguaagauggauuuggggguaccucuucuagcauugggauguuacucacaaguuaauccgcuaacccuaacggcggcaguguugcuauuaauaacacacuacgcgauuauagguccugggcuacaagcuaaagcaacucgagaggcgcaaaagagaacagcagccggcauuaugaaaaacccaaccguugauggcauaaugacaauugauuuggauccuguaaucuaugauucaaaauucgaaaaacagcuagggcaaguaaugcuucuuguucuaugugcaguccaauuauuguugaugagaacaucgugggccuuaugugaagcacucacacuagcuacuggacccauaaccacuuuaugggaagguagcccaggaaaauuuuggaacaccacuauugcagugucuauggcaaauauauuccgggguuccuaccuggcuggagcuggguuagccuuuucuaucaugaaaucggucggcaccgguaaacgugguacagguucacaaggagaaacccuaggagaaaaguggaagaagaaauuaaaucaauuaagcaggaaagaauuugaccucuauaagaaaucagguauaacugagguagaccgaacagaagcuaaagaaggccuuaaacgcggggagauaacccaccaugcagucucaagaggcagcgcaaaauuacagugguucguugagcgcaauaugguaauccccgaaggaagagugauugaucuuggaugcggacgagguggcuggagcuauuauugcgcaggucucaagaagguaaccgaagucagaggguauacaaaaggugguccgggucaugaggaaccuguucccauguccacauauggguggaacauaguuaaauuaauguccggaaaagaugucuucuaccuaccacccgaaaaaugcgauacacuccucugugacaucggggaaucaagcccauccccuacagucgaagagucacgaacgauuagggucuuaaagaugguagaaccauggcuaaagaauaaccaauuuuguauuaaaguauuaaaucccuacaugccuaccguaauagaacauuuggagagauugcagagaaaacacggaggcaugcuaguuagaaauccacucagccgaaacuccacacacgaaauguauuggaucagcaaugggacagguaacauuguggcgagugucaacaugguaucaagacuguugcugaaucguuuuacaaugacacaucgacgacccaccauagaaaaggacguagaucugggcgcugguacgcgccauguuaacgcagaaccggaaacuccuaauauggacgucauaggggagcgaauuaaaagaauuaaggaagaacauaacucaacuuggcauuaugaugaugaaaaucccuauaaaacaugggcuuaucaugguucauaugaaguuaaagcaacuggaucggcuucaaguaugauuaauggaguugugaaacuauuaacuaaaccaugggacguggugcccaugguuacucaaauggcaaugacagauacaacaccauuuggucaacaaagaguauuuaaagagaaaguagauacccgcacuccaagauccaugccagggacacgucgaguuauggguaucacagcugaauggcuauggcguacacucggaagaaauaaaaagccaaggcuuugcacacgcgaagaguucaccaagaaaguacgaaccaacgcagcgaugggcgccguauuuacggaggaaaaucaaugggauagcgcaaaagcagccguagaagacgaagauuuuuggaaauuaguagauagagagagggagcuccauaaauuaggaaaauguggcucaugcguguacaacaugaugggaaaaagagagaagaaacucggcgaauuugguaaagcuaaaggaucacgagcaauuugguauaugugguuaggagcaagauauuuggaauuugaggcauugggauuccuuaaugaagaucauugguuuucaagagaaaauucuuauaguggaguugagggcgaagguuuacauaagcuaggauauauuuuacgugacauuaguaaaauuccagggggugcgauguacgcagacgacacagcuggaugggauacaagaauuacagaagaugaccuacacaaugaagaaaagauaacucaacagauggauccagaacacagacaacuugcgaacgcgauauuuaagcucacauaucagaauaaagugguaaaaguacaaagaccuacuccgacuggcacuguuauggacauuaucaguaggaaagaucagcgugguucuggccaagugggaacauaugguuugaacacuuucaccaauauggaggcccaacuaauaaggcaaauggaaggagaaggagucuugucuaaggccgaccucgaaaacccacauuuaccugagaagaaaauaacacaaugguuagaaacuaaggggguagaaagguuaaagagaauggccauuaguggagacgacugugucguaaagccuauagaugaccgauucgccaacgcguuacuugcauuaaacgacauggggaaagucagaaaagacauaccgcaauggcaaccuucaaaagguuggcacgauuggcaacaagucccauucuguucucaccauuuccacgaauuaauaaugaaagacggacguaagcugguuguaccaugucgcccacaagaugaguuaauuggccgugcaaggauuagucaaggagcaggauggagucuacgugaaacagcauguuuagguaaggcauaugcucaaauguggucccuaauguacuuucaccggcgagaccuuagguuagcaagcaacgcgauaugcucagcagugccugugcauuggguacccacaagccguacaacguggucaauccacgcgcaucaccaauggaugaccacagaagacauguuaacaguauggaaccguguauggauugaagacaauccauggauggaggauaaaacuccaguaacaacaugggaggauguaccuuacuuggguaaacgggaagaucaguggugcgguagucuaauaggauuaacaagccgugcuacaugggcacaaaacauacccacagccauccaacaggugcgaagccuuauagguaaugaagaguuuuuagauuauaugcccucuaugaagcgauuucggaaggaagaggagucugaaggagcgaucugguaa

SEQ ID NO: 23269 - RNA, 9873 nt, Artificial Sequence
  derived and/or modified CDS sequence (opt6) from DENV-3__KJ189287__SS-prME
acuucucugugcuugaugaugauacuccccgcggcacuagcauuucaucucacaucacgagacggagaaccacguaugauagucgguaaaaaugaaagaggaaaaucacuauuguuuaaaacagcuuccggaaucaacauguguacucuuauagcuauggaucuaggagaaaugugcgaugacacaguuaccuauaaauguccacacauuacugaagucgaaccugaggauauagacugcuggugcaauuugacaaguacauggguaacauauggaacuuguaaccaagcuggggagcacaggcgagacaaacgcucuguggcacuugcaccacauguugggaugggguuagauacacguacucaaacuuggaugucagcugaaggcgccuggcggcaaguagaaaaagucgagacuugggcccuaagacauccgggauucacaauuuuggcucuauuucuugcacacuacauaggaacuucacuuacucaaaaaguagugauauucauauuguuaaugcuagugacuccguccaugacaaugagauguguaggcguagguaauagagacuuuguggaaggccuuuccggcgcaaccuggguggacgugguacuagaacacggaggauguguaaccacuauggcgaaaaauaaaccaacguuagauauugaauuacagaaaacagaagcgacacaauuggcuacuuuaaggaaacuuugcaucgagggaaaaaucacaaauauaaccacagacucuagauguccaacccaaggugaagcuguuuuaccggaagaacaagaucaaaauuacgucugcaaacauacuuacguagaucgcgggugggggaauggcuguggguuauuugggaaagguucccuagugacgugugcaaaauuccaauguuuagaaccaaucgaagggaaagucguccaauaugaaaauuuaaaauacacaguaauuauaacaguacauacgggugaucaacaccaaguugguaaugaaacacaaggaguaacugcagaaauaacaccacaggcaagcaccacggaggcaacacuucccgaguauggcacuuugggauuagaauguucgccaagaacaggccuagauuuuaaugagaugauacuuuuaacgaugaaaaacaaagccuggauggugcaucgucaaugguucuuugaccucccgcuuccauggacuucuggggcaacuacagagacgccaaccuggaaccgaaaagaacuauuagugacauuuaaaaacgcgcacgcuaagaaacaagaaguuguaguacuagggucucaagaaggcgcaaugcacacagcuuuaacaggagcaacggagauccaaaacucuggaggaaccucaauuuuugcaggucaccuuaaauguagauuaaaaauggauaaauuagaacuaaaagguaugucauaugccauguguaccaauacauucguacucaagaaagaagucucugaaacucaacaugguacaauauuaauaaaaguggaauacaaaggagaagaugcaccgugcaaaauuccuuuuucgacagaagacggucauggaaaagcacauaaugguaggcuuauaaccgcuaacccagucguaacuaagaaagaagaacccguaaauauagaagcagaaccgccauucggugaaagcaacaucguuaucggaauaggagauaacgcucuaaaaauaaacugguacaagaaaggaucuucuauugggaaaauguuugaagcaacugcaaggggcgcacgucgaauggcuauucuuggagacacugcaugggauuuugguucaguaggugggguucuaaauagucuaggaaagaugguucaccaaauauuuggcuccgccuacacagcauuauucaguggcguguccuggguaaugaaaauugguauuggggugcuucuaacguggauaggacuaaauucgaagaacacuuccaugucuuucucauguauagccauuggaauaauaacuuuauacuuaggagcaguagugcaagcugacauggguugugucauuaacuggaagggaaaagagcuuaaauguggaagcggaauauuugugacaaaugagguacauacauggaccgagcaguauaaauuccaagcagauucgccuaaaagauuagcaacagcgauagccggugcuugggaaaacggcgucuguggaauaaggucaaccaccagaauggaaaauuuacuauggaaacaaauagcaaacgagcucaacuacauauuaugggaaaacaauauuaaauuaacaguuguagugggggauaucauugggauauuagagcaagguaagcgaacccuaacuccacaacccauggaacuaaaauauucauggaagacguggggaaaagcaaaaauugucaccgcagaaacccaaaauucaucguuuauuauagaugguccuaacacccccgaaugccccagcgcaaguagagcauggaauguaugggaaguggaggacuacggguucggcguauucaccacaaacauaugguuaagacugcgagaagucuauacgcaacuaugugaccaccgucuaaugagugcugccguuaaagacgaacgagcaguccaugcggauaugggauacuggauugaaucucagaaaaauggauccuggaaacuugaaaaagcaucacuaaucgaagugaaaacuuguacguggccaaaaagccauacauuauggucuaacggcgugcuugaaucggauaugauuaucccuaaaagucuugcuggaccgaucucucaacauaaucauagaccagguuaccacacucaaaccgcugggcccuggcaccuaggcaaacuugaacuagauuuuaauuauugugaagguacgacagugguuauuacagaaaacugugggacacgaggaccaucacuuagaaccacuaccguuaguggaaaauuaauacaugaaugguguuguaggucuuguacauuacccccuuugagguacaugggcgaggauggcuguugguauggaauggaaauccgaccaauaagcgaaaaagaggagaacaugguaaaaucauuaguuuccgcgggaaguggaaaaguagauaacuucaccaugggaguuuuaugccuagccaucuuauucgaagaagugaugaggggcaaauuuggcaagaaacacaugauagcaggaguuuucuuuacauucguguuguuauuaagcggacaaauaacuuggaggaacauggcacauacacugauuaugauagggucgaaugcaucagaucgaaugggaaugggaguaaccuaucuagcacuuauagcaacuuucaaaauacaaccuuuucuaguauuaggguucuuucugaggaaauuaacaucaagagaaaaccuccuauuaggcguggguuuggcaauggcuacgacauugcaauuaccugaagauauugagcaaauggcaaacgguauagcacuuggacuaauggcacucaaacuaauaacccaauuugaaacauaucaacuauggacagcacucauaucucuaacaugcaguaauaccauauucacgcugacuguagcauggagaacagcaacauuaauacucgccggugugucauuacuaccuguaugucaauccuccucgaugaggaaaaccgacugguugccaauggcuguagcggcaaugggaguaccaccauuaccucuauuuauauucucucuuaaggauacgcuaaaaagacgaagcuggccucuuaaugaaggggucauggcgguaggacucgucaguauacuugcguccuccuuacuucgaaacgauguaccuauggccggcccacuggucgcuggcgggcuauuaauagcauguuauguuauuacaggaaccagcgcagaucuuaccguugaaaaagcagcugauauaacuugggaagaagaagcggagcaaaccggaguuucccauaaucucaugauaacaguggacgaugauggaacuaugcguauuaaagaugaugagacggagaacauucuaacuguuuuauuaaaaacagcacugcucauaguauccgguauauucccauauaguaucccugccacuuuauuaguguggcauacuuggcaaaaacaaacgcagagguccggcguacucugggauguuccaagcccaccugaaacacaaaaggcggaacucgaagaaggcgucuauagaauaaaacagcagggaauauuuggaaaaacccaaguagguguagggguacagaaagaaggaguuuuccacacaauguggcauguuaccaggggugcuguguuaacauacaaugggaaaagauuagaaccaaauugggccagcgucaagaaagaccucauuaguuauggaggaggauggcgauuguccacucaguggcaaaaaggagaagaaguacagguaaucgcaguggaacccgguaaaaaccccaaaaauuuucaaacaaugccugguacauuucaaacuacuacaggagagauuggcgcaauagcucuagauuuuaaaccuggaacaagugguucaccgaucauaaauagggaagguaaggucguaggucuauacggaaacggaguugugacuaaaaacggaggauacgugucggguauagcgcaaaccaaugcugaaccagacggacccacgccagagcuggaggaagagauguuuaagaaacguaauuugaccauuauggauuuacauccugguagcgggaaaacucgcaaguauuuacccgcgaucguuagagaagcaauuaagagaagacugagaacuuuaauauuagcuccuacuagaguaguugcugcugaaauggaagaggcacucaagggucuccccauaagauaucaaacuaccgcgacuaagagugagcacacaggccgagagauuguugauuugaugugucacgcgacauuuacuaugagacugcuaagucccguacggguaccuaacuacaauuugaucaucauggaugaagcucauuucacugauccagcaucaauagcugcgagaggauauauaaguacucgcguuggaaugggugaagcagcugcaauauucaugacagcgacaccaccuggcacagcugaugcuuuuccacaaucuaacgcaccgauacaggaugaagaacgagauauacccgaaagaucuuggaacaguggcaaugaauggauaacggacuucgcuggaaagacaguaugguuuguuccuagcauuaaagccggaaaugauauagcgaauuguuugcggaagaauggcaagaaaguuauucaauuaagucgaaaaacguucgauacagaauaccagaaaacaaaacuuaaugauugggacuucgucgugacaacggauauaucggagaugggagcaaauuucaaagcagaccgaguuauagauccacggcgguguuugaagccugugauccugaccgacgguccugaaagaguuauauuggcagggccaaugccaguuacggcagcaagcgcggcacaacgaagaggacgaguagguagaaacccucaaaaagaaaacgaccaguauauuuuuacaggacaaccguugaacaaugacgaagaucacgcacauuggacagaagcaaagaugcuucuugauaauauaaauaccccagaaggaauaauacccgcccuuuucgaaccagagagagagaaaagugcugcaauagauggagaauaucgacucaaaggugaauccaggaagacauucguagaacuuaugaggcggggagaccugccgguuugguuagcgcacaaagucgccucagaaggaauaaaguacacggaucgaaaauggugcuuugauggucagagaaauaaccagauucuggaggagaauauggaugucgaaauauggacaaaagagggugaaaagaaaaaguugagaccaagaugguuggacgcacgaacauauagugauccccuagcacuaaaggaguucaaagauuucgcugcaggcagaaaaucaauagcccucgauuuaguaacagaaauaggccgcguaccaucucaucuagcucaccguacuagaaaugcacuagauaauuuaguuaugcugcauacaagugaacauggaggacgugcuuacagacacgcgguugaagaacuuccggaaacaauggaaacacuacucuuguuaggauuaaugauacuuuuaacuggaggagcaaugcuauuuuugauuuccggaaaggggauuggaaaaacgagcauaggauugaucugcguaauagcuucuucaggcaugcuauggauggccgaaauuccguuacaauggauagccuccgccauaguacucgaauuuuucaugaugguacuccuuauaccagagcccgaaaaacagagaacaccgcaagauaaucaacuugcuuaugucguaaucggcauccuaacauuagcagcgaucauugcagcaaaugaaaugggacugcuggaaacgacuaaacgagaccuaggaaugucaaaggagccagguguaguauccccaaccaguuaucuagacguagacuuacacccagcgagcgcauggacccuguacgcaguagccacaacugugaucacuccaaugcuccgacacaccauugagaacuccacagcaaacguaucauuagcugccauugcuaaccaggcuguaguccuuaugggucuagacaagggauggccuauaaguaagauggaucuaggaguaccgcuucuagcuuuagguugcuacagccaaguaaauccgcugacucugacggcagcaguacuacuguuaauaacccauuaugcgaucauaggaccaggucuacaagcaaaagcaacaagagaggcccaaaagaggacggcagcggguaucaugaaaaacccgacaguugacggaauuaugacuauugaucuagauccgguuauauaugacucgaaauuugaaaaacaguugggacaggucaugcuacugguacuaugugccguucaacugcucuuaaugagaaccuccugggcuuuaugugaggcuuugacacuugcaacaggucccauaacgacuuugugggaaggaucuccggguaaauucuggaacacuaccauagcaguuuccauggcuaauaucuuuaggggcucguaccuggcuggugcaggacuagccuuuuccauaaugaaaucuguugggacgggcaaaagaggaacagguucacaaggagagacauuaggcgaaaaauggaagaagaaacugaaccaacuuucaaggaaagaguucgauuuauauaagaaaucaggcaucacagaaguagaucggacggaagccaaagaaggguuaaaaagaggggaaauaacccaccaugcaguaucaagggguagugcaaaauugcaaugguuuguagagagaaauaugguaauaccggagggaaggguuaucgauuuggguugcggaagaggugguuggagcuauuauugugcaggucuaaagaaagucacugaggugcgcggauacacgaaagggggaccaggccacgaagaaccugugccuaugucgacauacggauggaauauaguuaaauuaauguccggcaaagauguauuuuaucuaccgccugaaaagugcgacacucuacuuugcgacaucggugaauccucacccagcccuaccguagaagaaagcaggacaauucguguucuuaaaaugguagaacccuggcuaaagaauaaccaauuuuguauuaaggugcuaaaucccuauaugccgacuguuauugaacaucuagaaaggcuucagcgaaagcaugggggaaugcuaguuaggaauccguugucaagaaacuccacacacgaaauguauuggauaucuaauggaacuggaaacaucguugccuccguaaauaugguaucccgacuucuccucaacagauuuacaaugacucauagacgcccaacuauagaaaaagacguagaucuaggcgcaggaacgcggcacguuaaugcugaaccugaaacgccuaauauggaugucauaggugaacgaauaaagcgcauaaaagaagaacacaauaguacauggcacuaugaugaugaaaacccauacaaaacaugggcauaccauggaaguuaugaagucaaagcaacaggaagugcuucaucaaugauaaacgguguuguuaaacuauuaaccaaaccaugggaugucguaccgaugguuacacagauggcaaugaccgauaccacuccauucggacagcagcggguauuuaaagaaaaaguugauacacggacgccaaggucaauggcagguacaagacgaguuaugggaauuaccgcugaauggcuuuggagaacucucggcagaaacaagaaaccuagauuaugcacgagagaagaguuuaccaagaaagugcgaacaaacgcagccaugggcgccguuuucacggaagaaaaccagugggacagcgcuaaagcugcuguagaagacgaagauuuuuggaaacugguugaucgagaacgugaacuucacaaauuaggaaagugcggaucuuguguauauaauaugauggguaaaagagagaagaaauuaggggaauuuggaaaggcuaaggggucaagggccauuugguauaugugguuaggugcucgguacuuagaguucgaagcucuaggauucuugaaugaagaucauugguuuucgcgugaaaacaguuauucaggaguugagggagaaggucuacauaaacuuggcuacauucuaagagauauuuccaaaauaccaggaggagcgauguaugccgacgauacugcagguugggauacccguaucacagaagacgauuuacauaaugaagagaaaauaacucagcaaauggaccccgaacacagacaauuggcuaaugcuauauucaaguuaacuuaccaaaauaaagucgucaaaguacagcggccaacaccaacaggcacaguaauggauauaaucagcagaaaggaucaacgggguuccggccagguggggaccuacggacuaaauacauuuacuaauauggaagcucaauuaauacgucaaauggaaggugagggaguccugucgaaagcggauuuagaaaacccucaucuaccagagaagaaaauaacacaauggcuggaaacaaagggcguagaaagacugaaaagaauggcaauauccggggacgacugugugguaaaaccuauagaugaccgauuugcaaacgcucuacucgccuugaaugauaugggaaaaguacggaaagauauaccgcaauggcagcccucaaagggcuggcaugauuggcaacaggucccauuuuguucccaucauuuccaugaacuuauaaugaaagacgggaggaaacuuguugucccauguagaccgcaagaugaacuaaucggacgagcacgcaucucucagggagcggguuggagucuacgggaaaccgccuguuuagguaaagccuacgcccaaauguggucccuuauguacuuccacagacgggacuugagauuggcgucuaaugccauauguucugcuguacccguccauuggguuccgacaucaagaacuacauggucaauccaugcccaucaccaauggaugacaacggaggacauguugacaguuuggaaccgagucuggaucgaagacaauccauggauggaagauaagacuccagugacuacaugggaagauguaccguauuuaggcaaaagggaagaucaauggugcgguagcuugauuggguuaacaucgagggcaacaugggcucaaaauauaccaacggccauccaacaaguaagaagucuaaucggaaaugaagaguuucucgacuacaugccaaguaugaaacgauuuaggaaagaagaagaauccgagggugcaauaugguga

SEQ ID NO: 23270 - RNA, 9873 nt, Artificial Sequence
  derived and/or modified CDS sequence (opt6) from DENV-3__KJ189288__SS-prME
acgucguuaugccuaaugaugauauuaccagcagcucuagcauuucaccugacuucucgagauggugaacccagaaugauaguaggcaaaaacgaacgagggaaaagccuauuauuuaaaacggcuagugguacaaauaugugcaccuuaauugcuauggauuuaggggaaaugugugaugacacuguuacauacaaauguccucacauaacagaaguugaacccgaagacauagauugcugguguaaucugacaagcacaugggucacuuauggcaccuguaaucaagcaggagaacaccggcgugauaaaagaucuguagcacuagcuccucacgugggaaugggacuggauacacguacacaaacguggauguccgcugaaggggcguggagacaagucgaaaaaguagaaacaugggcacugcgacacccagguuucacgauacucgccuuguuuuuggcccauuauauuggaaccaguuuaacgcaaaaaguaguaauauucauuuuacucaugcucguaacaccuagcaugaccaugagaugcguuggaguaggaaacagggauuuuguagaaggguuaucaggugcuacauggguugaugugguauuagaacacgguggaugugugacaaccauggccaaaaauaaaccaacguuagauaucgaauuacagaaaacugaagcaacacaauuggccacauuaaggaaacuuuguauagagggaaaaauaaccaauaucaccacugauucaagauguccuacgcaaggagaagccgugcucccagaagaacaagaucaaaauuaugugugcaaacacacauauguugaccgcgguuggggaaauggguguggguuauucggaaaaggaagccuaguaacgugugcaaaauuucaaugcuuagaaccaauagagggcaaaaugguacaauacgaaaaucuaaaauauacaguaauaauaacuguacauacaggcgaucaacaccaaguagguaacgaaacacaaggugucaccgcagagauaacgccucaagccagcaccacagaagcuacccuacccgaguauggaacacuaggauuagaaugcucaccccgcaccgguuuggauuuuaacgagaugauucuacuaacaaugaaaaacaaagcauggaugguccacagacaaugguucuuugaucuaccacuaccguggacaagcggagcaacaacagaaacacccacguggaauagaaaggagcuccuagucaccuucaaaaaugcacacgcaaagaaacaggaaguugucgucuugggcucacaagaaggagcgaugcacaccgcucucacgggcgcgacugaaauacaaaauucgggagggacaucaauuuuugcaggccaucuaaaaugucgcuugaaaauggacaaacuugaguuaaaaggcaugucauacgccauguguaccaauacuuucgugcucaagaaagaaguaucggagacacaacacggcaccaucuugauuaaaguugaguacaaaggagaagaugccccguguaaaauaccauucucuacugaagacggacaugggaaagcccacaauggaagguuaaucacagcuaauccaguaguaacuaagaaggaggagccaguaaauauagaagcggagccuccauucggcgagucgaauauaguuauaggaauaggcgauaaugcauugaagauaaacugguauaagaagggaaguucuaucgggaaaauguucgaagcuacggcaagaggugcgcgacggauggcaaucuuaggagauacugccugggacuucgggaguguagggggaguucuaaauucccuaggcaaaaugguacaccagauauucgguucagcauauaccgcccuauucuccggaguaucauggguuaugaaaauaggaauaggugucuuauuaacguggaucggacucaacagcaaaaacacuucgaugucauucagcugcauagcaauugguaucaucacccuauaucuaggcgcagucguacaagcggauaugggcugcgucauuaacuggaaagguaaagaguuaaaaugcgguucaggcaucuuuguaaccaaugagguacauacuuggacagaacaauacaaauuucaagcagauucuccuaaacgucuggcgacugccaucgcaggcgcuugggaaaacgguguuugugggauacgaaguaccacaagaauggaaaacuuacucuggaaacaaauugcuaacgaacuuaacuacauauuaugggaaaauaauguaaaauuaacgguaguuguaggugauaucauugguguucuugaacaaggaaaacgcacgcuaacaccacaaccuauggaacuaaaauauucuuggaaaacauggggaaaagcuaagauagugacugcggagacacaaaacucauccuuuauuaucgaugguccaaauacaccugaaugcccgucagcgucacgcgcauggaacgugugggaaguagaagauuacggcuucggcguuuuuacaaccaauauuuggcuuagguuaagagaggcauauacgcaacucugugaccauagacuuaugagcgcugcaguaaaagacgaacgugccguacacgcugacauggguuauuggauugaaucucagaaaaacggaucauggaaacuugagaaagcuagccucauagagguaaagacuuguacuuggccaaagucacacacgcuguggucaaacggagucuuagaaagcgauaugauuauuccaaaaucucuugcaggcccuaucucgcaacacaaucauaggccuggauaucauacucaaacagcaggcccuuggcauuuaggaaagcuagaacuugacuuuaauuauugcgaaggaaccacuguagucaucacggagaacugcgguacaagggggccuagcuuaagaacaacuacaguaagcgguaaacuuauucaugagugguguuguagaaguuguaccuugccuccucucagauauaugggcgaagauggguguugguacggaauggaaauaagacccauaagugaaaaagaggaaaauauggugaaaucucuagucagugcugguucaggaaaaguagauaacuuuacuauggguguauuauguuuagcgauauuauuugaagaagugaugagaggaaaauucgggaaaaagcacaugauugcuggaguauucuuuacauuugugcuccuacuuucuggacaaauuacauggcgugauauggcucauacgcugauuaugauaggauccaaugcaucggauaggauggggaugggagugacuuauuuagcauuaaucgcaacauuuaagauucagccauuucuggcccuaggauucuuucuaagaaaacuaacaaguagggaaaauuuacuacuggguguaggacucgcuauggcaacuacacuacaauugccggaagacauugaacaaauggcgaaugguauagcucugggccucauggcauuaaaacuaauaacccaauuugaaacauaucagcucuggacagcguuaauaucauuaacuuguucaaacacgauauucacacuaacagucgccuggcgcacugcgacgcucauucuagccgguguuucauuauugccagugugucaaucaagcaguaugaggaaaacugauuggcuuccaauggcaguugcugcaauggguguuccaccacuuccccucuucauauuuuccuuaaaggauacgcugaaaaggagaaguuggccacuaaacgaaggugucauggcuguuggauuaguuucaaucuuagcauccucacuauugagaaacgacgugccgauggcaggacccuugguugccggcggucuacuaauugcgugcuacgucaucacaggaacaagugcugaucugacgguagaaaaggcugccgacauuaccugggaagaggaagcugaacaaacuggaguaucucacaaccuaaugauaacggucgacgacgacgggacaaugcgaauaaaagacgaugaaacagaaaauaucuuaaccguacuacuaaaaacugcucuguugauagucaguggaaucuuccccuacucuaucccggcuacccuucuaguauggcauacauggcaaaagcaaacucagaggucagggguucuuugggaugucccaagcccgccggaaacacaaaaggcagaauuagaagaaggaguauaucgaaucaaacaacaaggaauauuuggaaaaacccaagugggcguugggguccagaaagaaggaguguuucacacaauguggcauguaacaagaggcgcgguauuaaccuauaauggaaaaagguuggagcccaacugggcaagcguuaagaaagauuugauuucauacgguggaggauggcgcuuaucuacacaguggcaaaagggugaagagguccaaguaauugcagucgagccaggcaaaaauccuaaaaauuuccaaacuaugccuggcacguuucaaacaacgacuggggaaauaggugccauugcauuagauuucaaaccaggcaccagcgguucaccaaucauaaaccgagaaggaaaagucguuggauuauacggaaauggagucgucaccaaaaacggcgguuacguaucggguauagcacaaacaaacgcugaacccgacgggccaacaccagaauuagaagaagaaauguuuaagaagaggaaccuuacaauuauggauuuacaccccgguucuggaaaaacaagaaaauauuuaccagcaauaguaagggaagcaauaaaacggagacucaggacauuaauacuagcgccaacacgaguugucgcagcugaaauggaagaagcgcuuaaaggacuuccaaucagauaccaaacaacugccaccaagagugaacacacgggcagggaaauaguagauuuaaugugccaugcaacuuuuaccaugagauugcuaaguccuguccgaguaccuaacuauaaucuaaucauaauggaugaggcccacuucacagacccagcaucuaucgcagcgcgcggauacaucaguacccgaguagguaugggcgaagcagcggcaauuuucaugacagcuaccccaccagguacagccgaugcauuuccgcaaucuaaugcgccaauucaagaugaagaacgcgauauaccagaacgaaguuggaacucaggaaacgaauggauuacagauuucgccggaaaaacugucugguuuguaccauccauuaaagcaggcaacgauauugccaauugucuuaggaaaaacgguaagaaaguuauacagcuaagccguaagacauucgauacugaauaccagaaaacuaaauuaaaugacugggacuuuguggucacaacugacaucucagaaaugggagcaaauuucaaagcugauagagucauugauccaaggaggugccuuaagcccguaauucuuacagauggcccagaacguguaauacuagcuggccccaugccagugacagcagcuagcgcagcucaaagaagagguaggguuggacguaacccgcagaaggaaaaugaucaauauauuuuuaccggacagccauugaauaaugaugaagaucacgcgcauuggacagaagccaaaauguuauuagacaacauaaauacaccagaaggcaucauaccugccuuauuugaaccagaacgagaaaagucagcagcaauagauggagaauaccggcugaaaggagaaagccgcaagacauucgucgagcuuaugagacgcggagaccucccaguaugguuagcgcauaaaguagcaucagagggaauaaaauauacagaucgcaaaugguguuuugauggacaaaggaacaaccaaauacuagaggaaaauauggauguagagauauggacuaaagaaggcgagaagaagaaauuacgaccgagauggcuggaugcgcgaaccuauucugauccuuuagcuuugaaggaauuuaaagacuucgcagcagggagaaaaaguauagcacuagaucucgucacagaaaucggaagagugccuucacacuuggcgcacaggacgagaaacgcauuagauaaccucgugaugcuucacacgucagagcacggagguagagcguauaggcaugcuguugaagaacuaccggagacaauggaaacgcuuuuauuguugggauugaugauuuugcuuacagggggugcuaugcucuuucuaauaagcgguaaagguauaggaaagacaaguauuggccuuauaugcguaauagccucuagcggaaugcuauggauggcagaaauaccccugcaauggauugcaucugccauuguacuggaauuuuucaugaugguucuauugguuccagaaccagaaaagcaacguacuccacaagauaaucaacuugcuuacgugguuauugguauacuuacacuugcagccauuaucgcagcaaacgagauggguuuguuggaaacaacaaaaagagauuuagguaugucuaaagagccggguguuguuucaccuacaagcuaccuagauguugaccuucacccggcgagcgcguggacgcuguaugcaguagcgacgacggucauaacaccuaugcuucgacauacaauagaaaacucgacagcaaacgugagcuuagccgcuauugcuaaucaggcgguugucuuaaugggucuagauaagggauggccaaucucaaaaauggaccuaggagugccccuucuugcauuggguugcuacagucaagugaacccacuuaccuuaacugcugcuguacuuuuauuaauaacccauuaugcuaucaucggaccgggacuacaagcaaaagcaacccgagaagcacagaaaagaacagcagcaggaauaaugaagaauccaacaguggaugguauaaugacgauugauuuagauccgguaaucuacgauuccaaauuugaaaagcagcuagggcaaguaaugcugcuaguauuaugcgcugugcaacuuuuacugaugcguacuucaugggcuuugugcgaagcucuaacuuuggcgacaggaccaauuacgacccugugggaagggaguccugguaaauuuuggaacacaacaauagcggucagcauggcaaauauauuucguggaucauaucuugccggcgcaggcuuggcauucucgauaaugaaaaguguaggcaccgggaaaagaggaaccgguucacaaggagaaaccuugggagagaaauggaagaagaaacuuaaccaacugucaaggaaagaguuugaucucuauaagaaaucggguauaacagaaguggacagaacggaagcaaaagaagguuugaaaagaggugaaauaacucaucaugcugugagccgugguucggccaaguuacagugguucguagaaagaaauauggugauccccgaggggcggguuauagaucuuggaugcggacgcggaggauggagcuauuacugugcgggcuugaagaaagugacugaaguucggggguacacuaaaggcgguccgggucaugaggaaccuguaccuaugagcacauauggguggaauauagucaaacucaugagugggaaagauguauucuaccuuccucccgaaaagugcgauacucuauugugcgacauaggugaaagcucuccaaguccaaccguagaggaaucccgcacaauucgcguuuugaaaaugguagaaccuuggcuuaaaaauaaccaauucuguauaaaaguuuuaaauccguauaugccaacagucauagaacacuuagaaagacugcaacguaagcaugguggaaugcuaguacgcaaucccuuaagccggaacaguacacacgaaauguacuggaucucaaauggaacggguaauauaguagcaucagugaauaugguuucgagauugcuacucaaccguuucacgaugacacaccgacgaccuaccauagagaaagaugucgaccuuggagcuggaacucggcacguaaaugcagaaccagaaacaccgaauauggacgugauuggcgaaagaauuaagcgcauaaaagaggaacacaacucgacguggcacuacgacgaugaaaauccauauaaaacaugggccuaucaugggagcuaugaaguuaaggcaacuggguccgcaucgaguaugauaaaugggguaguuaaacuuuuaaccaaacccugggacguuguuccaaugguaacucaaauggcaaugaccgauacaacuccauucggacaacaaagaguguuuaaagaaaaagucgacacuagaaccccaagaagcaugccggguaccagacgcgugauggggauaaccgcagagugguuauggagaaccuuagguagaaauaagaaaccccgucucugcacgagggaggaguucaccaagaaaguacggacuaaugcugcgaugggugccguauuuacagaagaaaaccagugggacagcgccaaagcagccguagaagaugaagauuuuuggaagcuaguagacagagaacgagaauuacacaaacucggaaaguguggaucaugugucuauaauaugauggguaagcgugagaagaaacuuggggaauuugggaaagcuaaagguuccagggccauuugguacauguggcucggggccagauacuuagaauuugaagcucucggcuuuuugaaugaagaccacugguuuucccgagaaaauucauauagcggagucgaaggagagggucuacauaaacuggguuauaucuuaagagacauauccaaaaucccgggcggugcuauguaugcugaugacacagcaggaugggauacacgaauaacugaggaugaccuacauaaugaagagaaaaucacacaacagauggacccggaacaccgucaauuagcuaaugcuauuuuuaaacuuacauaccaaaacaaaguagucaagguacaacgcccuacaccaacagggaccguaauggauauuaucucgaggaaagaucaacgaggaucuggccaaguaggcacauacgggcuaaauacauuuacgaacauggaagcacaguuaauaagacaaauggaaggggaagggguacucaguaaggcggauuuagaaaacccgcaucugccagagaagaaaauaacacaguggcuagaaacaaaagggguugaaagguugaaaagaauggcaauaucuggugaugauugcgucgugaaaccaauugaugacagauuugcaaaugcauuacuagcacuuaaugauauggggaaaguaagaaaagacauaccacaauggcaaccgaguaaaggcuggcaugauuggcaacagguuccguuuuguucccaccauuuccaugagcuuauaaugaaagauggacgaaaacuuguuguaccuugcagaccccaagacgaacucauuggucgagcuaggauaucacaaggugcuggauggagcuuaagagaaaccgcuugcuugggaaaagcauacgcucaaauguggagucuaauguauuuucauagaagggaucuaagacuugcgagcaaugcuauaugcucagccguacccguacauuggguuccaacuagcagaacuacguggaguauacaugcacaucaccaauggaugacaacagaagauaugcucaccguuuggaauaggguauggauagaagauaauccguggauggaagauaagacacccgucacaacgugggaagacgucccuuaucuuggaaaaagagaggaucagugguguggaagucuaauuggcuuaaccaguagggcgacgugggcacaaaauauuccaacggccauucaacaagugagaucauuaauaggaaaugaggaguuucuagauuacaugccuaguaugaaaagauuuaggaaagaagaggaaucagaaggggcaauaugguag

SEQ ID NO: 23271 - RNA, 9873 nt, Artificial Sequence
  derived and/or modified CDS sequence (opt6) from DENV-3__KJ189289__SS-prME
acgucacuaugccuaaugaugauauugccagccgcccuagcauuucaucuuacaucucgagacggagaaccacgaaugauuguaggcaaaaaugaacgagguaaaucacuucucuucaaaacugcgagcggaauuaacauguguacguuaauagcaauggaccuuggagaaaugugugacgauacagucacauacaaaugcccacauauaacagaaguagaaccagaagauauugauuguugguguaaucuuacaagcacuuggguaacguacgguacuuguaaucaagcaggagaacaccggcgugauaaaagaaguguugcauuggcuccacacguaggaauggggcuagacacacggacacaaacuuggaugagcgcagagggggcauggcgacaagucgaaaaagucgaaaccugggcauuacgccauccugguuucacgauauuagcacuguucuuagcccauuauauuggaaccucucuaacucaaaaagucguaauauuuauacugcucauguuagucacuccaucgaugacgaugcguuguguagguguuggaaaccgggacuucguggaagggcuaucuggggcgaccuggguugacgucguauuagaacacggugguuguguuaccacuauggccaaaaauaaacccacauuagacaucgaguugcagaaaacagaagccacucaacuagcgacauugagaaaauuauguauagaagguaaaaucacaaacaucacaacagacucaagauguccaacacaaggagaagccguacuuccggaagaacaagaucagaacuaugucuguaaacauaccuacguugaucgaggaugggguaacggaugcgguuuauuuggaaaagggagccugguaacaugugcuaaauuucaaugcuuagagccuaucgaggggaaaguuguccaguacgagaaucuaaaauacaccgucauaaucacgguucauaccggagaccaacaucaaguaggaaacgaaacacaaggaguuacagcagaaaucaccccucaggcgagcacuacagaggcuacauugccagaauacggaacacuaggucuagaguguaguccgagaacaggucuggauuuuaaugaaaugauauuacucacaaugaaaaacaaagcauggauggugcaucgacaaugguuuuucgauuuaccccuaccauggacaagcggcgcaacaacggaaacgcccacuuggaacagaaaagagcuacuggugacauucaaaaaugcucacgcaaagaaacaagaaguugugguuuuaggaucgcaggaaggagcaaugcacacagccuuaacaggggcaaccgaaauacaaaacuccgggggaacauccauauucgcgggacauuuaaaaugccgguuaaaaauggauaaacuugaacuaaaaggaaugaguuacgccauguguacaaacacuuuugucuugaagaaagaaguaucagaaacgcagcauggaaccauucucauaaaaguagaauauaagggcgaagaugcuccuugcaagauacccuuuaguacugaggacggacauggaaaggcccauaauggcagguugauuaccgcuaauccaguagucaccaagaaagaggagccuguuaacaucgaagccgagccuccuuucggugaaucaaacauuguuauaggcauaggagauaacgcacuaaaaauaaauugguauaagaaagguagcagcauugguaaaauguuugaagcuacggcacgaggugcucgcaggauggccauauugggagauacugcaugggauuuugguucuguaggaggaguacuuaauucacugggcaaaaugguucaccaaaucuuugguucagcguauacugcauuauuuucgggcgugagcuggguuaugaaaauugguauaggaguacuccucacauggauuggauuaaauucuaaaaacacaucuaugaguuuuucgugcauugcuauagguauaauaacauuguaucucggugcaguagugcaagcugacaugggauguguaauaaacuggaagggcaaggaguuaaaaugugguagcggaauauuugucacaaaugaaguacauacauggaccgaacaauauaaauuccaagcugauucgccuaaaaggcuugcuacagcaauagcgggggcuugggaaaacgggguauguggaauaaggucuacaacgagaauggaaaauuuacuauggaaacaaaucgcaaacgaacugaacuauauauugugggaaaauaauauuaaguuaacgguuguaguaggugacacuauuggaguguuggaacagggaaaaagaacucuaacgccccaaccgauggaacuaaaguacucguggaagaccuggggaaaagcaaaaauagugacggcagagacgcagaacaguucauuuauuaucgacgggccaaauacaccggagugucccucagcaagucgagccuggaauguaugggaaguggaagauuaugguuucggaguauucacuacuaauauauggcugcguuuacgagagguuuacacccaacuaugugaccaccgucugaugagugcggcggucaaagaugagcgugcuguccaugccgacaugggcuacuggaucgaaucgcaaaagaacggaucauggaaacuagagaaagcgagccuuauugaagugaaaacguguacauggcccaaaucccacacucuguggaguaacggaguacucgaaagugacaugaucauuccgaaaaguuuagcaggaccaauuagucagcacaaucaucguccuggauaucauacccagacagcuggaccauggcacuuaggaaaauuggaacuagauuucaauuauugcgaaggcacuacagucgugauuacagaaaauuguggaacaaggggaccuagucuucgaacuacaaccguguccggaaaacuuauacaugaauggugcugcagaaguuguaccuuaccuccguuacgcuauaugggcgaggacggauguugguaugguauggagauuagaccaauuucagagaaagaggaaaauauggugaaaagccuuguuuccgcggggucaggaaagguggauaacuucacuauggguguucuauguuuagcaauauuauucgaggagguaaugaggggaaaauuugggaaaaagcacaugauagcuggaguauucuuuacauuuguucuucuauugucagggcaaauaacauggagagauauggcucauacacuuauaaugauugggucaaaugcuucagauaggaugggaaugggaguaaccuaucuugcguuaaucgcaacauucaaaauacaaccguuccuagcuuuagguuucuuucuaagaaagcuaacaaguagagaaaacuugcuauuaggaguuggauuggcuauggcgacgacacuacaacucccagaagauauagagcagauggcaaacgggaucgcacuuggacuuauggcacugaaacuaauuacacaauuugaaacauaucaguuguggacagcauugaucucucugacuugcagcaauacaauauuuacuuuaacaguagcauggaggaccgcuacacuuauauuagcugguguuaguuuauuaccaguuugucaaucgaguucuaugagaaagacugauuggcuaccuauggccguagccgcgauggggguuccgccacuaccgcuuuucauuuuuagccugaaagauacacuuaagagaagauccuggccguuaaaugagggcguaauggcaguagggcuuguauccaucuuagcuucaagccuacuccgcaaugacguacccauggcugguccccugguugccggcgggcuucugaucgcaugcuauguaauaacagguacuagcgcagaucuaacaguagaaaaagcagcugacauaacaugggaagaagaagcagagcaaacaggcguaucccauaaccucaugauuacaguggaugaugacggaacaaugagaauuaaagaugacgaaacagagaauauacugacaguauugcugaaaacagcuuugcucauuguaucugguaucuuuccauauucaaucccugcuacguugcuaguauggcauacauggcaaaaacaaacacaaagaagcggagucuuaugggauguuccuucaccuccugaaacucagaaagcagaguuggaagaagguguguacaggauaaaacagcaaggaauuuuuggaaagacccaaguaggagugggaguacaaaaggaaggcguauuccacacaauguggcaugucacgagaggagcuguacuaacuuacaauggaaaaagacucgaaccaaacugggcaagugugaagaaagaucugauaaguuacgggggugguuggcgcuuaucaacucaguggcagaaaggugaggaaguccagguaauagccguggaaccagguaagaauccuaaaaauuuucaaacuaugccagguacauuucaaaccacaacgggagaaauaggagcaauagcacuagauuuuaaaccuggaaccuccggaucuccgauaauaaacagggaagguaagguuguaggauuauacggaaauggaguaguuaccaaaaauggcggauacgucucuggcauagcacaaacuaacgcugaacccgacggacccacgccugaguuagaagaagaaauguucaaaaagcgaaaucuuaccaucauggaucuucauccuggcucagguaaaacgagaaaguaccuuccagcuauuguaagggaggcaaucaagcgacgccuucgaacguugauauuagcaccuacacguguaguagccgcagaaauggaagaagcacuaaaaggauuaccaauaagauaucaaacuacggccaccaaaagugagcacacgggacgagaaauuguagaucugaugugucaugcuacauuuacuaugagauuauuaagcccaguacguguuccgaacuacaaccugauuaucauggaugaggcacauuucaccgauccugcgucaauagcagcucgagguuauauuuccacacgaguugguaugggagaagcugcugcaauauuuaugacugcaacuccaccgggaacagcagaugcuuucccacagucgaacgcuccgauucaggaugaagaaagagauauaccagaaaggucguggaacucuggcaaugaguggauuacagauuuugcaggaaagacgguaugguuugucccaucuauaaaagcaggaaacgacauagcaaauuguuuaaggaaaaauggcaagaaagugauccaacuaucacgaaaaacguuugacacugaguaucagaaaacaaaauugaacgauugggauuuugugguaacgacugacauuucugaaaugggcgccaauuuuaaagcggauagggucauugacccaagacgaugccuaaaaccaguuauacuaacagauggaccugagcgcguaauccuagcgggacccaugcccgucacugcagcgucugcagcgcaacgccgcggaaggguaggccgaaacccacaaaaagaaaacgaucaauacaucuuuacgggacagccuuuaaacaacgaugaagaucacgcacauuggacugaggcgaaaauguuauuagauaacauuaacacuccggaagguauuauaccugcccuauuugaaccugagcgugaaaaaucugcagcaauagauggggaauacaggcuaaagggcgagucuagaaaaaccuuugucgaauuaaugcgaagaggagaucuccccguauggcucgcucauaaaguagcgucggaagggauuaaauacacggauagaaaaugguguuucgaugggcaacgaaauaaccaaauacuagaagaaaacauggacgucgaaaucuggaccaaagagggugaaaagaagaaauuaagaccacgguggcuagacgcaagaacguauucugauccccuagcccuaaaagaguucaaggacuuugccgcgggucggaaaucaauagcuuuagaucucguuacggaaauuggccguguucccucacaucuagcacaccgaacaagaaacgcucuugauaauuuggucaugcuacacacaagcgagcacggggguagagcauaucgacaugcaguagaagaacugccagagacaauggaaacacuauuacuacuaggacuaaugauacuacuaaccggaggagcuauguuauuuuuaauaucggggaaaggaauaggcaaaacaucuauuggcuuaauaugcgucaucgcuaguuccggcauguuguggauggcggaaauuccucuacaauggauugccagcgcuauaguuuuagaguuuuucaugaugguccuauuaaucccagaaccagaaaagcaaaggacaccacaagauaaucaacuagcuuauguaguuauagguauauuaacguuagcggcaaucauagcggcaaaugaaaugggucuucuagaaacaaccaaaagagaccuaggaaugaguaaagagcccggagugguuuccaguacuucuuauuuagauguggauuugcauccugccucugccuggacuuuguaugccguagcgaccacaguuaucacgccuaugcuacgacacaccauugaaaauucaacggccaauguaucucuggcugcaauugcaaaccaagcaguuguuuuaaugggccuagacaaaggguggccuauaucuaaaauggauuuaggcguaccacuucuagcauuaggauguuacucccagguaaacccacuuacauuaaccgcugcugugcuacuauuaauaacacauuacgcaauaauaggaccaggucuacaagcuaaagcaacuagggaagcucagaaaaggacagccgcugguaucaugaaaaacccuacagucgauggcauaaugacgauugacuuagacccaguaauuuacgacagcaaguuugaaaagcaacuuggucaaguaauguugcuaguacuaugcgcaguacaacuacuacugaugagaacgucgugggcacuaugcgaagcucuaacauuggcuaccggaccuauaacaacauugugggagggcucgccagguaaguuuuggaacaccacaaucgcuguaagcauggccaauauauucagaggaucauauuuggcuggugccggucuagccuuuaguauaaugaagaguguaggaacggguaaaaggggaacugguucgcagggggaaacucuaggcgaaaaauggaagaagaaauuaaaucaauugucacguaaagaguucgaucucuacaaaaagagugggauuaccgagguugaucguacagaggccaaggaaggauuaaagagaggagaaauaacgcaucacgcagugucccgaggcagugcaaaacuacaaugguucgucgaacguaauaugguuauuccagaaggaagagugauagaucuuggcugugggagaggagggugguccuauuacugugcugggcuaaagaagguaacugagguccguggcuacacuaaagguggaccuggucaugaagaaccgguaccaaugucgacuuacgguuggaacauaguaaagcuaauguccggaaaagauguauucuaucuaccaccggagaaaugugacacauuacuuugugacaucggcgaaaguucccccuccccgacuguagaggaaucaagaacuaucagagucuuaaaaauggucgagccauggcucaagaacaaucaauuuugcauaaagguccuuaauccauauaugcccacuguaaucgagcacuuagaaagacuacaacgaaagcauggaggaaugcuuguacguaauccacuaucucguaauagcacucacgagauguauuggauaucaaacggcacaggaaacauaguugcaucaguuaacauggucuccagacugcuacuaaauagguucacgaugacccacagaagaccuacuauagaaaaagauguagaucugggggcuggcacccgacacguuaacgccgaaccggagacuccaaacauggauguuauuggagaaagaauaaaacgaauuaaggaagaacacaacucaacauggcacuaugacgaugagaauccauauaagacaugggcuuaucauggaucauaugaagucaaagcgacaggcagugcuaguagcaugauaaaugguguggugaaauuauugaccaaaccaugggacguaguaccaaugguaacgcaaauggcaaugacagauaccacaccuuuuggucaacaacgugucuuuaaagagaaaguugacacuagaacgccacguuccaugccaggcacacgacgugucauggggauaaccgcggaauggcuguggcguacacuuggacggaauaaaaagccgcgauuauguacucgagaagaauuuacgaaaaaggugcgaacaaacgcugcgaugggagcaguguucacggaagagaaucaaugggauucagcaaagacggcgguggaggaugaagauuuuuggaaguuaguagaccgcgaaagagaacugcacaaacuaggaaaauguggcagcuguguguauaauaugaugggaaaacgugagaagaaauuaggggaauuuggcaaagcaaaaggcagucgagcaauuugguauauguggcucggggcaagauacuuggaguucgaagcacuaggguuucuuaaugaagaucacugguuuuccagagaaaauucauauaguggaguagagggggaaggccuucacaaacuuggauauauacuaagagauauuucuaaaauuccagggggugcuauguaugcugaugauacagcuggcugggacacgcguaucaccgaagacgauuuacauaaugaggagaaaauuacucaacaaauggauccagagcaccggcaacucgcaaaugcaauauuuaaauugacauaucaaaauaaaguaguaaagguucaaaggccaacuccaaccggcacgguuauggacauuauuagcagaaaagaucagaggggcaguggacaaguaggaacuuacggccuuaauacauuuacaaauauggaagcacagcuaaucaggcaaauggaaggugaagggguuuuaucaaaagcggaucuugaaaacccacaccuuccugagaagaaaauaacacaaugguuggaaacaaaagguguugaaagauuaaaacgaauggcuauaucaggugaugauugcgugguaaaacccauugaugaucgauuugcgaacgcucuacuggcucuaaacgauaugggcaaaguucguaaagauauaccacaguggcaaccaucuaaaggauggcacgauuggcaacaaguaccguuuuguucucaucacuuucaugagcucaucaugaaagauggcaggaagcuaguugugccuugccguccccaggacgaacucauaggcagagcucgaauuucucaaggagcagguuggucauuacgggaaacagcgugccuugguaaagcguaugcacagauguggagucugauguacuuccaucggagggaucuaaggcuagcuagcaaugccauuugcagugcagugccuguucacuggguaccuacaucaagaacuaccugguccauccaugcacaccaccaauggaugacaacugaggauauguuaaccgucuggaaccguguauggauugaggauaacccauggauggaggacaagaccccagugaccacuugggaagauguuccuuauuuaggcaaaagagaagaccaauggugcggcagcuuaauaggauugacgagcagagccacaugggcgcaaaauauaccaacagcaauucaacaaguaaggagucuuauaggaaaugaagaguuucucgauuacaugcccucuaugaaaagauuuagaaaggaagaagaaagugaaggggccauaugguaa

SEQ ID NO: 23272 - RNA, 9873 nt, Artificial Sequence
  derived and/or modified CDS sequence (opt6) from DENV-3__KJ189290__SS-prME
acguccuuaugucuuaugaugauacuaccugcagcucucgcauuccacuugacaagcagggauggagaacccaggaugaucguagguaaaaaugaaagagggaaaucauuguuauuuaaaaccgcuagcggaauaaauaugugcacucuaaucgcaauggaccucggcgaaaugugugaugauaccguuacauauaaaugcccacacauaacagaaguagaaccugaagauauagauuguuggugcaaucuaacaagcacauggguaacauacgguacaugcaaucaagcuggugaacauagaagggauaaaagaucuguagcuuuagcaccccaugugggaaugggcuuggacacacgaacacaaaccuggaugucagcagaaggugcuuggcgacaaguagaaaaaguugaaacuugggcuuugcgacauccaggcuuuacaauacucgcuuuauuucuagcucauuauauagggacaucucucacacaaaaagugguaaucuuuauauuacugauguugguaacaccaucaaugaccaugagauguguggggguuggcaacagagauuuugucgaggguuuaucuggcgcaacuuggguagaugucguucuagaacauggaggaugugucacaacgauggccaaaaauaaaccaacacuugauauagaacuacagaaaacagaggcgacacaacuggcuacucucagaaaacucugcauagagggcaaaauuacuaauauaacgacagauagccgcugcccuacacaaggagaggcaguauugcccgaggaacaagaucaaaacuacguauguaaacacacguacgucgauagaggauggggaaacggaugcggauuauucggaaaagguaguuuaguaacuugcgcuaaauuucaauguuuagaaccuauugaaggaaaaguuguccaauacgagaaccuuaaauauacuguuauaauaacaguucacacuggagaucaacaucagguuggaaacgaaacacaagggguuacagccgaaauaacaccccaggcuuccacgacugaagcaacccugccagaauauggaacucuugguuuagaauguucuccuagaaccgggcuugauuuuaaugaaaugauacuacuuacgaugaaaaacaaggcuuggaugguucauagacaaugguucuuugaucuuccguuaccuuggacaaguggugcuacuacagagacucccacuuggaaucguaaagaauuauugguuacuuucaaaaaugcacacgccaagaaacaagaaguugugguauuaggcucacaagaaggugcuaugcacacggcacucaccggagcuacagagauacaaaacaguggaggaaccaguauauuugcaggacacuuaaaaugucgauuaaaaauggauaaauuggaauuaaaagggaugaguuacgcaauguguacgaacacauuuguacuaaagaaagaagucucagaaacccaacauggaacuauauuaauuaaaguugaauauaaaggagaagaugccccaugcaaaauaccguuuucaacagaagauggucacggaaaagcacauaauggaagauugauaacggccaauccuguaguaacgaagaaagaggaacccguuaauauugaagcagagccaccguuuggcgaaaguaauaucgugaucggcauaggggacaaugcuuugaaaauaaauugguacaagaaaggauccucgaucggcaaaauguuugaagcuacagcacgaggggcaaggcgaauggcgauucuuggugacaccgcaugggacuuuggaucgguaggagguguguuaaacagccuagguaaaaugguacaccaaauauucggaucagccuacacggcacuauuuagcgguguaaguugggugaugaaaauaggcaucggaguguugcuaacuuggauaggauuaaauaguaaaaauaccucuaugucauuuucaugcauagcaauagguauaauuacacuauacuuaggugcagucguucaagcagauauggggugugucaucaauuggaaaggaaaagaacuaaaaugugguagcgguaucuucguaacuaacgaaguacauacauggaccgaacaauacaaauuucaagcagacucaccaaagagacuugcgacagcuauagcgggagcaugggagaacggugugugugggauaaggucaacaaccagaauggaaaacuugcuauggaagcaaaucgcuaaugaauuaaacuauauauuaugggaaaauaacauaaagcuaacuguuguuguaggagauauaauagguguguuggaacaaggaaaaaggacucuaacaccacaaccaauggaauuaaaguacucuuggaaaaccuggggaaaggcaaaaauaguuaccgccgaaacacagaauaguuccuuuauaauugauggcccaaauacuccggaaugcccgucugcaucacgagcguggaauguaugggaaguugaagacuaugguuuuggaguguuuacgaccaacauuugguuacgccuucgugaaguauacacgcaacuaugcgaucaucggcugaugucagcugcaguaaaagaugaacgagcgguccacgcugacauggguuacuggaucgaaagccagaaaaauggguccuggaagcuggaaaaagcgucgcucauagaagugaagacauguacauggcccaaaucucacacguuauggucaaacggaguuuuagaaucagauaugauuauuccaaaguccuuagcuggcccaaucucucagcacaaucaucguccaggauaccacacacaaacagcugguccguggcacuuagguaaacuagaguuagauuuuaacuacugugaaggaacaacuguaguuauaaccgaaaauugcgguacaagagguccaucucuacgaacuacaacaguuucuggcaaacuaauacaugaaugguguugcagaaguuguacacucccacccuuacguuacaugggagaagacggcuguugguacggcauggaaauaaggccaauuagcgagaaggaagagaauaugguaaaaucuuuagucagugcaggcagugguaaaguagauaauuuuacgaugggcguuuugugucuugcgauucuauucgaagaaguuaugagagguaaauucggcaaaaagcauaugauagcaggggucuucuucacguuuguucuacuacuaucaggucaaauaacauggagaaacauggcacauaccuuaauaaugauuggcucuaaugcaucagaccguauggggaugggcguaaccuaucucgccuuaauugcaacauuuaagauucagccguuucuagcccuaggauuuuuccuuagaaaauugacuucacgagaaaaucuucuucuagguguaggccuggcaauggcuacuacucuucaacuaccagaggauauugaacagauggccaacgguauagcacuaggauugauggcguugaaacuaauaacccaguucgaaaccuaucaacucuggacggcacuuaucucucuaacauguagcaacacaauuuuuacacuuacuguagcuuggcgaacagcaacacuaauucuugcgggcguuucauugcuaccgguaugccaaagcaguaguaugagaaaaacagauuggcuacccauggcaguggcagccaugggaguacccccauugccuuuauucauauuuucgcugaaagauacauugaaaaggcguuccuggccccucaaugaggguguaauggcagugggauuaguaaguauucuagcaucgucauugcuuagaaacgacguacccauggcaggaccuuuaguagcaggaggacugcuaauagcauguuauguuauuacagggaccuccgccgaucuaaccgucgagaaagccgcugacaucacaugggaggaagaagcggaacagacugguguaucacacaaucuaaugauaacaguugaugaugaugggacaaugcguauaaaggaugaugagacugagaauauccucacaguucuucuaaaaacagcauugcucauaguaagcggaauuuuuccguauucaauuccugcaacacuacuggucuggcauacauggcaaaaacagacccaaaggaguggcguauuaugggauguaccaagcccuccagagacucagaaggcggaacuugaggaggguguguacagaauuaaacagcaaggaaucuuugguaaaacgcaaguuggaguaggaguucaaaaagaagguguuuuccauacaauguggcacguaaccagaggagccguacucacauacaauggaaaaagacuggaaccuaacugggcaagugugaagaaagaucucauuagcuacggagguggguggaggcuaucaacccaauggcaaaaaggggaagagguacagguuauugcaguggaaccugguaagaaccccaaaaauuuccagacaaugccaggaaccuuucaaacaacgaccggugagauaggggccauagcacuggauuucaaacccggaacaucaggaucaccgauaauaaaccgcgaaggaaaaguuguuggguuauauggaaauggcguaguaacuaaaaacgguggguauguaaguggaaucgcgcagacaaaugccgaaccggauggccccacaccagagcuagaggaagagauguucaagaaacguaaucucacuauaauggauuuacacccagguagcgggaagaccaggaaauauuuaccggccauaguacgcgaggcaaucaagcggcgacuaagaacucugauauuagccccaacuaggguuguagcugcugaaauggaagaagccuuaaaaggccuaccaauaagauaccaaacuacagcgaccaaaagugagcauacugguagagaaauaguugacuugaugugccacgccacguucaccaugagacuuuugaguccaguucguguaccaaacuauaaccugauaaucauggacgaagcccauuucaccgacccagcaucgauagcagcccgugguuacaucucuacaaggguuggaaugggagaggcggcagcaauuuuuaugacggcgacaccgcccggaacugcggacgcauucccacaauccaaugcgccaauacaagacgaagagagagauauacccgaaaggucauggaacuccgguaaugaauggauaacagauuuugcaggaaaaacaguaugguuuguuccaaguauuaaggcuggaaacgacauagccaauugucugaggaaaaauggcaagaaaguaauucaacuaucuagaaaaaccuuugacacagaauaccagaaaacuaaacucaaugacugggauuucguagucacuaccgacauaucagaaaugggagccaauuucaaagccgaucgaguuaucgauccaagacggugccuaaaaccggucauucuaacagaugguccagaacgagugauauuagccggaccgaugccaguuacggcggcgagcgcugcacaaagacgagggagagugggcagaaacccucaaaaagagaaugaucaauauauauucaccggacaacccuugaacaaugaugaagaucaugcacauuggacggaggcgaaaaugcuuuuagauaauauuaauacuccugaaggcaucauccccgcacuuuucgaaccagaacgggaaaagucggccgcaauugacggcgaauaucgguuaaaaggagagucucgcaaaacauuuguugagcuaaugagacgaggugacuuacccguuugguuagcucauaaaguggcuagugaaggaauuaaauacacugauagaaaaugguguuucgacgggcaaagaaacaaccagauacuagaagaaaauauggauguggagauauggacgaaggaaggugagaagaagaaauuacgaccucgaugguuagacgcacgaacguauucagauccacuggcccuaaaagaguucaaggauuuugcagcgggacgcaagucaauugccuuagaucuagugacagaaauaggcagagugccgagucaucuugcucaucgcacuagaaaugcuuuagauaaucuaguaaugcuacauaccucagagcacggggguagagcuuauaggcaugcaguagaagaacugccugaaacgauggaaacacuucuucuucuuggacugaugauacuccuaacaggaggggcgauguuauuuuugauaagugguaagggaaucggaaaaacgucaaucgguuuaauaugcgucauugcuaguucagguaugcuuuggauggcagaaaucccguugcaauggauugcuagcgcuauaguauuagaguucuucaugaugguccuucuaauaccugaaccggagaaacaaaggacuccacaagauaaucaacuggcguauguaguaauagggauccucacccuugcagcaauaauagcagcgaaugaaaugggacuauuagaaacuacaaaaagggaucucggaaugucgaaggagccuggggucgugucaccuaccucauauuuagauguggauuuacauccagcaucugcuuggacacuauaugcaguagcaacuacaguaauuacaccaaugcugagacauacaauagagaauaguacugcaaaugucucccuagcagccauagccaaccaggcgguagugcucaugggacucgauaaaggguggccuauuaguaaaauggaucuaggaguuccauuacuagcucugggauguuacagccaaguaaacccgcuuacauugacagcagcaguacuauuauuaauaacgcauuaugcaauaaucggcccuggacuccaagcaaaagcaacgagagaggcacagaaaagaaccgcagcagguauaaugaaaaauccaacuguggauggcaucaugaccauagaucucgauccgguaaucuaugacagcaaauuugaaaagcaauugggacaaguaauguugcugguucuaugcgcaguucaacuguuauuaaugagaacaaguugggcuuugugugaggcacucacguuggccacaggccccauaacgacauuaugggaaggcucaccggggaaauucuggaacacaacaauagcggucucuauggccaauauuuucagaggaagcuauuuagcuggagcggguuuagcauuuucaauaaugaaaaguguuggcacuggaaaaagagguacuggaucacaaggagaaacacuaggagaaaaauggaagaagaaauuaaaccaacuaucccggaaagaauuugaucucuacaaaagaucugguauuacagagguagaccgcaccgaagcgaaagaaggacugaagcgaggugaaaucacgcaccacgcgguuucacgugggagugcgaagcuacaaugguucguugaaagaaauaugguaauuccagagggcagaguuaucgauuuaggauguggaagggguggguggaguuauuacugugcgggcuuaaagaaaguuacagaagugagaggguauacuaaaggagguccuggacacgaagaaccuguaccaaugucgacauacggcuggaauauuguaaaauuaaugagcggcaaggauguauuuuaccuucccccagagaaaugcgacacccuacugugcgacauuggcgaaaguucaccaucaccgacaguugaggaauccagaacgauaaggguuuuaaagauggucgaaccauggcucaaaaauaaucaauuuugcauuaagguauuaaaucccuauaugccuacaguuauagagcacuuagaaagauugcaaagaaaacauggagguaugcuggucagaaauccgcucucaaggaacuccacacacgaaauguauuggaucucuaauggcacaggcaacaucguugcuucagucaacauggugaguagacuccuacuuaaucgguucaccaugacacaucggagaccgacuauagaaaaagauguugauuuaggugcuggcacccggcacgucaaugcagagcccgaaacucccaauauggacguaauaggugaaaggauuaaaagaauuaaagaggaacacaauucgacguggcauuaugacgaagaaaauccuuacaaaacuugggccuaucacgggucauacgaggugaaggcaaccggaucggcaaguagcaugauuaaugggguagugaaauuauuaacuaaaccuugggauguagugccaaugguaacacagauggcgaugaccgauacaacaccauucggucagcagagaguauuuaaagaaaagguugauacucgaacaccacguucaaugcccggcacaagacgcguaaugggaauaacugcagaauggcuauggagaacucuagggagaaacaaaaagccaagauuauguacuagagaggaauuuacgaaaaagguuagaacaaacgcagcaaugggagcuguauuuacugaagaaaaccagugggauagugcaaaagccgcgguggaggacgaagauuuuuggaaacucgucgacagagaaagagaacuacauaagcucggcaagugugggagcuguguguacaacaugaugggcaaaagagagaagaaacuaggagaguucgguaaagcuaaaggaagcagagcaauaugguauauguggcugggugcacguuauuuagaguucgaagcucuaggauucuuaaaugaagaucauugguucuccagagaaaauucuuacucaggggucgagggagaaggacuacauaaacugggguauauccuaagggacaucuccaaaauuccaggaggagcaauguaugcagacgauacagcaggaugggacacgagaaucacagaagaugaccuucacaacgaagagaaaauuacgcaacagauggauccagaacauagacaacuagcaaaugcuaucuuuaaacuaacuuaucaaaacaaaguaguaaaagugcaaagaccaacuccaacuggcaccguaauggauauuauaagucgaaaagaucaacgagguaguggccagguggguacuuacggccugaauacauuuacuaauauggaagcacaauugauuaggcaaauggaaggugaaggaguacuuucgaaagccgacuuagagaacccacauuuaccugagaagaaaauaacacaaugguuagagacaaaaggaguugaaagauuaaagcgaauggcaaucaguggggaugacuguguuguaaaaccuauagacgacagguuugcaaaugcgcuacuagcacuaaacgacaugggaaaaguucgaaaggauauuccccaauggcaaccaucaaaaggauggcaugacuggcagcaaguuccauuuuguucccaccacuuucaugaacugauuaugaaagauggucgaaaauugguggugccaugcaggccucaagaugaacucauuggcagagcaaggauuagccaaggggcuggcuggucguugcgagagacagcguguuuaggaaaagccuaugcacaaauguggucauuaauguauuuucaccggcgagaucuuagauuggcaaguaacgcuauaugcuccgcaguaccgguucauugggucccaacaucuagaacaacuuggagcauucaugcucaucaccaauggaugacgacagaagacaugcuuacaguuuggaaccgcguguggauagaagacaaucccuggauggaagauaaaacuccagugacgacaugggaagacguacccuacuuaggaaaacgagaagaccagugguguggaagccuaauaggauuaacaucuagagcaacaugggcccagaacaucccaacagcaauacagcagguccgaucccucauagguaaugaagaguuuuuagacuacaugccgagcaugaagcgauuucggaaagaagaagaaagugaaggugcaauaugguaa

SEQ ID NO: 23273 - RNA, 9873 nt, Artificial Sequence
  derived and/or modified CDS sequence (opt6) from DENV-3__KJ189291__SS-prME
acaucacuaugccuaaugaugauauugccagcagcuuuagcauuccauuuaacaaguagagacggagaaccacgaaugauuguagguaaaaacgaacggggaaaaucacuauuauuuaaaacugcaaguggaauaaauauguguacucuaauagcgauggaucuuggcgaaaugugcgaugauacuguaacauacaaaugcccacauauaacagaaguagaaccagaggacauugacugcuggugcaaccuaacaucuacguggguaaccuacggaaccuguaaccaagcaggagaacaucgacgagacaaacggucaguggcauuagcaccacacguggguaugggacucgauacgagaacucaaacuuggaugagugcugaaggugcuuggagacaaguagaaaaagucgaaacaugggcuuuacgacaucccgguuuuacaauacucgcucuauuccucgcacauuacaucgguacaucacuaacacaaaaaguagugauuuuuauauuguuaauguuaguaacaccguccaugacaaugagauguguaggaguaggcaaccgagacuucguagaaggacuuuccggcgcgacuuggguagacguagugcuugaacacggggguugcguaacuacaauggccaaaaauaaaccaacccuagauauugaauuacagaaaacggaagcuacucaacuagcaacccuccgaaaacuauguauagaaggcaaaauuacaaauauuacaacagauucacgauguccgacgcagggagaagcuguucuuccugaagaacaggaucaaaauuacguauguaaacacacauauguagauagagguuggggaaacggauguggauuauucggaaaaggaaguuuggugacaugcgcuaaauuucaaugucuugaaccuauugaaggaaaaguaguacaguacgagaaccuaaaauacacgguaauuauaacaguucauaccggggaucaacaccaaguaggaaacgaaacacaagggguaacugcagaaauuacaccucaagcaaguaccacagaggccacacuacccgaauauggcacauuaggcuuagaaugcaguccaaggacgggucuagacuuuaacgaaaugauauuacuaaccaugaaaaacaaagcauggaugguacacagacaaugguucuuugauuuaccuuuaccauggacaaguggagcuacuacagaaaccccaaccuggaaucgaaaagagcuauuagucacuuucaaaaaugcccacgccaagaaacaagaaguaguggucuuagguucccaagaaggugcaaugcauaccgcacuaacaggugccacggagauucaaaauucgggcggaacaucuauauucgcaggucacuugaaaugucgucuaaaaauggacaaacuagaacuaaaaggcaugucauacgcaauguguacuaacacauucguacugaagaaagagguauccgagacucagcacgggacaaucuuaauaaaaguggaauauaaaggugaagaugcgcccugcaaaauuccauucucaacagaagacggccauggcaaagcgcauaacgguagacuuauuacggccaacccgguaguaacuaagaaagaagaaccaguuaauauagaggccgaaccacccuuuggggaaagcaauauugugaucggaauaggggauaaugcauuaaaaauuaauugguauaagaaaggaaguucaaucggcaaaauguucgaagcaacagcccguggugcccgaaggauggcaauacuaggggauacugcaugggacuucggcucuguaggugguguacugaauagcuuaggaaaaaugguucaccagauauuugguagcgcguacacagcauuauuuucuggcguaucauggguuaugaaaauaggcaucggcguucuauuaacuuggauuggacugaacucgaagaacacaucuaugucguucucaugcauagccauuggaauuaucaccuuguaucuuggggcaguuguacaagcagacaugggaugcguuauaaauuggaaaggaaaagaacucaaaugugguucggggauauuugugacgaaugaaguacacacauggacagaacaauauaaauuucaagcagacaguccaaaacgacucgcaacagcuauugcaggagcuugggaaaauggagucuguggaauaagauccacuacaaggauggaaaaccuucuauggaaacagauagcuaaugaguuaaacuacauuuuaugggagaauaauauuaaauugacggucguaguuggggauauuauagggguucuagaacaagguaaacgcacauuaacaccucaaccaauggaauugaaauacucauggaaaacuuggggcaaggcaaaaaucguuacugcugagacgcaaaauucuuccuucauaauagacgguccuaacacaccagaaugcccgagcgcgucgagggccuggaauguaugggaaguggaagauuauggcuucggaguuuucacgacaaacauaugguugcggcucagggagguguauacgcaauuaugugaucaucgcuugaugucggccgcaguaaaagacgaacgagcugugcacgcagauaugggguauuggauagaaucacagaaaaacgggaguuggaaauuagaaaaagcuaguuuaauagaggucaaaacaugcaccuggccaaaaucgcacacguuauggaguaauggaguacuagaaucggauaugauuauaccaaaaucacuggcuggaccaauuagucaacauaaucaccguccaggauaucacacgcaaacagccggaccauggcacuuagggaagcuggaacuugauuuuaacuauugugaagggacaacgguagugaucacagaaaauugugguacucgaggaccaucuuuacgaacuacuacgguuagcgguaaacugauacacgaaugguguuguagaaguuguacccuacccccguuacgguauaugggggaagauggaugcugguacgguauggaaaucagaccaauaucggaaaaagaggaaaauauggucaagagccuagucagugcagggagcggaaaaguagacaauuucaccaugggaguacuaugccuugcaauacucuuugaagaaguaaugagagguaaauuugguaagaaacauaugauugcuggaguauucuuuacauuugugcuguuacuuaguggccaaauaacuuggaggaacauggcacacacccuaauuaugauuggaaguaaugcaagugauagaaugggcaugggcgucacauacuuggcauuaauagcaacguuuaaaauccaaccuuucuuagcccucggauucuuuuuaagaaaacuaaccaguagggagaaucuacuguuaggaguaggccucgcaauggcgacuacuuuacagcuaccggaggauauugaacagauggcgaacggaauugcucuggguuugauggcguuaaaacuuauuacucaauucgagacauaucaacuguggacagcucuuauaagccugacauguucaaacacgauauuuacacugaccguagcguggaggacagcaacacugauauuagcaggcguaucucuuuugcccguuugucagaguucgaguaugagaaagacagauuggcuuccaauggcaguagccgcuauggguguuccaccucuuccuuuauucauauuuucgcuaaaagauaccuuaaaacgucgaucguggccacugaacgagggcgugauggcgguaggguuaguuagcauauuagccaguucccuauuacgaaacgacguaccuauggcuggcccuuuaguugcgggaggguuguuaaucgcauguuauguaauuaccgggacgagcgcagacuuaaccguagagaaggcggcagacauaaccugggaggaagaagccgaacaaacaggaguaagucauaaucucaugauaacuguggaugacgauggaaccaugagaauaaaagacgacgaaaccgagaauauacucacaguauuacuaaaaacagcucuauuaauaguaagugggauauuuccauauaguauaccagcuacacuucuaguguggcacacuuggcagaagcaaacgcaacguucagguguauuaugggacgugccgaguccuccagagacgcaaaaagcagaacuagaggaaggcguguauagaaucaagcagcaaggcauuuuuggaaaaacgcaaguaggaguggguguucaaaaagaggggguauuccacacaauguggcaugugacaagaggagcaguccugacguauaacgguaaacggcucgaacccaacugggcaucuguaaagaaagaccuaauuaguuauggaggcggauggcgauugucaacucaauggcaaaaaggagaggaaguucaaguuauugcuguggaaccuggcaaaaaucccaaaaacuuccaaacaaugccugggacauuccagacaacuacgggagaaauuggagcgaucgcauuagacuucaaaccaggcacaucaggaucgccgaucauaaauagagaagguaaaguaguuggucuauacgguaacggcguagugacgaaaaacggagguuacguaagcggcauagcucaaacgaaugcugaaccugauggacccaccccggaauuagaagaagaaauguuuaagaaacgaaauuugacuauaauggacuuacauccuggcagcgggaaaacacguaaauauuuaccggcgauaguaagagaggcaauuaaaagacgacuacgaacacugauacuagcucccacaagagucguagcugcggaaauggaagaagcacuuaaaggacuccccauucgcuaucaaaccacugcgacaaagucagaacacacgggucgagagauaguugaucuaaugugucaugcaacauucacuaugcgacuacuuuccccugucagagucccgaauuauaaucuaaucauaauggacgaggcacacuucacagacccugcuucuauugcugcaagaggauacauaucaacacgggucgguaugggggaagcugcugcaauuuuuaugacagcuacucccccaggaacagcagaugcauuuccacaaagcaacgcaccuauucaagacgaggagagagacauaccagaaagaagcuggaauagugguaacgaauggauaaccgauuuugcagggaaaacugucugguuugucccaucuauaaaagcaggcaacgauauagcuaauugcuuaaggaaaaaugguaagaaaguaauacaguugucaagaaaaacguuugauacugaauaucagaaaacuaaacugaaugacugggacuucgucguaacaacugauaucuccgagaugggagcgaacuucaaagcggauagagugauugacccgcggcgcugucugaaacccguaauacucaccgaugguccggagaggguuaucuuagcaggaccaaugccuguaacugcggcaucugcagcacaaaggagaggucgugugggacgaaauccacagaaagagaaugaccaguauauauuuacaggacaaccauuaaauaacgaugaagaucacgcacauuggacugaggcuaaaaugcuccucgacaauaucaauaccccagaagguauaaucccugcguuguucgaaccggagcgagaaaaaucagcagcaauagauggagaguacagauuaaaaggagaaucaaggaaaacauuuguugaauuaaugagacguggcgaucugcccguguggcuggcacacaaagucgcuagugaagguauaaaauacacagacaggaaaugguguuuugacggccaacguaauaaucaaauucuagaggaaaauauggauguagaaauauggacaaaagagggagagaagaagaaauuacgaccgcgcugguuagacgcuagaaccuauucggauccguuagcuuuaaaggaauuuaaagauuucgcagcgggcaggaagaguauagcuuuggacuuaguaacagagauuggaagagucccaucccauuuggcccaucguacccgaaacgcauuagauaaccugguaauguuacauacuucggagcacggaggaagggcauacagacaugccguggaagaauuaccugaaacaauggaaacccuauuauugcuaggucuuaugauucuuuugacagguggggcgaugcucuuucucauaucaggaaaaggcauaggaaaaacauccauaggacucauuugcgucauugcaucaaguggaaugcuauggauggccgagauuccacuccaguggauugcuucagcuauagucuuagaauuuuucaugaugguacuguuaaucccugaaccagagaaacaaagaacaccccaagacaaucaguuggcuuauguaguaauaggcauccuuacgcuagcugcgauaauugcugcaaaugaaaugggacuacuagaaacaacaaaacgugaucucggcaugucaaaagagccaggaguugucagcccaaccucguaucuugauguugauuugcaucccgcaagugccuggacuuuauacgcaguagcgacaacugucaucacacccaugcucagacauacaauagaaaauaguacagcaaacgucagccucgccgcaauagcaaaucaagcgguaguauugaugggccuagauaaaggauggccaauaucaaaaauggaucuagguguuccgcuguuagcacucgguugcuacucacagguuaaucccuuaacacuaacggcagcaguguuguuacuaauaacacauuacgcaauuauuggaccuggacuacaagccaaagcuacaagagaggcacagaaaagaaccgcggcaggcauaaugaaaaacccaacgguggaugggauuaugacgauugaccuagacccaguaauauaugacuccaaauucgaaaaacaauuagggcagguaaugcuauuaguauuaugugcaguccagcuauugcuuaugcguaccucaugggcacuuugugaggcauuaacccuagcaacaggaccuauuacaacccuaugggaaggauccccaggaaaauucuggaacacgacuauagcuguaagcauggccaauauauucagagguucauacuuagcaggagccggauuagccuuuucaaucaugaaaagcgucgggaccggcaagagagguacuggcagccaaggcgaaacauuaggcgagaaauggaagaagaaauuaaaccaacucucucgcaaagaauuugaucuguauaaaagauccgguauuaccgaaguagaucgcaccgaagcaaaagagggauugaaaagaggagagauaacacaucacgcaguaagcaggggcagugccaaauugcagugguucguagaaagaaauauggugauaccugaaggcagaguaauagauuuaggaugcggcagagggggcugguccuauuauugcgcggggcucaagaaaguaacggaaguuagaggguacacuaaaggcgguccuggacaugaagaaccgguuccaaugucaacauacggguggaacauugugaaacuuaugucagguaaggacguauuuuaucuaccgccagaaaagugugacacauuacuaugcgacauuggugaaucaagcccuucgccaaccguagaagaaucaagaacgauccguguacuuaagaugguugagccauggcugaaaaauaaccaguucuguaucaaaguacuuaaucccuauaugcccacagucauugaacacuuggaaaggcuucaaagaaaacauggcggaaugcuaguuagaaauccacuauccagaaacagcacacaugaaauguacuggauuucaaaugguacugguaauauuguagcuucagucaacaugguaucaagauugcuuuugaaucgguucacuaugacucauagaaggccaacaauagaaaaagacguagaucuuggagcgggcacacgacauguuaaugcagaaccugagacccccaacauggacguaaucggcgaacgcauaaaacgcauuaaagaagaacacaauaguacauggcauuacgacgaggaaaauccuuacaaaacaugggcauaucaugggucauaugagguuaaagcaacuggaucggcaucaagcaugauuaacgggguaguaaaauuacugacaaaaccgugggacguaguuccuaugguaacacaaauggcuaugacagacacaacgccuuuuggucaacagcggguauucaaagaaaaaguagauaccagaacaccaagaaguaugccaggcacuagaagaguuaugggaauuacugcagaguggcuauggcguacauugggaagaaauaagaaaccacgucuauguaccagagaagaauuuacaaagaaaguaagaacuaacgcagcaaugggagccgucuucacagaagaaaaucagugggacucagccaaagcagcagucgaagaugaggacuucuggaaacucguagacagggaacgagaacuccauaaguuagggaagugcggcucauguguauauaauaugaugggaaaaagagagaagaaacuaggagaauuuggcaaggcgaaagguucacgugcuauaugguauaugugguuaggcgcaagauaucucgaguucgaagcguuaggauuccucaaugaagaccauugguucagcagagaaaauucuuauucgggaguugagggugaaggacuacacaaacugggguauauucuucgagauauaucuaaaauccccggaggagccauguaugcggacgauacagcgggaugggauacuaggauaaccgaggaugaucugcacaacgaagagaaaaucacacaacaaauggauccugaacaucgacaguuagcuaaugcaaucuuuaaauugacuuaccagaacaaagucguuaaggugcaaagacccacuccaacugguacuguuauggauauuauaagcagaaaggaccaacggggaagcggacagguaggcacauauggccuaaauacguucacaaauauggaagcgcagcucauacgucaaauggaaggugaagguguucuauccaaggcagaucuagaaaauccucaucucccggagaagaaaauuacucaguggcuagaaacaaaaggaguggaacgauuaaaacgcauggcaauauccggugaugacugugugguuaaaccaauugaugauagauucgcgaaugcucuccuugcguuaaacgacaugggcaaaguucguaaggauauaccacaauggcaaccaucgaaaggguggcacgacuggcaacaagucccuuucuguucucaucauuuccaugaacuaauaaugaaggacggacgcaagcuaguaguaccauguagaccccaagacgaacuaauugggagagcaagaauaucucaaggugcagguuggucgcuacgagaaacagcuugcuuggggaaagcauacgcacaaauguggacauugauguauuuccacaggagagaccuaagauuagcaagcaaugcaauuugcagugccguuccaguccauuggguaccaacuucaaggaccacauggaguauacaugcucaccaccaauggaugacaacagaagacaugcugacaguguggaaccguguuuggauagaagauaauccguggauggaggacaagacaccuguuacaacaugggaagacguuccauaucuugguaaaagagaggaucaguggugcgguagccuaaucggcuuaaccucucgcgcgaccugggcacaaaacaucccgacagccauucaacaaguucgaucauuaauagguaaugaagaguuucuugacuacaugccaucaaugaagcgguuuagaaaagaagaagagagcgaaggcgcuaucugguaa

SEQ ID NO: 23274 - RNA, 9873 nt, Artificial Sequence
  derived and/or modified CDS sequence (opt6) from DENV-3__KJ189292__SS-prME
acaucccuaugccuaaugaugauacuaccugcagcacuggcuuuucauuuaaccaguagagacggugaaccaagaaugaucguugguaaaaacgaaagaggaaaaucccuccuguuuaaaaccgcuucgggaauaaacaugugcacauuaauagcuauggaccucggagaaaugugugacgauaccguuacauauaaauguccucacauuacugaggcagaaccggaagauauugauugcugguguaaucucacgagcacuuggguuaccuauggaacuugcaaccaagcaggggaacacagaagagacaaacguucuguggcacuagcaccacacguagguaugggccuggauacgcggacacaaacauggaugagugcagaaggggcuuggagacaaguagaaaaaguagagacaugggcacuacgacaccccgguuuuacaauacucgcgcuauuuuuagcgcauuauauugguacaagccuaacacaaaaaguuguuauauuuaucuuacuaaugcuagucacuccuucgaugacaaugagauguguaggcguagguaacagagauuuuguagagggucuuucgggcgcgacuuggguugaugugguacuagaacacggaggaugcgugacgacgauggccaaaaauaaaccaacuuuagacauugaguuacagaaaacugaggcuacccaacuggcaacucuacgaaaacucugcauagaaggaaaaauuacgaauauuacuacugauagucgcugcccaacccaaggggaagcaguccugccagaagaacaagaucaaaauuauguaugcaaacauacuuacgucgauagagguuggggaaaugguuguggguuauuuggaaaaggcucauuaguaacaugugcgaaauuucaauguuuagagcccauugaggguaaaguuguacaauaugaaaaucuaaaauauacaguaauaaucacaguccauacuggugaccaacaucaagugggaaaugagacgcaagguguuacagcagaaauuaccccacaggcaucaacaacagaagcaacccuaccggaauacgggacacuuggcuuagaguguucaccacggacagggcuagauuuuaaugaaaugauauugcuuacuaugaaaaacaaagccuggaugguccaccgccaaugguucuuugauuuaccacuaccauggacaucgggagcuacuacagaaacaccaacuuggaaucguaaagaacuuuugguuacuuuuaaaaaugcccaugccaagaaacaagaagucguagucuuaggaagccaagaaggagcaaugcauaccgcacuuaccggagcaaccgaaauccaaaauagcggagggacaucuauuuuugcuggacaccuaaaaugucgguuaaaaauggauaaauuagagcuaaaaggaaugaguuaugcaaugugcacuaauaccuuuguauuaaagaaagaaguaucagagacacaacaugguacaaucuugauaaaaguggaauacaaaggggaagacgcuccguguaaaauuccguuuagcacagaagacggccaugguaaagcccauaaugguagacuuaucaccgcgaauccugugguaaccaagaaagaggagccaguuaauauagaggccgagccacccuucggugaaucuaauauuaugauagguauuggagauaaugcccuaaaaauaaauugguacaagaaaggcucgaguaucggaaaaauguuugaagcgacggcaagaggugcacgccgaauggcaauucucggggacacagcgugggauuuugguucaguagguggagugcuaaacaguuuagggaaaauggugcaccaaauauuuggcucugcuuauaccgcauuauuuucgggaguuagcugggugaugaaaauuggaauuggaguuuuacuaacuuggaucgguuuaaacucaaagaauacgagcaugucauuuucuugcaucgcaauagggaucauuacacuguacuugggcgcuguaguacaagcagauauggguugcauaauaaauuggaaaggaaaagaacuuaaaugcgguucgggcauuuuugugacaaaugagguacauacuuggacagaacaauacaaauuucaagcggauagcccaaaaaggcuagcaacagcgauagcaggagcuugggagaacggcguauguggaauuaggaguacaacaaggauggaaaaucuauuauggaagcaaauagcgaaugaauuaaauuauauacuuugggaaaauaauauaaagcugacugugguagucggagauauaauaggcguacuagaacaggggaaaagaacucuaacuccgcaaccaauggaauugaaauacucguggaaaacauggggaaaagcuaaaauaguaacugcagaaacacaaaacucuagcuucaucauagaugggcccaauaccccagaauguccaagcgcaagucgggcguggaacguaugggaaguugaggauuacggauuuggugucuucaccacaaauauauggcuacgauuacgugaaguuuacacucagcuaugugaccaccgccuaaugagcgcagcgguaaaagacgagagagcaguccacgcugacauggguuacuggauugaaucccagaaaaauggaucguggaaacucgaaaaggccagccugauugaggugaaaacguguacauggccgaaaucccauacacuauggaguaaugggguauuagaaucggauaugauaaucccaaagagcuuagcuggucccauuagccagcacaaucaucguccaggauaccacacccaaaccgcaggacccuggcaccucggcaagcucgaacuugauuucaauuacugugaggggacaacggucgucaucacggaaaauuguggaaccagaggaccaaguuuacgaacuacaacugucagugguaagcucauacacgaaugguguuguagaucuugcacuuuaccaccucuaagauauaugggugaggauggauguugguacgguauggaaauuagacccauaagcgaaaaggaagaaaauaugguuaagucgcucguaucugcaggaucagggaaaguugauaacuucaccaugggaguauuaugucuagccauucucuuugaagaaguuaugagagguaaauucgguaaaaagcacaugaucgcgggagucuucuuuacauucgugcuauuauuaucugggcaaaucacuuggagagauauggcacauacacucaucaugauagguucgaacgcaucugaccgcaugggcaugggaguaacuuacuuagcucuuauagccacuuuuaaaauacaacccuuuuuagcguuaggguucuuucuucggaaauuaacuuccagagaaaaucuucuucucgguguuggguuggcaauggcaacaacuuuacagcuaccagaggauauagaacaaauggcuaaugguauagcucuaggucuaauggcccuaaaacuaauaacacaauuugaaacuuaucaauuauggacggcgcuuaucucccuaacgugcagcaacacuauuuuuacuuugacaguugcguggaggacugcaacauuaauauuggcgggaguaucuuuguuaccaguuugccagucaaguagcaugcggaaaacagauugguugcccauggccguggcagcgauggguguacccccguuaccucuuuuuauuuucagcuuaaaagauacuuuaaaaagacgcucguggccauuaaaugaggguguuauggcugugggcuuagucuccauauuagcuucaaguuuauuacgaaacgauguuccaauggcgggccccuuagucgccggugggcuuuuaaucgcauguuaugugauaaccgguacgagugcagacuuaacgguagaaaaggcagcggauauaacaugggaggaagaagcggagcaaacagggguaagucauaaucuaaugauuacgguggacgaugauggaacgaugagaauuaaagaugacgagacggaaaauauacuaacaguuuuacuaaaaacagcgcuucuaauaguaagcgguauuuuuccuuacagcauaccugcaacauuacucguauggcauacauggcaaaagcaaacacaacggucagguguacuaugggacguucccucaccacccgagacacagaaagcagaacuagaggaaggugucuauaggauaaaacaacaagguaucuuuggaaaaacacagguggguguggguguacaaaaagaaggaguuuuccacacaauguggcauguaaccagaggugcagucuuaacauauaacgguaaaaggcuugagccaaacugggccagugucaagaaagaccuuaucucauacgggggcgguuggcgacuuagcacacaauggcaaaaaggagaagaaguacagguaauagcuguugaaccaggcaagaaccccaaaaauuuucaaacaauaccgggaacuuuucagacaaccaccggugaaauaggugcuauagcacuagacuuuaagccaggcaccucuggaucaccaauaauuaauagggagggaaaagugguaggacuguauggcaacggagugguuacuaagaacggagguuauguaucugguaucgcacaaacaaacgcugaaccagaugguucaacaccagaguuagaagaggaaauguucaagaaaagaaacuuaacgauuauggaccuacauccaggcucaggcaagacccguaaguauuuaccagcuauuguaagagaagcuauaaaaagacgguuaagaacucuaaucuuagcaccaaccagaguaguagcagcagagauggaagaggcacuaaaagguuugccuauacgauaccaaaccacggcuacaaaaucugaacauacgggcagagaaaucguugacuugaugugucacgcaacauuuacgaugcguuuauuaaguccuguaaggguaccuaacuauaacuugauaauaauggaugaagcacauuucacugacccagcgaguauagcagccagaggcuacauauccacuagaguaggaaugggugaggcagcagcuauauucaugaccgcuacuccaccugguacagcagacgcauucccacaaucaaacgcgccuauacaagaugaggaacgagacaucccagaaagaucguggaacucgggaaaugaauggauaacggauuuugcaggaaaaaccguaugguuuguuccaaguauaaaagcugguaacgauauugcaaauugucuacguaagaauggaaagaaaguaauacaguugagcagaaaaacuuuugacacagaauaucagaaaaccaaacugaaugauugggauuucgucguaacgacagauauuuccgaaaugggugcgaauuucaaagccgauaggguaauugaucccagacgauguuugaaaccaguaauucugacagacggaccugaaaggguaauacuagccggaccuaugcccgugacaguugcaucggcggcacaaagacgagggcgagugggcaggaauccacaaaaagaaaacgaccaauauauuuucacaggucaaccauuaaauaaugaugaagaccaugcucauuggacagaagcuaagauguuguuggauaauauaaacacuccggaaggaauuaucccugcccuguucgagccagagcgagaaaaaucugccgcaauagacggugaauaccguuuaaagggugagaguagaaagacuuucguagaauuaaugagaagaggugaccugcccguguggcuggcucauaaaguggcuucggagggaauaaaauacaccgacagaaaaugguguuuugacggucaacgaaacaaccaaauucuagaggagaauauggauguggaaauuuggacuaaggaaggagagaagaagaaacuucgcccgagaugguuagacgcuagaacauacucagacccccuggcacuuaaagaauuuaaggacuuugcugcagguaggaaaucaauagcuuuagaucuaguaacagagaucggaagaguaccaagccaucuagcacaccgaacuagaaaugcacuugacaacuuggugaugcugcauacaagcgaacauggagggagagcauacaggcaugcagucgaagaacuaccggagacuauggaaacucuacuccucuuaggauugaugauacuauuaacuggaggagcaauguuguucuuaauaucaggcaaagggauaggaaagacgucaauaggauuaauuugcgucaucgcguccagcggaauguuauggauggccgagauaccgcuccaauggaucgcaucagcuauuguccuagaguucuuuaugaugguauuacugauaccggaaccggaaaagcaacgaacaccacaagauaaccaauuagccuacguuguaauaggcauucuaacccuagcagccauaauagcugcaaaugaaauggggcuucuggaaacgacgaagagggaucuagggaugucgaaagaaccugggguaguaucgccaacaucuuacuuggauguggaucuccacccugcgucugccuggacacuuuaugcgguugccacaacgguuauuaccccuaugcuaagacauacaauugaaaacaguacugcaaauguuucacuagcggcgauagcaaaucaagcgguuguucucauggguuuggauaaaggguggcccauuuccaaaauggaucugggcguaccauuacuggcucuagggugcuacagucaggucaauccacuaacuuugacugcagcggucuuacuacuaauuacucauuacgcuauuauuggaccaggucuccaagcuaaagcgacucgugaagcgcagaaaagaacggcagcagguauuaugaaaaaccccacaguggacggaaucaugaccauugauuuggauccuguuauauaugacucaaaauuugaaaagcaguuagggcaagugaugcuauuagugcuaugcgcaguucaauuguuacucaugaggacgucuugggcauuaugugaagcauuaacccuugcaacaggcccuauaacuacucuaugggaaggaucgcccggaaaauuuuggaauacgaccauagcuguaucaauggcaaacauuuuccgagggucauaucuagcaggagcaggcuuggcauuuucuauuaugaagagugucggaacgggaaaaaggggaacgggaagucaaggcgaaacgcuaggggaaaaauggaagaaaaaguuaaaccaguuaucccguaaagaauuugauuuguauaagaaaucagguaucacggagguagaucggacagaggccaaagaaggcuuaaaaagaggugaaauaacacaucacgcagucucaagagguucagcaaaguuacagugguuuguugaaagaaacaugguuauuccagaaggucgcguaauugacuuaggaugcggccguggaggauggucauauuauugugcaggacuuaagaaaguuacagaaguccguggauacaccaaaggaggaccuggacacgaagaaccugucccuaugucaacuuauggcuggaauauagugaaguugaugucugguaaggacguauucuacuugccuccggagaaaugugauacauuacuuugugauauaggagaauccuccccuucaccaacaguagaagaaagucgaacaauaaggguacuuaagaugguagaaccguggcuuaaaaauaaccaguuuugcauuaaaguuuuaaauccuuacaugccaaccgucaucgaacaucuagaaagacuacagagaaagcauggaggaauguugguaagaaauccacuaagccguaauucaacacaugagauguauuggaucucuaacggaacaggaaauaucguggccagcgucaauaugguaucgagacuacuauuaaauagguucaccaugacucauagaagaccuacgauugagaaagauguagauuuaggcgccggaacccgucauguaaacgccgaaccagaaacacccaauauggauguaauuggagaacgaauaaagcgaaucaaagaggaacauaauucuaccuggcacuaugacgaugaaaacccguauaaaaccugggccuaccauggguccuaugaggucaaagccacuggaucugcaucuucgaugauaaaugguguaguaaaacuacuaaccaagccgugggacguuguaccaaugguuacucaaauggcuaugaccgacacaacaccguuuggacaacagagaguauucaaagagaagguagacaccagaacgccaagguccaugccaggaacucgaagagugauggguauaacagcggaauggcuguggcgaacgcuaggacguaauaagaaaccgaggcuaugcacaagagaagaauuuaccaagaaaguucguacaaacgccgcgaugggagcuguauuuacggaggagaaucagugggacagcgcuaaggcggcaguagaagaugaggacuuuuggaaacucguugaucgugaacgagaacuacacaaacuaggaaaaugcgggucgugcguauauaauaugaugggcaaaagagagaagaaauuaggugaauuuggaaaagcuaaaggaucuagagccauaugguacaugugguuaggagcgcgauaucuugaauuugaagcauugggcuuucugaacgaagaucauugguucucuagagaaaauuccuauaguggaguugagggagaaggauuacacaagcuaggauauauuuugagagauauaucaaagauuccuggaggugcaauguacgcggacgauacagcaggaugggacacccgcaucacagaagaugaccuccacaacgaagagaaaauuacacaacaaauggauccagaacaccgacaauuagcaaaugcaauauuuaaacuaacuuaucaaaauaagguaguaaagguucagagaccgaccccuacgggcacagugauggacauaaucucucgaaaagaccaacgugguuccggucaaguagggacauaugguuuaaauacauuuacaaauauggaaguacaauuaauucgucaaauggaaggugaaggagugcuaucuaaagcugaccuggaaaacccacauuuaccugagaagaaaaucacacagugguuagaaacaaaaggggucgagcggcuuaaacgcauggcgauuagcggugacgauuguguuguuaaaccuauugaugacagguucgcuaaugcauugcuugcacuaaaugacaugggcaagauaagaaaggacauuccacaauggcaacccucuaaaggguggcacgacuggcagcaaguaccauuuugcagccaucacuuccacgaauuaaucaugaaagaugggaggaagcuggucguaccgugccgcccacaagacgaacuaauaggucgcgcaaggauuagucagggagcggguuggucguugcgggagaccgccugccugggaaaggcauacgcacaaauguggaguuuaauguacuuccacagacgugacuugagacuagcaagcaaugcuauaugcagugcaguaccuguacauugggugccaacgucaagaacgaccuggagcauucacgcucaucaucaauggaugacaacagaagacaugcuuaccguuuggaaccgagucuggauugaagacaaucccuggauggaagacaagacuccagucaccacuugggaagaugucccuuaccuugggaagagggaagaucaaugguguggaucauuaauaggacuaaccucuagagccaccugggcacagaauauaccaacagcuauucaacagguacgaaguuuaaucgguaaugaagaauuucuggauuauaugccuaguaugaaaagauucagaaaagaagaagaaucagaaggcgcuauuugguaa

SEQ ID NO: 23275 - RNA, 9873 nt, Artificial Sequence
  derived and/or modified CDS sequence (opt6) from DENV-3__KJ189293__SS-prME
acgagcuugugcuuaaugaugauauuaccagcagcacuugcauuccaucuuaccaguagagacggagaaccacggaugaucguaggcaaaaacgaaagaggaaaaaguuuauuauucaaaacagcaucugguauaaauaugugcacccucauagcaauggauuugggagaaaugugugacgauacuguuacauacaaauguccacauauaacggaaguagaaccagaagauaucgacugcuggugcaauuuaaccucuacuugggucacauauggaacuuguaaccaagcuggagaacaucgaagagauaaacgaucgguugcgcuugcuccgcacguagguaugggauuagauacaagaacacaaacguggaugucagcagaaggagcguggcgacaaguggagaaagucgaaacaugggcauuaagacacccaggauuuacgauacuagcucuuuuucuagcacauuauauuggaaccagucucacacaaaaaguaguaauuuucauauuacuaaugcuagugacaccaucaaugacaaugagaugcguaggagugggaaaccgcgacuucguugaagguuugucaggagccacuuggguagaugucguguuagagcaugggggaugcgugacaacaauggcuaaaaacaaacccacgcucgacaucgaauuacagaaaaccgaagcuacucaauuagccacacuacgcaaauugugcaucgaaggaaaaauuacgaacauaaccacugauagccguugucccacacaaggugaagcaguccugccagaggaacaagaucagaauuauguauguaaacauacuuauguggauaggggaugggggaacgguuguggauuauuuggaaaagguucauuagugacaugugcaaaauuucaguguuuggagccaauagaaggaaaaguuguacaauacgagaaucuaaaauauacaguaauaauaacgguccauacaggagaucaacaucaagucgguaaugaaacacagggaguaacagccgagauaacaccgcaggcuaguacaacggaagcaacacucccagaguaugggacauuaggauuggaguguucgccacguacaggacuagacuucaacgaaaugauauuguuaacaaugaaaaauaaagcauggaugguacaucgccaaugguucuucgaucuaccccugccauggacaagcggagccacaaccgagacaccuaccuggaauagaaaagaauuauugguaacuuucaaaaacgcccacgccaagaaacaggaagugguaguccuugguagccaagaaggagccaugcauacugcacuaacgggagcuaccgaaauacaaaacucgggcggcacaucgauauuugccggccauuuaaaaugcagauuaaaaauggacaaacuugaauuaaaagggaugucuuaugccauguguacaaacacauucgugcuuaagaaagaaguaagugaaacacaacacggcaccauuuuaauaaaaguagaauacaaaggagaggacgcgccuuguaaaauccccuuuaguacagaagauggacauggaaaagcccacaaugguaggcuuauuacagccaauccaguggucacaaagaaagaagaaccugucaacaucgaagcagaaccaccguuuggagaaucgaauaucguaauuggaaucggagauaacgcacucaaaauaaacugguacaagaaagggucuucaauaggaaaaauguuugaagcuacggcccggggagcgcgucguauggcaauacuaggugacacagcgugggacuucggaagcguaggagguguacuuaacagucucggaaaaaugguccaccagauauucgggucugccuacacggcacuauuuucagguguauccugggugaugaaaauagggauugguguacuauuaacauggauaggcuugaacagcaaaaauacgaguaugucuuucucuugcauagcaauagguauaaucacucuauaccuaggugcaguaguacaggcugacaugggaugcguaauuaacuggaaaggaaaagaacucaaaugugggucaggaauuuucgucacaaacgaaguucacaccuggacugagcaguacaaauuucaagccgauagcccaaaaaggcucgcgacagcaauugccggugcgugggagaaugguguuugcgguauacgguccacaaccagaauggaaaaucuacucuggaaacagauagcaaacgagcuuaauuacauucuaugggaaaauaauauaaaacuaacuguaguaguaggggacauuauuggcguucuugaacaaggaaaacggacucuuacaccacaaccuauggaauuaaaauauuccuggaagacguggggaaaagccaagaucguaacagcugaaacacagaauaguucguuuauaaucgaugguccgaauaccccggagugcccaucugcaucacgagccuggaacguuugggaaguagaggacuauggauuuggaguauuuacaacaaauauuuggcuacgguuacgcgaaguuuauacacaguuaugcgaucaucgucuuauguccgcagcaguaaaagaugaaagagcaguacaugcagauaugggauauuggauagaaucacaaaagaacgguucuuggaaacuggaaaaagcgagucuaaucgagguaaaaacuuguacguggccuaaaucucacaccuuauggucuaauggcguacuggaaucugacaugauaauucccaaaagucuugcaggcccaauaagccaacauaaucacagacccggauaccauacccaaacagccgggccauggcaucucggaaaacuugaacucgacuucaacuauugcgaaggaacaaccguuguuauaacagaaaacuguggcacaagaggacccaguuuacguacaaccacagucucaggaaaacuuauccaugaauggugcugcagaagcuguacacuuccgccauuacgauacaugggggaggauggcuguugguacggaauggaaauaaggccaaucagugagaaagaggaaaacaugguaaaaucauugguauccgccggcucgggaaaaguugauaacuuuacuaugggaguucuuugccuagcaauauuauuugaagagguuaugagaggaaaguucggcaagaaacauaugauugcaggcguauuuuucacauucguguuauuauuaucugggcagauaaccuggagagacauggcccauaccuuaaucaugaucggaaguaacgcaagugauagaaugggcaugggggugacauacuuagcuuuaauugcaacauuuaaaauacaaccguuccuagcucuaggguucuuucucagaaaacucacaucacgugaaaaucuucucuuaggagucggacuugcaauggcuacaacuuuacaauuaccugaggacauagagcagauggcaaauggaauagcgcuuggauugauggcacuaaagcuaaucacgcaauuugagacauaucaguuauggaccgcgcuaauuagucucaccuguuccaauaccaucuuuacacuaacgguggcauggagaacugccacauuaauucuggcuggaguaagccuacuuccuguuugccaaucaucauccaugagaaaaacagauuggcuaccaauggcagucgcugccaugggagugccgccacuuccuuuauuuauauuuucuuuaaaagacacucugaaacgacguuccuggccucuaaacgagggagugauggcaguaggauugguaagcauuuuggcaucaucacuguuaagaaaugacguuccuauggcuggcccauugguagccggggguuuacuuauagcuuguuacguaauuacaggaacaagcgcagaucuuacaguugaaaaagcagccgauauuaccugggaagaagaagcugaacagacuggaguaagucauaacuuaaugauuacuguugaugaugauggaacuaugagaauaaaagaugaugaaacagaaaauauacuaacagucuuauuaaaaacagcuuuacuaaucguuuccgguauuuuuccuuacagcauaccugccacccuauuaguauggcacacauggcaaaaacaaacccagcgaaguggcguauuaugggacgugccuucaccuccugaaacucaaaaagcagagcuagaggaaggaguguaucguaucaaacaacaaggaauuuuugguaaaacacagguugguguaggaguacaaaaggaaggugucuuucauacuauguggcacgucacaagaggcgcuguccucacguacaauggaaaacgguuagaaccaaacugggcaaguguuaagaaagacuugauaucuuaugguggaggauggcgacuaagcacucaguggcaaaaaggcgaagaggugcaaguaauagcugucgaaccagguaaaaaucccaaaaauuuucaaacgaugccgggcacauuccagacaaccacaggcgaaauuggugcuauugcauuagacuucaaaccagggacaaguggaucaccgauaauaaaucgagaagguaaggucguaggucucuauggaaauggaguagucaccaaaaauggagguuacguaucaggcauugcacaaacaaacgcagaaccagacgggccgaccccggagcuggaagaagagauguuuaagaaacguaaucuuacaauuauggaccuacaucccggaagcgguaagacccgaaaauacuuacccgccauaguucgugaggccaucaaaaggagauugcgaaccuuaauucuggcaccaacuagaguuguagcagcugaaauggaggaagcucuaaaggguuuacccauccgauaccaaacgaccgcaacaaagucagaacauacggggagagaaauuguagaucucaugugccaugcaacuuucacgaugagacuacucucaccaguucggguucccaacuacaauuuaaucauaauggaugaagcgcacuuuacugauccugccuccauagcagccagaggauauauaucuacuagaguagguaugggugaagcggcggcuauuuuuaugacggcaacaccacccgggacggccgacgcauuuccacaaucaaacgcuccuauucaagacgaagaacgcgauaucccagaacgaucauggaacucaggaaaugaauggauaaccgacuuugcagguaaaaccguaugguuuguccccucuauaaaagcuggaaaugacauugcgaacugcuuaaggaaaaacgggaagaaagucauacaauugucaaggaaaacauuugacacagaauaccagaaaacaaaauuaaacgacugggacuucgucguuacaacggauaucagugagaugggagcuaacuucaaagcggaucgugucaucgauccccgaaggugccuuaaaccgguuaucuuaacggacggaccagaaagagugauccuggcuggaccaaugccggugacagcagcuucugcugcucaacgacgaggacguguagggagaaauccucaaaaagaaaaugaucaauauauuuuuaccggucagccuuuaaauaaugaugaggaucacgcacauuggacugaagcaaaaauguuacucgauaauauaaauacgccagaaggaauaauuccagcacuauucgaaccugaacgugaaaaaucugcugcgauugauggagaauaucgccucaaaggagaaagcaggaagacauucguggagcuaaugagaagaggugaccuucccguauggcucgcacacaaagucgccagcgaaggcaucaaauacacugaccgaaagugguguuucgaugggcagagaaacaaucaaauuuuggaagaaaauauggauguugaaaucuggacuaaggaaggggagaagaagaaacugcggccuagauggcuggacgcgcggacguacuccgauccguuagcccucaaagaauuuaaagacuucgccgcaggccguaaaucaauagcauuagaucucguuacagaaauugguagaguuccuucucaucuagcacaucgcacccgaaacgcguuggacaaccuuguaaugcuccacacaucagaacauggagguagggcauauagacacgcuguagaagaguugccugaaacaauggaaacuuugcuuuugcuuggauugaugaucuuauuaacuggcggugcuaugcuuuuucuuauaucgggaaaaggaaucgguaaaaccucuauagguuugauuugugucauagcuucgucgggaauguuauggauggcggagauaccccuacaauggauugcaucugcgaucgugcucgaguucuuuaugaugguuuuauugauuccugaaccugaaaaacagagaaccccucaggacaaccaauuagcauauguuguaauuggaauacugacacuugcagcuaucaucgcugcaaaugaaaugggauuauuggaaacaaccaaacgagauuuaggaaugucaaaggagcccggaguuguuucacccaccuccuaccuagauguagauuuacauccagcgucugcauggacauuauacgcuguagccacaacgguuauuaccccaauguuacgacauacaauagaaaauucuacagccaauguuagucuagcugcaaucgcuaaccaagcagucguuuugaugggauuagauaaaggauggccuauaaguaaaauggacuugggcgucccacuauuagcacuaggaugcuacucgcaaguaaacccucuuacacuaacagcagcuguacuauugcuuaucacucacuaugcuauuaucggcccaggccuacaggcgaaagccacaagggaagcucagaaaaggacagcggcuggcauaaugaaaaaccccacgguugaugguauuaugaccauugaucuugauccgguaauauacgacuccaaauucgagaaacaacuaggacaaguuauguuacuuguucuaugcgccguacaauuauuguugaugaggaccaguugggcuuugugugaggcgcugacguuagccacaggaccaaucaccacacugugggaaggaaguccaggaaaauuuuggaacacgacuauagccguuuccauggcaaauauuuuucgaggaaguuaccuagcgggagcaggacuugcauuuagcaucaugaaaucaguaggcacugggaaacgagggacaggaucacaaggggagacacuaggugaaaaauggaagaagaaacuaaaucaacucucaaggaaggaguucgaucuauauaagaaaaguggcauaaccgaaguagaucgcacagaagcaaaagaaggucucaaaagaggggaaauaacucaucaugcaguuagucgaggaucugcaaaacugcaaugguucguagaacgaaauaugguaauuccagaaggaaggguaauugaucuaggcugcggacgagguggcugguccuauuacugugcuggccuaaagaaaguaacagaagugaggggauacacaaaaggaggacccggucacgaagaaccgguaccgaugucuacuuauggcuggaauauaguaaaacuaaugucuggaaaagacgucuuuuaccucccaccagaaaaaugcgacacauuguuaugcgauauuggggaaaguucaccauccccaacuguugaagagagccgcacuauaagaguacucaagaugguagaaccauggcuuaaaaacaaucaauuuuguauaaaaguuuuaaauccuuacaugccuacgguuaucgagcacuuagaacggcuacaacgaaaacaugggggaauguuaguucgaaacccacuaagccgaaauaguacccacgaaauguacuggauuucuaaugguacgggcaacauaguagcuucugucaacaugguuagucguuuguuacuuaacagguuuacgaugacacauagacgaccgacgauugagaaagauguugaucuaggcgcuggcacacgccaugugaaugcugagcccgaaaccccaaauauggauguuauaggcgaacgcauuaaaagaauuaaagaggaacacaauucgacauggcauuacgacgacgaaaauccauacaaaacaugggcuuaucacgguuccuaugaaguaaaagccacaggaucagcaaguuccaugauaaauggagucguuaaacuacucacaaagcccugggaugugguuccgaugguaacccaaauggcaaugacagacacaacuccauucggacaacaacgcguauuuaaagaaaaggucgacacacguacgccacgaucgaugccaggaacgagaaggguaaugggcaucacagcggaaugguuauggaggacauugggcagaaacaagaaaccacgucucugcacucgggaagaguucacaaagaagguccggacaaacgcagcgaugggcgcagucuuuacagaagagaaucaaugggauagugcaaaagcggcaguagaagaugaagauuuuuggaaacuggucgaucgggagcgggaauuacauaaacuggguaaaugcgguuccugugucuauaauaugaugggaaaaagggagaagaaauuaggugaguucgguaaagcuaaagggagcagagcgaucugguacauguggcucggagccagguauuuagaguucgaggcauuagguuucuuaaaugaagaccauugguuuagccgagaaaacucauacucuggaguugaaggagagggcuuacacaaauuaggguauauacuacgggacaucucaaaaauucccgggggagccauguaugcagacgacaccgcagggugggacacacguauaacagaagaugacuuacacaacgaggagaaaauuacacagcaaauggacccagaacacagacaacuugcuaaugccauauuuaaauuaacuuaucaaaacaaaguaguaaagguucaacguccuacaccuacuggcaccguuauggacauuauaucccguaaagaccaacguggaucaggacaaguagggacauauggguuaaauaccuuuacaaauauggaagcacaguuaauucgacaaauggagggcgaaggaguccucagcaaagcugacuuggaaaauccgcacuugcccgagaagaaaaucacgcaauggcucgaaacgaaagggguugaacgccucaaacguauggcaaucaguggagaugacuguguuguaaaaccuauagaugacagauucgcaaaugcacuacucgcccuaaaugacauggguaaaguaagaaaagauauuccacaauggcaaccgagcaaaggauggcaugauuggcaacaagucccuuucuguucgcaucacuuucacgaacuaauaaugaaagauggcagaaaauugguggugcccugucgaccgcaagaugaguugauugggagagcgagaauuucacaaggcgcaggguggaguuuaagagagacugcuuguuuagguaaagcauaugcgcaaauguggucauuaauguacuuccaucgucgggauuugcgcuuagcaucuaaugcuauauguagcgcgguccccguacauuggguaccaacaaguaggacgacauggucgauucaugcacaccaucaauggaugacaacagaagauaugcuaaccguguggaaucgcguauggauagaagauaauccguggauggaggacaaaacgccagucacaaccugggaagaugucccauaucucggaaaacgugaggaucagugguguggaucguugaucggccucacaucccgagcaacaugggcgcaaaauauaccaacagcaauucaacaaguucgaucauuaaucggaaacgaagaguuccucgauuacaugccaucaaugaaaagauuuagaaaagaagaggaaagugaaggggccauuugguga

SEQ ID NO: 23276 - RNA, 9873 nt, Artificial Sequence
  derived and/or modified CDS sequence (opt6) from DENV-3__KJ189294__SS-prME
acuucccuuugcuuaaugaugauccuacccgcggcauuagcguuucaccugacuucacgugauggagaaccacguaugauugucgguaaaaaugaaaggggaaaaucucuacuguucaaaacugccucugguauaaauauguguaccuuaauagcaauggaccugggagaaaugugcgacgacacuguuacuuauaaaugcccgcauauaacggaagucgaaccagaagacauugacuguuggugcaaucuuacaaguacguggguaacuuacggaaccuguaaucaagccggagaacaucguagagauaaaaggucuguagcacucgcgccacauguugggauggguuuagacacacgaacacaaacuuggaugucugcagaaggagcauggcgucaaguggaaaaaguagaaacgugggcacucagacauccuggauuuacuauccuggcccuauuuuuagcacauuauauugggaccaguuugacgcaaaaaguugucauauuuauucuuuuaauguugguaacaccaucgaugacaaugcgaugcguaggaguagggaauagagauuucgucgaaggccuaucaggugcuacgugggucgacguaguccuugaacauggcggauguguaacuacaauggcuaaaaauaaaccaacucucgacaucgaauuacagaaaaccgaagccacgcaacuagcgacauugcggaaauuaugcauagaaggaaaaauuacaaacaucacuacagauucacgcugccccacccaaggcgaggcagucuuaccugaagaacaagaucaaaacuauguaugcaaacauacauauguagauaggggauggggcaauggcugcggccuauuuggaaaaggaagucugguuacuugcgcuaaauuucaauguuuagaaccaaucgaaggaaaaguuguccaauacgaaaacuugaaauacacagugaucauaaccguccauacgggagaucaacaucaaguagguaaugaaacacaaggaguaacugcugaaaucacuccgcaagccaguacuacagaggcuacacuaccagaauauggaacccuuggccuagaauguagcccucgaacuggccucgacuucaacgaaaugauccuccucacaaugaaaaauaaggcauggauggugcauaggcaaugguuuuucgacuugccucuaccuuggacaucuggagcaacgacugaaacaccaacuuggaauagaaaagaacugcuagugacauucaaaaaugcccaugcuaagaaacaagaaguuguaguauuaggcucgcaagaaggagcuaugcacacagcucuaacaggcgcaacggaaauacaaaauucuggagguacgucaaucuuugcgggucacuugaaauguagauuaaaaauggauaaauuagaguuaaaagguaugucguaugcgauguguacuaauacguucguccugaagaaagaaguuucugaaacacaacaugggacaauccucauaaaaguagaauacaaaggugaagaugcacccugcaaaauaccauuuucaacagaagauggucacggaaaagcccauaauggcagauuaauaacagccaaccccgucgucaccaaaaaggaagaaccagugaauauagaagccgaacccccauuuggggaaucaaacauaguaauuggaaucggcgacaacgcccuaaaaauaaauugguacaagaaaggaucaucuaucggaaaaauguuugaggcuacagcaagaggugcacgccgcauggcaaucuugggagacaccgcgugggacuuugggagugucggcggaguacuuaacagucuagggaagauggugcaucaaauauuugggagugcguauacagcauuguuuucaggaguuucuugggucaugaaaauugggauaggcguauuacucacauggauuggacucaauucuaaaaauacuucuaugagcuucaguugcauagccauuggaauuauaacauuauaucuaggagcaguuguacaagccgauaugggcuguguuaucaacuggaaagguaaagaauugaaaugugguagugguauauucgucacuaaugaaguacauaccuggacagaacaauacaaguuucaagcggacagucccaaacgguuagccacagcuauugccggcgcaugggagaaugguguuuguggaauaagaaguacaacaagaauggaaaaccuacuuuggaaacaaaucgcaaaugaacuaaauuauauccucugggaaaauaacauaaaauuaacaguagucguaggagauauaauuggaauuuuagaacaaggaaagcgcacacuaacgccacaacccauggaacugaaauacaguuggaagacguggggaaaagcuaaaauaguuacugccgagacacaaaauucuagcuuuauaauugacgggccuaauacgccagaguguccaucagccagccgcgcauggaacguuugggaaguugaggacuacggcuucggaguauuuacaacaaauauauggcuuagauugcgagaagucuauacgcaauuaugcgaucacaggcuaaugucggcagcuguaaaagacgagagagcuguccaugcagacaugggauacuggaucgagucacagaaaaaugguucauggaaacuagaaaaggcuucauuaauagaagugaagacuuguacuuggccuaaaucucacacucucuggucgaaugguguucuagaaagugacaugaucaucccuaaaucauuagcuggcccaauaucacagcauaaccacagaccaggcuaucauacacagacggcugguccauggcaccuaggcaaacucgaauuggacuucaacuacugcgaaggcacaacgguaguaaucacggaaaacugcgggacaagagguccgaguuugagaacaacgacugugucagggaagcucauucaugaaugguguugucguaguugcacccuaccuccacugcgauauaugggugaggauggauguugguacgguauggagauacgaccaauaagcgaaaaagaggagaauaugguuaagagucucguaucagcuggauccggcaaaguugauaauuucacuaugggaguauuaugccucgcaauauuguuugaggaaguaaugaggggcaaauuugggaagaaacauaugauagcuggaguauuuuucaccuuuguccugcuucucagcggacaaauuacguggcgugauauggcccauacuuuaauuaugauagguagcaaugcaagcgauaggauggggauggguguuacauacuuagcacuaauagcaacguuuaaaauccaacccuuccucgcauuaggauucuuuuuacguaaacuaacgagcagggagaaccuauuauugggggugggacuagcgauggcgacuacccugcaacuacccgaagauauagagcagauggcgaauggaaucgcucuuggcuuaauggcccugaaacuaauaacccaauucgagaccuaucaauuauggaccgcauuaauaucuuuaacaugcucgaauacuaucuuuacgcuaaccguugcauggagaacagccacauuaauuuuagccgggguuucauuacuucccguuugccaaucuuccaguaugaggaaaacagauugguuaccaauggcaguagcggcgaugggaguaccaccucuaccucuauucauuuucucucuaaaagacacacuaaaacgaagauccuggccacuuaaugaagggguaauggcggugggucuuguaucuauacuugcaucaaguuuauugagaaaugacguuccuauggcggggccuuuggucgccgggggauuauuaauagccuguuauguaauuacagggacauccgcagacuuaaccguagagaaagccgcagauauaacaugggaagaggaagcugaacagacagggguuucccacaauuugaugauaacuguagaugacgacgguacaaugagaaucaaagaugaugaaacagagaauauauuaacaguauuacugaagacggcacuuuuaaucguaucgggaaucuuuccuuacucgauuccugcaacacuauuaguuuggcauacuuggcaaaaacaaacucaacgcaguggaguauuaugggauguccccucgccacccgaaacccaaaaagcagaacuagaagaagguguguacaggaucaaacaacaaggaauuuuuggaaaaacucaagucggaguaggaguacaaaaagaaggagucuuccauacuauguggcauguuacucguggugcuguuuuaacauauaauggcaaacgccuagaaccuaauugggcuucggugaagaaagaucugauuucauacgggggaggcuggagacuaucuacacaauggcaaaagggugaagaaguucaaguuaucgcggucgaaccuggcaaaaauccgaagaauuuucagacgaugccuggcacauuucaaaccacuaccggagagauaggagccauagcacuugacuucaaaccaggcacaucaggcucuccgauaauaaacagagaaggcaaggucgugggacuguauggaaaugguguaguuacgaaaaacgguggguaugucaguggaauugcccaaacuaacgcagaaccagauggcccgacaccugagcucgaagaagagauguuuaaaaagagaaacuuaaccauaauggauuuacauccaggcucgggaaaaacgagaaaauaucuaccugccaucguucgugaggcaauuaaacgaagacuacggaccuugauauuagcaccuacccgaguaguagcggcagaaauggaggaagcauuaaaaggucuaccaauaagguaucaaaccacggccacgaaaucagaacauacaggaagggaaauaguugaccuuaugugccaugcaacuuucacaaugagauugcuuuccccuguacguguacccaauuauaaccuuauaauuauggaugaggcgcauuuuacagacccagccucaaucgcagcucgaggauauauuaguacaaggguggguaugggugaagcagcagccaucuuuaugacggcaacuccuccgggaacagcagaugcauuuccccaaucaaacgcgccuauucaggaugaagaaagggacauuccggaacggaguuggaacucaggaaaugaauggauuacagauuuugcaggaaaaacgguaugguucguaccgucaauaaaagcuggaaaugauaucgccaacugcuugcggaagaacggcaagaaagucauucaacuuuccagaaagacauuugauacggaauaucagaagaccaaacuuaacgacugggauuucguuguaacuaccgacauauccgaaaugggcgcuaauuucaaagcagacagggucauagacccucgacguugucuuaaaccgguaauauuaacugaugggccagaaagaguaauuuuagcugguccuaugccaguaaccgcggcaucagccgcccaacguagaggucgaguagguaggaacccucaaaaagaaaacgaucaauacauauuuacaggccaaccucuaaacaaugaugaagaucacgcccauuggaccgaagccaagaugcuguuagauaauauuaauacuccagaaggaauuauaccagcucuuuucgagccagaacgcgagaaaucagcggccauagauggagaauaucgucuaaaaggagagucuaggaaaacuuucgucgaauuaaugcgcagaggcgauuuaccuguuuggcuagcucauaaagucgcaagcgagggaauuaaauauacagacagaaaaugguguuuugacggacaacgcaacaaucaaauacuagaagaaaauauggacguggagauauggacuaaggaaggagaaaagaagaaacuuaggccaagauggcuggaugcuagaacuuacucagauccacucgcacuaaaggaguucaaagacuuugcggcaggaaggaagucaaucgcacuagauuuggugacagaaauaggacgcguucccucacaucucgcccauaggacaaggaaugcccuggauaaucuaguaaugcugcacacaucggaacauggaggucgagcauaccgucacgcagucgaggaguuaccggagacaauggagacacuucucuuauuaggacuuaugauccuuuuaaccggcggcgcaaugcuuuuccucauauccggaaaaggaauuggaaagacauccauuggucuuaucugcguaauugcaucuagcgguaugcuauggauggcggaaauaccacuacaguggauugcgucugcuauaguuuuggaguucuuuaugauggugcuauuaauuccggagcccgagaaacaacggacaccccaagauaaccaacuagcauauguuguuauagguaucuuaacguuagcagcuauaaucgcagccaacgaaaugggauugcuagagacuacaaaaagggauuuagguaugaguaaggaaccaggugucguaucgccuacaucauaucuagacgucgaucugcacccagcuucugcauggacacucuaugcuguagcgacaacugucauaacaccgaugcuuagacauacgauugaaaacagcacugccaaugucucguuagcggcgaucgccaaucaagcuguaguccuaaugggguuggauaaaggguggcccauaagcaaaauggacuuaggaguacccuuguuagcacuugggugcuacucucaggugaauccauuaacguuaacagcagcaguccuucuucugauaacacauuaugcuauaauaggaccaggauuacaagcgaaagccacuagagaagcgcaaaagcguacugcagcaggcauaaugaaaaacccuacaguggacggaauaaugacaaucgacuuggaucccguaaucuaugacagcaaauuugaaaaacaguuagggcaaguuaugcucuuaguacuuugugcuguacaacuccuacugaugcgaacaaguugggcacugugcgaagcguuaacauuagccacaggaccaauuacuacguuaugggaaggaucaccaggaaaauuuuggaauacaacaauugcuguuucgauggcaaauauuuuucggggaaguuauuuagcgggagcuggauuggcuuuuaguaucaugaagucaguggggacuggcaagagaggaacugggucacaaggagaaaccuugggugaaaaauggaagaagaaauugaaucagcuuagccguaaagaauuugacuuauauaagaaaucuggaauaaccgagguagauagaacggaagcaaaagaagggcuaaaaagaggugaaauaacccaucaugcuguuagccggggaucagcuaaacuucaaugguucguggaaaggaacauggugauaccggaaggucgcguaaucgaucuaggauguggacgaggggguuggaguuauuacugugcaggacugaagaaaguaacagagguacgaggauacaccaaaggagguccaggucacgaagaaccagucccaaugaguacuuauggcuggaauauuguaaaacuuauguccggaaaggacguauuuuauuuaccgccugagaagugugauacccuucucugugauauaggcgaaucuaguccauccccaacuguugaagaaaguagaacaauacgaguucucaagaugguugaaccaugguugaaaaauaaccaauuuuguauaaaaguacuaaacccauauaugccuacagugauagaacacuuggaaagauuacaaagaaaacaugguggaauguuaguaagaaacccuuuaagucgaaauucaacacaugaaauguauuggauaucuaauggaacagguaacauaguggcuagugucaauaugguaucaagacuuuuacuuaauagauuuacaaugacucacagaagaccaacuauagaaaaggacguagauuuaggagcaggaacgcgacacguaaacgcagaaccugaaacuccaaauauggaugugaucggagaaaggauaaaacgaaucaaggaggagcauaauuccacguggcacuacgaugaugaaaaccccuacaaaacuugggcguaccaugguagcuacgaaguaaaagcaacaggcucagcgaguucaaugaucaauggagucguaaaauuacucacuaaaccgugggacguuguccccauggugacccaaauggcuaugaccgauacuacgcccuuuggccaacaaagaguuuucaaagagaaaguagauacgaggacgccaaggucuaugccaggcacgcgaaggguuaugggaauuacugcagaaugguuauggcgaaccuuagguagaaauaagaaaccaaggcucuguacgagggaagaauuuaccaaaaagguaagaacaaacgcagccaugggcgccguuuuuacggaagaaaaccaaugggacagcgcgaaagccgcaguagaagacgaagauuuuuggaaauugguagacagagaacgggaacugcacaaauuagggaaaugugggucauguguauacaacaugaugggaaaaagagagaagaaauuaggcgaguuuggaaaagcaaaaggaagcagggccauaugguauauguggcugggugcucgcuaccuagaguucgaagcguuaggguuccugaaugaagaccacugguuuucacgggaaaacucauauuccgguguagaaggagaaggacuacauaaacucggauacauucugagagauauuucaaaaauuccagggggagcuauguaugcugaugacacugcagguugggauacuagaauaaccgaagaugaucuucauaacgaagagaaaauuacccagcaaauggaucccgaacauagacaauuggcaaaugcaauauuuaagcuaacguaucaaaacaaaguagucaaaguacaaaggccaacuccgacagggacuguaauggauauuauaucuagaaaagaccaacgugggagcggacaggucggaacauauggauuaaauacuuuuaccaacauggaggcucaacuaauucggcaaauggaaggagaaggcgucuugucgaaagcggauuuggaaaauccgcacuuaccagagaagaaaaucacgcaaugguuagaaacaaaagguguagaacgauuaaagcgaauggccauaucuggagacgauugcguaguuaaaccaaucgaugauagauucgcaaacgcucuauuagcccugaacgauaugggaaaaguccgaaaggacauuccccaguggcaaccaagcaaaggguggcaugacuggcaacaagucccuuucuguucccaccacuuucaugaauuaauuaugaaagauggacgaaaauuaguagugccaugcaggccgcaggacgaacucauuggucgagcucguauuagccagggggcgggauggucuuuaagggaaacugcuugccuagguaaggcuuaugcacaaauguggucucuaauguacuuucaucgacgugaucuuagacuugccagcaacgcgauaugcagcgcuguaccgguccauugggugccaacaaguagaacuacuuggaguauacaugcccaucaccaguggaugacaacagaagacauguuaacuguguggaaucgaguuuggauagaagacaacccauggauggaggacaagacaccaguaacaacaugggaggacguaccauaccuuggcaaacgcgaagaccaguggugcgguucucuaauaggucuaacaucgagggcuaccugggcacagaauauaccuaccgcuauacaacagguaagaucguuaauaggaaaugaagaauuuuuagacuacaugccuaguaugaagcguuuccggaaagaagaagaaucggaaggagccauaugguag

SEQ ID NO: 23277 - RNA, 9873 nt, Artificial Sequence
  derived and/or modified CDS sequence (opt6) from DENV-3__KJ189295__SS-prME
acaagccucugcuugaugaugauucuuccugcggcacucgcguuccacuuaaccagcagagauggagaaccgagaaugaucguagggaaaaaugaaaggggaaaaucacuucucuucaaaacggcaucgggaaucaauauguguacauuaauagcgauggauuuaggagaaaugugugaugacacagugaccuacaaauguccucauauaacggaaguugaaccugaagauauagauugcuggugcaauuuaacgucuaccuggguaaccuauggaacuuguaaucaggcaggagaacauagacgcgauaaaagaaguguggcauuagcaccucacgucggaaugggacucgauaccaggacgcagaccuggaugagugcagaaggagcguggaggcaagucgaaaaaguugaaacuugggcucuaagacacccaggauucacgauauuagcucuauuccuagcacacuacauuggaacaagccugacccagaaagugguaauauuuaucuugcuuauguuagugacgccuucgaugacgaugcguugugucggaguaggaaaucgagacuucguagagggacuaagcggugccacuuggguugacguuguuuuagagcacgggggcugcguuaccaccauggccaaaaacaaaccaacacucgauaucgaacuacagaaaaccgaagcuacacaauuagcaacgcuaaggaaacuuugcauugaggggaaaaucacaaacauuacaaccgauuccagauguccgacccaaggcgaagcaguauuacccgaggagcaagaccaaaauuauguauguaaacauacauaugucgaccguggcuggggaaacggaugcggccucuucgguaaaggcagcuuaguaacaugugcaaaauuccaaugucuugagccaaucgaaggcaaaguggugcaauaugagaacuugaaauacaccgucauuauaacagugcauacuggagaccaacaccaaguuggaaaugagacccagggaguaacagcagagauuacaccccaagcgucaacaacagaggcgacgcuuccagaauacggaacccuaggcuuagaaugcucaccuagaacugguuuagacuuuaaugaaaugauacuacuuacuaugaaaaacaaagccuggaugguacaucggcagugguuuuucgaucucccacuaccauggacaucaggggcuacaacagaaaccccgacuuggaaucguaaagaauuacuuguaacuuucaaaaaugcucacgcuaagaaacaggaaguuguaguccuugggucacaagaaggggcaaugcacacugcuuuaacuggugcuacagagauccagaacuccggaggcaccucuauuuucgcgggucauuuaaaauguagacuaaaaauggacaaauuagaauugaaaggaaugagcuacgcuauguguacaaauaccuuugugcuuaagaaagaaguaucugagacucaacaugggacuauucuaaucaaaguagaguauaaaggugaagacgcuccuuguaaaaucccauucaguacggaagauggacacggcaaagcgcacaacggucguuuaauuacagcuaauccaguaguuaccaagaaagaagaaccugucaauauagaagcggaaccaccuuuuggagaaaguaacauuguuaucggaauuggggacaaugcauugaaaauaaacugguauaagaaaggcuccagcauaggaaaaauguucgaagcuacagcacgaggagcaagacguauggcuauacuaggagauacagcaugggacuuuggaucuguagggggaguucuaaacagucuggguaaaaugguucaucaaauauucgguagcgcuuauacugcauuauucuccggaguaucaugggucaugaaaauugguaucggcguauugcuaacauggauuggccugaauaguaaaaacacgucuaugaguuuuaguuguauugcaauagguauuaucacucucuauuuaggugcugugguucaggccgacaugggauguguuauuaacuggaaagggaaagaguuaaaauguggaaguggaauuuuuguaacaaaugagguacacaccuggacagaacaguauaaauuccaagcagauucucccaaaagauuagcuaccgccauagcuggagcaugggaaaauggcguaugcggcauaagaucaacaacacguauggagaaucuccuauggaaacaaauagcaaacgaguuaaauuacauacuaugggaaaauaacauaaaauuaaccguagucgucggugauauaauugggguacuugagcaaggaaaacgaacacuuacaccucagccuauggagcuuaaauauuccuggaagacaugggguaaagcaaaaauaguuacagcagagacacaaaacuccaguuuuauaauagauggucccaauacaccagaauguccuagcgcaaguagggcguggaacgucugggagguggaagauuacggauuuggcguauuuacuacaaauauauggcugcguuuaagagaaguuuacacgcaguugugcgaucacagguugaugagugcugcaguaaaagacgagcgugcgguacaugcggauaugggauacuggauugaaagucaaaagaauggaaguuggaaguuagaaaaagcaucgcucaucgaagucaagacaugcacuuggccaaaaucacauacucuuuggucaaauggaguauuagaaucggacaugauaauuccuaaaucguuagcaggcccgauuucgcaacacaaccaucgacccggauaucacacacaaaccgcgggcccauggcauuugggaaaauuagaauuagauuuuaauuauugugagggaacuacgguaguaauaacagagaacugcgguacuagaggaccgaguuugagaacaacuaccgugucggggaaauuaauucaugaaugguguuguaggucauguaccuuaccuccguuaagauauaugggagaagaugguuguugguauggaauggaaauacguccaaucucagaaaaagaagaaaauaugguaaaaagucuggucagugcggguuccggaaagguugauaacuucacaaugggaguauuaugcuuggcuaucuuguuugaggaaguaaugagaggaaaauucggcaagaaacauaugauugccgguguauucuucacauuuguucuacugcuuucuggacagauaacauggcgagauauggcacauacacuaauuaugauaggaaguaaugcaucugaucgaaugggaaugggaguuacauaucuagcauugauugcuacauuuaaaauucaacccuuccuugcacugggauucuuuuugagaaaguugaccaguagagagaacuuauuauuaggaguaggcuuggcaauggcgaccacauuacaauuacccgaagacaucgagcaaauggcaaacggcauugcauuaggacuaauggcgcuuaaauuaauuacacaguuugaaacuuaucaacucuggacugcgcuaauuucucucacgugcucaaauacuauauucacccuaacaguugcuuggagaacagcgacuuugauacucgcaggcguaagucuauuaccggucugccaaagcaguucuaugagaaagacugauuggcuuccaauggccguugcugcaaugggagugcccccauuaccacuguuuaucuuuaguuugaaagacacucuaaagagaagaucuuggccuuugaaugaggguguaauggcaguaggcuuggucucgauauuggcuucuuccuuacugagaaacgauguacccauggcagggccacucguggcuggaggccuuuuaauugcaugcuacguaaucacgggaacaucagccgauuuaacgguagagaaggcagcugacaucacgugggaagaagaagcagaacaaacaggugugucucacaaucuuaugauuacuguugaugaugacgguaccaugcguauaaaagacgacgaaacugaaaauauccuuacuguauuacuaaaaaccgccuuauuaauuguaucugguauauuuccguauagcauaccggccaccuugcuaguauggcauacuuggcagaagcaaacucaaaggagcgguguguuaugggauguuccgagcccuccagaaacacaaaaagcggaacuagaagaggggguguauagaaucaaacaacaagguauauucgguaaaacacaaguaggcgucggagugcaaaaggaaggugucuuucacacaauguggcacguuacaagaggagcgguauuaacuuauaaugggaaaaggcuugaaccaaacugggcaucugugaagaaagacuuaauuagcuauggugggggauggagauuauccacgcaauggcaaaaaggagaagaaguacaaguaauagcaguagaacccgggaagaauccuaagaauuuucaaacaaugccaggaacauuccaaacaacaaccggugagauaggugcgauagcacuugacuucaagccaggcacuagcggaaguccuauaaucaacagagagggaaagguaguuggacuuuacggcaauggaguggugacuaaaaacggcggguacguaucaggcauagcucaaacaaacgcggaaccagacggcccuacgccggaacuagaagaagaaauguucaagaaacggaauuuaacaauaauggaucuucaccccgggagcggaaaaacucgcaaauacuuaccagcaauaguaagggaagcuauaaaaaggaggcucagaacucugauacuagcuccuacucgaguuguugcagcagaaauggaggaggcuuugaaaggacuaccgauucgauaucagacaacugcaacaaagucggaacacacaggccgagaaauaguugaucuaaugugucacgcuacuuucacaaugagacuauuaucuccggugagaguccccaacuacaaucuuauaaucauggaugaagcucauuuuacugacccggcaagcaucgcagcaagaggcuauaucucaacaagagucgguaugggagaagccgccgcuauuuuuaugaccgcuaccccacccggcacugcagaugcauuuccacagaguaaugcgcccauucaggaugaggaacgagacauuccagaaagguccuggaacucagguaaugaauggaucacagacuucgcaggaaagacaguuugguucguaccgucaauuaaagcggguaaugacauagcaaacugcuuaagaaagaauggaaagaaaguuauacaguugucccguaaaaccuucgauacggaauaucaaaagacaaaacuuaacgauugggauuuuguagugacgacagauauaagcgagaugggcgcaaacuucaaggcugacaggguuauagacccccgaagauguuuaaaaccagugauccucacagacggcccagagaggguuauuuuggcuggucccaugccaguaacugcagcaucagcggcacaaaggagaggaagaguugguagaaacccgcaaaaagaaaaugaccaguauauauucacgggacaaccucuaaacaacgaugaagaucaugcacacuggacagaagccaagaugcuauuagacaacauaaacacgccggaagguauaauccccgcguuauuugaaccagaaagagaaaaaucugcggcaauagauggcgaauauaggcugaaaggagagucaagaaagacauuuguagaacugaugcguagaggagaucuacccguauggcuagcccauaaaguugcuagugaaggaaucaaauacacagaucgaaaaugguguuucgacggacaaaggaacaaccaaauucuugaagaaaacauggacguagaaauuuggacaaaagaaggggagaagaagaaauuacguccuagauggcuggacgcuagaaccuauucggaucccuuggcuuugaaagaauuuaaggacuucgcugcagggaggaagucaauagccuuggaucuaguaacggaaauaggaagggucccaucacaccuagcgcaucgcacucguaaugcauuagauaaccuaguaauguuacacacuucugagcauggcggcagagcauaucggcaugcgguagaagaacuacccgaaacgauggaaacacuacuuuuauuaggauugaugauacuucuaacaggcggugcaauguuguuucuaauuagcgguaaaggcauugggaaaacaaguauaggacucauaugugucauugcgagcucgggcauguuauggauggcggagauaccuuugcaauggauagcuucagcaauuguacuagaauuuuucaugauggugcuacucaucccagaaccagaaaagcagagaacaccacaggauaaccaacucgcguauguggugauagguauuuuaacacuagcagcaaucauagcagcuaaugaaaugggucugcuagaaacaacaaaacgggacuuggguaugucuaaggaaccaggcguggucucgccuacgaguuauuuagacguugauuuacacccugcgagugcauggacccuauaugcugucgccacuacuguaauaacaccaauguuaagacauacaauugaaaacagcacagcuaauguguccuuagcugccauugcgaaucaagccguagugcucaugggacuggacaagggguggccuaucucaaaaauggaccuaggcgugccacuacuugcauuagguuguuauucccaaguuaauccauuaacgcuuacagcagcgguacuccuguuaauaacacacuacgccauaauagggccaggauuacaagcgaaagcuacaagagaggcacaaaagaggacugcugcaggaauuaugaagaauccaaccguagauggaauuaugacaaucgaccucgauccggucaucuaugacucuaaauucgaaaaacaacuaggccaagugaugcuucucguucuaugugcgguucagcuccuacuaaugcgaacuucuugggcucucugugaagcucuaacgcuugccaccgguccaaucacaacacucugggaggggagcccugguaaauuuuggaacacaacaauagcuguaucaauggcuaacauauucagggggaguuaucucgcaggagcaggauuagcauuuucaauaaugaaaaguguuggaacagguaaacguggaacuggaagccagggagaaacucuaggcgaaaaauggaagaagaaauuaaaucaacuaucucgaaaagaauuugaccuauacaagaaaucuggcaucacugaaguagacaggacagaagccaaagaaggacuuaagaggggcgaaauaacucaucaugcuguaagcagaggcucugccaaauuacaaugguuuguggaaagaaauaugguaauuccagaaggccgaguaauagauuuagguugcggucguggugguuggaguuacuauugugcaggacuaaagaaagugacugaaguaaggggguauacaaaaggcggaccaggacacgaagaaccagucccuaugucaacauacggauggaacauaguuaaacuuaugaguggcaaagacgucuucuacuuaccgccugaaaaaugcgauacacuacuaugugacauaggugaaucaucaccuucccccacaguugaagaaaguagaacaauuagaguuuuaaagaugguugaaccuuggcuaaagaauaaucaauucuguauaaaaguuuuaaacccuuauaugccaacaguaauagaacaucuugaaaggcuacagagaaaacauggugguaugcuaguaagaaacccucugaguagaaacucaacgcacgaaauguauuggauaucuaaugggaccggcaauauaguagcaagugugaauaugguaaguagauuguuauuaaaccgauucacgaugacacaucgucgucccacaauugaaaaagauguagauuuaggugcaggaacuagacaugucaacgcagaaccggaaacaccaaauauggacguaauaggggaaagaauaaaaagaauuaaagaagaacauaauucgacuuggcauuaugacgacgaaaaucccuauaaaaccugggcguaccaugguucuuaugagguuaaggcgaccgguucugcaucaucaaugaucaauggaguagucaagcuccuaaccaagccuugggaugucguuccaaugguaacacaaauggcaaugacagauacaacaccuuucgggcagcagagagucuuuaaggaaaagguagacacgcgaaccccuagaaguaugccugggacaagacgugucaugggaaucacggcagaauggcuuuggcguacauugggacguaauaagaaaccacgacuauguacuagggaagaguuuacuaagaaagucagaacgaacgcagcuaugggagcaguauucacagaggagaaccaaugggacuccgcaaaagcugccguugaagaugaagauuuuuggaaauugguagacagagaaagagaauuacauaagcugggaaaguguggguccuguguguauaacaugauggguaaaagagagaagaaacuaggggaauuuggcaaagcuaagggaagcagagcuauaugguacauguggcucggugcuagauacuuagaauuugaagcacuaggguuucuuaaugaagaccacugguuuagcagagaaaacucauauucaggaguugaaggugagggucuacauaaacuagguuacauauuaagagacauuucaaaaauuccgggaggggcgauguaugcagaugauacugcagggugggacacucgcaucacagaggacgacuugcauaaugaagagaaaauaacacaacagauggaccccgaacaucgacaauuagcaaacgcaaucuuuaaacucacauaccaaaauaaaguugucaagguucaaagaccgacuccaacagggacagucauggacauaauaucucguaaagaucagcgggggaguggucaaguuggaacguacggacuuaauacauuuacaaacauggaggcacaacuaauucgacaaauggaaggagagggcguguugcucaaagcugaccuugaaaauccacacuuaccagagaagaaaauaacacaaugguuggaaacaaaaggcguagaaaggcuuaaaaggauggccaucucaggagacgacuguguaguuaagccaauagacgacagguuugcaaaugcacugcuugcacuaaacgauauggggaagguuaggaaagacauaccacaauggcaaccuucaaaaggcuggcaugauuggcaacaaguaccuuucugcucccaucauuuucaugaacucauuaugaaagacggacggaaauuggucgugccgugccgcccacaagaugaauuaauugguagggcccgaauaucccaaggggcagguuggagucuaagagagacagccugucuggguaaagccuaugcgcaaauguggucacuaauguacuuucauagacgggauuuaaggcuugcaucuaaugcaauuugcagcgcugucccuguucauuggguaccaacgucaagaacuaccuggagcauucaugcccaucaccaauggaugaccacugaagauaugcuaacgguauggaauaggguuuggaucgaagacaacccguggauggaagauagaacaccuguaacuacgugggaagacguaccauaucuggguaaaagggaagaccaauggugcgguucuuuaauaggucuaaccagucgugcgacgugggcccaaaauauacccacagcuauacaacaaguuagaaguuugauuggcaaugaagaauuucuagacuacaugccaucaaugaaacgguuucgcaaagaggaggagucggagggcgcaauaugguaa

SEQ ID NO: 23278 - RNA, 9873 nt, Artificial Sequence
  derived and/or modified CDS sequence (opt6) from DENV-3__KJ189297__SS-prME
acuucuuuaugccuuaugaugauuuugccugcagcuuuggcauuucauuugacaucacgugauggagaaccaagaaugauaguagggaaaaaugaacgugguaaaucauuguuauucaaaaccgcaagcggaaucaauauguguacauuaauagcaauggaucugggugaaaugugcgacgauacuguaaccuacaaauguccccauaucaccgaaguugaaccggaggauauagauuguugguguaauuuaacgaguacauggguaacguacgguacuugcaaucaagccggugagcauagaagagauaaacgaaguguugcgcuugcaccucauguaggaaugggucucgauacaagaacgcaaacuuggaugagcgcugagggagcuuggcgacaaguggaaaaaguugaaacaugggcucuccgacauccuggauucacuauccuagcucucuucuuggcacacuauauugguaccucacuuacucaaaaaguaguuaucuucauucuuuuaaugcuagucacaccguccaugacgaugcggugcguuggaguaggcaauagggauuuugucgaaggacuauccggugcuacuuggguugacguagucuuagaacauggagggugugucacaacuauggcuaaaaauaaaccgacauuagauaucgagcuacagaaaacugaggcaacgcaacuagcaacauuaagaaaacuguguaucgaagguaaaauaaccaauaucacaacagauagucgcuguccaacucaaggugaagcaguucugccagaggaacaagaccaaaauuacguuugcaaacacacauacguugaccguggaugggggaacggaugugggcuauuuggaaaagggucacucguuacuugugccaaauuccaaugccucgaaccaauagaggguaaagucguucaauacgaaaaccuaaaauauacggucauuauaacugugcauacuggagaccaacaucaaguagguaacgaaacacaaggagugaccgcagagauuacaccacaagcaucaaccacugaagcaacuuuaccugaauacgguacuuugggcuuagaauguucacccagaacuggucucgacuuuaaugagaugauacuucuuaccaugaaaaacaaagccuggaugguucauagacaaugguucuucgaucugccuuuaccuuggacaaguggggcaacaacggaaacuccaacauggaauaggaaagaacuucuuguaacguuuaaaaaugcacaugccaagaaacaagaagucguaguacucggcucacaagagggugccaugcacaccgcauuaacaggugcaacggagauacaaaauuccggugggacuagcauuuuugcugggcaucuaaaauguagacuaaaaauggacaaacuggaacuaaaaggcaugucuuaugcgauguguacuaacacauuuguauuaaagaaagaaguuucagaaacacaacaugguaccauuuuaauaaaaguagaguauaaaggggaagaugcgccaugcaaaauuccauuuagcacagaagauggccacgguaaagcacauaacggacguuuaaucacagccaauccagucgucacuaagaaagaggaaccuguaaacauugaagcggagccacccuucggagaaucgaauauuguuauuggaaucggcgacaacgcucucaaaauaaacugguauaaaaaggggagcucaauuggaaagauguuugaagcaacagcuagaggggccagaagaauggcuauucuuggagauaccgccugggacuucggaucggugggaggcgugcuaaacagcuuaggcaagaugguucaccaaaucuuuggaagcgcuuauaccgcacuauuuucuggaguaaguuggguuaugaaaauugggauuggagucuuacuaacuuggauaggacuaaauucuaaaaauaccucaaugucuuucaguuguauagcgaucggaauuauuacauuguaucugggagccgugguccaggcggauaugggcugugugauuaauuggaaagggaaagaacucaaaugcgguucugguauuuucguaacaaacgaaguacauacauggaccgaacaauauaaauuucaagcggacucgccuaagcgguuagccacugcgauagcaggagccugggaaaacgguguuugcggaauaaggaguacuaccagaauggaaaaccuauuauggaaacagauagccaacgaguugaauuacauucucugggagaauaauauuaaauuaacaguaguaguaggugauauuauagggguauuggaacaagguaaaagaacucuaacuccccagccuauggagcuaaaauauaguuggaaaacauggggaaaagcuaaaauagucacggcagaaacgcaaaacagcuccuuuauaauagacggucccaacacacccgaauguccaagugcaucaagagcuuggaaugugugggaaguugaagacuacggguuuggcguauuuacuacgaauauuuggcuacgacugcgagaaguauauacacagcuuugugaucaccgauuaaugucagcggcuguuaaagaugaacgagcgguucacgcggacaugggcuauuggaucgagucacagaaaaauggcagcuggaaacuagaaaaagccucauuaaucgagguaaaaaccuguacauggccaaaaagucauacguuauggaguaauggcguacuagagucggacaugauaaucccaaaauccuuggcaggccccaucucacaacauaaucauagaccaggauaucacacacaaacugcagguccauggcauuuagguaaguuagaguuagacuucaacuacugugaaggcaccaccgucguaauaacggagaauugugguacaagaggaccaagucuccggaccaccacuguaucaggaaaguuaauccacgaaugguguuguagguccuguacauugccuccauugagauacaugggagaggacgguuguugguacgguauggagauccguccaauaagugaaaaagaggaaaacauggugaagagucuagucagcgcuggcaguggaaaaguugauaacuucacaauggguguacuaugcuuagccauacucuucgaagaggugaugagggguaaauucggcaagaaacacaugauugcuggaguauucuuuacauucgugcuacugcuaaguggacagaucacuuggcgagacauggcucauacacuaaucaugauugggagcaacgcaagcgaucggaugggaaugggagugacuuaucuagcguugauugcuacuuucaaaauucagcccuucuuggcacugggauucuuucuaagaaaacuaacuucaagagaaaaucuuuuauuaggaguaggauuggcaauggcaacaacgcuacaauugccagaggacauagagcagauggccaaugguauugcccuaggacugauggcacuaaaauugauaacacaauuugagacuuaucaacuuuggaccgccuuaauaaguuuaaccuguucaaauacgauauuuacuuuaacagucgcauggagaacggccaccuuaauuuuagcuggggucaguuuauuaccuguaugucagucuucuuccaugaggaagacugauuggcucccgauggccguggcagcuaugggaguaccaccgcuaccucuauuuauauucucccuaaaggacacacugaagcgaaggucauggccccuuaacgagggggucauggcaguuggacucguguccauacuugcaagcucauuacuucgaaaugauguaccaauggcuggaccacuuguggcaggagggcuguugauugcuugcuauguaaucacuggaacuagcgcagacuuaacaguagagaaagcagcugacauuacuugggaagaggaagcggaacaaaccgggguaagucacaauuugaugauuacuguagacgacgauggaacaaugaggauaaaagaugacgagacagagaacauacuaacagugcuauuaaagacagccuuauugauagucuccggaauauuuccguauaguauccccgcaacacuacuugucuggcacacauggcaaaaacaaacacagagaagcggaguuuuaugggauguuccgucaccaccagaaacacagaaagcagaguuggaagaaggcgucuauagaauaaagcaacaagggauauucggaaaaacccagguuggcguuggcguacagaaggaaggaguuuuucauaccauguggcacguaacuagaggugccguccucacauacaauggaaagagguuagaaccuaauugggcaucugucaagaaagaccuaauuucuuacggcggaggguggcgcuuaaguacucaauggcagaagggagaagaaguacaaguaauugccguggaaccggguaaaaacccuaaaaauuuccaaacuaugccaggaacauuucagacaacaacgggagagauuggugcgauagcucucgauuucaaacccgggacaucuggaagucccauuauuaacagagaaggaaaaguaguaggauuguacggaaauggcguaguaaccaaaaacgggggcuauguaucgggaauagcucaaacgaacgcagaaccagacgguccuacccccgaacuggaagaggaaauguuuaagaaacggaaucuuacaauuauggaucuacaccccggaaguggcaaaacucguaaguaucugccugcuauaguacgagaggcaauaaaacgaagacugcguacccuuauuuuggcuccuacacgugugguagcggcugaaauggaagaggccuuaaaagguuuaccaauaagguaucaaaccacugcaacuaagucagaacauacagggagggaaauaguugaucuaaugugucaugcgacguuuacaaugcgccuucuuucaccagucagaguacccaauuacaaccuaauuauuauggaugaagcgcauuuuacggauccugcaucaauagcggcgcgaggauauauuuccacuaggguaggaaugggugaggcagcggcaaucuucaugacagcuacuccacccggaacggcagacgcguuuccucaaucaaaugcgccgauacaagaugaagaacgagacaucccagaaaggucauggaacuccggcaacgaauggaucaccgauuucgcagguaaaacgguaugguuuguucccaguauaaaagcgggaaacgacauugcaaauugucuaaggaaaaaugggaagaaaguaauucaacucucgcgaaagacauucgauacugaauaccaaaagacaaaacuaaaugacugggauuucguaguaacuacagauauuucagagaugggagcgaauuucaaagcagaccguguuauugacccaaggagaugucuaaaaccaguuauuuuaacagaugggcccgaaagaguaauacuggccgguccuaugccgguaacugcggcaucggcugcucaaaggagaggaagaguaggucgaaacccucaaaaagaaaaugaucaauauauuuucacagggcaaccccuaaauaaugacgaggaucacgcacacuggacugaggcaaaaaugcuucuagacaauauaaauacuccggaaggaaucauaccagcgcuauuugaaccagaacgagaaaaaucugcugccaucgacggcgaauaucgucugaaaggugaaucacgaaaaacuuuuguugaacuaaugcgcagaggagaucugccagucuggcuagcccauaaaguagccucggagggaauaaaauacacugaccgaaagugguguuuugacgggcaaagaaacaaucaaauccuagaagaaaacauggauguugagauuuggacuaaagagggggagaagaagaaacuaagaccaagauggcuggacgcaagaaccuauucagauccuuuagcucuuaaggaguuuaaagacuucgcagcggggagaaaaagcauugcacuugaccugguaacagagauagggcgaguccccucgcaucucgcacauagaaccaggaaugcacuagauaacuuagugauguuacauacaagugaacacggaggccgagcuuauagacaugcuguggaagaacugccggaaacuauggaaacauuauuacuccuagguuuaaugauauuauuaaccggaggagcuauguuauuucuaauaucuggaaaaggaaucgguaagacuucgauuggucuaauuugcguaauagcauccucugguauguuauggauggcugaaaucccuuuacaauggauagcaagugccaucguccuggaauuuuucaugaugguuuuauugauaccagaaccagaaaagcagagaacaccacaggacaaucaguuggcauauguuguaauuggcauauuaacucucgcagcuauaauagccgccaaugaaaugggcuuacuggaaaccacuaaaagagacuuaggaaugucgaaagaaccaggagugguaagcccaacaucuuauuuagaugucgacuugcacccagcaucggcauggacccuuuacgcaguagcuacuacaguuauuacaccaaugcuaagacacacgauugaaaacaguacagcuaacguuagucucgcugcaauagcaaaucaggcgguaguacucaugggacuagauaagggcuggccaauauccaagauggaucuaggugugccacugcuagcgcuaggaugcuacucacaaguaaacccccuaacucuaacagcggcaguguuacuccuuauaacgcauuaugcaauaauaggcccaggucuccaagccaaagccaccagagaagcacaaaagcgaaccgcagcagggauaaugaaaaauccaacaguggacgguauuaugacgauagacuuggacccaguaauuuacgacucaaaauucgaaaaacaauuagggcaaguaauguuacuuguacugugcgcgguucagcuguuacucaugaggacaucaugggcccucugcgaggcuuuaacguuagcuaccgguccaauaacuacacuuugggaagggucacccggcaaguuuuggaacacuacuauagcggugaguauggcaaauauauuuagagguucuuacuuagcaggagcaggccucgccuuuucuaucaugaaaucgguaggcacuggaaagaggggaaccggcucucaaggggaaacucuuggcgaaaaguggaagaagaaauuaaaucaacuaagccguaaagaguuugauuuguauaagaaaucugguauaacagaaguugauaggacagaagcuaaagaagggcuuaaaagaggugaaauaacgcaucacgcaguuucuagaggaucggccaaacuccagugguuuguggaacgaaauauggucauuccagaaggaagaguaauagaucuagguuguggaagaggugguuggaguuauuacugugcuggguuaaagaaggucacagaaguaagggguuacacuaaaggaggcccuggacacgaagaaccaguuccaaugucaacauaugguuggaauauaguaaagcucaugucaggcaaagaugucuucuaccuuccgccugagaaaugugauacuuuacugugugauauaggugaaucuagcccuagucccacuguugaagaaucacggacuauaagagucuuaaaaaugguugaaccaugguugaaaaauaaccaguuuugcauaaaggugcuaaaucccuacaugcccacggugaucgagcaccuagaaagauuacaaagaaagcauggagguaugcugguaagaaauccauuaucaagaaauaguacucaugagauguacuggauaagcaacgguaccggaaauauuguugccagcguaaauaugguuucuaggcuacuauuaaacagguuuacuaugacgcaccgaagacccacaaucgaaaaggaugucgacuuaggugccggaacaagacauguaaaugcggaaccggagacaccaaauauggauguaauuggugaacgaauaaaacgaauaaaggaagaacauaauuccacuuggcauuacgacgacgaaaauccguauaaaacgugggcauaccacggauccuaugaaguuaaagcgacgggguccgccagcuccaugaucaaugggguaguaaaauuauugacuaaaccaugggaugugguacccaugguaacacagauggcuaugacagauacaacgcccuuuggccaacaacgcguuuucaaggaaaaaguugauacgcguacaccccgaucuaugcccgggacccggagaguaauggggauuacugcagaaugguuauggaggacgcucggccggaacaagaaaccaagacuauguacgcgagaagaauuuacuaagaagguccgaacgaaugcagccaugggagcaguauucacugaagagaaucaaugggauucggcaaaggcagcaguagaagaugaagauuuuuggaaacuuguagaucgagagcgcgaacugcauaaauuaggaaagugcgguucauguguauacaauaugaugggaaaacgugagaagaaauuaggugaguuuggaaaggcuaaggguucacgagcuaucugguacaugugguuaggagcucguuaucuggaguucgaagccuuaggauuuuuaaaugaagaucauugguucucacgugaaaacuccuacucaggaguugaaggugaaggucuccacaaacuaggguacauauuaagggauauaucucaaaucccaggcggagcuauguacgccgaugacacagcgggcugggauacacgaauuacugaagacgaucuacauaaugaggagaaaauuacucagcagauggacccggaacauagacaauuagcgaacgcuauauuuaaacuaacuuaccagaauaaaguaguaaaaguacaaagacccacaccaacagguacagugauggauauaauuucaagaaaagaccaacguggaagcggacagguagggacuuauggccucaauacuuuuacgaacauggaagcacaacuaauaagacaaauggagggagaagggguacuaucuaaagcugaccucgaaaacccucaucuaccagagaagaaaaucacgcaauggcuagaaacaaaaggagucgaacgcuuaaaacggauggcuauaaguggagacgauugcguagucaaacccauagaugaucguuuugcaaaugcacuacuugcucuuaacgacaugggaaaaguaagaaaagacauaccacaguggcaaccuucaaaaggauggcacgacuggcaacaaguaccauuuuguucucaucauuuucaugaauuaauaaugaaagacggacgaaagcuagugguuccuugucgcccacaagaugagcuaauugguagagcccgcauaagucaaggggcugguuggucauuaagagagaccgcuugcuuagggaaagccuacgcacaaauguggucauuaauguacuuucauagaagggaccuucgauuggccucaaacgcuauauguagcgcugucccaguccauugggugccgacuucgagaacaacguggucuauacaugcucaucaucaauggaugacaacagaggauaugcuaacgguguggaaccgcguauggauagaggacaacccauggauggaagacaaaacacccgucacuacgugggaagaugucccauaucuuggcaaacgagaagaucaaugguguggaucgcugauaggauuaacaucaagagcaacaugggcacaaaauauaccaacggcaauacagcaagugagaucauuaauuggaaaugaggaauuuuuagauuauaugccgucuaugaaaagauucagaaaagaagaagagucagaaggugcgaucugguga

SEQ ID NO: 23279 - RNA, 9873 nt, Artificial Sequence
  derived and/or modified CDS sequence (opt6) from DENV-3__KJ189298__SS-prME
acuucguuaugcuuaaugaugauacugccugcagcguuagccuuucacuugacaagccgugauggagaaccacgaaugauuguugguaaaaaugaacguggaaaaaguuuacuuuucaaaacagcaagcgguauuaacaugugcacauuaauagcuauggacuuaggugaaaugugugaugacacugugacuuauaaaugcccgcacauuacagaaguggaaccagaagacauugauuguugguguaacuuaacaagcaccuggguaacauauggaacuugcaaucaagcgggagaacacaggcgggauaaaaggaguguugcauuagcuccucacguagguauggguuuagauacaaggacgcaaacauggauguccgcugagggagcguggaggcaaguagaaaaaguggaaaccugggcacuuagacacccagguuucacaauuuuggcguuauuuuuagcgcauuauauagguacuucacuuacgcaaaaaguuguuaucuuuauucugcuaaugcuuguuacaccaucuaugacuaugagauguguuggaguagggaauagagacuuugucgaaggacuaucaggugcuacuuggguagacguagugcuagaacaugggggaugcgugaccaccauggcuaaaaauaaaccuacccuagacauugaacuucagaaaacagaagcuacucaauuagcaacuuuacguaagcuauguaucgaaggaaaaauaacaaauauuacaaccgauucacguugcccuacucaaggagaggcgguacuaccagaagaacaagaucaaaauuauguguguaaacacacauacguagauagaggauggggaaauggauguggcuuauuugguaaaggaucuuugguuacgugugcuaaguuccaauguuuagagccaauagaagguaagguuguacaauaugaaaacuugaaauauacgguuauaauuacgguccauacuggcgaucaacaucaaguugguaacgaaacgcaaggagucacagcugagauuaccccacaagcaaguacaacagaagcgacacuaccugaguacgguacucuugguuuggaguguucaccgcguacgggcuuagacuuuaacgaaaugauucuauuaacgaugaaaaacaaggcauggauggugcauagacaaugguucuuugauuuaccauuacccuggacaagcggugcaacgacggaaacuccaacauggaaucgaaaagagcuauuaguaacuuuuaaaaaugcccacgcgaaaaagcaagaaguuguggucuuagguucacaagaaggugcgaugcauacagcguugacgggagcaacggaaauacaaaauucaggaggcacgucuauauuugccggucauuugaaaugucgccuaaaaauggacaaacuagaguugaagggaaugucguacgcuauguguaccaacacuuuugugcuaaagaaagaaguaucagaaacacaacauggcacaauauugauaaaaguagaauauaaaggagaggacgcaccaugcaaaaucccauuuucuacugaagacggucaugguaaagcgcacaauggcagauuaaucaccgcaaacccggucgucaccaagaaagaagaacccguuaauauagaagcugagccaccuuuuggagaaucaaacauuguuauagguauaggagauaacgcgcuaaagauaaacugguacaagaaaggaucaucuaucggcaaaauguuugaagccacugcgcggggcgcacgacgcauggccauucuaggugauaccgcaugggauuuuggaagcgucggaggcgugcuaaauagcuuaggaaaaaugguccaccaaaucuucggaucagcauauacugcgcuauuuucaggaguuucauggguaaugaagauaggaauaggaguuuuauuaacauggauagggcuuaauaguaaaaauacuagcaugaguuuuagcugcauagccauaggaauuauuacgcuguaucugggugcgguaguucaggcagauauggguugcguaaucaacuggaaaggcaaagaauugaaauguggaaguggcauauuuguaacuaacgagguccacacuuggacugaacaguauaaauuucaagcugauagcccgaaaaggcucgcaacugcaaucgccggagcaugggaaaauggaguuuguggcauacgaucaacuacacgaauggaaaaucuacucuggaagcagauugcaaacgaguuaaacuauauuuuaugggaaaauaacauuaaacuaacuguaguuguaggcgacauaaucggaguauuggaacaagguaaaagaacgcuaacuccacaacccauggaacugaaguauucauggaagacuuggggaaaggcgaaaauugucaccgcggaaacacaaaauagcucguuuauaauugacggccccaauacacccgagugcccaagcgcgucgcgggcauggaacguaugggagguagaagacuauggauuugguguguuuacaacaaauauauggcuaagacuuagagaaguauacacacaacugugcgaucaucggcuaaugagcgcugcagugaaggaugaacgagcuguucaugcugauaugggauauuggauugaaagccagaaaaauggcaguuggaaauuagagaaagccagcuugauagagguuaaaacauguacuuggccaaaaagucauacuuuauggaguaaugguguacuggagagugacaugaucauaccaaagaguuuagcugggccaauaagucagcacaaucacagaccuggauaccacacacaaacugcaggccccuggcaccuagguaaacuagagcuagacuucaacuauugugaagguacuacaguaguaauaacagaaaacuguggaacgagaggacccucauuacguacaacuacaguaucuggcaaacuuauucacgaaugguguugucguagcuguacauuaccuccuuuaagguauaugggagaggaugguuguugguacggaauggagaucagaccuauaagugagaaagaagaaaacaugguaaagucguuaguaucggccgggaguggcaagguggacaacuucacaauggggguacuaugccuugcaauauuauuugaagaagucaugcgaggcaaauucggcaagaaacauaugaucgcugggguauucuuuacguuuguucuacuccuuucggggcaaauuacauggcgaaauauggcucacaccuuaaucaugauuggaaguaaugcaucugaccggaugggaauggggguaacuuauuuggcuuuaauugcaaccuuuaaaauacaaccauuucuugcacucggguucuuucuaagaaaauugacgagucgagaaaacuuauuacuagggguugguuuagcuauggcaaccacuuugcaacugccugaagacauugagcaaauggccaaugguaucgcucuuggccuaauggcuuuaaaacuaauaacacaguuugaaacauaucaauuauggacugcgcuaauaagucuaacauguagcaacacaauauuuacccuaacaguagcuuggagaacugcaacacuuauauuagcgggcgucagcuuacuacccgugugccaaagcaguagcaugcgaaaaacugauuggcuaccuauggccguagcugcgaugggaguaccuccauuaccccuuuuuauauuuucauugaaagauacguugaagagacgaucauggccucugaaugaggguguaauggccguuggauuaguaaguauacuagcuucgucgcuccuacgcaacgaugugccaauggcagguccauuaguagcugguggccucuugaucgccuguuacgucauaacggguacuucagcagacuuaacgguugagaaagccgcagauauaacaugggaggaggaggcagaacaaacuggcguuagucacaauuuaaugauuacaguagacgacgacgggaccaugcggauaaaagaugaugaaacagaaaauaucuuaacaguacuccuaaaaacggcacuuuuaauaguuuccgguauauuuccuuacucuaucccagcaacacuauuaguauggcauacuuggcaaaaacagacucaacguucuggaguauuaugggauguuccaucaccucccgaaacccagaaagcagagcuagaagagggcguauaucggaucaaacaacaaggcauauucggcaagacucaaguaggagucggaguacaaaaagagggaguauuccauacuauguggcacguaaccaggggugccgucuugacuuauaaugggaaacgccuagaaccaaauugggccaguguaaagaaagaccuuauuagcuacggcgguggauggcgauuaucaacucaauggcaaaaaggagaagaaguacaaguuauagcuguugaaccugggaaaaauccuaagaacuuccaaaccaugccagggacauuucaaacgaccaccggcgaaauuggugcaauugccuuagauuucaagcccggaaccucggguaguccaaucauuaaucgagaaggaaaggucguaggauuauauggcaauggaguaguaaccaaaaauggaggcuauguaagugguauugcacagacuaacgcugagccagacggaccgacacccgaacuggaagaagaaauguuuaagaaacgaaaucuuacaauaauggauuuacaccccgguaguggcaaaacucguaaauaccuaccugcaaucguaagagaagcuauuaaaagaagguuacgaacguugauauuagcaccaacccguguaguagccgcggaaauggaggaagcccuaaagggauuaccaaucagguaccaaacaacagcuacaaaaagcgaacauacagggagagagauaguagacuuaaugugucaugcaacguucaccaugagauuauugucacccguccgcgucccaaauuauaaucugauuauaauggaugaggcgcacuucacagauccugccaguauugccgcacgaggguacauuuccacuaggguagguaugggggaagccgcagcaaucuucaugacugcaacgccaccagguacagcagaugccuucccacagaguaaugcaccaauacaggacgaggagcgagauauuccagaaaggucauggaacucgggcaaugaauggauaacagacuuugccgguaagacgguuugguucgucccuucgauaaaagcagggaaugauaucgcaaacugucuucgaaagaauggcaaaaagguuauucaacuuagcaggaaaacguuugacacagaguaucaaaagacuaaacucaaugauugggauuuuguuguaacaaccgacaucagugaaaugggugccaauuuuaaagcagacagagugauagacccucgaaggugccuuaagccugugauacuaacugacggacccgagaggguuauauuagccggaccuaugccaguaacugcugcuucagcggcgcaaaggcgaggaagagugggccguaauccgcaaaaagaaaacgaucaguauauauuuacgggucagccacuaaauaaugacgaggaucaugcucacuggaccgaagccaagaugcuacuagacaauauuaauaccccagaaggaauuauuccagcauuguuugaaccggaacgagaaaaaucugccgcuauugacggggaauacagguuaaaaggagaaucaagaaaaacuuuuguagaacugaugagaagaggugauuuaccagugugguuggcccauaagguugcgucagaagggaucaaguauacugauagaaaauggugcuuugauggucaacgaaauaaccaaauacucgaagagaauauggacguagaaauauggacgaaagaaggcgagaagaagaaacuaagaccuagaugguuagaugcucgaacauauagcgacccucuagcacuaaaagaguuuaaagacuucgcugcaggaagaaaaucuauagcuuuggaucuggugacagagauagggagggugccuucacauuuagcucacaggacacgaaaugcacuagacaauuuagucaugcuccauacauccgagcauggaggcagagcuuaccgucaugcaguugaagaauuaccugaaacuauggaaaccuugcuuuugcuaggauugaugauccuacuaacugggggagcuauguuauuucugauuagcggaaaagggauaggcaaaacaaguauaggguuaauaugcguaauagcuucaucugggaugcuauggauggccgaaauucccuuacaauggauagcuucugccauaguacuugaguucuuuaugauggucuuguuaauaccugaaccugaaaaacaaaggacaccccaagacaaucaauuagcuuauguaguuauuggaauacucacauuggcugcgaucauagcagcaaacgaaauggguuugcuugaaacaacaaaacgagacuuaggaaugucaaaagaaccaggaguaguaagcccaacuucguauuuggacguagauuuacacccggcuuccgcuuggacacuauacgcaguagcuacaaccguuauaacacccaugcuaagacauacaauagaaaacucaacagcgaacguaucacucgcagcaauagcaaaucaagccgucguacucaugggacuugauaaagguuggccaauaaguaaaauggauuuaggugugccguuguuagcauuaggcuguuauucacaaguaaauccuuuaacucuuacagccgcagugcuucuacuuauuacacauuaugcuauuauuggaccaggccuccaggccaaagcaacucgggaggcccagaaaagaacugcagccggaauaaugaaaaaccccacaguagacggcauuaugacaauagaucuagauccaguaauauacgacaguaaauuugaaaaacaauugggccaaguaauguuguuagugcugugcgcgguccaacugcucuuaaugagaacaaguugggcacuaugcgaagcucuuacguuagccacagguccuaucacgacgcuuugggaaggaaguccgggcaaauucuggaauacaaccauugcaguaaguauggcaaacauuuuucgaggaaguuauuuagcuggagcgggacuagcguuuucgauuaugaaaucagugggaaccggaaaacgaggaacggggagucaaggcgaaacucuaggugaaaaauggaaaaagaaacuuaaccagcuaagccgcaaagaguuugacuuguacaagaaaagcggaauaacagaaguggauagaaccgaggcgaaagaaggucuuaaaagaggggaaauuacucaccacgcuguaagcagagguagugcaaaacuacaaugguuuguggaacguaacauggucauaccugaagggagaguaauagaucucggcugugggcgagguggauggaguuacuauugcgccggacuaaagaaagucaccgaaguuagaggcuacacaaaaggcggcccgggucacgaagaaccgguuccuaugucuacauaugguuggaauauaguaaaguuaauguccgggaaagacguguucuaucuuccaccagaaaagugugacacauuacuaugugauaucggugaaagcuccccaagcccgacaguggaagaaaguaggacuauacgagugcuuaaaaugguugagccauggcuuaagaauaaucaauucugcauuaagguacuaaauccauacaugcccacuguuauugaacaucuagaaagauuacaacgaaagcauggaggaaugcuaguacgaaauccauuauccagaaacucuacgcacgagauguauuggauaucaaacggaacagguaauauuguugcaagcguuaauauggucaguagacugcugcugaaucgcuucacaaugacucaucguaggccaacaaucgaaaaagauguagaccuaggugcgggaaccagacauguuaaugcagaaccugagacgccuaauauggacgucauuggagaacgcauaaaaagaauuaaagaagaacauaauucuacauggcauuaugaugaagaaaacccuuacaaaacaugggccuaucacggaucuuaugagguuaaagcuaccgggagugcguccaguaugauuaauggcguuguuaaacuucuuacaaaaccaugggaugucguuccgaugguaacucagauggcaaugaccgauacaacuccauuuggucaacaacgcguuuuuaaagaaaaagucgauaccagaacuccgagauccaugccuggaacacgaagaguuaugggaaucacagccgaaugguuauggcgaacccuuggcaggaauaagaaaccucgccuuuguacuagagaggaauuuacgaagaaagucagaacuaaugcugcaaugggugcagucuucacagaagaaaaucaaugggauucagccaaagcagcggucgaggaugaagacuuuuggaaauuaguagauagagaacgcgaauuacauaaacuggguaaaugcgggagcuguguauacaacaugaugggaaagcgagaaaagaaguugggggaguucggaaaggcuaaggguagcagagcaauaugguauauguggcuuggcgcacgguaucuggaauuugaagcacugggcuuucuaaacgaagaucacugguuuucaagagaaaauucauauucgggagucgaaggagaagguuuacauaaauuaggauauauauuacgggacauuucuaaaauuccagggggugcaauguaugcggaugauaccgccgggugggauaccagaaucacggaggacgaucugcauaaugaagagaaaauaacccaacaaauggauccagaacauagacaacuagcgaacgcgauuuuuaaacucacguaccaaaacaaagucguuaaaguacaaagaccuacuccaaccgguacaguuauggauauuaucagcaggaaggaccaaagggguaguggccaagucggaacauacggauugaauacuuucacaaacauggaagcccaguuaauucgucaaauggagggagaaggcguguugucgaaagcagaccuggagaauccccaccuacccgagaagaaaauaacacaaugguuagaaacuaaagguguagagcgguuaaagcgcauggcaauuaguggagacgacuguguaguaaaaccaauugaugaucgauuugccaaugcacuucuugcguugaaugacaugggaaaaguucgcaaagacaucccucaguggcaaccaucaaaaggauggcaugauuggcaacaaguuccuuuuugcucacaccacuuccaugaguugauaaugaaagauggcagaaagcuagucguuccuugccgaccccaagacgaauugauuggcagagcacgcauaucacaaggagcugguugguccuuacgagaaaccgcuugucuaggaaaggccuaugcacaaaugugguccuugauguauuuccacagaagggaucuuagacuugcuaguaaugcuauuugcucugcaguuccaguacauugggugcccacgucucggacuacauggaguauucacgcucaccaucaauggaugacaacagaagauauguuaaccguguggaauaggguauggauagaggacaauccauggauggaagauaagacuccaguuacuaccugggaagaugugcccuaccuagguaaacgcgaagaucaauggugugguaguuugauaggauugacaucaagagcaacaugggcacaaaacauaccgacagccauacaacaaguuaggaguuugauuggaaaugaagaauuucuagacuacaugccaucaaugaaaagauuucgcaaggaggaggaaucagaaggagccauaugguaa

SEQ ID NO: 23280 - RNA, 9873 nt, Artificial Sequence
  derived and/or modified CDS sequence (opt6) from DENV-3__KJ189301__SS-prME
acgucauuguguuuaaugaugauccuuccagccgcauuagcauuccacuugacgagucgagacggggagccacgaaugauaguagggaaaaacgaaagagggaaaucauuauuauuuaaaacagcuucuggaacaaacaugugcacuuugaucgcaauggaucuaggagaaaugugugacgauacgguaacauauaaauguccacauauaacugaaguggaaccagaggacauugacuguugguguaaccuaacuucuacuuggguuacauacggaacauguaaucaagccggugagcaucggagagauaaaagaagcguagccuuggcaccucacguugguaugggauuagauacccggacccaaacuuggaugagugcagagggugcauggagacaaguagaaaaaguugaaacgugggcacuuagacauccaggauuuacaauuuuggcucuauuucuugcucacuauauugguacauccuugacacaaaaagugguaauuuuuauccuuuuaaugcuuguuaccccuuccaugacaaugcgaugugugggaguuggaaacagagacuuuguagagggacuuucaggagcaaccuggguagacguuguauuagaacacgguggaugcguaacuacaauggcgaaaaauaaaccgacuuuggacauugagcuacagaaaacagaagcgacacaacuagcuacauuacgaaaauuauguauagaaggaaaaauaacaaauauaacgacugauuccagaugcccgacucaaggggaagcaguacuaccugaagaacaagaccaaaauuacguuugcaaacauacuuauguagaccgaggguggggaaacgggugugggcuauuugggaaaggcucacuuguuaccugcgcgaaauuucaaugucuugaaccaauugaaggcaaaguagugcaguacgaaaaucucaaauauacuguaauaauuacuguacauacaggcgaucaacaccaaguagggaaugagacccagggaguuacagccgaaauaacgccccaagccucuacaacagaagccacauugcccgaauaugggacccuuggauuagaauguuccccaagaacaggacucgacuuuaacgaaaugaucuuacuaacuaugaaaaauaaagcguggaugguacacagacaaugguucuuugaccugccccuaccauggacuuccggggccacaacagagacaccuacauggaauaggaaagaacuauuaguaacauucaaaaaugcacaugcuaagaaacaagagguggucguuuuggguagucaagaaggcgcuaugcauaccgcgcugaccggagccaccgagauucaaaacagcggaggaaccuccauauucgcaggacaccugaaaugcaggcuuaaaauggacaaacuugaacuuaaaggaauguccuacgccauguguacaaauacguucguguugaagaaagaaguaucugagacccaacauggaacaauacugauaaaagucgaauauaaaggagaagaugccccauguaagauaccauuuagcacugaagauggucauggaaaagcgcauaaugguagacugaucacugcaaaucccguaguuacuaagaaagaagaaccaguuaacauugaggcagaaccuccuuuuggggagucuaauauagugauaggcauaggagacaaugccuugaaaaucaacugguauaaaaagggcucgaguauagggaaaauguuugaagcaacagcaagaggggcacgucguauggcaauauugggugauacugcaugggauuuugguucgguuggugguguacuaaauucauuaggaaaaaugguacaucaaaucuucggaagcgcuuacacggcguuauuuagcgggguuucgugggugaugaagauagguauaggaguauuacuuacuuggauaggccuaaacagcaaaaauacaagcaugucuuuuagcugcauagcaaucggaauuauaacguuauauuuaggggcgguuguacaagccgauaugggaugcgugaucaauuggaagggcaaagaguuaaaguguggaagcgggauauuuguaacaaaugaagugcauacauggacugaacaauacaaauuccaagcggauucaccaaaacgacucgcaacugcaauagcuggagcuugggaaaacggggucugcggaauaaggucaacuacuagaauggaaaauuuacuauggaaacagauugcaaaugaguuaaauuauauacuuugggaaaauaauguaaaacucacagucguagucggggauauuauaggaguucuugaaaggggcaaacgaacacucacgccgcagccuauggaguuaaaguauucauggaaaacguggggcaaagcaaaaauaguuacagcagaaacacaaaacuccucauuuauaaucgacgggccgaauacccccgaauguccauccgcaucucgagcguggaacguaugggaaguagaagauuauggguuuggugucuucacgacaaacaucuggcugcgucuaagagaggcauacacgcaacuaugugaucauagacuaaugagugcagcaguuaaggacgaacgugcugugcaugcggauauggguuacuggauugagagucagaaaaauggauccuggaaauuagaaaaggccagccucauugaaguaaagacuuguacguggccaaaaucacauacacuaugguccaacggcguccucgaaucagacaugauaauaccaaaaucuuuagcaggcccuauaucgcaacauaaccauagaccugguuaccacacgcagaccgccgguccguggcaucuaggaaaacuugaauuggauuuuaacuauugugaaggaacuacaguugugaucacggagaauugcggaacaagaggcccaaguuuacgaacaacuacagucucaggaaaacuaauacaugaaugguguuguagaagcugcacacuuccaccucugagauauaugggugaagacgguuguugguaugguauggaaauacggccuauaagugaaaaagaggaaaacaugguuaaaucacucguguccgcuggcucagggaaaguugacaauuuuacaaugggcguccuguguuuagcuauacuguucgaagaaguuaugcgugguaaauucggcaagaaacacaugauagcagggguauucuuuacuuuuguuuugcuacucuccggacaaauaacauggcgagauauggcucacacacuaaucaugauagguucaaacgcuagugauagaaugggaauggggguaacguaccuugcauuaauugcgacguucaaaauacaaccauuucuagcgcuaggauucuuucuaaggaaauugacaucccgagaaaaucugcugcucggaguggggcuagcaauggcuacaacacuacaacucccagaagacauugagcaaauggcuaacgguaucgcucuaggcuuaauggcgcucaaauuaauaacacaguuugagacauaucagcuuuggaccgcucucaucucucucacuugcagcaauacaauauuuacucugacaguugcauggcgaaccgcaacuuuaauccucgcaggcguuucucuguugccagugugucaaucuucgaguaugaggaaaacagauuggcugccaauggcaguagcagccauggggguaccgccacucccacuuuucaucuucagccucaaagauacauuaaagagacgaucuuggccacuaaacgagggagucauggcuguuggccuaguuaguauucuugcauccagucuacuuagaaaugacgucccuauggcggggccucucgucgcaggcggcuugcuaauugccugcuauguaauuaccggaacaagugcugaccuaacgguagaaaaagcagcagauauuacgugggaagaagaagcugaacaaacgggaguuagucauaauuuaaugauaacuguagaugaugauggaacuaugcggauuaaagaugacgaaaccgaaaauauacuaaccgugcuacuaaagacugcacuauuaauugucuccgggauuuucccguacucgaucccagcaacauuguuagucuggcacacguggcaaaaacaaacccaaaggucaggagucuugugggauguaccaagcccaccggaaacucagaaagcggagcucgaagaaggaguguauagaaucaaacaacagggcauauucgggaaaacucaaguugguguggguguucaaaaggaaggaguuuuccauacaauguggcacguuacaagaggcgcuguauuaacuuauaauggcaaaagacuggagccaaauugggccagugucaagaaagacuuaauaaguuacggagggggauggcgacucagcacgcaauggcaaaaaggagaagaaguacaagugauagcaguagaaccaggcaaaaauccuaaaaauuuucaaacaaugccaggaacauuccaaacgacaacgggagagauuggagcgauugcauuagauuuuaaaccgggaacaucaggaucaccaauaaucaaucgugagggcaaaguaguuggauuauacggaaacggcguagucaccaaaaaugggggauauguuuccggaauugcccagacuaacgccgaaccugaugggccaacaccagaauuagaagaagaaauguuuaagaaacggaacuuaacaauuauggacuugcaucccggcucagguaaaaccaggaaauacuuaccagccauagucagagaggcgauaaaaagaagguugaggacucuaauccuagcuccaacccggguaguugcagcagaaauggaagaggcacuaaagggauugccgauaagguaucaaaccacugcgacgaagucugaacauaccgggagagaaaucguugacuuaaugugucacgcaacauuuacaaugcgauugcuaucaccggucagaguaccaaauuauaauuugauaauuauggaugaagcccacuuuacagauccggcuuccauugcagccagaggauauaucagcacucgaguuggaaugggggaagcagcagcuauuuuuaugacugcuaccccuccagguaccgcagaugcauuuccucaauccaacgcuccaauacaggaugaagaaagggauauuccagaaagauccuggaacucgggcaaugaauggaucacagauuucgcaggaaaaacaguaugguuugugccaaguaucaaagcugggaacgauauugccaacugcuugcgcaagaaugggaagaaaguuauucaauuaaguaggaaaacuuucgauacugaauaccagaaaacaaaauuaaaugacugggauuuuguaguaaccacggauauaucggaaaugggcgcuaauuuuaaagcagacagggucauagacccccggagguguuuaaaacccguaauacuaacugaugguccagagagggucauacuggcaggaccaaugccgguaacagcagcuucagcugcgcagcgacgagguagaguagguagaaauccacaaaaagagaacgaccaauacauauucacaggacaaccgcuuaauaaugaugaagaucacgcacauuggacugaagcaaagaugcuguuagacaauauuaauacacccgaaggcauaauucccgcuuuauuugagcccgaacgugaaaaaucagcagcaauagauggagaauacagauuaaaaggcgagucucggaaaacguuuguugagcugaugcgaagaggagaucucccgguauggcuugcacauaagguugcaagugaaggcauaaaauacacugauagaaaguggugcuucgauggacaaagaaauaaucaaauauuagaagagaacauggauguugaaaucuggacuaaggaaggagagaaaaagaaauugaggccucgcuggcuagaugcuagaacuuauucggauccacuggcacugaaagaauuuaaagauuucgcagccgguaggaaaucuauagcacuggaccuaguaaccgaaauagggagagugccuucucaccucgcccauagaacacggaaugcacuagauaauuuagucaugcuucacacaagugaacacggcggccgcgcauacagacacgcaguugaagaauuaccggaaaccauggaaacgcuacuacuguugggccuaaugauauugcuaacgggaggugcaaugcuguuucugaucagcggaaaagguauagguaaaacaucaauaggguugauaugugugauagcaucguccggaaugcuuuggauggcugaaauaccauuacaguggauagcuagugccauaguguuggaauuuuucaugaugguccucuuaguuccggaaccagaaaaacaaaggacaccccaagauaaccaacucgcuuaugucgucauuggcauccuaacauuagcugccauaauagcugcuaaugaaauggguuuacucgagacuaccaagcgcgauuuaggaaugucaaaggaacccggagucgucaguccaacaucuuacuuagauguugaucuacauccagcguccgcuuggacacucuaugcgguagcaaccacggucauuacaccaaugcugcgacauacuauagaaaauaguacagcgaaugugaguuuggcggccaucgccaaucaggcuguaguucuuaugggccuagauaagggauggccuauaucaaagauggaccuagggguuccauuacuggcuuuaggcugcuauucucaggucaaucccuuaacacugaccgcugcaguuuuacuacuuauaacacacuacgcgauaauuggcccuggccuucaagcgaaggcuacaagagaggcgcagaaaaggacugcagcgggaaucaugaagaauccgacuguugaugggauaaugaccauagacuuagacccaguuauauaugacagcaaauucgaaaaacaauugggccaaguuaugcuacuugugcuuugcgccguacaauuauugcuaaugagaacgucgugggcccuaugugaagcguuaacgcuagccacugguccgauaacaacacuaugggaagguucgccaggcaaguuuuggaacacuacaaucgcaguaucaauggcaaacauuuucagaggaucguaccuagcuggcgcuggacuagcauuuaguauaaugaaaucuguagggacgggaaaacgaggaacagggagucaaggagaaacguuaggcgaaaaauggaagaagaaacugaaccagcucucgcguaaagaauuugauuuauauaagaaaucuggcauaaccgaaguugaucgaacugaagcuaaagaagggcuaaagagaggugaaauuacgcaucaugccguuagccgaggaagugcuaaauuacaaugguuuguagaacgcaacaugguaauccccgaaggacgaguuauagauuuagguugcggaagaggagguuggaguuauuauugugcuggacuaaagaaaguuaccgagguucggggauacaccaaaggaggaccaggucacgaagaaccaguaccaauguccacuuauggcuggaacauuguuaagcugauguccgguaaggauguauuuuauuuaccaccagagaaaugcgacacuuuguuaugugacauaggugaaaguagcccuucgccuacaguggaggaaaguaggacaauaaggguauuaaaaaugguagagccuuggcuuaagaauaaucaauuuugcaucaaaguacuaaauccauacaugccaacagucaucgaacaucuugagagguuacaacgaaaacauggggguauguuaguuaggaacccgcucagccgaaauucuacgcacgaaauguauuggauaucaaauggaacaggcaauauuguagccaguguaaauaugguaucccgauuacuauuaaauagauucacuaugacacauagacggcccaccaucgaaaaagauguagaucuaggagccggaacccgucacguaaaugcggaaccagaaacgccaaauauggacguaauaggugaaagaauaaaacgaauaaaagaagaacacaauucuacuuggcauuaugaugaugagaauccauauaaaacgugggcguaucacggaagcuaugagguaaaagccacugggagugcuuccagcaugauuaacggcguuguaaaacuauuaacaaagcccugggacguggucccuauggugacccaaauggcgaugacugauacaacaccuuucggucagcaacgagucuucaaagaaaaaguugacacgcgaacgccgagaagcaugccaggcacaagacggguaaugggaauaaccgccgaauggcucuggagaacauuaggaagaaacaagaaaccacgucuuuguacgagagaagaauuuacaaagaaagugcgaacaaaugcggcaaugggggccguauuuacugaagaaaaccagugggauagcgcuaaggcagcaguagaagacgaggacuuuuggaagcuaguugacagagaacgggagcuacauaaacucgguaaauguggaagcugcguuuauaauaugaugggaaaaagagaaaagaaacuaggggaguucgguaaagcaaaaggcuccagggcaauuugguauaugugguuaggggcccgauaccuagaauuugaggcucuaggcuuuuugaacgaagaccacugguucuccagagagaacucguauagcggcgucgaaggugagggcuugcauaaacuaggauauauauuacgagauaucuccaaaaucccugguggggccauguaugcugacgacaccgcuggcugggauacgcgaauuacggaagacgauuuacacaacgaagaaaagaucacgcaacagauggaccccgagcaucggcaguuagccaacgcaauauuuaaguugacguaucagaauaaaguagugaaaguucaacggccgacaccuacagguacgguaauggacauuauaucccguaaggaucaacgcgggagcggacaggucggaacauauggucuaaauacguuuacaaauauggaggcucaacuuauacgacaaauggaaggagaaggaguccuaucaaaagcggaucuagaaaacccucaucuucccgagaagaaaaucacgcaaugguuagagacuaaaggugucgaaagguuaaagcgaauggccauuucaggagacgacugcguaguaaagccaaucgacgacagguuugccaacgcuuuauuagccuuaaaugauaugggaaaaguccgaaaagauaucccgcaauggcagccuagcaaaggauggcacgacuggcaacaaguuccauuuugcagucaucacuuccacgaacucaucaugaaagacggucgaaaguuagucguaccuugcaggccgcaagacgaacuaauagguagagcuagaauuagucaaggggcugguuggagccugagagaaacagcgugucucgggaaagcauaugcacaaauguggaguuuaauguauuuucauagaagagauuuacgauuagcaucuaacgcaauuuguucugcaguaccaguucacugggugccaaccucgaggacuacuuggucaauacaugcacaccaucaauggaugacaacagaagauaugcuuacaguauggaauagaguauggauugaagauaacccuuggauggaagauaaaacaccaguaacuaccugggaagacguccccuacuuggguaaacgcgaagaucaauggugugguagucucaucggcuugacaucucgagcaacaugggcgcaaaauaucccaacagcaauacaacaaguccguuccuuaauaggcaacgaggaguuccuggacuacaugccaucaaugaaaagguucagaaaggaggaagagucugagggggcaaucugguag

SEQ ID NO: 23281 - RNA, 9873 nt, Artificial Sequence
  derived and/or modified CDS sequence (opt6) from DENV-3__KF955456__SS-prME
acgagcuuaugccuuaugaugauccucccagcagcacuagcauuucaccuaacaucucgggacggggaaccuaggaugauagucggcaaaaaugaacggggcaaaucacugcuauuuaaaacagcaaguggaauuaauaugugcacacuaauagcuauggaccuaggcgaaaugugcgaugauaccgugaccuacaaaugcccucauaucgcagaaguugaaccagaggauauagacugcuggugcaacuuaacuucuacaugggucacauacggaacuugcaaucaagcgggcgaacauaggcgugauaaacggagugucgcacuugcuccccauguugggaugggguuagauacaagaacacaaacguggaugagugcagaaggcgcauggcgacaaguggaaaaaguugaaacuugggcacuacgccacccaggcuucacaauauuagcucuguucuuagcacauuauaucgguaccagucucacacaaaaaguaguaauuuuuguccucuugauguuaguaacaccgucaaugaccaugcguugcguuggaguugggaaucgagauuuuguagaagguuuaagcggagcaacauggguagauguuguacuagaacacgggggaugugucacgaccauggccaaaaacaaaccgacacucgacauugagcuccagaaaaccgaggcuacgcaauuggcuacucuacguaaauuaugcaucgaaggaaaaauaacgaauaucacuacagacaguagaugcccaacucagggagaagcagugcugccugaagaacaagaccaaaacuacguguguaagcacacauacguugacagaggauggggaaacggguguggguuauucggaaaaggcucucuaguaacgugugcaaaauuucaaugucuagagcccauagaaggcaagguuguacaauacgaaaaucuaaaguacacuguaauuauaacagugcauacuggagaucaacaccaagucgggaaugaaacgcaaggaguaacagcggaaauaaccccucaggcaagcacaacagaggcaauacuaccggaauauggcacacuagguuuagaaugcagcccacguacuggacuagauuuuaacgaaaugaucuuguugacaaugaaaaauaaagcguggaugguccauagacaaugguucuuugaccuucccuugccuuggacgagcggagcaacgacggagacuccuacuuggaacagaaaagaacuucucguaacauucaaaaacgcacacgcuaaaaagcaagaaguaguaguuuuggggucacaagaaggcgcgaugcacacugcacuaacaggcgcaacagaaauccaaaauagcggcggaacuucaauauucgcaggccaccucaaguguagguuaaaaauggauaaauuagaacuaaaagggaugucauaugcuauguguacaaacacauuuguuuugaagaaagaaguauccgaaacucaacauggaacaauucugauuaaaguggaauauaaaggcgaagaugcaccaugcaaaauaccguuuagcacggaggaugggcaggguaaggcacacaacggacgucuuauaacugcaaauccugucgucacuaagaaagaagaaccaguaaauaucgaagcagaaccaccauuuggcgaaucaaauauagugauaggaauaggugacaaugcgcuuaaaaucaacugguacaagaaagggucgagcauagguaaaauguucgaagcuaccgcacgaggagcgagacguauggcaaucuugggugauacggcgugggauuuuggcagcguuggugguguacucaauaguuugggcaagaugguacaucagauuuuuggaagugcguacacugcauuauucucaggcguaucaugggugaugaaaauagguaucggaguguuguugacauggaucggccucaacucuaaaaacacaaguaugucauuuucaugcauagccaucggcauaauuacucuguauuuaggagccguaguucaagcugacaccgguugugugauaaauuggaaaggaaaagaacuaaaaugcggcucugguauauuugucacuaaugaaguccacacauggacugagcaauacaaauuucaagcggacucgccaaaacgucuggcgacagcuaucgccggugcuugggaaaaugguguauguggaauacgcucuaccacccgaauggagaauuuacucuggaaacaaguggcgaacgaauuaaauuauauuuuaugggaaaacaauauuaaauuaacugucguaguaggagauauaauaggaguauuggagcaggguaaacgcacuuugacaccacaaccgauggaacugaaauacaguuggaaaacaugggguaaagcaaagauuguaacagcugagacucaaaauucauccuucauaaucgaugguccaaauacaccggaaugucccagugcaucgcgugccuggaauguaugggagguggaagacuacggauuugguguauuuacaaccaacauaugguuaaaguuaagagaaguauauacacaacuaugcgaucaccgccuuaugagugcagcuguaaaggacgaaagagcgguccacgccgauaugggguacuggauagagagucaaaagaacggaucauggaaauuagagaaagcaagccugauagaaguaaagacguguaccuggccgaagucacauacucuauggucaaacggcguacuagaaagugacaugauaauaccaaaaaguuuggcaggaccuauaagucaacauaauuaccgaccugguuaccacacccaaacagcugguccauggcacuuggguaaacuagaacucgauuucaacuacugugaagguacaacuguagucauaaccgagaacugugguacacgagguccuucauuacguacaacaacagucaguggcaaauuaauacacgaaugguguugccgcaguuguacacucccaccgcuacgcuauaugggcgaagauggguguugguauggaauggaaauuagaccuauaucggaaaaagaagaaaauaugguaaaaucuuuggugagugcgggaagcggcaaagucgacaauuuuaccaugggagugcuaugcuuagcuauauuauuugaagaaguaaugcguggcaaguuugguaagaaacacaugauagcuggaguuuucuuuacauucguauuacuauuaucuggccaaauaacauggcgagacauggcacacacccuaguaaugauuggcagcaaugcaagugaucgcauggguaugggaguuacauaccuugcgcucauugcaacauucaaaauacaaccauuuuuagcauuaggauucuuucuaagaaaacuuacaucacgagaaaauuuacuauuaggcguugguuuggccauggcaacaacauuacaacucccagaagacauugaacaaauggcgaacggaauugcauuaggacuaauggcccuuaaacuuauaacacaauuugagacuuaucaacuuuggacugcccuaauuucauuaacauguuccaacacuauauuuacuuuaacaguggcguggcgaaccgcuacauuaauacuugcagggguaucuuuacugcccgugugccaaucaucgucgaugagaaaaagcgacuggcugccaaugacaguugcagccaugggcgucccuccacuaccguuguucauauuuagccuaaaagacacucuaaaacgaagaucuuggccauugaacgaaggaguaauggcuguugguuuaguaagcauuuuagcuaguucacuacuuagaaacgacguuccaauggcugguccauuaguggccgguggacuuuuaauugcguguuaugucauaacuggaacaucagcugaucugacaguagaaaaggcugcagaugucacaugggaagaagaggcagagcaaacgggcgucucgcauaaccuuaugaucacugucgaugacgacggaacaaugcgcauuaaagacgacgagaccgaaaauauacugaccgugcuacuuaagacagcgcuacuuauaguaucgggaauuuuuccuuauaguauaccugcgacauugcuaguauggcacacauggcaaaaacaaacacguagaaguggaguauuaugggauguucccagcccuccagagacacaaaaagcagaauuagaagaaggcguauaucggauaaagcaacaaggaauuuuuggaaaaacucagguaggggucggcguacaaaaggaaggaguauuucacacuauguggcauguaacuaggggugcaguuuuaacguacaauggaaaaaggcucgaaccaaauugggcauccguaaagaaagacuugaucuccuaugggggagguuggaggcuaagcgcacaauggcagaaaggggaagagguucaagucauugcaguagaaccaggaaagaauccaaagaacuuucagaccaugccggguacguuucaaacgacuacaggggaaaucggugcaauugcccuugauuucaaacccggaacaaguggaucacccauaauaaauagagaagggaagguugucggacuauaugguaacgguguagucaccaaaaauggcggguauguaucuggcauagcacaaacuaacgcagaaccagacggccccacaccugaacuagaagaagaaauguuuaaaaagcgcaaccuuacuaucauggaccuucacccgggaucuggaaaaacacguaaauauuugccagcgauaguuagggaagcaauaaaacgacgacucaggacguuaauauuagcucccacacgagucguagcagcagaaauggaagaggcuuuaaaaggacugccuauaagauaccaaacaacggcgacaaagucagagcacacaggaagggaaauuguggaucuaaugugucacgccacuuuuacaaugagguuacucagcccaguaagaguaccaaacuauaaccucaucauaauggacgaagcacauuuuacugacccggccucaaucgcggcuagaggcuacauauccacucgaguaggaaugggagaagcugcagcuauauuuaugaccgcuaccccgccaggaacagcagaugccuucccccaaagcaacgcaccaauucaagaugaagaaagagauauuccugaaagauccuggaacaguggaaacgaauggauaaccgauuuugcagguaagacuguaugguucguuccgaguauaaaagccggaaaugacauagcgaacugucuacguaagaaugggaagaaagucauccaauugagucgaaagaccuuugacaccgaauaucaaaagacuaaacuaaaugauugggacuuuguaguuacgacagacauuagcgagaugggagccaacuucaaagcagaccgggugauagauccuagaagaugccuuaagccaguuauacucaccgauggaccagaacguguuauacucgcuggcccaaugcccguaacugcggcuuccgcagcucaacgacgcgguagaguaggacggaacccacagaaggagaaugaccaauacauauuuaccggccaaccuuuaaauaacgacgaggaccaugcacacuggacagaagcaaaaauguuacucgacaauaucaauacaccagaaggaauaauaccugcacuguucgaaccggaaagggaaaaaucagcagcgauagauggggaauaucgauuaaagggagaaucgaggaagacuuuuguagagcuuaugagacgaggagauuuaccgguauggcuagcucacaaaguagcaucugaaggaaucaaauauaccgaucgaaaaugguguuuugauggccagcgaaacaaucaaauucuagaagaaaauauggauguagaaaucuggacuaaagagggagagaagaagaaacugaggccuagaugguuggacgcacguacauauucagauccauuggcguuaaaagaauuuaaagacuuugcagcaggaaggaaaaguauagcauuggaucuaguaaccgaaaucgguagaguaccaagucaucuugcacaccgcacccguaacgcauuagauaaucucguuauguugcacacaucagaacacgguggaaaggcauaccgccaugcagucgaagaacucccugaaacgauggaaaccuuauuguuauuaggccuuaugauauugcuaacggguggugcuaugcuauuccucauuucaggaaagggaaucgggaagacaaguauaggucucauauguguaauagcaucgagcggcauguuauggauggcugaaauuccucuacaauggauugcuucggcaauuguauuagaguucuuuaugauggucuuacugauuccagaaccagaaaaacagcggacaccacaagacaaucaauuagcuuacguuguuaucgggaucuuaacucuggccgcaauaauagcugcaaacgagaugggacuacuugaaacaacuaaaagagaccugggaaugagcaaagagccaggcguaguaaguccuacaaguuacuuagauguugacuugcaccccgcuagcgcauggacacuguacgcaguagcgacaaccguuauaacaccaauguuaaggcacacaauagaaaauaguacugcgaaugucagcuuggcagcgaucgcgaaucaagcgguaguacuaaugggacucgacaaaggguggcccauaucaaagauggaucuugggguucccuuguuagcucuaggaugcuauucucaagucaacccucuuacacucacggcagcuguucuuuuauuaaucacacauuaugcgauaauaggacccggacuacaagcuaaggcaacccgcgaggcacagaaaagaacagcagcuggaauuaugaaaaauccaaccguagaugguauaaugaccauagacuuagaucccguuaucuaugauucaaaauucgaaaagcaacuuggccaagugaugcuuuuaguacuaugugcgauucaacuacuacucaugagaacuuccugggcucucugcgaagcccuaacgcuggcgacaggaccaaucacaacacugugggaaggaagcccagguaaauucuggaauaccacaauugcaguaucuauggcgaauauuuuuagggggucauaucuugcuggggcgggucucgcuuucucgaucaugaagucuguaggaaccgggaaacgagggaccggaucacaaggggaaacccuaggagagaaauggaagaagaaacugaaucaauuaucgcgaaaagaauuugaccuauauaagaaaaguggaauuaccgaggucgaucggacggaagccaaagaaggcuuaaaaagaggagagaucacucaccaugcugucagccgggguagugcaaagcuacaaugguuuguugaaagaaacaugguaaucccggaaggacgcgucauagaucuagguuguggcaggggcggguggagcuauuauugcgcaggauuaaagaaaguaacugaagugagaggauacacaaaaggggguccaggacacgaagaacccgucccgaugaguacauaugguuggaauauuguuaaauugaugucaggaaaagaugucuuuuaucugccaccagaaaaaugugauacacuauuaugcgauauuggcgagucuuccccauccccuacaguagaagagucaagaacaauaagaguauugaaaaugguugagccuuggcugaaaaauaaccaguucugcauaaagguauuaaauccauacaugccuacuguaauugaacacuuggaaagauuacagaggaaauaugguggaauguuaguaaggaacccucucagcagaaauuccacacacgagauguauuggaucagcaauggaacggggaacauugucgcauccgucaacaugguuagcagacuauuguuaaaucgauucacaaugacacacaggagaccaaccauugaaaaggaugucgaucuaggggcagggacucgccacguaaacgccgaaccagaaacuccuaauauggauguaauaggugagagaauaaagagaauuaaggaggaacacaauucaacuuggcacuaugacgaugagaacccguauaagacaugggcuuaucacgguagcuaugaaguaaaggcaacgggcagcgcaucuagcaugauuaaugggguagucaagcugcuuacuaaaccaugggauguuguaccaaugguaacccaaauggcuaugaccgacacgacuccuuucggacagcaaagaguguucaaagagaagguagacacuagaacacccaggagcaugccugggacacgaaggguuaugggaaucaccgcugaaugguuauggagaaccuuagguaggaauaagaagccaaggcucuguacacgugaagaguuuaccaagaaaguuagaacaaacgccgcaaugggcgcgguuuuuacggaagaaaaucaaugggacucagcuaaagcagccguggaagaugaagacuucuggaagcuaguugauagagaacgagaauuacauaaauuaggcaaaugugguucuuguguauauaacaugaugggaaaaagggaaaagaaauuaggugaguucgguaaggcuaagggaagcagagccaucugguauaugugguugggagcaagguauuuagaauuugaagcccuaggguuucuaaacgaagaccauugguuuagccgugagaacaguuauucaggaguugaaggugaaggauuacacaaacuuggauacauccucagagauauaucuaaaauuccagguggcgccauguaugcagaugauacagcuggaugggacacacgcauuacagaagaugaccugcacaaugaagagaaaaucacacagcagauggacccagaacauagacaacuagcaaaugcgauauuuaaacuuaccuaccaaaauaaaguugucaaaguacaaagaccgacaccuacggguacgguaauggacauaaucagcagaaaggaccagcgaggcucgggacaaguagggacauacggcuuaaacaccuuuacuaacauggaagcacaauuaaucaggcaaauggaaggggagggaguucuuacaaaagcagaccuugaaaacccacaccucagugagaagaaaauaacacaaugguuagaaacaaaagggguugaacgauuaaaaagaauggcuauuuccggagacgauugcguuguuaagccgaucgaugacagauucgcaaaugcguuguuagccuugaaugacaugggaaagguaagaaaagauauaccucaguggcaaccaaguaaaggauggcacgauuggcaacaaguccccuucugcagucaucacuuucacgaauuaauaaugaaagauggacgaaaguuagucguuccgugucgaccucaagaugaacuaauuggccgcgcccgaauaagucaaggagccggauggagucuccgugagacggcgugucuagguaaagcguaugcacaaauguggagccuaauguauuuccaccgaagagaucuacgauuagcgagcaaugcuauuuguucugcagucccgguacauugggugccaacaucacgcacaacauggaguauacaugcucaucaucaauggaugacaacagaggauauguuaacaguauggaauagaguauggaucgaagacaauccuuggauggaagauaaaaccccgguaacgaccugggagaacgugccauaucucggaaaaagagaagaucaauggugcggaucuuuaauaggcuugacgagucgugcaaccugggcgcaaaauaucccaacagcuauccaacaaguuaggucgcuaauuggaaaugaggaauuuuuagauuauaugccgaguaugaagcguuuccguaaagaagaagaaucugaaggugcaaucugguaa

SEQ ID NO: 23282 - RNA, 9873 nt, Artificial Sequence
  derived and/or modified CDS sequence (opt6) from DENV-3__KF955465__SS-prME
acaucgcucugcauaaugaugauccuaccagcugcguuagcuuuucacuugacaucaagagauggagaaccacgaaugauaguagguaaaaacgaacgcgguaaaucacuauuauuuaaaacugccaguggaauuaacaugugcacucuuauagcuauggauuugggagaaaugugcgaugacacaguaaccuauaaauguccacacauaaccgaagucgaaccggaagauauagauuguugguguaauuuaaccaguaccugggugacuuacgguacuuguaaccaagccggggaacauaggagggauaaaagaucgguagcuuuagcaccccacguaggaauggguuuagacacaagaacacaaaccuggaugagugcugaaggagcauggcgucaaguagaaaaaguagaaacaugggcauuaagacacccggguuuuacuauucuagcgcucuuucuugcucauuauaucgggacaucauuaacccaaaaaguaguaauauuuauacuauuaaugcuagugacaccaagcaugacuaugcguugugucggcguggggaaccgagauuuuguggaaggacucucaggagcaaccuggguagacguaguacuagaacacgggggaugcguaacaaccauggccaaaaauaaacccaccuuggacauagaauuacagaaaacagaagccacccaauuagcuacauuacgaaaauuguguaucgaaggaaaaaucaccaauaucacaaccgacagccgcugucccacacaaggagaagcaguguugccugaggaacaagaccaaaacuauguuuguaaacauacuuauguagauagaggauggggcaauggaugcggucuuuucggaaaaggaucucuagucacuugcgcgaaauuccaauguuuggaacccauagaaggaaaaguaguacaauaugagaauuuaaaauacacgguaauuauaacuguacacacaggagaccaacaucaagucggcaacgagacacaaggugucacagcagaaauuacaccccaagccucgacuacugaagcgauacuaccagaauacggcacuuuaggucuugaguguagucccagaacaggccuagauuuuaacgaaaugguucuguuaacaaugaaaaauaaagcauggaugguacaucggcaaugguucuucgauuugccgcucccauggacgucaggagcaacgaccgagaccccuacuuggaauaggaaagaacuauuaguuacauuuaaaaaugcacaugcgaagaaacaggagguaguaguccuuggaagccaggagggugcaaugcauacugcacuaaccggagccacggaaauacaaaacaguggagggacaagcauuuuugcaggacaucuaaaauguagacuaaaaauggauaaauuagaguuaaaaggaauguccuacgccauguguacaaauacuuuuguauuaaagaaagaaguaagcgagacacaacauggaacaauacugauaaaaguggaauacaaaggagaggauguuccauguaaaauaccuuuuucaacagaagauggccagggaaaagcucacaauggccggcuaauaacggcaaacccagugguaacaaagaaagaagaaccaguaaacauagaagcagagccucccuuuggugaaagcaacauuguaauaggaauuggagauaaugcccuaaaaauaaauugguacaagaaagguucuaguauuggaaaaauguuugaggcgacagcccgcggagcuagacgcauggcaauccugggagacacugcaugggacuuuggaagugucgggggagucuuaaauucauuaggaaaaaugguacaccaaauauucggaucugccuauaccgcauuguucaguggagugucaugggugaugaaaauagguauugggguauuacugacuuggauaggccuuaacaguaaaaacacgucaaugucauucaguugcaucguaauagguaucauaacauuauaucuaggggcaguaguacaagcagauaugggaugcgugauaaacuggaaaggcaaagaacuaaaaugcggcucuggaauauuuguuacaaaugagguacacacauggaccgagcaauauaaauuucaagcugacaguccgaaacgguuagccacagcaauagccggagcaugggaaaacggaguguguggaauaagaagcaccacaagaauggagaaucuauuauggaaacaaauagccaaugaauugaauuauauauuaugggaaaauaauauuaaacuaacgguaguaguaggcgauauaauagguguauuggaacagggaaaacgaacccuaacaccucaaccaauggaacuuaaauacagcuggaaaacuugggguaaagcaaaaauaguaacugcggagacacaaaauaguagcuucauuauugaugguccgaacacaccagaaugccccucagccucgcgcgcauggaauguuugggagguagaagauuauggcuucggcguguuuacaaccaacauaugguugaaacuaagggaaguauacacgcaguuaugugaucaccgauuaaugucagcagcuguuaaagacgagagagcuguccaugcagacaugggauacuggauugaaagccagaaaaacggaucauggaaacucgaaaaagcaucccucauugaaguaaaaacauguaccuggcccaaaagucacacuuuauggagcaauggaguguuagaaagcgacaugauuauaccuaaaucgcuagccggaccuauaucacaacacaacuaccgcccggguuaccacacacagaccgccggaccguggcauuuagguaaacuagagcucgauuuuaacuauugugaaggaaccacagucgugaucacagaaaauugcgguacaagagguccaucauugcguaccacaacagugaguggaaaacuaauacacgagugguguuguagaucauguacucuaccaccucuaagauauaugggagaggacgguuguugguacgggauggaaauacggccaauuagugaaaaggaagaaaauauggucaagucucucgugagcgccggauccggaaagguagacaauuuuacuaugggaguuuuauguuuagcgauccuuuuugaagaagucaugagagggaaguuuggcaagaaacauaugaucgcuggcguauucuuuacuuuuguacuacuacugucuggacaaauaacguggcgggauauggcacacacacucauuaugaucggcaguaaugcauccgaucgaaugggcauggggguaacuuacuuagcguuaaucgcuacauuuaaaauucaaccguuuuuagcauuagguuucuuuuuaagaaaacuaaccucuagggaaaaucuuuugcucggaguuggcuuagcgauggcgaccacucugcaauuaccggaagacaucgaacaaauggccaauggaaucgcuuuaggacuaauggcuuuaaaacuaauuacccaauuugagacguaucaacuauggacagcauuaauaucauuaacauguucaaauacuauuuuuacacuaacaguggcauggcggacagcaacauuaauucucgcuggagucucccuuuuaccugugugccagucuucaagcaugaggaaaacagacugguugccuaugaccguggccgccauggguguuccaccacuaccacuauucauauuuucacucaaagauacauuaaaaaggagaucauggccacuuaacgaaggugugauggcaguuggauugguuucuauacuugccucgucacuauuacggaacgacguacccauggcaggaccucuaguagcgggaggguuguuaauagcauguuauguaauaacuggaacgagugcagaucuaacuguagagaaggcagcugacguaacgugggaggaagaggccgaacaaacaggcgugucgcauaacuuaaugauaacuguagaugaugauggaacgaugagaauuaaagaugaugaaacagagaauauauuaacgguacuacuaaagacggcauuauuaauaguuagugggauuuuuccuuacaguauaccagcaacccugcuaguauggcauacuuggcaaaagcaaacacaaagaucaggaguacuaugggacgugccaagucccccggaaacacagaaagcagaacuagaagaaggaguguaucggauuaaacaacaggggaucuuuggaaaaacucagguaggaguaggaguucaaaaagaagguguauuucacacuauguggcauguuacucgaggggccgucuuaacguacaacggcaaacguuuggaacccaacugggcaucugucaagaaagaucugaucaguuauggagguggauggcguuuauccgcccaauggcaaaaaggggaagaagugcaaguuauagcgguagaacccgguaaaaaucccaaaaacuuucaaacgaugccuggaacguuucaaacaacaacuggugagauaggugcgaucgcauuggauuuuaaaccugggacaucgggcagcccaauaauaaaucgugaggggaaaguagucggucuuuauggaaaugguguaguuacaaagaacggcgguuaugucucaggaauagcccaaacuaaugcagaacccgacggaccgacaccagagcuggaagaggaaauguucaagaaaagaaaucuaacuauaauggacuuacauccuggaucaggaaaaaccagaaaauaccuaccugcuauagucagagaagcaauaaaacggcgguuaagaaccuuaauauuagcaccaacgagaguuguggcugcggaaauggaagaagccuuaaaagguuugccaaucagguaucagacuacagcuacgaaaucugaacacacaggcagagaaaucgucgaucuaaugugccacgccacuuucacuaugcgacuauuaucgccaguuagagugccaaauuacaauuuaauuauuauggacgaagcgcacuucaccgacccugccagcauagcagcuagaggauauaucaguacccggguaggaaugggugaagcugcugcuauauuuaugacagcuacuccacccggcaccgcagaugcauuuccacaaagcaacgccccaauucaagaugaggaaagagauauaccagaaagaaguuggaacucaggcaaugaguggauaacagauuuugcgggcaaaaccguuugguuugucccgagcauuaaagcaggaaacgauauugcuaacugccuuaggaaaaaugggaagaaaguaauacaacuauccaggaagacuuuugauacagaguaccagaaaacuaaauuaaacgauugggacuucguaguaacuaccgacaucucagaaaugggugcaaacuucaaagcagacaggguuauugacccgagacgauguuuaaaacccguaaucuuaacagacgguccggaacguguuauucucgcaggcccaaugccgguaaccgcagcauccgcggcgcaacgaaggggaagagugggcaggaacccacaaaaggaaaaugaccaauauauauuuacaggacagccacuaaauaaugacgaagaucacgcucauuggacagaagccaaaaugcuacuggacaauauaaacacaccugaaggcaucauaccagcucuauucgagcccgagagagaaaaaucagccgcaauagauggagaauauagauuaaagggagagucacguaaaacauucguagaguuaaugcgaagaggcgaucugcccgucugguuagcacauaagguagcaagugaaggaauaaaguacacugaucggaaaugguguuucgauggucaaagaaauaaccagauauuagaggaaaauauggacguagaaauauggaccaaagagggugagaagaagaaacuccgaccuagauggcuugaugcgcgaacuuacuccgauccccuagcucucaaagaauuuaaagacuucgcagccggcaggaaaaguauugcauuagaucuagucacagagaucggccgaguaccaucccaucuugcacauagaacuagaaacgcacuugauaauuugguaauguuacauaccucugaacacggaggaaaggcuuauaggcacgcagucgaagaauuacccgaaaccauggagacuuuacuuuuacuaggauugaugauccuauuaacaggcggagcaauguuguuuuuaauaucuggaaaagggaucggaaagacuuccauuggacucauauguguuauagcauccucuggcaugcucuggauggccgagauccccuuacaauggauagcuagugcaauagugcuugaguucuucaugaugguccuacuuauaccagaaccagaaaaacaaagaacuccccaagauaaucaauuggcuuauguugugauaggcauucuuacucucgcugcuaucauagcagcgaaugaaaugggccuuuuagaaacuacuaaacgagaccucggaaugucuaaagaaccuggcgucguaaguccaacguccuaccucgacguggauuugcacccagcaucggcuuggacucuauaugccguagccacuacaguaauaaccccgauguuacggcacacaauagaaaauaguacugcaaacguaucccuggcagccauagcuaaccaagccguaguuuuaaugggacuugauaaggguuggccaauuucuaaaauggaccuaggggugccccugcuugcacucgguugcuacucacaaguuaauccccuaacgcucacagcugcaguauuauuguugauaacccauuaugcuaucauuggaccugggcuucaagcgaaggccacaagagaagcacagaaaagaacggccgccgguauuaugaagaacccgacaguugaugggauuaugaccauagaucucgaucccguuauauaugauucuaaauucgaaaaacaguuaggucagguaaugcuauuaguccuaugugcaguucaacuccuacugaugcguacaaguugggcucuaugugaagcacuuacacuugcuacgggaccuauaacaacccugugggaaggaucaccagggaaauuuuggaauacuaccaucgcaguuucuauggcgaacauuuucaggggguccuaccuugcuggugcagguuuagcauuuaguauaaugaaaucggucggcacagggaaacguggaacaggcucucaaggcgaaacucuuggagaaaaauggaagaagaaauuaaaucaacuaucaagaaaggaguucgaccuauacaagaaaucugggauaacugaaguugacagaacagaagcaaaggaaggauugaaaagaggagaaauuacacaucaugcaguuagccguggaucagcaaaacuucaaugguuuguagagagaaacauggucauucccgaaggccgcgucaucgauuuagguuguggucgugggggauggucauauuauugcgcaggacuaaagaaaguaaccgaggugcgaggauacacaaaagguggaccaggacacgaagaaccgguuccaaugucuacuuaugguuggaacauagugaaauugaugaguggaaaggauguauuuuacuuaccaccagagaagugugacacgcuacugugcgacaucggagaaaguagcccuuccccuaccguugaagagucaaggacaaucagaguacuaaaaaugguagagccuuggcuaaagaacaaucaguuuuguauuaaagugcuaaauccauauaugccaaccgugauagaacauuuagaacgguuacaaagaaaacaugguggaauguuaguucguaauccucugucaagaaauagcacucaugaaauguacuggauuucaaauggaacugguaauauuguagcuucaguaaacaugguaucacgacugcuauuaaaucgauucacaaugacucaucgaaggccgacaauugaaaaggacguugaccuuggagcggggacacgacacgucaacgcagaaccagagacaccaaauauggacgugauaggagaacgcauaaagcguauaaaagaagaacacaauuccacuuggcauuaugaugacgagaacccuuauaagacuugggcauaccauggcucguaugaaguuaaagcaacugggagcgcuucgucaaugaucaacgguguagucaaacuuuuaacgaaaccaugggaugucgucccgaugguaacucaaauggcaaugacagauacaacaccuuuuggccaacaaaggguuuuuaaggaaaaaguugacacuaggaccccuaggucgaugccaggaacccgacgaguaaugggaauaaccgcggaguggcucuggcguacacuggggcgaaauaagaaacccagacuuugcacucgcgaagaauuuaccaagaaaguuaggacuaaugcugcaaugggcgcuguuuucaccgaagagaaccaaugggauucagcuaaagcggccguugaagaugaagacuuuuggauccuuguugacagggaaagagaacuccacaaauuggguaagugcggaagcuguguuuauaacaugauggggaagagagagaagaaauugggugaguucggaaaagcaaaaggauccagagcuauaugguacaugugguuaggcgcucguuauuuagaguucgaggcuuugggauuuuugaacgaagaucacugguuuucccgugaaaacuccuauagcggaguagaaggagaaggacuacauaaauuaggauauauauugagggauauuucuaaaauaccuggcggagcuauguaugcggaugacacugcuggcugggacacuaggauuaccgaagaugaccuacacaaugaagaaaagauaacacagcaaauggauccagaacacaggcaacucgcaaaugcaauauucaaacuaacauaucaaaauaaaguugucaagguacaacgcccuacaccaacaggcaccgucauggauauaauaucuagaaaagaccaacgggguaguggacaaguaggaacuuacggccucaauacauucacaaacauggaagcgcaguuaauaagacaaauggaaggagaaggcgugcuaucaaaagcugauuuggaaaacccacaccuaccagagaagaaaaucacgcagugguuagaaacgaaagguguugaaaggcuuaaaagaauggcgaucagcggcgacgauuguguuguaaaaccaaucgacgaucgauucgcgaaugcacuauuagcucuaaacgacaugggcaagguacggaaagacauaccacaauggcaacccucaaaagguuggcaugacuggcaacaaguaccauuuuguucucaucauuuucaugagcucauaaugaaggauggacggaagcuaguaguucccugcagaccucaagacgagcugauaggcagagcgagaauuagccagggugccggauggagccuuagggaaacagcaugucucggaaaagcguaugcucagauguggucgcuaauguacuuucaucgucgcgauuuacgguuggcaaguaacgcuauaugcagugcuguuccuguccacugggugccaaccucacguacuaccuggucaauacacgcacaccaucaguggaugaccacggaagauaugcuaacuguauggaauagaguauggauagaagacaacccguggauggaagacaaaacuccggugacuacuugggaaaacgucccuuaccuaggcaaacgcgaagaccaaugguguggaucacugauaggucugacauccagagcaaccugggcucaaaacaucccaacagcaauucaacaaguacgaucucuuaucgggaaugaagaguucuuagauuauaugccgagcaugaaacgguuucgaaaggaagaagaaucagaaggugcaauaugguaa

SEQ ID NO: 23283 - RNA, 9873 nt, Artificial Sequence
  derived and/or modified CDS sequence (opt6) from DENV-3__KF955466__SS-prME
acgucacuauguuuaaugaugauacuuccggcagcucuagcauuccaccuaacguccagggauggagagccuaggaugauagucgguaaaaaugaaagaggaaaaucucuucuuuucaaaaccgcuucaggaaucaacauguguacacuaauagcaauggaccucggggaaaugugugacgacacagugaccuacaaauguccucauaucacagaagucgaaccggaggacauagauugcuggugcaaccugacaucaacguggguaacauacgggacuuguaaccaggcaggagaacauagaagagacaaaaggucagucgcgcuugcuccgcacguagggaugggucuugauacucgcacacaaacguggaugagugccgaaggagcuuggaggcaaguagaaaaaguagaaaccugggcucuacggcacccaggauucacaauacuagcguuauuucuugcucauuacauaggaacguccuugacucaaaaaguuguaauauucauuuugcuaaugcuagucacaccaucaaugacaaugaggugcgugggagucgggaacagagauuucguugaaggacuuucuggagcaaccugggucgacgucguauuggaacauggagggugugucacaacaauggcuaaaaauaaaccgacuuuagauaucgaguuacagaaaaccgaagcaacucagcuagcuacccuaagaaaauuaugcauagaaggaaaaauuaccaauauaacgacagauaguagauguccaacgcaaggagaagcaguauuaccagaggaacaagaucagaacuauguguguaaacauacauauguugaccgaggauggggaaacggguguggucuguucgggaaaggaagccucgugaccugcgccaaauuucaaugccucgaaccaauagaagguaagguaguacaauacgagaacuuaaaauauacaguaauuauaaccguucauacaggggaccaacaccaaguagguaaugaaacgcaaggagucacagcggaaauuacgccccaagcauccacaacugaagcaauauuaccagaauacggaaccuuaggauuagaguguagccccagaacaggacucgacuucaaugaaaugauacucuuaacgaugaaaaacaaggcuuggaugguucacagacagugguucuucgaucuuccucucccguggacaaguggggcuacuaccgaaacaccuacuuggaacaggaaggagcuccuaguaacauuuaagaaugcacacgccaagaaacaagaggucguaguucuuggcucacaagaaggugcuaugcacacugcccucacuggagcuacggaaauacaaaacagcggagguacaucgauauuugcuggacaucugaagugccgauuaaaaauggacaaacuggaacuuaaaggaaugucauaugcaauguguacuaauaccuuuguucucaagaaagaaguaagcgaaacgcagcaugguacaauucuuauaaagguugaauauaagggcgaagacguaccgugcaagauucccuucucaacagaggacggacaaggaaaggcgcauaaugguagguuaauaacggcaaauccaguggugaccaagaaagaggaaccugucaacauagaagcagagccaccauuuggagagucaaacauuguuauuggaauuggggauaacgcacuaaaaaucaauugguauaagaaagguucuucgauagguaaaauguucgaagccacugcaagaggagcuagaagaauggcaauauuaggugauacugccugggauuuugguucagucggaggcguucucaauucuuuggggaaaaugguccaccaaauauuugguagugcauauacagcauuguuuucaggaguauccugggucaugaaaauaggcauaggcguucuacuaaccuggaucggacucaauuccaaaaacacgucuaugaguuucucgugcauaguaauagguauaaucacauuauaccucggggccguuguucaagcggacauggguuguguuauaaauuggaagggcaaggaacucaaaugcggaaguggaauauuugucaccaaugagguacauacguggacugaacaauacaaauuccaagcugacaguccuaaaagguuagcaacagcuauugccggugcaugggaaaauggaguauguggcauucgaagcacaacacguauggagaaccuucuguggaaacagauugcuaaugaauuaaacuauauacuuugggaaaauaauaucaaacuaacgguggucguaggagacauaauaggggugcucgagcagggaaagagaacucuuacaccccaaccuauggaacuaaaauacagcuggaaaacuugggguaaagcaaaaaucguuacagccgaaacgcaaaauuccucuuuuaucauagaugguccuaacacaccugaauguccgagugcuucuagagcauggaacguuugggaaguugaagacuacgguuuugguguauuuacaacaaauaucugguuaaaacuaagagagguauauacacagcuuugugaccaucgacuuaugucagcggcugugaaagaugagcgugcuguacacgcagauaugggguacuggaucgagucacagaagaacggaucuuggaaacuugaaaaagccaguuuaauagaaguuaaaacaugcacguggccaaaaucacacacacuauggucgaauggagugcuggaaucagauaugauaauaccaaaaucauuagcugguccuauaagucaacauaauuaucgacccggguaccauacccagaccgccgggccauggcaccucggaaaacuugaacuagauuucaauuacugcgaagguacaacaguaguaauaacggaaaauugugguacgagagggcccaguuuaagaacuacaacagucucggguaaacuaauacaugaauggugcuguagaaguuguacuuuaccaccacuuagauauaugggagaagacggauguugguaugguauggagauacgaccuauaagugaaaaggaagaaaauauggucaaaagucuuguaucagccggaucaggaaaaguagacaauuuuacgauggggguauuaugccucgcgauccuauuugaagaagucaugagggguaaguucggcaagaaacacaugauugcuggaguauucuuuaccuuuguauuauuacugucuggacaaauaacuuggcgggacauggcacauacgcuaaucaugauuggaucuaaugccagugaucgaaugggcaugggaguuacuuaccuggcacuaauagcuacauuuaaaauacaaccauuucuagcacugggauucuuccugcgaaaguuaacuucaagggagaacuuauuauuaggagucggacuagcaauggccacaacgcuucaacucccagaagacaucgaacagauggcgaauggcaucgcacuaggauuaauggcauuaaaguuaauaacucaauuugagacguaucaacucuggaccgcgcuaauuaguuuaacgugcuccaacacuauuuuuacacuuacaguugcuuggcguacggcuacacugauccucgcugggguuagccuacuacccgucugucaaucgucaaguaugcgaaaaacugacugguugccgaugacagucgcagcuaugggaguaccgcccuuaccacuauucauauuuucgcuaaaagauaccuuaaaacgaagaucauggccacuuaacgaaggaguaauggcuguaggauuaguaagcauacuggcgaguaguuugcuaagaaacgaugugccaauggcaggcccgcugguagcaggaggcuuacuaauugcauguuaugucauuacggggaccucugcagaccuuacaguugagaaagccgcugaugucacaugggaagaagaagcagaacaaacuggagugucucauaacuugaugauaacaguugacgacgauggcacaaugagaauaaaagaugacgaaacagaaaacauucuuacuguauugcuaaaaacagcauuauuaauuguaaguggaauauucccguauucuauuccagcgacgcuauuaguauggcacacauggcaaaaacagacacaaaggucugguguccucugggaugugccaaguccuccagagacucaaaaagcagagcuagaggaagguguauaccgaauuaaacaacaaggaauauuuggaaaaacucaaguuggaguagggguacagaaagaaggagucuuccauacuauguggcacgucacaagaggugcgguauugacauauaauggaaagcgauuggaaccgaauugggcaagcguaaagaaagaccuaaucucguauggagggggcuggagacuuagcgcacaauggcagaaaggugaggaagugcaaguaauugcagucgaaccaggcaaaaauccaaagaauuuucaaacgaugcccggaacguuccaaacuacuacgggagaaauaggugcuauagcacucgacuucaaaccugggacaagcggcaguccaauuauaaauagagaaggaaaaguagucggucuauaugguaacggagugguaacgaaaaacgguggauauguaucagggauagcucaaacuaaugcggaaccggacgguccaacaccggaacuagaagaggagauguuuaagaaacggaauuuaaccauuauggacuugcacccaggcucaggaaaaacacggaaguaucuaccagcuauaguucgugaagcuaucaaacgacgucuuagaacauuaaucuuagcaccaaccagagucgucgcagcagaaauggaagaggcacuaaaaggauuaccaauacgauaucagacgacugcaacaaagagcgaacacacugguagagaaaucgucgacuuaaugugucacgcgacauuuacuaugcguuuguugucccccgucagaguaccuaauuacaaccuuauaauaauggaugaagcacauuuuacagauccagcaucaaucgccgcacgggguuauauaucaacaagaguaggcaugggagaggcagcugcgauauucaugacagcaacgccaccuggaacagccgaugcguucccgcaaucuaacgcacccauacaagaugaagaaagagacauacccgaaaggagcuggaauagugguaaugaguggauaacugacuuugcugguaaaacaguaugguucguaccaaguauaaaagcagggaacgauauugcgaauugcuuaaggaagaauggcaagaaagucauacaacuaucuagaaagacauuugacacggaauaucagaaaacaaaacugaacgacugggauuuugugguaacgacugacauuucagaaaugggggcgaacuuuaaagcggaccggguuauagauccacgccgaugucuaaaaccaguaauauuaacggauggaccagagagggugauacuugcagguccuaugccuguuacugcagcaucagccgcacaacgaagaggccgaguuggacgaaacccucagaaagaaaacgaucaauauauuuuuacuggucagccacuaaacaaugacgaagaccacgcccauuggacagaggcgaaaaugcuauuggauaauauuaauaccccagaaggaauaauacccgccuuguuugaaccugagagagaaaaguccgcagccauagauggagaauaucgucuaaaaggggaaagcagaaaaacauucguggaauuaaugagacgaggcgaccuuccuguuuggcuagcacauaaaguugccucagaaggaauaaaauauacugauagaaaaugguguuuugacggacaacgaaauaaucagauauuggaagaaaacauggauguagagauauggacgaaagaaggagaaaagaaaaaguuaaggccccguuggcuugaugcaaggacuuauagcgauccacuagcuuugaaagaauuuaaggauuuugcagcuggaagaaaaaguauagcacuagauuugguuaccgaaauaggaagaguucccucacaucuagcacauaggacacgaaaugcacuagacaaucucguuaugcuacacaccagcgagcaugggggcaaggccuaucgccaugcaguugaagaacugcccgaaacaauggaaacacuacuuuuguuaggucuaaugauauuauugacagggggugcaauguuguuccuuaucucggguaaagguauagguaaaacuagcauaggcuuaauuugcguuauagcaucuucggguauguuauggauggcagaaauuccacuacaauggauugcaagcgcgaucguccuagaauuuuucaugaugguacuacuaauuccggagccugaaaaacaaaggacgccgcaggauaaucaacuugccuaugucguaauagggauucugacacuagcagccauaauugcugcaaacgaaaugggucuucuagaaacuacaaaaagggaccuugggaugucaaaggaaccaggugucguaagcccgacaaguuauuuagaugucgaccuacacccagcgagugcguggacacucuaugcaguggcuacaacaguaauaacuccgaugcuacgacauaccauugaaaauucgacagcgaauguaucuuuggcagcgaucgccaaccaggcaguugugcucauggggcucgacaaaggauggccaauaagcaaaauggauuuagggguuccucuacuugcccuaggguguuacucgcaaguaaacccacuuacacuaacugcugcaguucuacuccucauaacucacuacgcaauaauaggacccggccuccaggcuaaagcaacacgugaggcgcagaaacguacagcagcaggcauaaugaagaaccccacuguugauggcauaaugacaaucgaucuggauccagucaucuacgacaguaaguuugaaaaacaauuaggacaagugauguuacuuguauuaugugcuguucagcuccuacuuaugcgcaccucaugggcacuaugcgaggcauuaacacucgcaacuggcccaauaacuacuuugugggaaggaucacccggaaaguuuuggaauacgacuauugcuguaucuauggccaauauauuucgcggaagcuauuuagcuggagcaggccuagcauuuucaaucaugaaaucagugggaacagguaaaagagguacuggaagccaaggggaaacauuaggugaaaaauggaagaagaaacuaaaucaguuaagccgaaaagaauuugauuuguacaagaaaucgggcaucacggaagucgauagaacagaagccaaagagggauuaaaacgaggugaaaucacgcaucacgcggucagucgugggagcgcaaaguuacaaugguucguugagcggaauaugguaauaccagagggcagaguaauagacuuaggaugcgggagaggaggguggaguuacuauugugcaggccuaaagaaagucacggaggugagaggauacacgaaagggggaccugggcacgaagaaccuguaccaaugucaacauacggauggaacauagugaaacuuauguccggaaaagauguguuuuaccuaccgccugaaaaaugcgacacccuacucugugauauaggagaaaguagcccaucuccuacuguagaagaaucaagaacgauacgaguucuaaaaaugguagaaccaugguugaagaauaaucaguuuuguauaaaaguuuugaauccuuacaugccaacuguaauagaacauuuagaacgcuuacaacgaaaacaugguggaaugcuuguaagaaauccuuuaagccgaaauaguacgcaugaaauguauuggaucucuaacgggaccggaaacaucguugcuucaguaaauaugguauccagauuacuguugaaucgauucacaaugacccaccgaagaccuacaauagagaaggauguugacuuaggcgcugguacgcgacacguaaaugcggaacccgagacaccuaauauggauguuauuggcgagcgcauuaaacgaaucaaggaggaacauaauaguacauggcauuaugaugaugaaaaccccuauaaaacaugggcauaccacgguaguuaugaggugaaagccacuggaagugcaaguucaaugauaaacggcgucgugaaguuacuaacaaaaccuugggacgucguuccaaugguaacgcaaauggcaaugacugacacaacaccauucgggcagcagaggguguuuaaggagaaaguagauacacguacaccaagaaguaugccagguacuagacgaguaauggguauuacagcagaaugguuauggagaacacucgggaggaacaagaaaccaaggcuauguacuagagaagaauuuacuaagaaaguacguaccaacgcagcuaugggggcuguauuuacugaagagaaucaaugggauucagcaaaagcugccguagaagaugaagauuuuuggaugcuuguugaccgugagcgugaauugcauaaacucgguaaaugcgguucaugcgucuauaauaugauggguaaacgggagaaaaagcuaggcgaguuugguaaagccaaggggucuagagcaauuugguacauguggcuaggagcaagauaccuagaauuugaagcccucggcuuucucaacgaagaccacugguucucuagagaaaauucguacagcggugucgaaggugagggccuacacaagcuaggauacauauuaagggauauaucuaaaauaccagggggagcuauguacgccgacgauacggcaggaugggacacuagaauaacugaagacgaccuacacaaugaagagaaaauaacacaacaaauggauccugaacaucgacaauuagcaaacgcaauuuuuaaacucacuuaucagaauaaaguagucaagguucaaagaccaaccccaaccggaacaguuauggauauuauuucaaggaaggaccaaagggguucuggccaaguugguacuuacggauuaaacacauucaccaauauggaagcucagcuuauaaggcaaauggaaggugagggugugcuaucgaaagcagaucuugaaaacccucaccuaccggagaagaaaaucacucaauggcuggaaacaaaaggaguugagcguuuaaaacguauggcgauaagcggugaugacugcguugucaaaccgauugacgaucgguuugcuaaugcacuauuggccuuaaacgauauggguaaaguucggaaagauauuccacaauggcaaccuucuaaagguuggcacgauuggcaacagguaccuuuuuguucacaucauuuucacgaauuaauaaugaaagacggccgcaaauuggucguaccguguaggccccaagaugaacuuauugggagagcaagaauuucucagggggcaggguggagccuucgagaaacagccuguuugggcaaagcauacgcacagauguggucucuaauguauuuccaucgacgggaccucaggcuagcgucgaaugcgaucugcagugcggucccuguacauuggguuccaacaucacgcacaacuuggaguauucaugcgcaccaucaguggaugacaacagaagacaugcugacaguuuggaaccggguuuggaucgaagauaacccauggauggaagauaaaaccccaguaacaacaugggaaaauguaccuuacuuaggaaaaagggaggaucaauggugcggcagucuaauuggcuugaccucccgugcaacaugggcacaaaauaucccuacagcaauccaacagguucgcucauuaauaggaaaugaagaauuucuggacuauaugccuucuaugaaacgauuccguaaagaagaagaaagcgaaggagcaauuugguaa

SEQ ID NO: 23284 - RNA, 9873 nt, Artificial Sequence
  derived and/or modified CDS sequence (opt6) from DENV-3__KF955468__SS-prME
acuucucuuuguuuaaugaugaucuuaccagcagcuuuagcauuccauuuaaccucacgcgauggugaaccuagaaugauagugggcaaaaaugagagaggaaaaaguuuacuauuuaaaacugcuagugggauaaacauguguacguuaauagccauggauuuaggggaaaugugcgacgacacaguaacuuacaaauguccgcacauaacggaaguugaaccagaagauauugacuguugguguaauuuaacaaguacuuggguuacauacggcacaugcaaccaagcgggugaacacagaagagauaaacguucaguugcccuugcaccacacguuggaaugggucuagauacuaggacgcaaacauggauguccgcugaaggugcguggagacaaguagaaaaaguugaaacaugggcccugcgacacccaggguucacuauuuuagcuuuauucuuagcgcacuauauagguacuucccugacucaaaaaguagugauauucauacuucuuaugcuaguaacacccucuaugacaaugagaugugugggagucgggaaccgugauuucgucgaaggauuaaguggggccacauggguugaugucgugcucgaacacggaggaugugucacaaccauggccaaaaacaaaccaacguuagauauagaguuacagaaaacagaagcgacucaacuagcuacuuuaagaaaauuauguauagaagguaaaauaaccaacauaacaacagauucuagauguccgacccaaggugaggccguuuuaccagaagaacaagaccaaaauuacguauguaaacauacauauguagauagaggguggggaaacggcuguggauuauucgguaaaggaucucucguaacaugugcaaaauuucagugucucgagccuauagagggaaaaguaguucaguacgaaaacuuaaaauacacugucauaauuacuguacacacaggcgaucagcaccagguugguaaugagacgcagggcguuacagcugaaauuacaccucaggccaguacaaccgaagccauuuugcccgaauacggaacacucggguuagaaugcagcccccgaaccggacuagacuucaaugaaaugauacuuuugacgaugaaaaauaaggcuuggauggugcacagacagugguucuucgauuugccccuacccuggacuucaggagcaacaaccgaaacucccacauggaacagaaaagaauuacugguuaccuuuaaaaaugcgcaugcgaagaaacaagagguagugguuuuagguagucaggaaggggcaaugcauaccgcacuaacaggagcaacagaaauucaaaauucaggcggcaccaguauauuugcgggccacuuaaaauguagauugaaaauggauaaacuugagcucaaaggaaugagcuaugcgaugugcacaaauacauuuguacuuaagaaagaaguuuccgaaacacaacauggaacaauccuaauaaaaguagaauauaaaggggaagauguaccaugcaaaauuccuuuuucaacagaagauggacaaggcaaagcccacaaugggcguuugauaacugcuaaccccguuguaaccaagaaagaagaacccgucaauauugaagcagaaccaccauucggagaaucaaacauuguaauaggaauaggagauaaugcguuaaaaauuaauugguauaagaaagguagcaguauagguaaaauguuugaagcgacugccagaggagcaagacgaauggcuauccuaggugauacggccugggacuucgguuccguagguggaguauuaaauucguuagggaaaauggugcaccaaauauuuggaagcgcauauaccgcacuauucucuggugucaguugggugaugaaaauuggaauaggaguauuacuaacuuggauaggucucaauuccaaaaauacuagcaugucguucaguugcaucgugauagguauaauuacauuauauuugggugcaguaguucaagcagacaugggguguguuauaaauuggaaaggaaaagaacuaaaauguggauccgggauauuuguuacuaaugaagugcauacauggacugagcaauauaaauuucaagcagacagcccuaaacguuuggcaacagcgauugcuggagcaugggaaaauggaguuuguggaauaaggaguacgacgaggauggaaaaccuauuguggaaacagauagcaaacgagcugaauuauauucuaugggaaaauaacaucaaacuaacugucguaguuggggacauaauuggagugcuggaacaaggaaaaagaacacuaacgccccagccgauggagcuuaaauauaguuggaaaaccuggggcaaagcaaaaaucguuacggcugagacacagaauaguuccuucauuauugacggaccaaauacuccggaaugcccaucggcgucucgggcuuggaaugugugggaaguagaagacuauggguuuggaguuuuuacuacaaacauauggcuaaaacuaagagaaguauauacgcagcuuugcgaccaccgcuugaugagcgccgcaguuaaggacgagcgcgcuguacacgcggacaugggauauuggauugagagccaaaagaauggaagcuggaaauuagagaaggcuucauugauugaaguuaaaacuugcacguggccgaaaucccacacacucuggaguaauggaguguuagaaagcgacaugaucauuccuaaaucacuagcgggaccaaucucacaacauaauuauagaccuggauaccauacccaaacagcagguccuuggcaccucggaaagcuagaacuugacuucaauuacugugagggcacaacuguaguaauuacugaaaacugcggaacaagaggaccuagccuuaggacuacaacagucucggggaaauuaauacacgaaugguguuguaggaguuguacucucccaccguuacgcuauaugggagaagauggcuguugguauggcauggaaauaaggccaauaagugaaaaagaagaaaacaugguaaaaucacucguauccgcugguucgggaaaaguugauaacuuuaccauggguguauugugcuuagcaaucuuguuugaggagguuaugcgaggaaaauuuggcaagaaacauaugauagcaggaguauucuuuacauucguccuuuuguuaucuggacagauaacuuggcgagauauggcacacacacuaauuaugauaggcucaaaugcaucggacagaaugggaauggguguaacauacuuagcgcugauagcgacauucaaaauucaaccguuuuuagcucuaggauucuuucuucgaaaacuuacaucuagagagaauuuauugcuuggaguaggucuggccauggcaacaaccuuacaauugccugaagauauugaacagauggcaaacggaaucgcgcuuggguuaauggcuuuaaaacugauaacccaauuugaaacauaucagcuuuggacggcucuuauuucuuuaacaugcagcaauacaauauuaacccucaccgucgcauggagaacugcuacccucauacuagccggggucucgcuccugccgguaugccaaucaagcucaaugagaaaaacugauuggcuaccuaugacaguggcugcaauggguguuccgccuuuaccacuuuuuaucuuuucgcuaaaagauacgcuaaaacgacgaaguuggccacuaaacgaaggaguaauggccguagggcuaguuucgauacuugccucaagucuucuuaggaaugacguaccaauggcagguccucugguagccggaggccucuugauagcauguuaugucaucacugggacaucagcugacuuaacgguugaaaaagcugccgaugugacaugggaagaagaagcagaacagacgggaguuucccacaaucucaugauuacaguagaugaugacggaacgaugcgcaucaaagacgacgagaccgaaaauauccuaacaguucuguuaaaaacugcacuacuaauaguaucaggaauauuuccuuauucaauaccagcaacucucuuaguauggcauacuuggcaaaaacaaacccaacgaagcggaguacuuugggaugucccaagcccaccugagacucaaaaagcugagcuugaagagggugucuacaggauaaaacaacaaggaaucuuuggcaaaacccaaguuggagucgguguacaaaaagagggggucuuucauacuauguggcauguaacuaggggagcgguccuaacguauaauggaaaacguuuagaaccaaauugggcgucuguuaagaaagaccuaauaucguauggagguggcuggcgauuaucugcccaauggcagaaaggcgaggaaguacagguaauagccguugaaccagguaaaaacccuaaaaauuuccagacaaugccagggacguuucaaacuaccacgggagagauaggugccauugcccuugacuuuaaacccggaacaucuggaucaccaauaauuaaccgagaagguaggguuguuggacucuacggcaauggcguugugacgaaaaauggagguuaugucagcgggauugcacaaacaaacgcugaaccugaugggccuacucccgaacuugaagaggaaauguuuaaaaagagaaacuuaacaaucauggaccuacaucccggaucugggaaaacuagaaaauaucuuccagccaucgugagagaagcuauuaagaggcgacugagaacguuaauucuagcaccuacccgagugguagcggcagagauggaagaagcauugaaagguuuacccaucagauaucaaacuacagccacaaagucggagcauacuggcagagagauaguggaccuaaugugccacgcgacauuuacgaugagacugcuauccccuguucggguacccaauuacaaucuaauaauuauggaugaggcacauuucacagacccagcuucaauagccgcaaggggauacauaagcacgcguguaggaaugggcgaagcagccgcuauauucaugacagcaacgccuccaggaacugcagacgccuuuccccaauccaaugccccaauucaggacgaagaaagagauaucccugaacgaaguuggaacucugggaacgaauggauuacagacuucgcaggcaaaacuguuugguuuguaccaucaauaaaagccgggaacgauaucgcgaacugucucaggaaaaaugguaagaaagucauccaacuauccagaaaaacauuugacacagaauaccagaaaacaaaauuaaaugacugggauuucguagugacuacagauauaagcgagaugggagcaaacuucaaagcugacaggguaauugacccacgccgcugccuaaagccuguuauauuaacagacggaccagaacgcguaauauuggcugguccaaugcccguaacagcagcgagugcugcucagagaagaggucgagugggaaggaacccgcaaaaggagaaugaccaauacauauuuacagggcaaccacugaauaacgaugaggaccaugcacauuggaccgaagcuaaaaugcuauuagacaauauaaauacgcccgagggaauaauuccggcacuauucgaaccugagagggaaaagucugcagcaauagacggagaauacagguugaagggagaaagccgaaaaacauuuguugaauuaaugcgacgcggggacuuaccggugugguuagcacauaaaguugccucggaagggauaaaauacacagaucguaagugguguuuugacggccaaaggaauaaccaaauucuugaagaaaauauggacguggaaauauggacgaaagaaggugagaagaagaaauuacggcccagauggcucgaugcacggacguauucagacccuuuagcgcucaaagaguuuaaggacuucgccgccggccgaaaaagcauugcuuuagaucuugucacggaaauuggccguguaccaagucauuuagcucaccguacaagaaaugcguuagauaaccuuguuaugcuacauacaagcgaacacggcgggaaagcguaccgucaugcagucgaggaacucccagagaccauggagacuuuacuucugcuaggcuuaaugauuuuacuaacagguggagccaugcuguuucugauaucagguaaagggauaggcaaaaccuccauaggcuuaauaugcguuauagcuucuucaggaauguuauggauggccgaaauuccuuuacaauggaucgcgucagcaauuguucuagaauuuuucaugaugguauuauugauaccggaaccggagaagcagcgaacuccucaagacaaucaguuagcguacguuguaauuggcauacucacucuagcugcuauuauagcugcuaaugagaugggcuuauuagaaacaaccaaaagagauuuggggauguccaaagaaccugggguagugucuccuacaucuuaucuggaugucgacuuacacccagcaucggcuuggacccuuuaugcuguagcaacuaccgugauaaccccuaugcucagacacacaauagaaaacucgacggcaaacgucucccucgcugcuauugcuaaccaagcugugguauuaaugggauuggauaaggguuggccgaucucaaagauggacuuaggcguuccacuauuagcacuaggauguuauucacaagucaauccuuuaacauuaacagcagcagugcucuuacuaaucacacacuaugcuaucauugggccaggauugcaagcaaaagcuaccagagaagcacaaaagcgcacagcggcaggaauuaugaagaaucccacuguagacggcauaaugacaauagacuuagaucccgugauuuacgauagcaaguucgaaaaacagcucggacaaguaauguuauuaguauuaugcgcugugcaauuacuucucaugcguaccucuugggcguuaugcgaggcguugacucuugccacaggaccgaucacuacauuaugggaagguaguccaggcaaauuuuggaauacaacuauagccguaaguauggccaacauuuucagaggcuccuaucuugccggugccgguuuagccuuuuccauaaugaaaucaguuggaacagggaaacgaggaacagggucccaaggcgagacgcuaggggaaaaguggaagaagaaauuaaaccaauuaagccgaaaagaauuugauuuauauaagaaaaguggaaucaccgaaguggauagaacugaagcaaaagaaggcuuaaaaagaggagagauaacacaucacgcaguaucacgaggcucagcaaaauuacaaugguuuguagaaagaaacaugguaaucccagaaggacggguaauugauuuaggaugcggucgaggaggauggaguuauuauugcgcggggcuaaagaaaguaacugaaguuagagguuauacuaaaggaggucccgggcaugaagaaccuguuccgaugaguaccuacggcuggaacauuguuaaacuaaugucaggaaaagauguauucuaucuuccaccagaaaaaugugacacuuuauuaugcgacauaggcgaaucgaguccaucacccacugucgaggagucacgaacaaucagagugcucaaaaugguggagccauggcugaaaaauaaucaguuuuguaucaagguccuaaauccauauaugccuaccgugauugaacauuuagagagguuacaacggaagcauggggguauguugguaaggaacccguuaucgagaaauucuacacaugaaauguacuggauaucuaauggcacgggaaauauuguagcuucuguuaauauggucucgcgauugcuucuaaaccgauucacgaugacgcaucgucgaccaaccauagaaaaagacguagacuuaggagcggguacaaggcauguuaaugccgagccugaaacaccaaacauggaugucauaggagaaagaauuaaacgcauuaaagaagaacauaacaguacauggcacuacgaugaugaaaauccauauaaaacuugggcauaucacggcagcuaugaaguuaaagccacaggaagcgcuucaucaaugauaaacggagucguaaaacuacugaccaaaccaugggacguagugcccauggucacgcaaauggcgaugacagacaccacacccuuuggucagcaacgaguauuuaaagagaaaguagacaccagaacuccccgcucgaugccaggaacaagaagagucauggguauaaccgcagaauggcuuuggcggacguuaggaagaaauaagaaaccuagauuguguacucgagaggaauuuacuaaaaagguaagaaccaacgcggcaaugggugcgguauuuacagaagaaaaccaaugggauucggcuaaagcugcaguagaggaugaagacuucuggacacuuguagacagagaaagggaacuccacaaauugggaaaauguggauccugcgucuauaacaugaugggcaaacgugaaaagaaacuuggagaauuuggcaaggcaaagggcagccgugcgauuugguauauguggcucggugccagguaccucgaauuugaagcacuuggauuuuuaaacgaggaucacugguuuuccagggaaaauucauacuccggcguugaaggagaaggguugcacaagcuagguuacaucuuaagagacaucucgaaaauuccaggaggugcaauguacgcagacgauacagcagguugggauacaagaauaaccgaggaugaccugcacaacgaagagaaaauuacgcaacagauggacccugagcauagacaauuagcgaacgcuauuuuuaaauuaacuuaucaaaauaaaguaguaaaaguccagagaccuaccccaacaggcacagucauggauaucaucaguaggaaagaccaacgcggaucaggacaaguaggaacauauggucucaauacuuuuacaaacauggaagcucaacuaaucagacaaauggaaggagaaggaguacuaucaaaagcggaucuagaaaauccacaucuuccagagaagaaaauaacacaaugguuagaaacaaaagggguugaacgucugaaaagaauggcuauaaguggagaugauuguguggugaaaccgauagaugacagauuugcaaaugcauuauuagcccuaaaugauaugggaaaaguaagaaaagauauaccccaauggcaaccuuccaaaggguggcaugacuggcaacaaguuccauucuguagucaucacuuucacgagcuuauaaugaaagaugggcgaaaauuaguuguaccaugccgaccucaagaugaacuaauugggcgggcacgaauaagccaaggagcuggcuggucccugagagaaaccgccuguuuagguaaggcauaugcacaaauguggagucuuauguacuuucauagacgagaccuaagacucgcuuccaacgccauauguucagcgguucccguacauugggugccaacgagucguacuacauggaguauucacgcucaccaucaauggaugaccacugaggacaugcuuacuguguggaacagaguuuggauagaggauaaucccuggauggaggauaaaaccccggucacgaccugggaaaacgugccguaccuagggaaacgagaagaccaauggugugguucauugaucggauugacaucuagagcaacuugggcacaaaacaucccaacugcuauacaacaaguaagaucacuaauuggaaaugaagaguuucuagacuacaugcccucaaugaaacguuuccggaaagaggaagaaagcgagggcgcaauaugguaa

SEQ ID NO: 23285 - RNA, 9873 nt, Artificial Sequence
  derived and/or modified CDS sequence (opt6) from DENV-3__FJ744726__SS-prME
acuagccuaugucuaaugaugaugcuuccggcaacccuggcguuucaccuaaccuccagggauggagaaccacggaugauagucgccaaaaaugaacgugguaaaagucuucuuuuuaaaaccgcaagugguauuaauauguguacuuuaauagcuauggaucugggagaaaugugcgacgauaccguaacauauaaaugccccuugauagcagaagucgaaccugaagacauagauugcuggugcaauuuaacaucaaccuggguuacuuaugggacgugcaaccaagcgggagaacauaggcgagacaaacguucaguagcuuuggcaccgcauguaggaaugggacuagacaccagaacgcaaaccuggaugucagcagaaggcgcauggagacagguugaaaaaguagaaacaugggcuuuacgucauccaggcuuuacgauuuuagcucuauuuuuagcacauuacauugguacaucccugacgcaaaaaguaguaauauuuauacuacucauguuaguaacaccaucaaugacaaugaggugugugggcgucgggaaccgagauuuuguugaaggccugaguggagcaacaugggucgacgucguacuagaacaugggggcuguguuacaacaauggcuaaaaacaaaccuacuuuagauauagaacuccagaaaaccgaagcgacgcaacuagcaaccuuacggaaauugugcauugaagguaaaauuacaaauauaacaaccgacagcagaugcccuacacagggggaagcuauacuaccugaggaacaagaucaaaauuauguaugcaaacauacuuauguagauagaggcuggggaaauggcuguggauuauuuggcaaagggagccuuguaacuugugcaaaauuucaaugucuagagccgauagaaggaaaaguugugcaacaugaaaacuuaaaauacacagucaucauaacugugcacaccggggaucagcaucaaguuggcaacgauacucaggguguuacaguggaaauuacgccgcaagcauccacagucgaggccauucuaccagaguaugguacacugggacuugaaugcucaccgaggacgggacucgauuucaaugagaugaucuuauugacuaugaaaaauaaagccuggaugguacauagacaaugguucuuugacuuacccuugccguggaccuccggcgcaaccaccgaaacccccacauggaaccggaaagaauuauuggugaccuucaaaaacgcgcacgccaagaaacaagaggugguaguacuggguucucaggagggggcaaugcauaccgcucucacaggugcgacugaaauucagaacaguggaggaacaucuauuuucgcgggucaucuuaaaugcagacucaaaauggauaaauuagaauuaaaaggcaugagcuaugcaaugugucuaaacacuuuuguguugaagaaagaaguuucagaaacacaacauggcacaauauugaucaaagucgaauauaaaggggaggaugccccgugcaaaauuccguucaguacugaagacggucagggcaaagcucauaacgguaggcuaaucacggcaaauccaguaguuacgaagaaagaagaaccugugaauaucgaggcagaacccccuuuuggagaaaguaauauagugauagguaucggagacaaagcucuuaagauuaauugguacaagaaaggaagcucaauaggaaaaauguuugaagcuacugcacgaggagcacgaagaauggcuauccuaggcgauaccgcaugggauuuugguucagugggaggaguauuaaauucguuaggcaaaaugguccaucaaaucuuuggcucagcguacaccgcuuuauucagcggcguuaguuggauaaugaagauaggaauugggguucugcugacguggauuggacucaacagcaaaaauacaagcaugucguucucuuguauuguaauaggcauuauuacauuauaccuuggugcagugguucaagcagauauggggugugugauuaauuggaaagguaaagaacuaaagugcgggucugguauauuuguaacgaacgaaguacacaccuggacagaacaauacaaguuucaagcggauaguccaaagcguuuagcaacugcuauugcgggugccugggaaaaugggguuugugggauacgaagcacgacacgaauggaaaaccuacuauggaaacagaucgcuaaugagcuaaauuauauacuuugggagaauaauauuaaacuuacagucguaguuggcgacaucaucggagucuuggaacaaggaaaacgaacauuaacaccccaaccaauggagcucaaauacaguuggaagaccugggguaaggcuaagauaguaacugcagagacccaaaacuccucauucauaauagauggacccaacacuccugaauguccuucugcaucgagagcauggaacguaugggaaguggaggauuacggcuuugggguauuuaccacaaacauuuggcuaaaacuuagggaagucuauacucaaucaugcgaucaccgcuuaaugagugcagcaauaaaagaugaacgagcgguucaugcagauaugggcuacuggauugaaagucaaaagaacggaagcuggaaauuagaaaaggcuagcuuuauagagguaaaaacaugcacguggccaaaaagucauacacuguggaguaaugguguacuagagucggauaugauaauaccaaagucauuagcaggaccgauaucacaacauaaucacagacccggauaccauacucaaacugcuggaccauggcauuuggguaagcuagaauuggacuuuaauuauugcgaggguacaacaguagucauaacagaaaauugcgguaccagaggaccuagcuugagaacgaccacuguaucgggcaaguuaauacaugaaugguguuguaggagcuguacgcugcccccuuugagauauaugggggaggauggauguugguacgguauggaaauaagaccuauuaacgaaaaagaagaaaacaugguuaagaguuugguaucagcuggcucagguaaaauggacaacuucacuaugggaauacucugucuugccauacucuucgaagagguaaugcgugggaaguucggcaagaaacacaugauugcaggcguacuauuuacauuugugcuacuauuaucaggucaaauaacguggagggauauggcgcauacucuaauuaugauaggaaguaacgcuagcgaucgaaugggaaugggaguaacauaucuagcauugauugccaccuuuaaaauacaaccauucuuagcacucgguuucuuccuucggaaauugacaaguagagagaaccuacuauuggguguagguuuagcaauggcaacuaccuugcaacucccggaagauaucgaacagauggcuaauggaauugcccuaggauugaugaccuugaaauuaauuacacaauucgaaacauaucaguuauggacggcucucguuagcuuaacaugcaguaauacaauauucacacucacuguagcauggagaacagcaacacuuauacuagcaggaguaucucuacucccacuuugucagaguucaucaaugcgcaaaaccgauuggcucccuaugacaguagccgcuaugggcgugccaccacugccauuguucauuuuuaguuuaaaagauacuccuaaaagaagaucguggccucuuaacgaaggagucauggcuguaggauuaguuucgauauuagcuaguuccuuauuaagaaaugacguaccuauggccggaccauuaguggcuggaggacuuuugauagccuguuaugugauaacugguacgagcgccgaucucacuguagagaaagccgccgauguuacaugggaagaagaggcggaacaaacgggcguaucacacaaucuaaugauaacuguagaugaugauggaaccaugcgaauaaaagacgaugagaccgaaaauauccugacuguucuucuuaaaacggccuuacuaaucguaucggggauauuuccguacuccauucccgcaacacuauuagucuggcauacauggcaaaaacaaacacaacgcagcggcguuuuaugggacguaccaaguccaccugaaacacaaaaggccgaacuagaagaaggaguauaccguaucaaacagcagggaauuuuuggaaagacacaaguaggagugggaguacaaaaggaaggaguauuccauaccauguggcaugugacacgcggggcuguucuuacacauaacgguaagagauuagaaccaaacugggcaucuguuaagaaagaucuuaucucuuacggaggaggcuggaggcuuucugcucaauggcaaaaaggcgaagaagugcaaguaauagcaguugaaccaggcaaaaauccuaaaaauuuucaaacaaugcccggaauauuucaaacaacaacuggcgaaaucggugccauagcccuugacuuuaagccagguaccucagguagcccuauaaucaacagagaaggcaaaguaguugggcuauacggcaacgggguugugacgaagaaugguggguacguaaguggaauagcgcagacaaacgcagaaccagauggucccacuccggaguuggaagaagaaauguucaagaaaaggaauuuaacuauaauggaucuacauccgggaagugguaaaacacgcaaauaucuaccagcaaucgucagagaagcaauaaagagaagacuuaggacuuuaauauuagcuccaacucgcgucguggcggcagagauggaagaagcauuaaaagguuuaccgauaagguaucaaacgacagcuauuaaaagugagcauacuggacgagaaauaguggaccuuaugugccaugcaacuuuuacuaugagauuacugucgccaguccguguuccgaacuacaaucucauaauaauggaugaggcgcauuucacagauccagcaucgauugcugcacgaggauacauaucuacacgaguaggaaugggcgaagcggcagcaauuuuuaugacagcuacgccuccagguaccgcggaagcauuuccccaaaguaacgcuccgauucaagaugaagaaaaagauauaccggagcggucauggaacucgggaaaugaguggauaacagacuuuguugggaaaacugugugguucguuccgucaauuaaagcagguaaugauaucgcaaacuguuuaaggaaaaauggcaagaaagucauucaacuaaguagaaaaacauucgauacagaauaucagaaaacucgucucaacgauugggauuuuguaguaacaacagauauaagugaaaugggagcaaauuucaaagcagacaggguuauagauccucgaaggugcuuaaaaccugucauucugacagacggaccagaaagaguuauauuagcuggaccaaugccuguuacggcggccagugcagcacagaggcgagguagaguaggcagaaacccucagaaagaaaaugaucaauacauuuuuacaggacagccauuaaauaaugaugaagaucacgcucauuggacagaagcaaaaaugcuacucgauaacaucaacacuccagaaggcauuauacccgcacuuuucgaaccagaacgagaaaagucugcugcuauugacggugaauaucgauuaaaaggcgaaagucggaaaaccuuuguagagcucaugaggcgcggcgaccuaccaguguggcucgcacauaaagucgcaucagaaggaauaaaauauacagaucgaaaaugguguuucgauggugaacguaauaaucaaauacuagaggagaauauggauguugagauauggacaaaggagggggaacguaagaaacuucgaccgcgauggcuagaugcuagaacguauagugacccgcuagcacucaaagaauuuaaagacuucgcagcaggcagaaagucgauugcacuagaccucguaaccgagauagguagggugccuucgcaccuugcacaucggaccaggaacgccuuggauaaucucguaaugcuccauacgucugaacacgggggacgagcuuaccggcacgcggucgaagaauuaccagaaacaauggaaacccuucuacuucucggucugaugauauuacuaaccgggggagcuaugcuauuucuuaucucagguaaagggaucgguaaaacgaguauaggucucauaugcguuaucguguccagcgggaugcuuuggauggcugacguuccacuacaguggauugcuagcgcaauaguguuagaauuuuucaugauggugcuacucaucccagagccggaaaaacagcgaacuccucaagauaaccaauuagccuauguggugauaggaauauuaacccuagcagcuauuguuacugcgaaugagaugggacuucucgaaaccacuaaacgagaucuagguaugaguaaagaaccgggagugguguccccuacuucauaccuggaugucgaccuacaucccgcuagugcauggacucuauacgccguagcaacaacuguuauaacaccaaugcugagacauacaauagaaaauucaaccgcaaacgugucauuagcagcgauagcuaaucaagccguugugcucaugggucuggacaaaggauggccaauaaguaaaauggaucuugguguaccacuccuugcccucgguuguuauucacaggugaacccucucacauuaacagcugcaguacugcuccuaguaacacauuaugcaauuauaggaccagggcuacaggcaaaggcaacacgcgaggcucagaaaagaacagcugcugguauuaugaagaaccccacaguggauggcauaaugacaauugaccuggaucccgucauuuaugacucaaaauucgaaaagcaacuagggcaaguuaugcuauuaguucucugcgcaguucaauuauuauugaugagaacaucaugggcguuaugugaggcacucacuuuagcaacuggaccuauuacaacuuuaugggaaggaagcccuggaaaauucuggaauacaacaauagcagugagcauggcuaauauauucagaggaagcuacuuagcgggugcaggacuugcauuuucuauaaugaagucuguagggacuggaaaaagggguacaggcucacaaggagaaacauuaggagaaaaauggaagaagaaacuaaaccaauuaucuagaaaagaguucgacuuauacaagaaaucagguauaacggaaguggaucgaacggaagcuaaagaaggucucaaaagaggugaaacaacacaccaugccguaucacgagggucagcuaaauuacaaugguucguggaacguaauaugguaaucccagaaggucguguaaucgaucuaggaugcggacgaggugguugguccuacuacugugcaggauuaaagaaaguaaccgaagugagaggauauacaaaaggcgggccaggucaugaggaaccagucccaaugaguacauaugguuggaauaucguuaaacuaaugucagggaaagacguguucuauuuaccuccagaaaaaugugacacauuguugugugauaucggugaauccucuccaagcccgacaguggaagaaucccgaacgauaaggguacucaaaaugguggaaccguggcuuaaaaacaaccaauuuugcaucaagguuuuaaauccauauaugccuacaguaauugaacauuuagagcgacuacagagaaaacacggagguauguuaguacggaacccacuuagucguaacaguacucaugagauguauuggaucuccaacgggacaggaaauauaguuaguuccguuaauauggucagccgacuguuauuaaauagguuuacuaugacacacagaaggcccacuauugagaaagauguagaucugggugcaggaaccaggcacguaaacgccgagccggaaacaccaaauauggauguaauaggcgaacgaauaaaaagaauaaaggaggagcacucaagcacauggcauuacgaugaugaaaacccauacaaaacuugggccuaccauggaucuuaugagguaaaagcaacaggaagugcaucaagcaugaucaauggaguaguaaaacuacuaacaaaaccuugggacgugguucccaugguuacacagauggcuaugacugauacuaccccuuuuggucagcaaagaguauucaaagaaaagguagacacaagaacgccucgaccaaugccaggaacacgaaaaguaauggaaauaacagcagaauggcuauggaggacacuuggacggaacaaaagaccacgacucugcacgcgagaggaguucacuaagaaaguaagaacaaaugcggcgaugggugcaguauuuaccgaagagaaucagugggacagugcgcgggcugcaguagaagacgaagaauuuuggaaguuaguugacagagaaagagaacuucauaaacuagguaaauguggaaguugcguauauaauaugauggguaaaagggagaagaaauugggcgaguucggaaaggcuaaaggaaguagagcaauaugguacauguggcuaggagcgagguaucuagaguuugaggcgcuuggauucuuaaaugaagaccauugguucaguagagagaauaguuacucaggaguagaaggagaaggacuucacaaacucggauauauucuuagagacauaucuaaaaucccgggaggugcaauguaugccgaugauacagccgguugggacacacgaauaacagaagaugacuuacacaaugaagagaaaaucacgcaacaaauggauccagaacaucgacaacuagcuaaugcaauuuuuaaacuuaccuaccaaaauaagguagugaaaguucaaaggccuacgccaaagggcacaguuauggacauuauaucaagaaaggaucagcgugguucaggucaaguagggacauacggauuaaacacuuuuacaaauauggaagcccaacuuguucgucagauggaaggcgaagguguguuaucgaaaguugaccuugaaaacccacauuuacuagagaaaaagaucacucaaugguuagaaacgaaaggaguggagcgucuacgaaggauggccauaucaggugacgauugcgucguaaaaccaauagaugaucgguuugcuaaugcauuacuggcccucaacgauauggguaagguucgaaaagauaucccacaguggcaacccucuaaaggcuggcaugauuggcaacaagugccauucugcucucaccacuuccaugaacuuauaaugaaagauggcagaaaauuaguuguaccauguaggccccaagaugaauuaauagguagagcuagaaucucacaaggcgcugguuggucauuaaaggaaacugcgugccuuggaaaagcguaugcgcaaauguggaguuuaauguauuuucauagacgcgaccuaagauuagcuucgaaugcgauuugcucggccgucccagugcauuggguuccaacgucgcguacaacguggagcauccaugcgcaucaccaauggaugaccacagaggauaugcuuacaguuuggaaccgaguauggauagaggauaaccccuggauggaagauaagacaccagugacaacgugggaagacguaccauauuuagggaaacgugaagaccaauggugugguagucuaaucggauuaacgagcagagcgacuugggcccagaauauccugacagcaauacagcagguaagaaguuugauaggcgacgaagaguucuuagauuauaugccaagcaugaaacgauuucggaaagaagaagaguccgaaggagcuauaugguaa

SEQ ID NO: 23286 - RNA, 9873 nt, Artificial Sequence
  derived and/or modified CDS sequence (opt6) from DENV-3__FJ744729__SS-prME
acaaguuugugucuaaugaugauguuaccagcgacucuagcauuucauuugacaucacgagauggugaaccacgaaugauugucgccaaaaaugaaagaggaaaaaguuuacucuucaaaaccgcaucuggaaucaacaugugcacucuaauugcgauggaccuaggagaaaugugugaugauacaguaacauauaaauguccacucauagcagaaguggaaccagaagauauagacuguugguguaaucugacaaguaccuggguaacauaugguacaugcaaccaagcaggagaacaccgaagggacaaaagaaguguagcauuagcuccacacguuggaaugggucuagauacucgaacccaaacuuggaugucagcugaaggugcuuggaggcaagucgaaaaaguagaaacuugggcucugcgacacccaggauucacaauccucgcacuuuuucuggcacacuauauuggaacuucucugacgcaaaaagucgugauuuuuauauuauugaugcuaguaacgccgucgaugacuaugcgcuguguuggaguaggaaaccgagacuucguagaagguuugucaggugcuacauggguugauguuguauuggaacacggaggaugcguaacuaccauggcuaaaaacaaaccaacgcuagacauugaacuacagaaaacugaagcgacacaauuagccacacugagaaaacuaugcauagaaggaaaaauaacuaacauuaccacagacucgcgguguccaacucaaggagaagccaucuugccagaagaacaagaucagaauuauguguguaaacauacauauguugaccgaggaugggguaacggauguggacuguuugggaaagguucccuaguaacaugugcaaaauuucaaugcuugaaaccaauagaaggaaaagugguucaacacgaaaacuuaaaauauacugucauuauaacuguacauacgggagaucaacaccaagucggaaacgacacacaaggagucaccguugaaauaacaccacaagcaucaacagucgaagcaauacuaccagaauacgggacucucggucucgaauguucuccacggacuggauuagacuuuaaugagaugauucuauugacaaugaaaaacaaagccuggaugguucacaggcagugguuuuucgaucuaccguuaccauggaccaguggagccacgacugaaaccccgacguggaaucgaaaagaauuauugguaacauuuaaaaaugcacacgcuaagaaacaagaggucgugguacucggaucucaagaaggagcuaugcauacggcucugacaggagcuacagaaauacaaaauagcgggggaaccagcauauucgccgggcaccugaaauguaggcuaaaaauggacaagcuagaacuuaagggaaugucguaugccaugugccuaaacacguuuguccuaaagaaagaggucucugaaacacaacacggaacuaucuuaauaaaaguugaauauaaaggcgaagaugcaccaugcaaaauuccguuuucaaccgaagauggucaagggaaagcucauaacggccgacugauuacagcaaauccaguaguaacuaagaaagaagaacccgugaacauagaggcagagccaccguuuggagaaagcaacaucguuauugguauuggcgauaaagcgcuaaaaauaaacugguauaagaaagggagcaguaucgggaaaauguuugaagcaacugccagaggcgccaggagaauggccaucuugggggauacugcuugggauuucgggucuguagguggcguuuuaaacucgcuugggaaaaugguucaucagaucuuugggucagcauacaccgcacuuuucucaggcgucucauggauaaugaagaucggaauaggaguacuacucacuuggaucggacuuaauucuaaaaacacaaguaugucauuuucaugcauaguuaucgggauaauaaccuuauaucuuggggcaguuguucaggcagauaugggaugcguaauaaacuggaaaggaaaggagcucaaaugcgguagcgguauuuuuguuacgaaugaagugcauacuuggaccgaacaguacaaauuucaagccgauucaccaaagagacuagcaacugcuaucgcgggagcuugggaaaacgguguaugugggauaaggucaacuacacguauggaaaaucuuuuauggaaacaaauagccaacgagcuuaauuacauccuaugggaaaacaauauuaaguugacaguaguaguaggcgacauuauaggcgugcuugagcaagguaagcgaacccuaacgccucagccuauggaauuaaaauacucuuggaaaacaugggguaaggcaaaaaucguaaccgcagaaacacaaaacuccagcuuuauuauagacgggcccaacacacccgaguguccaucugccucaagggcauggaacguuugggaaguagaagacuacgguuuuggaguguucacaacaaauauauggcuaaaguuacgugaaguauauacucagucaugugaucacagguuaaugucggcagcaauuaaagacgaaagggcaguacaugcugauauggguuacuggauugagucucagaaaaacggcucguggaaacuagagaaggcuucguuuauagaaguuaaaacauguacauggccaaagagccacacgcuauggaguaacggagugcuggaaagcgauaugauuauuccaaaaucauuagcaggcccaaucucucaacacaaccauagaccggguuaccacacacaaaccgcaggaccuuggcaccuugggaaacucgagcucgacuucaauuauugcgaggguacaacaguggugauaacggaaaacugcggaacaagaggucccagcuuacgaacaacaaccgugaguggaaaauugauucacgagugguguugcaggaguugcaccuuaccuccacuaagauauaugggagaagacggauguugguacggaauggaaauuagaccuauaaaugagaaagaagaaaauauggucaagucacuuguaucagcuggaagugguaagauggauaacuuuacaauggggauacucugccuagccauccuuuucgaagaaguuaugcgaggaaaauucggcaagaaacauaugaucgcgggaguauuauuuacguucguauuauuacuaagcggacaaauuacauggagagacauggcacacacuuugauaaugauuggaucgaacgcaagugacagaauggggaugggagugacauacuuagccuugaucgcaacauuuaagauccagccauuucuugcauuaggauuuuuccucagaaaacuuacgaguagagagaaccuuuuguugggugugggucucgcaauggcuacaacccuucagcuaccagaggacauagaacagauggcaaacggaaucgcacucggucuaaugacgcuaaaacucauaacgcaauuugaaacauaucaauuauggacugcguuagucucacuaacaugcagcaauacuauauuuacauuaacuguagcguggagaacugccacacuaauucuagcaggcgucucuuuauuaccacuaugucaaaguucaucaaugagaaaaacugauugguuaccgaugacuguagccgccaugggugugccaccgcuaccucuguuuaucuuuaguuuaaaagacacaccaaaacgaaggucguggccguuaaaugagggagugauggcaguaggcuuaguaucaauauuagcgagcucacuacuacgaaacgacguacccauggcaggaccgcuaguugcuggcggacuauugauugcguguuacgucauaacuggaaccucugcggaucucacgguugaaaaggcagcggacguuacgugggaagaggaagcggagcaaaccggcguuucccacaacuugaugauaacggucgacgaugacggcacaaugagaaucaaagacgaugaaacggagaauauauugacagucuuauuaaagacggcccucuuaaucguaagcggaauuuucccuuauucaauaccagcaacuuuauuaguauggcacacuuggcaaaagcaaacgcaacggagcggcguacuaugggauguuccaucuccgccagaaacacagaaagcagaacuugaagagggugucuauagaaucaaacagcaagguauuuuuggcaaaacacaaguaggugucgggguucaaaaggaagguguuuuccauacaauguggcauguuacccgcggcgcaguauuaacacacaauggcaaaagacuugaaccaaacugggcuaguguuaagaaagaucuaauaucauacgggggaggauggaggcucagugcucaauggcaaaaaggcgaggagguucaaguaauugccguagagccaggcaaaaaucccaaaaacuuccaaacuaugccaggaauauuucaaacaacaacaggagaaauaggagcaauugcauuagauuucaagccuggaacaaguggaaguccaauuauaaaccgagaggggaagguagugggauuguacgguaaugguguaguaaccaaaaauggaggauauguuucaggaauugcacagaccaaugcggaaccagacgguccaacacccgaguuagaggaagaaauguuuaagaaaagaaauuuaacgauaauggacuugcauccuggaagcgguaaaacucguaaauaucuaccagcaauuguaagagaagcgauaaaacgaagacuacguacucuaauauuagcaccaacacggguuguagcagcggaaauggaagaggccuugaaaggucucccgauaagauaucagacaacugcuaucaagucggagcacacgggacgcgaaauaguugauuuaaugugucaugcaacauuuacaaugcgacuccuaucuccugugagggugccuaacuauaaucuaauuaucauggaugaagcucauuuuacagauccagcgaguauugcggcacgaggcuacauaucuacucgcguagggaugggugaagcagcugcaauuuuuaugacugcuacgccaccaggaacagcggaggcauuuccacagaguaacgcuccaauacaagacgaagaaagagauauaccagaaaggaguuggaacagcggaaacgaguggauaacagauuuugucgggaaaacaguaugguuuguaccaucuauaaaggcuggaaacgauauagcaaauugucuaaggaaaaauggcaagaaaguaauccaauuaagcaggaagaccuucgauacagaauaccagaagacacgacugaaugacugggacuucguugucacaacugauauuagugaaaugggagcuaauuucaaagcagacagaguuaucgacccacgaaggugucucaaaccagucauuuuaaccgauggaccugaaagagucauacuugccgggccgaugcccgucacugcagcuucagcagcucaacggaggggacgagucggaagaaauccucaaaaagaaaacgaccaguauauuuuuacugggcaaccucuuaauaaugaugaagaccaugcucacuggacagaggcuaaaauguuacuugauaacauaaacacuccugaggguaucaucccagcauuauuugagccggagagagaaaaaucagcugcuaucgacggugaauauagacuaaaaggagagucgcguaagaccuucguagagcugaugcgacgcggagacuugccuguauggcuugcacauaaaguagcaucugaaggaauuaaauacacugacagaaaaugguguuucgacggagaaagaaauaaucaaauccuagaggaaaacauggacguagaaauauggacaaaagagggagaacgaaagaagcugcgaccaagaugguuagacgcgcgaacauauagugacccacuugcauugaaggaguuuaaagauuucgccgcaggucgaaaaucaauugcacuugacuuaguaacugaaauagggagggucccuucgcauuuagcacauaggaccagaaaugcauuagauaaccuggugauguugcauaccucggaacacggcgguagagcauacagacaugccguggaagaguuaccagaaaccauggaaacuuugcuacuauuaggacuaaugauccuccuaacuggaggagcgauguuauuuuuaauaucagguaaaggcaucgguaaaacaucgauaggccugaucugugugaucguuuccagcgguaugcuguggauggcugauguuccgcuucaguggauagcauccgcgauaguacuagaguucuuuaugaugguccuccuuaucccugaacccgaaaagcagcgaacgccacaggacaaucaauuggcuuacguaguaauuggcauauuaacucuagcagcaauuguaacugccaaugaaaugggacuucuagagaccaccaagcgggaucuuggaaugucuaaagaacccgguguggugaguccuacgucuuaucuggaugucgaucugcauccagcaagugcauggacucuauacgcaguggcuacuaccguuauaacucccaugcucagacauacuauugaaaauagcaccgccaacguuagucuagcagcaauagcaaaucaagcagucguucugaugggauuggauaaaggauggccgauuucaaaaauggacuuaggagucccacucuuagcguuagggugcuauucccaaguaaacccguugacacucaccgccgcaguguuauuauugguuacacauuacgcaauaauagguccaggauuacaagcaaaagccacucgcgaagcacaaaaacgaacagcagcagguauaaugaaaaacccaaccguagacggaauaaugacuauugauuuagacccagugauauacgacaguaaguucgagaaacaacuagggcagguaaugcuauuaguacuaugugcaguacaauugcuacuaaugagaacaaguugggcuuugugcgaagcccucacguuagcaacuggacccaucacgacuuuaugggaaggaaguccuggcaaauucuggaauacaacgauagcuguaucuauggccaauaucuuucggggcucuuaucucgcaggcgcuggcuuggcauucucaauuaugaggaguguaggaacugguaaacgaggaacggguagccagggugagacucucggcgaaaaguggaagaagaaacugaaucagcuuucgcgaaaagaguuugaucuauauaagaaaucugguauaacugaggucgaccgcaccgaagcaaaagaaggacuuaaaagaggggagaccacacaucacgcuguaucccgagguuccgccaaacuacaaugguucguagagagaaacaugguaauuccagaaggacgagugauagaucuagguugcggucgggguggauggucauauuacugugcaggauugaaaaagguaaccgaggucagaggguauacaaaagguggaccaggccacgaagaaccuguaccaaugucaacauauggguggaauauaguuaaacuuaugucuggaaaagauguauuuuaucugccuccagaaaaaugugacacguuacucugugauaucggugaguccagcccaaguccaacagucgaggaaagcagaacaauucguguccucaaaauggucgaaccuuggcucaaaaauaaccaauuuuguauaaagguacugaauccuuacaugcccacaguaauugagcaucuagagcgucuucaaagaaaacacggaggcauguugguaaggaacccacuuagccgaaauagcacucaugagauguauuggauuaguaacggcacaggaaacauuguaagcucaguaaauaugguaucucgcuugcuauugaauagauuuacaaugacacaucguaggccaacaaucgaaaaggaugucgacuugggcgcaggaacgcgucauguaaaugcggaaccagaaacgccuaauauggacguaaucggagaaagaauaaagcgcauuaaagaagaacacucuucuacuuggcauuacgacgaugagaauccauacaaaacaugggcguaccacggaaguuacgaagucaaagccacgggaucagcaagcaguaugaucaaugggguuguuaaauugcuuacuaaaccaugggauguaguaccaauggugacacagauggcuaugacggacacuacuccguuugggcaacaaagggucuuuaaagagaaaguugacacgcguacaccgagacccaugccuggaacaagaaaaguaauggaaauuacagcagaauggcuauggcgaacacuugggagaaauaaaaggccaaggcuuuguacucgcgaagaguucacgaagaaaguacggacuaacgcugcaaugggggcuguauucacagaagaaaaccaaugggacucagcaagagcagcuguagaagacgaagaguucuggaaguuagucgauagggaaagagaauuacauaaacuuggaaaauguggaaguugcguauacaauaugaugggaaaacgugagaagaaauuaggggaguucgguaaagcaaaaggaucccgggccauaugguacauguggcuaggggcuagauauuuagaguucgaagcauugggauuucuaaaugaagaccacugguuuaguagagaaaauagcuauagcggaguagaaggggaaggucuucacaaguuaggguauauucuaagggauauuagcaaaauaccgggcggcgcaauguaugccgaugacacugccggaugggacaccagaauaacagaagacgaucuucacaaugaagagaaaauuacacaacagauggauccagaacauagacaauuggccaacgcaauauuuaaauuaacguaccagaauaagguagucaagguacagcgaccuacgcccaaaggaacggucauggacauaauuuccagaaaagaucaacgaggaagugggcaagucggcacguauggucuuaacacauuuacuaacauggaagcucaauuaguucgucaaauggaaggugaagguguauugucaaaaguugauuuagaaaauccacacuuauuagagaagaaaauuacucaaugguuggagacaaagggcgucgaaagacuacgcagaauggcaauaagcggcgacgauuguguaguaaagccaauagaugaccgauuugcaaaugcauuauuagcccuaaaugacauggguaagguucggaaagacaucccacaauggcaaccaucuaagggauggcaugacuggcagcaaguuccauuuuguagccaccacuuucaugaauuaauaaugaaagaugguagaaagcuaguuguacccuguagaccacaggacgaauugauugguagggcccgcaucucacagggagccggcugguccuuaaaggagacagcgugucuugguaaagcauaugcacaaauguggucgcuuauguacuuucacagaagagaucugaggcuggcgaguaacgccauuuguagugcaguaccagugcauuggguaccuacuagccguacuacaugguccauacacgcacaccaccaguggaugacaacugaagauaugcuaacaguuuggaauagaguauggauagaagauaaccccuggauggaagauaaaacaccuguuacgacaugggaggauguucccuaccuugggaaacgggaagaccaaugguguggaucccugauuggauuaacaucccgagccaccugggcccagaauauacuaacggcaauucaacaaguaaggucacuaauaggagaugaagaauuucuagacuacaugcccagcaugaaaagauuuaggaaagaagaagaauccgaaggggcaaucugguaa

SEQ ID NO: 23287 - RNA, 9873 nt, Artificial Sequence
  derived and/or modified CDS sequence (opt6) from DENV-3__FJ687448__SS-prME
accucauuaugucuaaugaugaugcuacccgcgacacuugcauuccaucuaacgucucgagauggagaaccacguaugauuguugccaaaaacgaaagaggaaaaucacuacuuuuuaaaacugcaucuggaauuaacaugugcaccuuaauagcgauggauuuaggagaaaugugcgaugauacaguaacauauaaauguccucuaauagcggagguagaaccagaggauaucgauuguugguguaaucuaacaucaaccuggguaacauacggaacauguaaucaagcuggcgaacacagacgggauaaacgaucaguagcacuagcaccacaugugggaaugggccuagacacacggacucaaacguggaugagcgcagagggggcauggaggcaaguagaaaaaguagagaccugggcauuacgucauccuggauuuacuauauuagcacuuuuccuagcgcauuacaucggaaccucucuaacacaaaaaguuguaauauuuauccuguuaaugcuuguaacaccaaguaugacaaugcgauguguaggggucgguaauagagauuucguugaaggccuaucaggggcuacguggguagacguaguacuggaacacggcgguuguguaacaacaauggccaaaaauaaaccaacucuugauauagaacuucagaaaacggaggcaacacaacuagcaacgcugcguaaauuguguaucgaaggcaaaauaacgaacauaaccaccgauucgcgcugucccacacaaggagaggcaauacuucccgaagaacaagaucaaaauuaugucuguaaacacaccuauguagacagagguuggggcaacgggugcggccuauuuggaaaagggagcuuaguuacgugcgcaaaauuccaaugucuggaacccauagagggaaaaguaguucaacacgaaaauuuaaaauauacagucauaaucacagugcacacgggcgaccaacaccaagugggaaaugauacacaaggaguaacaguagaaauaacgccucaagcaaguacuguagaagcaauacuaccagaauaugguacuuuagguuuagaauguucgccuagaacaggguuggacuucaacgaaaugauccuucuaacaaugaaaaauaaagcauggaugguacaccgucaaugguucuucgaccuaccguuaccauggaccucaggagcaaccacggaaacaccaacauggaauaggaaagaacuucuugucacauucaaaaaugcccaugccaagaaacaagaaguugucguccucgggucacaagaaggugccaugcacacagcauuaaccggugcaaccgaaauacaaaauagcgggggcacuucgaucuuugcaggacaucugaaauguaggcugaaaauggauaaauuggaauuaaaagguaugucauaugcaaugugucugaauacuuucguuuugaaaaaggaaguaagugaaacccaacacggaacaaucuuaauaaaaguugaauauaaaggagaagacgcccccuguaaaauuccauuuucaacagaggauggacaagggaaagcccauaauggaagauugaucacagcaaacccgguagugacaaagaaagaagaacccguaaacauagaagcggaacccccauuuggggaaagcaauauugugauuggcauaggcgacaaagcauuaaaaauuaacugguacaagaaagguucuuccauuggaaaaauguuugaagcaacugcuagaggugcacgacggauggcuauucugggagacacagcuugggacuucggaagugucggagggguauuaaacucccucggaaaaaugguucaucaaaucuucgguagcgccuacacagcauuauuuaguggcguaucuuggaucaugaaaauagguauagggguauuauuaacauggauuggacuuaauaguaaaaauacaucaaugucauuuucaugcaucguuauagguauaauuacacuauauuugggagccgugguucaagcagauauggguuguguuauaaauuggaagggaaaagaauuaaaaugcgggagcggaauauucgucacaaaugaaguacacacguggacggaacaguauaaauuucaagcagauagcccaaaaagacuagcgaccgcaauagccggugcaugggaaaauggaguguguggaaucagguccacgaccaggauggagaauuuacuauggaagcagauagcaaaugagcuaaacuauauacucugggaaaauaauauaaagcuaacgguaguugucggagacauaauuggaguuuuggaacaggguaaaagaacuuuaaccccacaaccaauggaacuuaaguauucuuggaaaacuugggguaaagcgaagauuguaacagcagaaacacaaaacucgucuuuuauaauugauggucccaacacuccagaauguccuagcgcaucgagagccuggaacguuugggagguagaagacuacggcuuugguguauucacuaccaauaucuggcuaaaauugagagaaguuuacacgcaauccugugaccauagacugaugucggcugcaauuaaggacgagcgggcaguacaugcugauaugggcuauuggauagaaucacagaaaaacggcucauggaaauuagaaaaagcaaguuucauagaaguaaaaacgugcacuuggcccaagucacacacauuauggucaaacggcguguuggaaagugauaugaucauaccaaagucgcuugcuggaccaauuucacaacauaaucaccguccuggauaccauacucaaacagccggcccuuggcaucucggaaagcucgaauuagacuuuaauuauugugaaggaacuacggucgucauuacugaaaauuguggaacgaggggcccaagucuaaggacaacgacuguaucuggaaaguugauucaugaaugguguugcaggucgugcacucuacccccauuaagauauaugggggaagauggaugcugguauggaauggaaauuagaccaauuaacgagaaagaggaaaauauggugaagagucugguaagugccggaucggggaagauggacaauuuuacuaugggaauacuuuguuuagcaauucuuuucgaggaaguaaugcgaggcaaauuuggcaagaaacauaugauugccggugugcuauuuaccuucgucuuacuuuugaguggacaaauaacguggagagauauggcucauacucuuauaaugauagggaguaacgccagugauagaauggguaugggaguaacauaucuggcacucaucgccacauucaaaauacaaccguuucucgcgcuaggauuuuuccucagaaaauuaacaucacgagaaaauuuacuauuaggcguuggacuggcaauggcuacaacguugcaacuaccggaagauauagaacaaauggcuaacgggauagcacuagguuugaugacgcucaagcuaauaacacaguuugaaacuuaucagcucuggacugcccuugugagucuaacaugcagcaacacaauauuuacacucacgguggcuuggagaacggcaacacuaauacuagcugguguaucacuuuuaccucuuugucaaagcaguuccaugaggaaaacagauuggcuacccaugacaguggccgcaaugggagucccaccucuaccuuuauucauauuuagucuaaaagauacaccuaaaaggcggaguuggcccuuaaacgaggguguaauggcaguuggcuuaguuaguauauuagcgucaucuuugcuaagaaaugacguuccgauggcaggucccuuaguagcgggagggcuccuuauagcaugcuauguaaucacaggaaccucagcagaucugacaguggaaaaagcggcugacguuacuugggaagaggaggcagaacaaacaggcguuucccauaaccuaaugauuacggucgaugacgauggaacaaugagaauaaaagacgacgaaacggaaaacauacuuacggugcuacuuaaaacagcgcuuuuaauaguaaguggaauauuuccauacucuauaccagccacucuccuaguuuggcauacauggcagaaacaaacgcaacgaucagguguauuaugggacguaccaaguccacccgaaacucagaaagccgaguuagaagaagguguauaucgaauaaaacagcaagguauuuucggaaaaacacaaguaggagugggaguucaaaaagaagguguuuuccacacaauguggcacgugaccagaggagcaguccugacucauaaugggaaaaggcuagaacccaauugggcgagcguaaagaaagauuuaauuucuuauggaggagguuggagauuaagcgcacaguggcagaaaggugaagaaguacaagugauagcaguugaaccagguaaaaauccgaagaauuuccaaacuaugcccggaauuuuucaaacgaccacaggagaaauaggcgcaaucgcucuugacuuuaagccaggaaccuccgggagcccuauuauaaauagagaagggaaagucguaggauuguacggaaauggagugguuaccaaaaauggagguuacguuucugggauagcacagacgaaugcggaaccagauggaccaacaccagaauuagaagaggaaauguuuaagaaacgaaacuuaacgauaauggaucuccauccagguagcgguaaaacaagaaaauaucuaccagcuauuguaagggaggcuauuaaaagacgcuuacgaacacuuauacucgcaccaacccggguaguggcggcggaaauggaagaagcauuaaaaggacugccaauuagauaucaaacaaccgcuauuaaaagcgaacauacgggucgagaaauaguagacuuaaugugccaugccaccuuuacuaugagacugcuaucgccaguaagaguucccaacuauaaucuuaucauaauggacgaagcccacuuuaccgacccggcaagcauagcagccagaggauacauuaguaccaggguuggaaugggugaagcagcugcgauauucaugaccgcgacuccgccagggaccgcggaagcauucccacaaucuaacgcccccauucaagacgaagaaagagauauaccagaaaggaguuggaacucaggcaacgaauggauaacugacuuuguaggaaaaacugucugguuugucccaagcaucaaggcagggaacgauauagcuaacugucugaggaaaaaugggaagaagguaauccaauuaucgcggaaaacauucgauacagaauaucagaaaacacgacuaaaugacugggauuuugucguuacaacagauaucagcgaaaugggagcaaauuucaaagcugacagaguaaucgauccuagaaggugcuuaaaaccugugauacuaacugaugguccggaaagggucauacucgcaggaccuaugccaguaacggcggcgagugcugcgcaaaggcgaggacgcgugggaagaaacccacaaaaggaaaaugaccaauacauauuuacgggacaaccacuaaauaaugacgaggaccacgcacauuggacugaagccaaaauguuauuggacaauaucaacacaccggaaggcauaauaccugcucucuucgaaccagagagagaaaaaucggcggcuauugauggagaguaucgacucaaaggugaaucgcgaaaaacguuuguggaacugaugcguagaggugaccugccagucuggcucgcacauaagguagcaagugaaggcauaaaauauacggaucguaaauggugcuucgauggagaaagaaacaaccaaauacuagaagaaaauauggauguggaaauauggacaaaagaaggugagcguaagaaacuacgaccacgaugguuagaugcucgaacauauagugauccauuagcauuaaaggaauuuaaagacuuugccgcagggagaaaaaguauagcccuagauuuagucacggaaauaggccgcguaccaagucaucuagcacauagaacccgaaacgcgcuggacaaucuaguuaugcuacauacaucugaacaugguggcagagcuuauagacacgcuguggaagaacucccagaaaccauggagacgcuacugcuauuaggguugaugauacuauuaaccggaggagcaaugcucuuuuuaauaagcggaaaaggcauagggaaaacaaguauaggccuaaucugcguaauaguaucuaguggaaugcuauggauggcagaugugccauugcaguggaucgcaucagcuauuguguuggaauuuuucaugaugguccuacuaauuccugaaccagaaaaacaaagaacuccucaagauaaucagcuugcauauguaguuauagguauacuaacauuggccgcgauaguaacagcuaaugagauggggcugcuagaaaccaccaagcgagaccuaggcauguccaaagaaccagguguuguuagcccaaccuccuaucuagauguagaucuacacccagcaagugcauggacauuauacgccgucgcgaccacagucaucacgccaaugcugagacauacaauagaaaacucgacagcaaauguaagucuagcagcaaucgcaaaccaagcaguagugcucaugggccuagacaaaggauggccaauuucaaaaauggacuuaggaguaccacuacuagcgcuuggauguuacucacagguuaacccccugacacuuacggcugcuguguuacuccuaguaacucauuaugccauaauaggcccuggauuacaagcgaaagcuaccagagaggcacagaaaagaacagcagcagguauaaugaaaaauccaacaguagacggaauaaugacgauugacuuggauccagugauauaugacagcaaguucgaaaagcaauuagggcaaguaauguuacuuguuuuaugugcagugcaacuccuguugaugagaacaaguugggcauuaugugaggcuuuaacguuggcaacgggcccgauaacuacacucugggaaggaucgccuggaaaauuuuggaauacgacgauugcaguaucuauggccaauaucuuucgcggcucauaucuggcgggugccggcuuagcguucaguauaaugaaaagugucggaacggguaaaagagguacaggaucucaaggggaaacgcugggugaaaaguggaagaagaaacucaaccaguuaagccguaaggaauuugaucuuuauaagaaaucaggaaucacugaaguagauagaacagaagcuaaagagggucuaaaacgcggagagacuacacaccaugcaguaagucgaggaagcgcaaaguuacaaugguuuguagaacgaaauaugguaauuccggaagguaggguuauagauuuaggguguggaagggguggauggaguuauuacugcgcuggacuaaagaaagugacagaaguuagaggauacacuaaggguggcccuggacaugaagaacccguacccaugucuacguauggauggaacauuguuaaauugaugagcggaaaggacguauuuuaucugcccccggaaaaaugugauacguuauuaugcgacauuggagaaagcaguccaucaccaacgguagaagagagccggacuauaaggguuuuaaaaauggucgaaccauggcucaaaaacaaucaauucugcaucaaggugcuuaauccuuauaugcccaccgugauagaacauuuggaacgccuacagcgaaaacauggugggauguuaguaagaaauccauuaagucgaaauagcacacacgaaauguacuggauaaguaauggcacagguaauauagucucuaguguaaauaugguuucaagguugcuacuaaauagauuuacgaugacacaccggcgaccuacaauagaaaaagacguggauuuaggugcugggacaaggcacgugaaugcagagccugagaccccuaacauggacgugauaggugagcgcauaaagagaauuaaggaggagcauaguucaacuuggcacuacgaugaugagaauccauauaaaacaugggcauaucacggaucauaugaaguaaaagcgacugggucggcuaguucaaugaucaacggaguagucaaguuauuaacaaaaccgugggacgucgucccuaugguaacccagauggcaaugacagauaccacaccauucggacaacaacgugucuucaaagaaaagguugauacucggacuccccggccuaugccgggaacgcgaaaaguaauggaaauuacagcagaguggcucuggaggacacucgguagaaauaaaagaccaagauugugcacacgugaagaauuuacgaaaaagguccgaacuaacgccgcuaugggggcaguauuuacugaggaaaaccaaugggacucggcgcgcgcggcaguugaagaugaagaguuuuggaagcuaguugaccgugagagggaauuacacaagcucggaaaaugcggauccugcguauacaacaugauggggaagagagaaaagaaauuaggagaguucggaaaggcaaaagggucgcgagcaauaugguacauguggcuaggggcacgauaucuggaauuugaagcgcuaggcuuucuaaaugaagaccauugguucucuagggaaaauagcuacagugguguggaaggcgaaggauuacauaagcucgguuacauacuaagagauauaagcaagauaccaggaggagcuauguacgcugacgacaccgccgggugggacacucgcauaacugaagaugauuuacacaaugaagagaaaauaacacaacagauggauccagaacacagacaacucgcaaaugcgauuuuuaaauuaacauaucaaaacaaaguggugaaaguacagcgcccaacaccaaaaggcacggucauggacauaauuagcaggaaagaucagagagguucagggcaaguaggcacauacgggcuuaauacguucacaaauauggaagcucagcuaguaagacaaauggaaggagaaggcguacuguccaaagucgaccuggagaauccacaucuacuugagaagaaaauaacucaauggcuugaaacaaagggaguugagagauuaagaaggauggcaauaucgggugaugauugcgucguaaaaccaauagacgacagauuugcaaaugccuuauuagcguuaaaugauauggguaaggugagaaaagauauuccucaauggcaaccauccaaaggguggcaugauuggcaacagguuccauuuugcucucaucacuuccacgaauuaauaaugaaggaugggcguaaauugguaguaccaugcaggccucaagacgaguuaaucggacgugcacgcaucucacaaggugcuggauggaguuuaaaggaaacugccugucuaggaaaagcauaugcucaaauguggucacuaauguacuuccacagacgggacuuaagacucgccagcaacgcaauuuguucagcagucccuguacacuggguuccaacaucgcgaacaacauggucaauacaugcucaccaccaguggaugacuacggaagacauguuaacuguuuggaaccgcgucuggauagaagauaaccccuggauggaggauaaaacacccgucacuaccugggaggacguaccuuaucuaggcaaacgcgaagaucaaugguguggcaguuuaauaggauuaacaucuagagccacaugggcucaaaauauauuaaccgcgauacaacaaguaaggucucuuaucggggaugaagaauuucuggauuauaugccuucuaugaaacgauucaggaaggaagaggaaucggagggagcaaucugguaa

SEQ ID NO: 23288 - RNA, 9873 nt, Artificial Sequence
  derived and/or modified CDS sequence (opt6) from DENV-3__FJ744732__SS-prME
acuucuuuaugucuuaugaugaugcuacccgcaacacuggcguuucauuuaacuucuagagauggcgaaccgcgcaugauuguggcgaaaaacgaacgaggcaaaagccucuuauucaaaacggcaagcggaauuaacauguguacacuaaucgcgauggauuugggugaaaugugugaugauacgguuacauauaaauguccauuaauagcggaaguagaaccggaagauauagauugcugguguaauuuaacuucaacauggguuaccuacggaacauguaaccaggcuggagaacaucggagagauaaacgcucaguugcucuagcgccacacguuggaaugggccuggauacaaggacacaaacauggaugagugcagaaggagcauggagacaaguagaaaaaguagagacuugggcuuugaggcauccuggcuucacaaucuuagcuuuauuuuuagcucauuacauagggacaagucuaacucaaaaaguggucauuuuuauccuacuaauguuggucacaccaucuaugacaaugagaugcgugggcguaggcaaccgagacuuuguugaaggccucagcggggcaacauggguagauguaguacuugaacacggcggauguguuacgaccauggcuaaaaauaaaccuacauuggacauagaauuacagaaaacggaagcaacccagcucgccacguuaagaaaacuuugcauagaaggaaaaauaacuaauauaacaaccgacucucgcuguccaacacagggagaagcuauuuugccagaagaacaggaccagaacuacguauguaaacacacauaugucgauagaggaugggguaauggcugcggcuuauuuggaaaagggagcuuaguuacuugcgcaaaauuucaaugucuagagccaauugagggaaaaguuguccagcaugagaacuuaaaauauacuguaauaauuacaguucacacgggugaucaacaucaaguagguaacgauacccaaggaguuacagucgaaauaacaccacaggcuucaacaguagaagcgaucuuaccugaauacggcacccugggacuugaauguucgccaaggacaggacuagacuuuaaugaaaugauacuauugacaaugaaaaauaaagccuggaugguacaucgacaaugguucuuugaccucccauuaccauggacuucaggcgcaacgacagaaaccccaaccuggaaucgaaaagaacugcugguaacauuuaaaaacgcacaugcuaagaaacaagagguaguagucuuaggaagucaggagggugcuaugcauaccgcccucacuggugccaccgaaauacaaaacagcgguggaaccucuauauuugccggacaccucaaaugcagacuaaaaauggacaaacuagaacucaaaggaaugaguuacgcgaugugcuuaaacacuuucguauuaaagaaagagguaucggaaacucaacauggaacgauacucauaaaaguugaauauaaaggagaagaugcacccuguaaaauaccuuuuucaacggaggauggccagggaaaggcacacaaugguaggcuuauuacagcuaaucccguaguuacuaagaaagaggaaccggugaacauagaagcggagccuccauuuggcgaaucaaauauaguaauaggcauaggcgauaaagcguuaaagauaaacugguacaaaaagggcucaaguauagguaagauguuugaagccacugccaggggagcuagaagaauggcaauccuaggugauacggcgugggacuuugguucuguuggaggaguacuuaauucauuaggaaaaaugguacaucaaauauucggauccgcuuacacugccuuauucaguggaguaucuuggauaaugaaaauuggaauaggaguucuccucacauggauaggcuugaauaguaaaaauacaucaaugucguuuuccuguauuguaauagggauaauuacauuauaucuuggggcagugguacaagcggacaugggaugcgucauaaauuggaaagguaaggaacugaaaugugguuccggcauuuuugugacaaaugagguucauacuuggacggaacaauauaaauuucaagcugauuccccaaaaagauuagcuaccgcuauugcuggagcuugggaaaauggggugugcgggauccgcucaacuacgcggauggaaaacuuacuauggaaacaaauagcaaaugaacugaauuacauccuuugggagaauaauauaaaauuaacugucguuguuggugauauuauaggaguguuagaacaaggcaaaagaacuuuaacaccacaaccaauggaguuaaaauauucguggaaaacuuggggaaaggccaaaauuguaacagcagaaacacagaauaguaguuucauuaucgacggcccaaacacaccggaauguccaagugcaaguagagcauggaacguaugggaaguagaggacuacggguucgguguuuuuacaacaaauaucuggcucaaauuaagagagguauacacccaaucaugcgaucacagacucaugucagcagccaucaaggaugaacgagcggugcacgcggauaugggauacuggauagaaagucagaaaaacggcucguggaaauuagaaaaagcaaguuuuaucgaagucaagaccuguacauggccaaaaagucauacauuauggagcaacggaguauuagagagugauaugauaauuccaaaaucacuugcagguccgaucagucaacauaaucaucguccaggcuaccauacacaaacagcaggaccuuggcauuuaggcaaguuggaauuagauuuuaacuacugugaagggacaacuguuguaauaacggagaacugcggcaccaggggaccgucacuuagaacaacaacaguuagugguaaacuaauucaugaguggugcuguagaucaugcacauuacccccacuaagauacaugggggaagacggcugcugguacggaauggagaucagaccgauaaaugaaaaagaggaaaacauggucaagagucucgucucagcugggagcggaaaaauggauaauuucacuauggguauccucugcuuggcaauacuuuucgaagaagugaugagagguaaauucggaaagaaacauaugaucgcaggaguacuauuuacuuucguauuacuacucucaggucaaauaacauggcgagauauggcacacacacucaucaugaucgggucgaaugcaagcgauagaaugggcauggguguaacauacuuagcucuuauagcaacuuucaaaauacagccauuccuugccuugggcuucuuucuacguaaauuaaccagcagagagaacuuauuguuaggaguuggacuugcuauggcgacuacgcugcaacuaccugaggauauagaacaaauggcgaacgggauagcauuaggccuaaugacacuaaaauuaauaacacaauuugaaacauaccaacuauggaccgcucuugugucauuaacaugcucgaacacaaucuucacauugacuguagcauggcgaaccgcuacgcuuauuuuagccgguguuucccuucuaccacugugucagucaagcucaaugagaaaaacagauugguugccuaugacagucgcagcaaugggagucccaccacucccauuauuuauuuucagccuuaaagacacuccaaaacgucgaucauggccguuaaacgaggguguuauggcaguaggccuuguauccauuuuagcgucaucguuauugcggaacgauguucccauggcgggcccauugguggcugguggcuuacuuauagcaugcuacgucaucacagggacaucugccgaucucaccgucgaaaaagcugcugaugucacaugggaagaagaagccgagcaaaccggggucagccauaaucuaaugauaacgguugacgacgaugguacgaugcgcauuaaagaugaugaaacagaaaauauucuaacaguauuauuaaaaacggcacuucuuauagucaguggaauuuuucccuacucuauuccggcgacguuguuaguauggcacacauggcaaaaacaaacacagagaucaggaguauugugggauguaccuucuccacccgagacacaaaaggccgaauuagaagaaggaguauaucgaauuaaacaacaagguauauucggcaaaacucaagucggaguaggaguucaaaaggaaggaguauuucacacaauguggcaugucacaagaggagccguccuaacgcacaauggaaaaagacuggagccuaauugggcaucggucaagaaagauuugauaaguuacggugguggauggaggcugucugcacaguggcaaaaaggcgaagaaguucaagugaucgcaguagagccagggaaaaaucccaaaaacuuucaaacgaugccagguaucuuccaaacgacaacuggagaaauuggagcaauugcccuugauuuuaagccaggaacgucaggaucuccuauaaucaaucgugaaggaaaaguuguaggguuauacggaaacgggguggucaccaagaauggggguuauguuucuggcaucgcacaaacaaacgcggaaccagaugguccaaccccugaguuagaagaagaaauguuuaagaaacggaauuugacaauaauggaccuccauccugguuccgguaagacuaggaaauauuuacccgcgauaguucgggaagcuauuaaacggcgccuuagaacauuaauauuggcgccuacuagaguuguagccgcugagauggaggaggcacuaaaaggguuaccuauuagauaucaaacaacggccauuaaauccgaacauacaggucgggaaauaguagaccucaugugccaugccacuuucaccaugagguuacuaucaccuguucguguaccaaauuacaaccugaucauuauggaugaagcacauuuuacggaucccgcuucuaucgccgccagaggauauauuucaacaagaguuggaaugggggaagcugcagcaauauucaugaccgccacuccuccuggaacugcugaagccuucccccagagcaacgcacccauacaagaugaagaacgagacauuccagagcguagcuggaacucaggaaacgaguggaucacugauuuugcaggcaaaaccguaugguucguuccuaguauuaaagcgggaaacgacauagcaaacugucuacggaaaaacgggaagaaagugauucaauuaucgcgaaaaaccuucgacacugaauaccagaaaacacgucugaacgauugggacuuuguaguuacaacggacauuuccgagaugggagcuaauuucaaagcagacagagucauugacccaagacguugucuaaaaccaguuaucuuaaccgauggaccagagcgcguuauauuggcaggaccuaugccugugacagcggcgucagcggcacaaagacgggguagagucggacguaauccacaaaaggaaaaugaucaauauauuuucacaggccagccucugaacaacgaugaagaccacgcgcacuggacagaggcuaagauguuacuagauaacauuaauacuccagaaggaauuauucccgcgcuauuugaaccugagcgagaaaagagugccgcaauagacggugaguaucgccuaaaaggugaaaguagaaaaacguuuguagaacuaaugagaagaggugaucugcccguuuggcuagcacauaaaguagcuucagagggaauaaaguacacugaucgaaaauggugcuuugauggagagcgaaauaaucaaauacuagaggaaaauauggacguugaaaucuggaccaaagagggagaaaggaagaaacuaaggccuaggugguuagaugcgaggaccuauuccgacccuuuggcucuaaaagaauuuaaggauuucgcggccggacgcaagucuaucgcguuagauuugguaacagaaauuggacguguaccaagccaccuugcucauagaacuagaaaugcauuagacaaccuuguaauguuacauacaagugagcauggagggcgcgcuuaucgacaugcaguagaagaacugccggagaccauggagacucuguuacuacuuggcuugaugauccugcuaacggguggggccauguuauucuuaauuagcggaaaggggauugggaaaacaucaauaggguuaauauguguaauagugagcucaggaaugcuuuggauggcugauguaccgcuccaauggauugcguccgccauuguuuuagaauuuuucaugaugguguuauuaauuccagaaccugaaaaacagagaaccccucaggauaaccaacuggcuuacgucguaauagggaucuuaacacuagcggcuauaguuaccgccaaugaaaugggacuacuugaaacaaccaaacgcgaccucgguaugucuaaggaaccaggcguaguuuccccaaccagcuacuuagauguggaccugcacccugccucagccuggacucucuacgcuguugcaacaacagucaucacacccaugcuucgacauacaauagagaauagcacagcaaacguuucgcuagcagcuauagcaaaucaggcuguaguacuaaugggacuagauaaggguuggccaaucaguaagauggaucuaggggugccucuucuagcguuagggugcuacagucaagucaauccauuaacacucacggccgccguacuacuauuaguuacacacuacgcaauuauuggucccggauuacaagcuaaagcuacuagagaagcacaaaagagaacagcugcaggaauaaugaaaaacccaacaguugacgguauaaugacgaucgaucucgauccuguuauauacgauucuaaauuugaaaaacaacuuggacaagugauguuguuggugcugugugccguucaacuccuacugaugagaacuuccugggcacuuugugaagcauuaacguuagcgacagguccuauaacaacguuaugggaagguucaccuggaaaauucuggaauaccaccaucgccguaagcauggccaauauuuuucgcggaagcuaccuagccggugcaggccuugcauuuagcauaaugaaaagugucggaaccgguaagagagggacugguagccaaggagaaacgcuaggagaaaaguggaagaagaaacuuaaccagcucucgcgcaaggaguuugaucucuauaagaaauccgggauaacugaaguagaucgcacagaagcaaaagaagguuugaaaagaggagaaacuacgcaccacgcugucagcagagguucagcaaaacuacaaugguuuguugaacgaaauaugguuauaccagaaggaaggguaauugacuuagguugcgggagagggggauggucauacuauugugcagguuugaagaaaguaaccgaaguaagaggauacacuaaaggagguccagggcaugaagaaccuguacccaugucgacuuacggguggaauaucgucaaguuaauguccggaaaggauguauuuuaucuaccaccugaaaaaugcgauacacuucugugugacauuggugagucgucucccucgccaacagucgaggagagcaggacuaucagagucuuaaaaaugguagaaccguggcuaaagaauaaucaauucugcauaaaaguauuaaauccauauaugccuacggugauugaacauuuggaaagguuacagcgaaaacauggcggaaugcuuguaagaaaccccuuaucaagaaauucuacacaugaaauguauuggauuagcaacggaacagguaauauaguguccucuguuaauaugguaucacgauuacuacuaaauagguucacuaugacacauagacgccccaccauugaaaaagaugucgacuugggagccgggacacggcacguaaaugcugaaccagaaaccccuaauauggauguaaucggagaacgaauaaaacgaauaaaagaagaacauucaaguacguggcacuacgaugacgaaaaucccuacaaaacgugggcauaucacggaucauaugaggugaaggcaacaggcuccgcuucauccaugauaaacggaguugugaaacugcuaacuaaacccugggacguuguuccuaugguaacgcaaauggcgaugacggacaccacgccuuuuggccaacaacgaguauuuaaagaaaagguagacacacgcacgccaagaccuaugccaggaacaagaaaaguaauggaaauuaccgcugaaugguuauggcgaacucugggacggaacaagcgaccuaggcuuuguacuagggaagaauuuacuaagaaaguuagaacgaacgccgcaaugggugcaguguucacagaagaaaaucagugggacucagcuagagcagcaguggaagaugaggaauuuuggaaguuagucgacagagagagggagcuacauaaacuugguaaaugugguucauguguuuacaauaugauggggaagcgagagaagaaacucggggaguucggaaaagcuaaagguagcagggcgaucugguauauguggcuaggcgccagauauuuagaauuugaagcacuaggcuuucuaaaugaagaucauugguuuagccgagaaaauagcuauucuggugucgaaggagaaggauuacacaaauuaggauacauacugagggacauaucuaaaauaccaggaggugccauguaugccgaugauacagccggaugggauacucgcauaacagaagaugauuuacacaacgaggagaaaauaacacaacaaauggaucccgagcaccgccagcuggcaaaugccauauucaaauugacguaucaaaauaaaguggugaaaguacaacgaccaacuccuaagggcaccguuauggacaucaucagccgaaaggaucaaagaggaucuggacaaguagggacuuauggacuuaauaccuucacaaacauggaagcccaguuaguaagacaaauggaaggugaggggguucucucgaaaguagaucuugagaauccacaucuucuagaaaagaaaauaacucaauggcuagaaacaaaaggcguugagcgacugagaagaauggccauaagcggagaugacugcguugugaaaccaauugaugacagguuugccaaugcguuauuggcuuugaaugacaugggaaaagucagaaaagauauaccacaauggcaaccuucgaaaggcuggcaugauuggcaacaaguaccuuucuguagccaucauuuucacgaauuaauuaugaaagacgggcguaaacuuguaguuccaugucggccucaagacgagcuaaucggccgagcaagaauaucucaaggagcgggguggagucuuaaagaaacugcuugucucggcaaagcauaugcacaaauguggucccuuauguauuuccacaggcgagaccuaagguuagccagcaaugcuaucugcucggcuguuccugugcauugggucccuaccucacgaacgacauggagcauacaugcccaccaucaguggaugacgaccgaagacaugcuaaccguguggaauaggguauggauagaagacaauccguggauggaagacaaaacgccugucaccacuugggaagacguaccauacuuggguaaaagggaggaucaauggugugggaguuugauaggucuaacuucuagagcuacuugggcgcaaaauauuuuaacggcaauccaacaaguaagaucuuuaauaggagaugaagaauuuuuagauuacaugccaagcaugaaacgauuucgaaaggaagaagaaagugaaggcgcgauaugguaa

SEQ ID NO: 23289 - RNA, 9873 nt, Artificial Sequence
  derived and/or modified CDS sequence (opt6) from DENV-3__FJ810414__SS-prME
acuucacucuguuuaaugaugauguuacccgcaacucucgcauuucaccuaacaagcagggauggggagccgcgaaugauuguugccaaaaaugaaagagguaaaucauuacucuuuaaaacagcaaguggaauuaauaugugcacauuaauagcaauggaccuuggcgaaaugugugaugauacuguaaccuauaaaugcccucuaaucgcugagguagaaccugaggauauagauugcugguguaauuugacaaguacauggguuacuuacggaacaugcaaucaagcaggcgaacaucggcgagacaaaagauccguggcauuagccccucacguagguaugggacucgauacgagaacccaaacauggaugucggcagaaggggcauggagacaaguagaaaaaguagagacgugggcacugcggcauccaggguuuacaauccucgcuuuauuccuugcacacuauauaggcaccucccuuacacaaaaaguuguaauauuuauuuuacugauguuaguuacaccgaguaugaccaugagauguguaggaguaggcaaucgagauuucguggaagggcucaguggggcaacauggguagacgugguauuagagcacggagggugcguaacaacaauggcuaaaaacaaacccacauuggauauugaauugcagaaaaccgaagcaacccaacuggccacccuaagaaaauuauguauugagggaaaaauuaccaauauuacaaccgauagucgauguccaacucaaggagaggcaauacucccugaggaacaagaccaaaauuacguuugcaaacauacauauguagacagaggauggggaaauggaugcggacuauucgguaaagggagccuagucacaugugcaaaauuucaaugcuuggaaccgauugagggaaaagucguacaacacgagaaucuaaaauauacugugaucaucacaguucauacuggagaucaacaucaagugggaaacgacacucaagggguuacaguagaaauaacaccgcaagccagcacugucgaggcaauccuaccugaauaugggacuuuagggcuagaaugcucuccacgaacaggacuggauuuuaacgaaaugauuuuauuaacuaugaaaaacaaagcauggaugguacaucgacaaugguucuucgauuugccgcuaccauggacaucuggagcuacaaccgaaacacccacuuggaacaggaaagaguuguuaguaacauuuaaaaacgcacaugcuaagaaacaagaaguuguaguucuggguucacaagaaggcgccaugcauacugcuuuaaccggcgcuacugagauacaaaauagugguggcaccagcauauucgcaggucaccuaaaaugccgcuuaaaaauggacaaauuagaacucaaaggaaugaguuacgcuaugugucucaauacuuuuguauuaaagaaagaagucucugaaacgcaacauggcacaauacugauuaaaguggaguauaaaggugaggacgcccccuguaaaauacccuuuucuacagaagauggacagggaaaagcgcauaauggcagauuaaucacagccaauccaguugucacgaagaaagaagaacccguaaacaucgaggccgaaccuccuuuuggcgaaucgaauauaguuauaggcauaggagacaaagcucugaaaauuaacugguauaagaaaggaucaucuauuggaaaaauguuugaggcuacggcucgcggcgcaagacgcauggcaaucuuaggcgacacagcaugggauuucggaucuguuggcggaguccuaaauucuuuaggcaaaaugguacaucaaauuuuuggauccgcauacacugcgcuuuucucagggguaucauggauaaugaaaaucggcaucggcguucuauuaacauggauuggucucaauucuaaaaauacaaguaugucauucagcuguaucguuauaggcaucauuacucuuuaccuuggugcgguugugcaggccgauaugggguguguuauuaacuggaaaggaaaagaguugaaaugcgguaguggaauauuuguuacgaaugaaguucauacauggaccgagcaauacaaauuccaagcggauaguccgaaacgucucgcaaccgccauagccggagcgugggaaaauggagucugcggcauuagaucaacaacaagaauggagaaccuacuauggaaacagauugcgaaugaauugaauuauauuuuaugggaaaauaauaucaaauuaacggugguuguaggugacauaauaggaguacuagaacaaggaaaaaggacuuuaaccccucaaccuauggaauuaaaauacagcuggaagacuugggguaaagcaaagaucguaacggccgagacccaaaacucuagcuuuauaauagacgggccuaauacgccagaguguccaagugcaucucgugcuuggaaugugugggaagucgaggauuaugguuucggggucuuuaccacuaacauauggcucaaauuacgcgaaguauacacacaaaguugugaucauagauuaaugagcgcugcgaucaaagaugaaagagccguucacgcagauauggguuauuggaucgaaucacagaaaaaugggucuuggaaauuagaaaaggcuaguuuuauagaaguaaaaacguguacuuggccaaaaucacacacguuguggucaaauggaguacuugaaucugacaugauuauaccuaaaucuuuagcagguccaaucucucaacacaaccaccguccagguuaucacacacaaacagcaggaccguggcaucuagggaaacucgagcuugacuucaauuacugugaaggaacaaccgugguaauaacugagaauuguggcacaagaggaccaaguuugagaacaacgacuguaucaggaaaacuaauacacgaaugguguugcagaaguugcacacuaccaccuuuacgauauaugggugaagacggcuguugguaugguauggaaauucgcccuauuaaugaaaaagaagaaaauauggccaaaucuuuagucagugcuggaucaggaaagauggacaauuuuacuauggguauucuaugucuagcaauccuauucgaggaggugaugagaggaaaauuuggaaagaagcauaugauugcgggcguauuauucaccuuuguuuuauuacuuaguggucaaauuacauggagagauauggcacauacguuaaucaugauagguucgaaugcaucagacagaauggggaugggagugacuuaccuggcuuuaaucgccacauucaaaauacaaccuuucuuagccuuaggguucuuucuaaggaagcuaacaagucgugaaaauuuacuguuaggaguuggucuugcaauggcgacaacacuacaacucccagaagauauagagcagauggcaaacgguauugcccuaggucuaaugacgcuuaaacugauuacucaauucgaaacauaccaguuauggaccgcauuagucagcuuaacgugcuccaacacaauuuuuacccuaacaguagccuggagaacagcaacucuaauacucgcaggagugagucuacuaccacuaugccaaucaaguucaaugagaaaaacugauugguuacccaugacaguagcagcaaugggagugccaccuuuaccauuauuuauauuuucacuaaaagauacgccaaaacgaagaagcuggccgcuuaacgaaggcguuauggccguuggccuaguuagcauuuuagccucuagcuuacuuagaaaugaugucccuauggcuggcccauuaguggcaggaggcuuacuuauugccuguuaugucauaacugggacaucagccgaccugacuguugaaaaagcagccgauguuacaugggaagaagaagccgagcagaccggaguaucacacaauuuaaugauuacuguagacgaugacggaacgaugcgcauuaaagaugacgagacagagaauauacugacgguuuuauugaaaaccgcauugcugaucguuucaggaauauucccauauucaaucccugcuacgcuacucgucuggcauacuuggcaaaaacaaacucaaaggucagguguauuaugggauguaccuucgccuccagaaacccaaaaagcagaauuagaagagggcgucuaucgaauaaaacaacagggaauauuuggcaaaacccaaguagggguaggcgugcaaaaagaaggcguauuccauaccauguggcaugugacccgcggagccguacuuacacauaauggcaaacgccuagagccaaacugggcaagcgucaagaaagaucuaauuucauauggagguggguggagauuaucagcgcaauggcagaagggugaagaaguucaagucaucgcgguggaaccggguaaaaacccgaaaaacuuucaaaccaugcccggaauauuucaaacaacgacaggagaaauaggugcgauugcucuggauuucaagccgggcacaucuggaucuccaaucauaaacagggaaggaaagguugugggauuauaugggaauggagucguuacuaagaacgguggcuaugugagcggaauagcacaaacaaacgccgaaccagaugguccgacaccagaauuagaagaagagauguucaaaaagcggaauuuaacaauuauggauuugcauccagguucgggaaaaaccaggaaauauuugccagcuauaguaagagaagcuauuaagaggaggcuucggacucuaauacuugcuccgacuaggguaguugcagcggaaauggaggaagcauugaaaggcuugccuauuagauaccaaacgacagcaaucaaaagcgaacauaccgggcgagaaauagucgauuuaaugugucaugccacauucacaaugaggcuauuaaguccagugcggguucccaauuauaaucuaauuaucauggacgaagcacauuuuacugacccagccucuaucgcugccagagguuauaucucaacccgagucggaaugggagaggcugcugcgaucuuuaugacagcuaccccuccuggcacagcagaagcauucccucagucaaaugcaccuauccaagaugaggaacgggacaucccggaacguaguuggaacucuggaaaugaauggauaacagauuuuguuggcaaaacuguuugguuuguaccuuccauuaaagcaggaaacgauauagcaaauugcuuaaggaaaaaugggaagaaaguaauacaacuaaguagaaaaacauuugauacagaguaucagaaaacgcgauuaaaugauugggauuuuguaguaacgacagacauuuccgagaugggggcaaauuuuaaagcggauagaguaauagauccaagacgcuguuuaaaaccaguaauuuugacagacgguccggagaggguaauacucgcagggccgaugccaguaaccgccgccucagccgcccaacgacgaggucgaguaggaaggaauccacaaaaggaaaaugaucaauacaucuucacuggucaaccauugaauaaugaugaggaucaugcgcauuggaccgaagcaaaaauguuacuugauaauaucaacacgccugagggcauaauaccugcacuguuugaaccagagagagaaaaaucagcugcuauagacggcgaauacagacuaaaaggagaaucgcgcaagacuuuuguggaguuaaugagaagaggagaccugccgguaugguuggcacauaaagucgcuuccgagggaauaaaguauacugaccgaaaguggugcuucgauggagaacgaaacaaucaaauauuggaagaaaauauggacguagaaauauggacgaaggaaggugaacggaagaaauuaagaccaagaugguuagacgcgcgaacauacucugacccacuugcacuaaaggaauuuaaagacuucgcugcagggcgaaaaucaaucgcccuggaccuagucaccgaaauaggaaggguuccuucccauuuagcucacagaacacggaaugccuuagauaauuugguaaugcuucauaccuccgagcauggggguagagcuuaucgacaugcaguugaagaguugcccgaaacgauggaaacccuuuuauuacucggguuaaugauauuguugaccggaggugcgaugcuguuuuuaauuucuggaaagggaauaggaaaaacguccauuggacugauaugugugaucguaagcucaggcaugcuuuggauggcugacguaccauuacaguggauagcaagcgcaauaguacuagaauuuuucaugauggucuugcucauaccagaaccugaaaaacaacgaaccccucaagauaaucaguuagcguacguaguaauaggcauccuaaccuuagcagcuaucguaacugcaaacgagauggggcuuuuagaaaccacaaaacgagaucuagguaugaguaaagagccaggugucguauccccaaccucuuaccucgauguugaccugcaccccgcaagugcguggacauuauaugccguugccacgacagucaucacacccaugcuacgccacacaauugaaaacaguacagcgaauguaaguuuagcagcaauagcuaaucaagcugucguauuaaugggucuagauaaaggguggccaaucaguaagauggaccucggaguacccuuacuagcuuuaggaugcuauucacaagugaauccguuaacacuuacugcggcuguauuacuauuagugacacacuaugccauaauuggaccuggauuacaagcuaaagcaacacgugaagcucagaaaagaaccgcagccggcaucaugaaaaauccaacuguagacgguauaaugacuauagaucuggauccggucauauaugauagcaaauuugagaaacaacuuggucaaguaaugcuacucguauuaugugcgguacaacuucuucucaugcguacaaguugggcguuaugugaagcucuuacauuggccacaggcccaauaacuacauugugggaaggaagcccugguaaauucuggaauacgacuaucgcugugucgauggcaaauauauuuagagggaguuacuuagcaggagcugguuuagcuuuuagcaucaugaaaaguguugguacgggaaaaagaggaaccggcucgcagggggaaacauuaggagaaaaguggaagaagaaacugaaccaacuuucaagaaaagaauuugauuuauacaagaaaagcgggauuacugaaguagauagaacagaagcaaaagaagggcuaaaaagaggggaaacuacgcaccacgcaguuuccagggguagugcuaaacuucaaugguucguugaaaggaauaugguaauuccagaaggucggguaaucgauuuggguugcggacgaggagggugguccuauuacugcgcaggauugaagaaaguaacagaagugagaggauacacaaaaggagggccaggacaugaagaacccguuccuauguccacguacggcuggaauaucgugaaacucaugagcgggaaggauguauuuuaucugccacccgaaaaaugugauacguuauuaugugacaucggggaaucaucaccaagcccuacgguggaagaaucgaggacaauacgaguuuuaaaaaugguugagccauggcuuaagaauaaccaauuuuguauuaagguacuaaauccauacaugccgacuguaaucgaacauuuagaaagauuacaacgaaaacauggaggaaugcuaguuagaaauccgcuaagccggaacaguacgcaugaaauguacuggauuaguaauggcacgggaaauaucguuaguaguguaaacaugguaucaagauuguugcuaaauagauuuacaaugacucacaggagaccaacaauugaaaaggacgucgacuugggcgcggguacuagacaugugaaugcagagccagaaacaccuaauauggacguaauaggagagcgaauuaaacggaucaaggaagaacauucuucuacauggcacuaugaugaugaaaacccuuacaagacaugggccuaucauggauccuaugaaguuaaagccacugggagcgcaagcucaaugauaaacggaguagugaaauuacuaaccaagccaugggaugucguuccaauggucacccaaauggcuaugacagacacaaccccauucgggcaacagcgaguauucaaggaaaagguugacaccagaaccccgaggccgaugccaggaaccagaaaaguaauggaaaucacugcagaauggcuauggcgaacauuaggaagaaacaagcggccacggcuuuguacucgugaagaguucaccaagaaaguaagaacaaaugccgcaaugggcgccguguucacagaagaaaaccaaugggauucagcacgagcugcaguggaagacgaagaguuuuggaaauuaguagaucgagaaagagaacuucauaaauuaggaaaaugugguucaugcguguacaacaugauggguaaaagggagaagaaauuaggugaauuuggaaaagcaaaaggaagcagggccaucugguauaugugguuaggagcacgauaccuagaguuugaggcucuuggcuuucuaaaugaagaccacugguuuucaagggaaaacucuuauagcggcguagaaggcgaaggccuacacaaacuuggguauaucuuaagggauauaucaaaaauucccgguggggcuauguaugcagaugacacugcuggaugggauacacgaauaacagaagacgacuugcauaacgaggagaaaaucacucaacagauggauccggaacaccgacaauuagcuaaugcgauuuuuaaguuaacauaucaaaauaaaguaguuaagguacaaaggccaacgccgaaaggcacuguuauggacaucauuucucgaaaagaucaacgagguucuggacagguaggaacguauggacuaaauaccuuuacuaauauggaggcccaauuaguucggcaaauggaaggagaaggcgugcuaagcaagguugacuuggaaaacccucauuuguuagagaagaaaauaacccaauggcucgaaacaaaaggcguugagagguugcgcagaauggcaauaaguggugaugacuguguagugaagccaauugacgaucgauucgcaaacgcauuacuugcacugaacgauaugggaaagguaaggaaagacauaccacaauggcagcccucaaaggguuggcaugacuggcaacaagugccuuuuuguucucaucauuuccacgaauuaauaaugaaggacgguagaaaguugguaguccccuguaggccucaagaugaguuaauugguagggcgcggauaucucagggugcaggcuggucgcuuaaagaaacagcuugcuuaggaaaagcauaugcgcaaauguggagucuaauguauuuucacaggagagaucuaagguuggcaaguaaugcgauaugcucugcuguuccuguacacugggucccaacuucacguaccacauggaguauccaugcgcaccaucaauggaugaccacugaagauauguuaacaguguggaacagaguauggauagaagauaaccccuggauggaagacaaaacaccuguuacgaccugggaggacguaccauaucuugguaaacgagaagaucaauggugcggaucauuaauaggacuaacaucacgagcaacgugggcccaaaacaucuugacagccauccaacagguucggucacucaucggggacgaggaguuccuagacuacaugccgucgaugaaacgcuucaggaaagaggaagaauccgaaggcgcgauaugguga

SEQ ID NO: 23290 - RNA, 9873 nt, Artificial Sequence
  derived and/or modified CDS sequence (opt6) from DENV-3__FJ744734__SS-prME
acaucccuguguuuaaugaugaugcuucccgcuacucuggcauuucaucuuacgagcagagacggagaaccaagaaugauaguggcuaaaaacgaaagaggcaaaucuuuacuuuucaaaaccgcuagcggcauaaauauguguacauugaucgcaauggaucugggugaaaugugugaugacacaguuaccuauaaauguccauuaauagcagaaguagaaccggaagacaucgauugcuggugcaaccucacaagcacaugggucacauaugggacauguaaucaagcgggagaacaucgaagagacaaacguucaguggcauuagcuccacacguugggaugggucuugacacucgcacacaaaccuggaugucggcugaaggcgcuuggcgacaaguagaaaaaguugaaacaugggcacuaagacauccuggauucacgauacuugcucuauuccuggcacacuacauagggacuucauuaacacaaaaagucgugauauuuauuuugcuaaugcuaguaacuccuucgaugacgaugagauguguugguguaggaaaccgagauuuuguagaaggucuaucgggagcaaccuggguagauguuguacuagaacacggcggaugcguuacaaccauggccaaaaauaaaccaacacuagauauugaauuacagaaaacagaggcaacccagcuagcaacauugcgcaaacuaugcauugaggguaaaauaacuaacaucacaaccgacagccgaugcccuacccaaggcgaggcgauuuugccagaagaacaggaccaaaauuacguuugcaaacauacauacgucgacagggggugggguaauggauguggauuguuuggcaaaggaagccuggucaccugugcaaaauuccaaugccuugagccuauugagggcaaaguuguacaacaugaaaaccugaaauauacuguuaucauuacuguccauacgggggaccagcaucagguaggcaaugacacacaaggcguaacagucgaaauaacuccccaagcaucuacaguggaagcuauacuaccugaauaugguacuuuaggauuagaaugcaguccacguacuggcuuagauuuuaacgaaaugauuuuauugaccaugaaaaauaaagcauggaugguacacagacaaugguucuuugaccuuccacuaccguggacuucuggagcuacaaccgagacaccaacuuggaauagaaaagaacuauuagucacguuuaaaaacgcacaugcuaagaaacaagaggucguaguccugggcagccaagaaggugcaaugcauacagcauugacgggcgcaacugaaauccaaaauaguggcgggacaucaaucuuugccggacauuuaaaaugucgauuaaaaauggauaaacuugaauuaaaagguaugucauaugcaauguguuugaauacuuucgugcuaaagaaagagguaagcgaaacacaacauggaacaauacuaaucaaaguggaauauaaaggagaagaugcaccauguaaaauuccauucuccacggaagauggacaggggaaagcgcacaauggaagacuaauaacagccaauccagucguuacuaagaaagaagaacccguaaauaucgaagcugaaccacccuuuggggaauccaauauuguuauagggauuggagauaaagcacuaaaaauaaauugguauaagaaaggaaguucaauagguaaaauguucgaagcaaccgccagaggugcuagaagaauggcaauucuuggugacacagcaugggacuuugggagugucgguggaguuuuaaacucacuugguaaaaugguccaccaaaucuucggaagugcauacaccgcuuuauucagcgguguaaguuggauuaugaaaaucggaauagguguauuacuaacauggauagguuuaaauagcaaaaauacuucaaugaguuuuucaugcaucgugauuggaaucauuacccuauaucugggugcugugguacaagcagauaugggcuguguaaucaauuggaaaggaaaagaacuaaaauguggcucagguauuuuuguaaccaacgaaguacauacguggacagaacaauacaaauuucaggcugacucuccaaaacgauuggcuacugccaucgcuggagcgugggaaaauggaguguguggcauucgcucaacaacaagaauggaaaaccuuuuauggaaacaaaucgcgaaugagcugaauuacauuuugugggaaaacaacauuaaacuuacugucgugguaggagauaucauaggagugcuagaacaagguaaaagaacacucacuccccaacccauggaauuaaaauacuccuggaaaacaugggguaaagcaaaaauagugacugcagaaacccaaaacucuagcuuuauaauagauggacccaacacucccgaauguccuuccgcuagcagagccuggaacgugugggaaguugaagauuauggcuuuggaguuuuuaccacgaauauaugguuaaaauugcgagaagucuauacacaaucaugugaccauagacugauguccgccgcuauaaaggaugaaagagcugugcacgccgauaugggauauuggauugagagucaaaagaauggaagcuggaaacucgaaaaggccagcuucauagagguaaaaacauguacuuggcccaaaucgcacacacucuggaguaacggagugcuugaaucagacaugauuauuccaaaauccuuggcuggcccaauuucucaacauaaucaucgaccagguuaccacacucagaccgcaggcccuuggcaucuuggaaaauuagaacuugacuuuaauuauugugaaggaacuacggugguuauaacggaaaauugcggcacaagaggaccauccuuacguaccacaacagugucuggcaagcuaauucaugaauggugcuguaggucaugcaccuugccaccacuacguuacaugggagaagacggauguugguauggaauggagauucgaccaauaaaugaaaaagaagaaaauauggucaagucguuaguaagugcagguucaggaaaaauggacaacuuuacuaugggcauauuaugucucgcaauucuauuugaagaaguaaugcgagguaaguuuggcaagaaacacaugauagcggguguauuguucacauucguuuuauuacuuaguggacagauaacauggcgggauauggcucauacauuaauaaugauagguucuaacgcgucagauagaaugggcaugggagucaccuaccuggcguuaauagcaaccuucaagauucaaccuuuucuugcacuaggauucuuuuuaagaaaacuaaccucgagagaaaaucuucuucugggaguggggcuugccauggcaacuacuuuacaauuaccggaagacauugaacaaauggcgaacgguauagccuuaggacuaaugacgcuuaaauugauuacacaguucgaaacauaccaguuauggacagcauuggucagucuuacuuguaguaacacaauuuuuaccuuaacaguagcuuggagaacugcgacacuaauccuagcuggcgugagcuuacuuccucuaugucaguccaguagcaugaggaagacugauugguuaccaaugacaguugcagcaaugggagucccaccccugccauuauuuauauuuaguuuaaaggauacaccaaagcggcgcucuuggccccuaaaugaaggggugauggcaguaggguugguaaguauacuagcaucgucucuauuacguaaugacguacccauggcuggcccucuaguagcaggaggguuauugaucgccuguuacguuauaacuggcacguccgcagaucuaacaguagaaaaagcagcugauguaacuugggaagaagaagcagaacaaaccgguguaucacauaacuugaugauuaccguagaugaugauggcacaaugagaauuaaagaugaugagacagaaaacauauuaaccguuuuauuaaagacggcacugcugauaguuagcggcauauuuccauauucuauuccagcaacgcuguuggucuggcauacauggcaaaaacaaacccaaagauccggagucuugugggacgugccaucuccacccgagacccagaaggcagaacucgaagaagguguuuaucggauaaaacagcaaggcauuuuuggaaaaacccaaguaggugucgggguucaaaaagaagguguguuccacacaauguggcacguaacaaggggcgcuguacuuacgcacaauggaaaaagauuagaacccaacugggcaucagucaagaaagaccuuauaagcuacggggguggauggcgguuaucugcacaguggcaaaaaggugaggaaguucagguuauugcuguagaaccggggaaaaacccuaaaaacuuucaaaccaugccgggcauuuuucagacuacgaugggugaaaucggugcgauagcgcuugacuucaaaccaggaacaucugguucuccaauaauaaacagagaaggaaaaguuguuggguuguaugguaaugguguagucacuaaaaauggaggguacgugagcggaauagcacaaacgaacgcugaaccagauggcccgaccccagaauuagaagaagaaauguuuaagaaacgaaaccuuacaauaauggauuuacauccaggaaguggaaagacucggaaauaccuaccugcuaucguacgugaggcaauaaagcgcagauuacgcacguuaauccuagcaccaaccaggguugucgccgcggaaauggaagaggcuuugaaaggccugccaauaagauaucaaacaacagcaauaaaaucugaacauaccggccgugaaauagucgacuuaaugugucacgcaacauuuacaaugcgucuuuuaaguccuguuagaguuccgaauuauaaucugauaaucauggaugaagcucacuuuacagauccggccucaauagcugcgagaggauacauuucaacacgaguugguaugggagaagcagccgccauauuuaugacugcaacaccgccgggcacugcagaagcauucccgcaauccaaugccccgauacaagaugaagagagagauauuccagaaagaucauggaacucuggcaaugaauggaucacagacuuugucgguaaaaccgugugguucguuccaaguauaaaggcugguaaugauaucgccaacuguuuaaggaaaaauggcaagaaaguaauacaauuaucuagaaaaaccuucgacacagaguaucaaaagacaagacucaacgacugggauuuuguaguuaccacagacauuagcgaaaugggagcaaauuucaaagccgacaggguaauagauccccggagauguuuaaaaccgguaauauugacggacggcccugaaagaguuauauuggcaggcccaaugccagucaccgcagcuucagcugcacaaagacggggucggguaggcaggaacccgcaaaaggagaaugaucaauauauauuuacaggacaaccacuuaauaaugacgaagaccaugcucauuggacugaagccaaaaugcuacuggacaauauaaauaccccagaagggaucauuccugcccuauucgaaccagaaagagagaaaagugcagcaauagauggagaauacagguuaaaaggugagagccgcaaaacauucguggaguuaaugcgcagaggugaucuuccuguaugguuagcgcauaaaguggcuucugaaggaauaaaauauacugacagaaaauggugcuuugacggggaaaggaauaaccaaauauuagaagaaaauauggacguagaaauauggacaaaagagggugaaagaaagaaauuaagaccuagguggcuagacgcacguacauauagugauccuuuagcauuaaaagaauuuaaagacuuugcugcaggccguaaaagcauagcuuuagaccuaguaacggaaauaggccgaguuccaucccauuuagcccacagaacaagaaacgcccucgauaauuuagugauguuacacacauccgaacacgggggucgugcguauagacacgcaguugaagaauuaccagaaacaauggaaacgcucuuacuacugggacuaaugauauuauuaacaggaggcgcuaugcuguucuuaauaucagggaagggaauugggaaaacaucuauaggauuaaucuguguuauaguaucaucaggaaugcuguggauggcagacguuccuuuacaguggauugcaagugccauugucuuagaguucuuuaugaugguucuucuaaucccagaacccgaaaaacagagaaccccacaagauaaccaguuagcguaugucguaauagggauauuaacacuagcugcgauugucacugcaaaugaaaugggacuguuagagaccacuaaacgugaucucggcaugagcaaagaaccgggcguaguaucaccaacaucauaucuugaugucgaucuucauccugcgagcgccuggacucuguacgcuguugcuacaacagugauuacacccauguuacgacauacaauagaaaauucaacggcgaauguaucgcuugccgcuauagcuaaucaagcggugguauugauggggcuggauaagggguggccaauuaguaaaauggauuuaggcguaccucuacuagcacugggguguuauucacagguuaauccauugacacugacagcagcuguacuauuguuaguaacacacuacgcaauuauuggaccuggccuacaagcgaaagcuacacgagaagcacaaaaacgaacugccgcaggaauaaugaagaauccuacuguggauggaaucaugacuauugaccuggauccugugauuuacgauucgaaauucgaaaaacaauuaggacaggugauguuacuuguccucugcgcgguacaacuucuguuaaugcguaccucuugggcuuuaugcgaggcuuugacacuagcaacagggccaauaacgacucuaugggaaggaucucccggaaaauuuuggaauacaaccauagccguaucgauggcaaacauauucagaggaagcuacuuggccggggccggguuagcauucaguauaaugaagucaguagggacugggaaacgcggcacgggaagucaaggugaaacacuaggagagaaauggaagaagaaauuaaaccaacucucacgaaaggaauuugaucucuacaagaaaaguggaauuacugagguagacaggacagaggcuaaagaaggucuaaaaagaggggaaacgacgcaucaugcugugaguagagguagugcgaaacugcaaugguuuguugaaagaaacauggugauaccagaggggcgagucauagacuuggggugcgggagaggaggaugguccuauuauugugcggggcugaagaaaguaacugagguacgcgguuauacaaaggguggaccaggucaugaagaaccaguaccaaugagcacuuacgguuggaauaucguuaagcuaaugucggguaaggauguauuuuaccuuccucccgagaaaugugauacccuguuaugugacauaggugaaucgucuccauccccgacagucgaggagucgaggacgauccguguuuuaaagaugguugaaccauggcucaaaaauaaucaguuuugcauuaagguauuaaauccauacaugcccacgguaauagagcaccuagagcgacugcaacgaaaacacggcgggauguuaguacgaaacccauuaagucguaacucuacacaugaaauguauuggauaagcaaugggacaggaaauauuguauccagcguaaacauggucagccguuuacuccuaaauagguucacaaugacacaucgacguccaaccauagaaaaggauguagaccucggcgcaggcacuaggcacguaaaugcggagccagaaacgccgaacauggacgugauaggagaacgcauaaaacgaauaaaagaggaacauaguucgacuuggcacuacgaugacgagaacccguauaaaacuugggcguaccacgguaguuacgaaguuaaagcuacaggaagugcaucuagcaugaucaauggcguuguaaaacuacuaacaaaaccaugggacgucguaccaauggugacucaaauggcgaugacugauacaacaccguuuggucaacagcguguauucaaagaaaaaguagauacuagaacccccagaccuaugccaggaaccagaaaaguuauggagauuacagcagaauggcuauggagaacacuaggaaggaauaagcgaccacgacucuguacaagagaagaauuuacaaagaaaguucguacaaacgcagcgaugggagcaguauucacugaagaaaaucagugggacagcgcccgugcagccguugaagacgaagaauuuuggaaauugguagacagagaaagagaacuacauaaacuaggaaaaugugggucguguguuuauaauaugauggggaaaagggagaagaaacuaggagaguuuggaaaagcuaaagguucgcgagcaauaugguauauguggcuaggggcgagguaccucgaauuugaagcauuggguuuccuaaaugaggaucauugguuuagccgagagaacaguuauagugguguagagggugagggacuccauaaacuaggauacauucuucgugacauaucaaaaauuccagguggagcgauguaugcagaugacacugcgggaugggacacacggauaacugaagaugaucuccauaacgaagagaaaauaacccaacagauggauccugaacacagacaacuggcaaaugcuaucuucaaguuaacauaucagaauaaagugguuaagguacaacgaccaaccccaaaagguaccguuauggacauuauaucacguaaggaccaacgaggaucagggcaaguaggaacuuauggacuaaacacuuucacaaauauggaggcccagcucgugcgacaaauggaaggagagggaguuuugagcaaaguagaucuugaaaauccacauuuacuugagaagaaaauuacccaaugguuagaaacaaaaggugucgagcgguugaggcgaauggcaauuaguggggacgauugcguagucaaaccgaucgaugaccguuucgcgaacgcucuacuagcgcuuaaugacaugggaaagguaagaaaagacauaccacaauggcaacccucuaaaggguggcaugacuggcagcaaguuccauuuuguucucaucauuuucaugaacuuauaaugaaggacggaaggaaauuaguaguaccuugccgcccucaagacgaguuaauagguagagccagaauaagccagggggcuggauggagccuaaaagaaacugcaugucuaggcaaggcguaugcacaaauguggagccuaauguacuuccaucggagagaucuuagguuagcaaguaacgcuauaugcucagcuguaccuguacauugggugccaacaagccgcaccacauggagcauacaugcacaucaucaauggaugacuacugaagacaugcucacggucuggaacagagucuggauagaagacaaucccuggauggaagauaaaacgcccgucacuacaugggaggacguaccuuaucugggcaaaagggaggaucaguggugcggaucucuaauuggauuaacuucgcgcgcaacaugggcucaaaauauauuaacagcuauucagcagguuaggaguuuaauaggggaugaggaauuuuuggacuauaugccuucgaugaaacgauuucgaaaagaagaagaaagcgaaggggcgauuugguaa

SEQ ID NO: 23291 - RNA, 9873 nt, Artificial Sequence
  derived and/or modified CDS sequence (opt6) from DENV-3__FJ744737__SS-prME
acguccuuaugucuaaugaugauguuaccugcgacuuuggcauuccaucuaacaucaagagacggggaaccgagaaugauaguagcuaaaaaugaacgaggaaaaucauuauuguuuaaaacagcgaguggcauaaauauguguacuuuaaucgcgauggaucugggagaaaugugcgacgauacaguuacauauaaaugcccccucauagcagaaguugaaccagaagauauagauuguugguguaauuugacaucuaccuggguuacuuauggcacauguaaucaagccggugaacauagaagggauaaaagaucagucgcacuggcaccgcauguggguaugggguuggauaccagaacacaaacuuggauguccgcagaaggagcauggagacaagucgaaaaaguagaaaccugggcucuaaggcauccaggauuuacaauuuuggcuuuauuucuugcgcauuauauagggacaagccugacccaaaaaguaguuauauucaucuuguugaugcuuguaaccccauccaugacgaugcgauguguuggaguagguaacagggauuuuguggaaggauugucgggcgcuacauggguugaugucguauuagaacacggugggugugugacaacuauggccaaaaacaaaccaacccuagauauugaacuacagaaaacagaagcuacccaacuugccacauuacguaaacuuuguauugaggguaaaaucacuaacauaacaacggacucaaggugcccuacacaaggagaagcaauucuaccggaggagcaggaccaaaauuaugugugcaaacacacuuauguggauagaggcugggguaaugguugcggucucuucggaaaaggcagucuaguaacgugcgccaaauuucaaugccuagaaccaauugagggaaaaguaguccagcaugaaaaucuaaaauacacugugauuaucacaguacauacaggagaucaacaucaaguuggaaaugauacucaaggaguaacagcggaaauuaccccacaagcaaguacaguagaagcaauacucccugaauacggcacccuaggcuuggaaugcucgccaagaacuggccuagacuucaaugagaugauacuucucaccaugaaaaauaaagcauggauggugcaucgacagugguuuuucgaucuccccuugccguggaccucuggcgcaacaacagaaacacccaccuggaacagaaaagaauuguuggucacguuuaaaaaugcccaugccaagaaacaagaagugguggugcuagggucacaagaaggcgcaaugcacacugcacuaacuggagcaacagagauucaaaauucuggugggacaagcaucuucgcuggacaucucaaaugccggcuuaaaauggacaaacuagaacucaaagguaugaguuaugcgauguguuuaaacacuuuuguccucaagaaagaggucagcgaaacucaacauggaacgauuuuaaucaaaguagaauauaagggugaagaugcaccgugcaaaaucccuuuuaguaccgaagacggacaaggaaaagcacacaacgguagauuaaucaccgcgaaucccguaguaacuaaaaaggaagaaccugucaauaucgaagccgaaccuccauuuggugaaucuaauauaguuaucggcauaggugauaaggcuuuaaaaauuaauugguauaagaaaggcucaucaaucggaaaaauguucgaagcaacugcaagaggagcaaggagaauggcaauauuaggagacacggcgugggauuucggaucgguggguggaguuuuaaauagccuagguaaaaugguacaucagauauuugguucugcuuauacagcguuauuuagcggcguauccuggauaaugaaaauagguauaggaguacuauugacguggauaggacuuaacagcaaaaauacaaguaugagcuuuucguguauuguuaucggaaucauaacauuauauuugggagcaguagugcaggcggauaugggauguguaauuaacuggaaggggaaagaauugaaaugcggaucagggaucuucgucacuaaugaaguacauacauggacagaacaguauaaguuucaggcagacagcccuaaacgacuggcaacagcaauagcaggcgcaugggaaaacggaguaugcggaaucagaucuacaacaagaauggaaaaucucuuguggaaacagauagcaaaugaauuaaacuacauccugugggagaacaacauaaaacuaacggucguaguaggagacauuauaggcguacuggagcaaggcaaaagaacucuaaccccacagccaauggagcuaaaauacucauggaaaacauggggcaaagcgaaaauaguaaccgcagaaacacaaaacagcaguuucauaaucgacggaccaaacacaccagaauguccgagcgcuucaagggcuuggaaugugugggaaguagaagacuauggcuucggaguguuuacuacaaauaucuggcuuaaacucagagaaguuuauacacaaucaugugaccauagauuaaugagcgccgcuauuaaagacgaacgugcaguucaugccgauauggguuacuggauagagucucagaaaaauggaucauggaaauuagagaaagcuaguuuuauagaagucaaaacuuguacguggccgaagagucacacacuauggucgaacgggguuuuagagagugacaugauaaucccuaaaucauuagcagggccaauuagccaacacaaucauagacccgguuaucauacgcaaacagccggaccguggcacuuaggcaaauuagaguuagauuuuaacuauugcgaagguacuacggucguaauaacugaaaauuguggaacucgagggcccaguuuaagaaccacaacaguaagugggaaacuuauccacgaaugguguugccgcaguuguacacucccuccguugagauauaugggagaagacggcugcugguaugguauggagaucaggcccauuaacgaaaaagaagaaaauauggucaagucuuuaguuucagcgggaucugggaaaauggauaacuuuaccauggguauacuauguuuggcaauucuauuugaagaaguaaugcgcggcaaauuugguaagaaacauaugauagcaggaguacuauuuaccuucgucuuauuauuaagugggcagauaacguggagagauauggcucauacucucauaaugauaggaucuaaugcuucagauagaaugggaaugggggucacuuaccuugcgcucauagcgacauuuaagauucagccauuucuggcguuggguuucuuccuaagaaaauuaacgucuagagaaaauuuacugcuaggagucggccucgccauggccacuacucuacaacuuccugaagauauagaacagauggcuaauggaauagcccucggccuaaugacacuuaaacucauaacccaguucgaaacauaucaacuauggacagcccuaguaagccuaacguguuccaauacaauauuuacccuuacaguagccuggagaacagcuacauugauauuagcaggcguuagccuccuaccacuaugccaaucaucauccaugcgaaagacagauuggcuaccuaugacaguggcugcuauggguguuccgccacuaccguuauucauuuucagccucaaagauacacccaaaagaagaaguuggccuuuaaaugaaggagugauggcaguagggcuuguaaguauauuagcgagcaguuuauuacguaaugauguccccauggcgggcccacuugucgcuggaggauuacuaauagcuugcuacguaaucacagguacaucggcugaucuaacaguggaaaaagcagccgaugugacuugggaagaagaagcagaacaaacagggguaagucauaaucuuaugaucacaguggacgaugauggaaccaugcguaucaaagaugaugaaaccgaaaacaucuuaacaguauuauugaagacagcccuccuuauugugaguggaauauuuccauauagcaucccagccacacucuuaguauggcauacguggcagaaacagacucagagaaguggcguccucugggaugucccuaguccgccagaaacucagaaggcugaauuagaagaaggaguuuauaggauuaaacagcaaggaauuuuuggcaagacgcaagucgggguggguguacaaaaggaaggaguauuucauacaauguggcauguuacaagaggagcaguucucacacauaaugguaaacgacuagagcccaacugggcaagcguuaagaaggacuuaauaucuuauggaggaggguggagacuaagcgcccaguggcaaaaaggggaggaagugcaaguuauagcuguagaaccagggaaaaaccccaaaaacuuucagacaaugccagguauuuuccagacaacaacuggcgaaauaggagcaaucgcuuuagacuuuaagccuggcacuuccgggagcccaauuaucaacagggaagguaagguugucggauuauacgguaauggcgucguaacuaaaaaugguggguauguaagcggaaucgcacagacaaacgcggaaccugauggaccaaccccugaacuugaagaagaaauguucaagaaaaggaauuugacgauaauggaucuacauccgggcucggggaaaacccgaaaguacuuaccagcaauagugcgcgaagcaauuaagagacgauuacgaacauugaucuuagcgccgacucgcgucgucgccgcggaaauggaggaggcacuaaaaggacuucccauuagauaccaaacaacagcgauaaaaucagaacauacgggccgagaaauugucgauuuaaugugccacgccacauucacgaugcgucuucucaguccuguacgcguacccaacuauaacuuaaucauuauggaugaagcacauuucacggacccggccucaauagcugccagaggauacauaaguaccagaguaggcaugggcgaggcugccgccauauucaugaccgcaacgccuccagguacugcagaggcuuuuccacaaucaaaugcuccgauacaagaugaagagagggacauaccagaaagaucuuggaacaguggaaacgaguggaucacagacuuugucggcaaaacuguaugguuuguaccguccauaaaggcgggaaacgauaucgcaaacugccuuaggaaaaaugggaaaaagguaauacaacuaaguagaaaaacguuugauacagaauaucagaaaacgcgacuaaaugacugggauuucguagucaccaccgauauuagcgaaaugggcgcaaauuucaaagcagaucgagucaucgacccccgucgaugucuaaagcccguuauauuaacugacggcccggaacgugugauacuagcgggcccuaugccaguaacggcggcaucagcagcgcagaggagagguagagugggcagaaacccacagaaagaaaacgaucaauauauauuuacuggccaaccccuuaacaacgaugaggaucaugcgcauuggacugaagccaaaauguuauuagacaauauaaacacuccugaggguauaauuccagcacuguuugaaccagaacgagagaaaucugcugcuauagacggagaauaccgcuuaaagggagagucacggaagacuuuuguugaacuaaugcguagaggcgacuuaccaguauggcuagcacauaagguggcaucggaaggcauaaaauacacugacagaaaguggugcuucgauggcgagaggaacaaccagauacuagaagaaaacauggacguggagaucuggacuaaagaaggagagagaaagaagcuacgaccacgaugguuagaugcacguacuuauagugauccauuagcgcuaaaagaauuuaaagacuuugcugcagggcgcaaaagcaucgcauuagaucucgucacugagaucggccgaguacccucucaucuagcacauagaacacgcaacgcccuugauaaccuggucauguugcacacaucagaacacggcgguagggcauaucgccaugcuguagaagaauuaccagaaaccauggaaacgcuauuauuauuaggcuuaaugauauuacuaaccgguggagcuauguuauuuuuaauaucagguaaggggauuggaaaaacaagcauuggauugaucugcgugauuguaucaagcggcaugcuauggauggccgacguucccuuacaauggaucgccuccgcuauuguccuugaguucuucaugaugguacuguuaaucccugaaccugaaaaacaacggacaccacaagauaaucaacucgcguacguuguaauugguauccuuacuuuggcugcgauaguuacagcaaacgaaaugggauuguuagaaaccacaaaaagagaccuugguaugucuaaagagccgggaguuguaucaccuacgucuuacuuggacguagaucuacauccagcaucagccuggacgcuuuaugcaguagcaacuaccguaauaacucccauguuaagacauacaaucgagaacucaacagcaaaugucagcuuagcugcgaucgcuaaucaagcugugguccuaauggguuuagauaaaggauggccaaucucuaaaauggauuuaggaguaccccuauuagcccuggggugcuauucacaaguaaacccacuuacuuuaacagcugcgguguuauuauuaguaacacauuaugcaaucauuggaccaggcuuacaagcaaaagcgacuagagaagcccagaaaagaaccgcagccgguauaaugaaaaauccaacaguagauggaauaaugacaaucgauuuagaccccgugauuuacgauuccaaauuugaaaaacaauuaggccaagucauguuacugguccuuugugcaguucaauuacuccucaugcgaaccagcugggcacuaugugaggcuuugacguuagcaaccgggccaauaacaacgcuaugggaagggucaccaggcaaguucuggaacacuacgaucgcaguguccauggcaaauauauuuagaggaucuuaucucgccggcgcaggacuggcuuuuaguauaaugaaaaguguaggaacaggaaagcgcggcacugggagucaaggugagacucuaggagaaaaauggaagaagaaauugaaucaacuaucaagaaaagaauuugauuuauauaagaaauccgggauuacagagguagaucguacagaggcuaaagagggacuaaagcgcggcgaaacuacacaccaugcaguaaguaggggaagugccaaauugcagugguucguagaacgaaacauggugauaccugaggggcguguaauagacuuaggaugcggucgugguggcugguccuacuauugugcaggucucaagaaaguaacggaaguuaggggguauacuaaaggggguccaggacaugaagaaccuguuccgaugucaacuuacgguuggaauauugucaaauuaaugagcggaaaagauguauuuuaccucccaccagagaaaugcgacacccuacuaugcgacauuggagaaaguucuccaucuccuacugucgaagagucgcgcacaauccgaguauuaaaaauggucgagccuugguugaaaaauaaucaguuuuguauuaaaguauuaaauccauauaugccuacgguaaucgaacacuuagagagguuacaacguaaacauggaggcauguugguuagaaacccgcugagcaggaacaguacacacgaaauguauuggauaagcaacgggacuggaaauauaguuaguucuguuaauaugguuucucgacuacuccuaaacagauucacaaugacacaucgacgucccaccauagaaaaagacgucgauuuaggcgcaggaacaaggcauguaaaugcagaacccgaaacaccaaauauggauguaauuggugaaagaauuaagagaauuaaagaggaacauaguagcaccuggcauuaugaugaugaaaaccccuauaaaacaugggccuaccacgggucauacgaggucaaagcaacgggaagugcuucaaguaugauaaauggcguggucaaauuacuaaccaaaccuugggauguagugccaauggucacccaaauggcuaugacagauaccacgccauucggucagcaacgagucuucaaagaaaaaguagacacacgaacaccucguccgaugccaggcacaaggaaagucauggaaauuacagcagaaugguuauggcgaacacugggacgcaauaagagaccaaggcuguguaccagagaagaauuuacuaagaaagugagaacaaacgcggccaugggugcgguguucacagaagaaaaucaaugggacucagcaagagcugccgucgaagacgaagaguuuuggaagcuagucgaucgggaaagagaacuucauaaacuaggcaaaugcggauccuguguauacaauaugaugggcaaacgcgagaagaagcuaggagaguuugggaaagcaaaaggaucaagagcgauaugguauauguggcuaggagcacgcuaucuagaguucgaagcauuaggauuucugaaugaagaccauugguucuccagagaaaacucguacucaggaguugaaggagaggggcuacacaaacucggauauauauuacgcgacauaaguaagauuccagggggagcuauguaugcagaugauacggcugguugggauacucggaucacugaagacgaucuacacaaugaagagaaaauaacccaacagauggauccggaacaucgucaacuagcuaacgcuaucuucaaguuaacauaccaaaauaagguagugaagguacagaggccaaccccaaaggguacggugauggacauuauauccagaaaggaccaacgcggaaguggccaggucggaacuuacggacuuaacacuuuuaccaauauggaggcgcaauuaguaaggcaaauggaaggugagggaguauuaucaaagguggacuuagaaaacccccacuuacuagagaagaaaauuacacaauggcuugaaaccaaaggaguagaaagacuuagacgaauggcaauuucuggugaugauuguguaguaaagccaauagacgauagauucgcuaacgcacuauuagcacugaaugacaugggcaaaguaagaaaagauauuccacaguggcaaccaagcaaggguuggcaugacuggcagcaagugcccuuuuguucgcaccacuuucaugaauuaauuaugaaggacggaagaaaacugguuguuccuugucgcccacaggacgaauuaauuggucgugcacgcauuucacaaggggcuggcuggucacuuaaagaaacagcaugucuaggaaaagcauaugcucaaaugugguccuugauguauuuccaucgaagggaucuaaggcuagcgaguaaugcaauaugcucagcuguaccaguacacuggguccccacuucaagaacaacauggucuauccacgcacaucaccaauggaugacaacagaagauauguuaacgguuuggaaccgcguuuggauagaagauaauccauggauggaagacaagacccccguaacgaccugggaggauguaccuuauuugggaaaaagggaagaccaaugguguggaagucucauuggacuaacaucaagagcuaccugggcacaaaacaucuuaacagcuauucaacaaguuagaagucuaauaggagaugaggaguuuuuagacuacaugcccuccaugaaacguuucagaaaagaagaagaaagcgaaggcgcuauuugguaa

SEQ ID NO: 23292 - RNA, 9873 nt, Artificial Sequence
  derived and/or modified CDS sequence (opt6) from DENV-3__FJ744739__SS-prME
acgaguuugugccuuaugaugaugcuacccgcgacucuggcguuccaucuuacuagcagagauggagaaccucggaugauaguugcuaaaaaugaaagaggaaaaaguuuauuauuuaaaaccguuaguggcauuaacauguguacgcuaauagcuauggacuuaggcgaaaugugugaugacaccguuacuuacaaauguccucuaauagcugaaguagaacccgaagacauugacugcuggugcaacuuaacaucgacaugggugaccuacggaacauguaaccaagcgggcgaacaucgacgugauaaacgauccguugcacuagcaccucacgugggaaugggcuuagauacacguacacaaacauggaugagcgcugaaggugcuuggcgacaaguagaaaaaguagaaacuugggcacuaagacacccgggcuuuaccauacuugcccucuuucuagcucauuauaucggaacaucauuaacacagaaagucgucauauucauacuucugaugcuagugacuccaucuaugacuaugagauguguugguguugguaauagagacuuuguggaaggauuaucuggugccacauggguagacgugguccuagaacacggaggguguguaacaacgauggcgaaaaacaaaccgaccuuagacauagaauuacagaaaacagaagcuacucagcuugcaacuuuacgaaaacuauguauagaaggcaaaauuacuaacaucaccaccgacucuagaugcccaacucaaggugaagcgauuuuaccggaagaacaagaucaaaauuacguaugcaaacauacuuauguagaccgaggauggggcaacgguuguggacuauuugguaaaggaaguuuaguuacgugcgcuaaauuucaauguuuagaacccauagaagggaaagugguacagcaugaaaaccuaaaauauacuguaauuauuacuguucauacgggagaccaacaccaaguaggaaacgauacgcaagguguaacuguagagauuacuccacaagcgucgacugucgaagcaauauuaccggaauacgguacccuuggguuagaauguucaccgaggacuggucuugacuuuaacgaaaugauacuauuaacuaugaaaaauaaagcauggaugguacacagacaaugguucuuugauuuaccuuuacccuggacuagcggcgcaaccacugaaacaccaacauggaaucguaaagaauuacucguaacguuuaaaaaugcccacgccaagaaacaagagguaguaguucuuggcucccaagaaggugcuaugcauacggcucuaacgggugcaacggagauucaaaacucaggagggacgucaauuuucgccggccaccuaaaauguagguuaaaaauggacaaauuagagcucaaagggaugaguuaugcaauguguuugaacacauucguacucaagaaagagguuagcgaaacucagcacggcacaauucuaauuaaagucgaauauaaaggggaggacgcaccauguaaaauaccauuuaguacggaggaugggcaaggaaaagcacacaauggaagacuuauuacggcgaauccuguaguaacaaagaaagaagaaccuguaaauauagaagcugaaccuccauuuggcgaaagcaacauaguaauaggaauuggagacaaagccuuaaagauaaauugguacaagaaggguucgagcauaggaaagauguuugaagcgacagcgcguggcgcccgcagaauggcuauacuaggugacaccgcgugggacuuugggagcguagggggcguauuaaauucccucgggaaaaugguacaucagauuuucggaagcgcauauacggcauuauuuagcggaguaaguuggauaaugaaaauaggcauuggaguucuucuaacguggaucggcuugaacaguaaaaauacaaguauguccuucaguuguauaguuauaggaauaaucacuuuguacuuaggcgccgugguccaagcagauaugggaugcguaaucaacuggaaaggaaaggaguuaaaauguggcuccggaauuuucgucacuaaugaaguacauacuuggacggagcaauauaaguuucaggcagauuccccaaaaagacuagcaacugcaauagccggugcuugggaaaacggggucugugguauucgaucaaccacaaggauggaaaaucucuuguggaagcaaaucgcaaaugaacuuaacuauauauuaugggaaaacaauaucaaauuaacugugguagucggggauauaaucggaguacuagaacaagggaaacggacauugacuccccaacccauggaauuaaaauacuccuggaaaacauggggcaaagccaaaaucguaacggcagaaacgcaaaauucgagcuuuauaauagaugguccaaauacaccggagugcccaagugcuucgagggcauggaacguaugggagguugaagauuacggguuuggaguauucacgacaaacauaugguuaaaguuaagagaaguguacacucaaaguugcgaccacagguuaaugucugcggcuauaaaggacgaacgugcggugcacgcggacaugggcuauuggauugagucucaaaagaacgguucuuggaaauuagagaaggcgucuuucaucgaaguaaagacuuguacuuggccuaagagucauacguuauggaguaauggcguuuuagaaagugauaugauuauacccaaaagccucgcgggucccaucagucagcauaaccauagaccgggauaucauacucagacagccgguccauggcauuuagguaaauuagaacuagacuuuaauuauugugagggaacgaccguaguuauuacggaaaauugugggaccagggguccuaguuuaagaaccacuacagucucgggaaaacuaauacaugaaugguguuguagaucuuguacgcuuccaccauuacgauacaugggggaggauggauguugguaugguauggaaauacgaccgauaaaugaaaaagaagaaaacaugguaaaaagucucguaagugcgggcucaggaaaaauggauaauuuuacuaugggcauuuuaugcuuagcgauucuguucgaagagguaaugagaggcaaauucgggaagaagcacaugaucgcggguguguuauuuacuuucguacuauuauuaagugggcaaauuacauggcgcgauauggcucacacgcuuauuaugauagguaguaacgcgagugaucgaauggggauggguguuacuuacuuagcauuaauagcaacuuucaaaauacaacccuuuuuggcuuuaggcuuuuuccuaagaaagcucacaaguagagaaaauuuacuacucgguguaggauuagcuauggcaacuacacugcaacuccccgaagauauagagcaaauggcgaauggaauugcacucgguuuaaugacccuaaaguuaauuacacaauuugaaacauaucaauuauggacagcccuaguuagucuaacauguucuaacacuauuuucaccuuaacaguagcguggcgcaccgcgaccuuaauacuagcggggguuucauugcuacccuuaugccaguccucgucgaugagaaaaacugacugguugcccaugacaguagcagcaaugggcgucccaccucuacccuuguuuauauuuucauugaaagauacuccuaaacgcagaucuuggccucucaaugaaggagucauggcaguuggguuaguuuccauauuggcgucaagucuucucagaaacgaugugcccauggcagggccguuaguagcuggggguuuguugauugccuguuacguaauaacugggacaucagcggauuugacaguagaaaaggcagccgauguuacaugggaggaagaagcugagcaaacaggaguaucacacaaucuuaugauaacuguagacgacgacgguacgaugagaauaaaagacgaugagacagaaaauauacucacaguuuuguugaaaacagcccuuuuaauaguauccggcaucuuuccuuauaguauacccgcuacguuauuaguauggcauacuuggcaaaaacaaacucagagaucuggaguauuaugggauguaccaucaccacccgagacgcaaaaagcagaauuagaagaaggugucuauagaauuaagcaacaagggauauuugguaaaacucaaguaggaguaggcguucagaaagaaggaguguuucauaccauguggcauguuacacgcggcgccgucuuaacucauaacgguaaaagacuggaaccuaauugggcauccguaaagaaggauuugauaucauacggaggcgguuggcgcuuaucggcucaauggcaaaaaggugaagaaguacaagucauagcaguggagccaggcaagaaccccaaaaacuuucaaacuaugccuggaauauuccagacaacaaccggugagauaggagcuauagcacuugauuuuaagccagguacgucuggaucaccaauuauaaaucgcgaaggaaagguugucgggcuuuacggcaauggaguggugaccaagaauggcggauauguuuccggaauugcacagacuaaugcugaaccagacggacccaccccugaacucgaagaagagauguuuaagaagcgaaaccuaacaauuauggauuuacauccaggaagugggaagacgcgaaaguaucucccggcuauuguuagagaagcaauaaagcgaaggcucagaacacuuauucuagcuccaacgcgaguagucgccgcggaaauggaagaggcgcuaaaaggcuugccuauucgauaucaaacgacugcaaucaaaucagaacauacuggacgagagaucgucgaccucaugugucacgcgacauucacaaugcgucuacugagcccaguacgaguuccuaacuauaaccuuaucauaauggacgaagcucauuuuacagauccugcuucaauagcggcaagaggauauauuaguaccagagucggcaugggagaagcagccgcuauauuuaugacggccacucccccuggaacagccgaagcauuuccucaaucgaacgcuccaauacaagacgaagaaagagauaucccugaaaggaguuggaauagcgguaaugaguggauuacagauuucgucgggaaaacugucugguucguaccauccauuaaagcugggaaugacaucgcuaauugucucaggaaaaaugggaagaaagucauucaauugagcagaaagacguuugacaccgaguaccagaaaacgcgauugaaugauugggacuucguaguaacaaccgacaucucagagaugggggcaaauuuuaaagcggaucgcguuauagauccaagaagaugucuaaaaccgguaauucuuacggauggacccgagagagucauacuagcgggccccaugccugucacagccgcgagugcagcacaacgaagaggcaggguaggaagaaauccccagaaggagaacgaccaguauauuuuuacaggacagccccugaacaacgacgaagaccacgcccauuggaccgaggcaaaaauguugcuagauaauauaaauacaccugagggaauuauaccugcucuuuucgaaccugaacgcgagaaaucugcagccauugacggagaauacaggcuuaaaggugaauccagaaaaaccuuuguagaacugaugagaagaggggaucuaccaguaugguuggcacacaaaguagcaucagaggggauuaaauacaccgaucguaaauggugcuuugacggagaacgcaauaaucaaauacuugaagaaaacauggacgucgagauauggacaaaagagggcgaaaggaagaaacucagaccucgguggcuagaugcaagaacauauagcgacccauuggcacuuaaagaauuuaaagacuuugccgcaggcagaaagaguauagcauuagacuugguaacugaaauaggaaggguuccgucucauuuggcucacagaacaagaaaugcacuagauaauuuaguuauguuacauacuuccgaacauggaggacgcgcauaucgacacgcaguugaggaacuacccgaaacuauggaaacauuguuacucuuaggacuaaugauccugcucacugggggugcaaugcuauuuuuaauuagugggaaaggaaucgggaaaacaucaaucggacuaauauguguuauaguaaguagcgggaugcuauggauggcagauguaccacuacaauggaucgcaucugcgauuguguuggaguucuuuaugaugguacuauuaaucccugaacccgagaaacagcgaacaccacaagacaaccaguuagccuacgucguuauuggcauacugacucuagcugcgauuguuacagcuaaugaaaugggucuauuggaaacuacuaagagagaucuggguaugaguaaagagcccgguguuguaucaccaacgucauauuuagaugucgaccuucauccugcaagcgcauggacauuauaugcaguagcuacaacugucauaacaccaaugcuuagacacacaauagaaaacagcacagcaaacguaucauuagcugcaaucgcuaaccaagcagugguucucauggguuuagacaagggauggccaauaucaaaaauggaccugggcgugccuuuauuagcucuaggauguuauucacaaguuaauccguuaacguuaacagcagcaguguugcuuuuaguaacacacuacgcgauuauuggaccuggccuacaagcgaaggcaacaagagaggcgcagaaacggaccgcggcuggaauaaugaaaaauccuaccguagauggcauuaugacuauagaccucgauccaguaauauacgauucaaaauucgaaaagcaauuggggcagguaauguuacucguuuuaugugcaguccaacuguuauugaugagaacaucuugggcgcuaugugaagcccuaacgcucgccacagguccgauaacaacccuaugggaaggaucaccuggaaaauuuuggaauacaacaauugcuguaagcauggcgaacauuuucagaggcucuuauuuagcuggagcgggacuagcguucucaauuaugaaaagcguugguacaggaaaacgcggcacgggaucacaaggugagacacuaggagaaaaauggaagaagaaauuaaaucaguuaucaagaaaggaguuugaccucuacaagaaaagcgggauaacggaaguugauagaacagaggcuaaagaaggccuaaaaagaggagaaacaacccaucacgccgucucgcgugggagcgcuaaacuccaaugguuugucgaaagaaacauggugauccccgaaggaagagugauagauuuaggauguggcagagggggcuggucuuacuacugugcaggacugaagaaagugacggaaguaaggggcuauacuaaaggagggccaggucaugaagaaccaguaccuaugucaacauacggcuggaauauuguaaaacuuauguccggaaaagauguauuuuaccuaccaccugaaaaaugcgacacccuguuaugugauaucggcgaaucuagucccagcccgacaguagaagaaucuagaacaauuagggucuuaaagaugguagagccauggcuuaaaaauaaucaauuuuguauaaaagucuugaacccuuacaugccaacagugauagaacaccuagagcgccuccaacggaaacacgguggaaugcuaguuagaaauccucucaguaggaacucaacacacgagauguauuggauuuccaauggcacaggaaauauugucucaucggugaauaugguaaguagauuacuacuuaacagguuuacuaugacccauagaagaccgacaauagaaaaagacguggacuugggcgcgggcacacgucacgucaaugcagagccagaaacaccuaauauggaugugauuggagagagaaucaaaagaauuaaagaggaacacaguagcacguggcauuacgaugacgagaacccauauaaaaccugggcauaucaugggucauacgaagucaaagcaacaggaucugcaucuaguaugauaaacggagucguuaagcuguuaaccaaaccuugggacguuguaccaaugguaacucaaauggcaaugacugauacuacaccauucggccaacagcgaguuuucaaggaaaaagucgauacuagaacaccgagaccaaugccuggcacuagaaaaguaauggagauaacagcugaguggcuuuggagaacguuaggccggaauaaacgaccaaggcuauguacgcgagaagaauuuacuaagaaggucaggacaaaugccgcuaugggcgccguuuuuacagaggaaaaucaaugggauucugcacgggcggcaguagaagacgaagaguucuggaaauuaguagacagggagagagaguuacauaaauuggggaaaugcggcucauguguuuauaauaugaugggcaagagagagaagaaauuaggagaguucggcaaagccaaaggaagcagagcaauaugguacaugugguuaggagcucgauaucuggaguucgaagcgcuaggcuuuuuaaacgaagaccacugguucagcagagaaaacuccuacaguggcguggaaggugaaggccuccauaaauugggauauauauuacgugauauaucaaagauuccggguggagcgauguacgccgaugacacugcuggcugggauacuagaauaacugaagaugacuugcauaaugaggagaaaauaacacaacaaauggauccagagcaucgucaguuagccaaugcaauauucaaauuaacguaccagaacaaagugguuaaaguucagagaccgaccccaaaggguaccguaauggauauuauaagucguaaggaccaaagggguucaggucaaguaggaacauauggacuuaauacguucacgaauauggaggcacaacucguaagacaaauggagggcgaaggagugcuaucaaaaguagaucucgaaaauccccaccuucuagaaaagaaaauaacccaauggcucgaaacuaaaggaguugaaagacuuaggcgaauggccauaaguggagaugauuguguuguaaaacccauagacgauagauuugcgaaugcacuauuagcucuaaacgauaugggcaaagucaggaaggacauaccucaauggcaaccaucgaaaggcuggcaugacuggcaacaagucccguucuguagucaucauuuucacgaacucauaaugaaagacggucgaaagcuaguugugccuugucgaccucaggacgaauugauuggaagggcccgaaucucgcaaggagcuggauggucacuaaaggaaacagcuugucuagggaaagcauaugcacaaaugugguccuuaauguacuuucacagaagagacuugcgguuagcgucaaaugccaucuguucugcgguaccaguucacuggguuccaaccucaaggacuacauggagcauacaugcgcaccaucaauggaugacuacugaagacaugcuaacggucuggaaucgagucuggauagaagauaauccuuggauggaggacaaaacucccguuacaacaugggaagacguaccauaucuugggaagcgugaagaucaaugguguggaaguuuuaucggccucacuagccgagcuaccugggcgcaaaauaucuugacugcaauacaacaaguucggucacucauaggugaugaggaauuuuuggauuauaugcccucaaugaaacgauucagaaaggaagaggaaucagaaggugcaauaugguaa

SEQ ID NO: 23293 - RNA, 9873 nt, Artificial Sequence
  derived and/or modified CDS sequence (opt6) from DENV-3__FJ744740__SS-prME
acuagcuuaugccuuaugaugaugcuuccugcaacacucgcguuccaucugacaagucgagauggugaaccucggaugauuguugccaaaaacgaaagagggaaaagccuguuauuuaaaacugcauccggaauaaauaugugcacccugaucgcuauggacuuaggagaaaugugcgacgacacuguuacguauaaauguccuuuaaucgcagaagucgaaccugaagauauagauugcuggugcaauuuaacuagcacauggguuacauacggcacauguaaucaagcaggggaacauagacgugacaaacguuccguagcgcuugcaccucacguggguaugggucuagacacuagaacucaaaccuggaugucagcagaaggagcauggcggcaaguugagaaagucgaaacaugggcgcuuagacauccuggauucacaauccucgcauuauuucucgcucauuauauaggaacgaguuugacccaaaaaguaguuauauuuauauugcucaugcuuguuacuccuucgaugacuaugcgauguguggguguuggcaauagggacuucguugaaggacuaaguggugccacuuggguagacguuguacucgaacacggagguugugucaccaccauagcuaaaaacaaaccuacacuugauaucgaauuacagaaaaccgaagcaacacaacuagcaacgcuucguaaacucugcauagaagguaaaauaacgaacauaacaacggauucacgauguccaacacaaggcgaggccauccuaccugaagaacaagaucaaaacuaugucuguaaacacaccuacguugaucgcggauggggcaacggaugcggcuuguuuggcaaaggcaguuuggugacgugugcaaaauuccaaugucuugaacccauagaaggcaaaguuguacaacacgagaacuuaaaauacacagugauaauuacaguacauacuggagaucaacaccaaguggguaaugauacucagggagucacuguggaaauuacaccacaagcuagcacuguugaagcaauccuuccagaauaugguacacuuggguuagaauguucgccgcggaccggccuagauuuuaaugaaaugauacucuuaacaaugaaaaauaaagcauggaugguucacagacagugguucuucgaccugccccucccauggacuucuggagccacaacggaaacaccaaccuggaacaggaaagaauuauuggugacuuuuaaaaaugcccacgccaagaaacaggagguaguaguacucgggucucaagaaggagcgaugcauacugcgcuaacaggagcuacugaaauacaaaacagugguggaacgucaauauuugcaggccaccuuaaauguagacuuaaaauggauaaauuagaacuaaaagguaugucguaugccaugugcuuaaauacauuuguccugaagaaagagguauccgaaacacaacacggcacaauucugauaaaagucgaauacaaaggagaagaugcaccauguaaaauccccuuuagcaccgaagauggacaagguaaggcccacaauggaagacugauaacggcuaacccgguuguaacgaagaaagaagaaccugucaacauugaagcagaaccaccuuucggcgagucuaauaucguuaucggaguuggcgacaaagcguuaaaaaucaacugguacaagaaaggaucaucaauuggaaaaauguucgaagcuacugcaaggggagccaggagaauggcuauauuaggugauacggcaugggauuucgggagugucggaggagucuuaaacucccuaggcaaaaugguccaccaaauuuucggcucagcuuauacggcacuauuuucugggguaaguuggauaaugaaaauugggauaggaguguugcuaacuuggauaggauugaauaguaaaaacacauccaugucguuuuccuguauagucaucggaauaauuacauuauauuuaggggcuguuguacaagcagauaugggaugcguaauaaauuggaaaggcaaagaauuaaaaugcggaucagggauauuugucacuaaugaaguacauacauggacagaacaguacaaauuucaggcugauaguccaaaaagacuagccacagcgauagcaggagccugggaaaacgguguaugcgguauccggaguacuacaaggauggaaaaucuacuuuggaaacaaauagcaaaugagcucaacuacauacucugggaaaauaacaucaaguuaacugucguugucggagacauaaucggaguacuagagcagggcaaaagaacauuaacuccucaaccgauggaacuuaaauauaguuggaaaacuugggguaaggcuaaaaucguaacugcugaaacacaaaacucgaguuucauuauagacggccccaacacaccugaauguccuagugcaucccgagcguggaacguuugggaaguggaagacuauggcuucgguguauucacaacuaacaucugguuaaaacuuagagaaguuuauacucagagcugcgaucacaggcucaugucugcagccauuaaagacgaacgugcuguccacgccgauaugggcuauuggauugaaucacagaaaaauggaaguuggaaguuagaaaaagcuaguuucauagaaguaaagacauguacauggccuaaaucacacacuuuguggucaaacggaguucuugaaucggauaugauuaucccaaagucccucgcgggcccaauaucacaacauaaucauagaccaggauaccacacacaaacagcaggucccuggcauuugggcaaacuagagcuagauuucaauuacugcgagggcacuacgguuguaauaacggaaaacuguggaacacgaggaccgucucuccgaacgacaacaguuuccggcaaauuaauacaugaauggugcugcagaaguuguacuuugccuccauuaagauauaugggggaagaugguugcugguacgggauggaaauacgaccaauuaaugaaaaagaagaaaauaugguaaagagucugguuucagccggaucagguaaaguagacaacuuuacaaugggaauacuguguuuagccauauuguuugaagaagucaugagggguaaauuuggcaagaaacacaugauugcugguguacuuuuuacauuuguccuacugcuaaguggucagauuacuuggcgggacauggcccauaccuuaaucaugauagguaguaacgcuagugauaggauggguaugggaguuacauaccuagcacuaaucgccacguuuaagauucaaccauuuuuagcauugggauucuuuuuacggaaacuaacaagccgagagaauuuacuuuuaggaguaggauuagcgauggccacaacccuccaauuaccugaggauauagaacaaauggcaaacggcauugcuuuaggauugaugacguuaaaauugauaacacaauuugagacuuaucaauuauggaccgccuuaguaucccucaccuguaguaauaccauauuuacuuugaccguggcauggagaacggcaacauugauauuggcuggaguuucacuacuucccuuaugucagaguucaucuaugagaaaaacagauugguuaccaaugacaguagccgcuaugggcguaccuccauuaccucucuuuaucuuuaguuugaaagauacacccaaaagaagaucauggccucuaaaugaaggagucauggcaguuggacucgucucgauacucgcgagcucauuacuucguaacgacguaccgauggccggaccacucguggcagggggacuacugaucgcauguuauguuauaacggggacaagugcagaucucacuguugagaaagcagcggauguaacuugggaagaagaagcagaacagacgggagugucucacaaucuaaugauaaccguggacgaugacggcacuaugagaauuaaagaugaugaaacugaaaacauucugacaguucugcuuaaaacggcauuguuaauaguuagcggaaucuuuccuuauucuauuccagcaacacuauuaguuuggcauacuuggcagaaacaaacacaaagaucugguguguugugggauguacccaguccgccugaaacacaaaaagcagagcucgaggagggagucuauaggaucaaacaacaagguauauuuggaaaaacacagguuggugugggaguacaaaaagaaggcguuuuucauaccauguggcaugugacgaggggcgcuguuuuaacucacaaugggaaaagguuggaacccaauugggccagcgugaaaaaggacuuaaucagcuaugggggaggcuggagacuaagcgcacaguggcagaaaggagaggagguucagguaaucgcagucgaacccgggaaaaaucccaaaaacuuucagacaaugcccggcaucuuucaaacgacaacgggugaaaucggagcuauagcauuagauuucaaaccaggaacaucagguucgcccauaauaaacagagaagggaaaguagucggauuguacggcaauggaguaguuaccaaaaauggcggcuacguaucaggaauugcucaaacuaaugcugaaccugaugggcccacgccagaacuggaagaagaaauguucaagaaacgaaaccugacuauaauggacuuacauccugguuccggaaaaacgcgaaaguaucuaccggccauaguccgugaagcaauaaaaagacgucuuagaacacuaauuuuagccccuacgaggguuguagcugcugaaauggaagaagcccucaaaggccuacccauaagauaccaaaccacagccauaaaauccgaacacacagguagagagauuguagauuuaaugugccaugcgaccuuuacuaugcggcucuuaucaccuguaaggguaccuaacuauaaucuuauuauuauggacgaagcccacuucacugauccggcaaguauagcugccagaggcuauaucucuacacgcguugguaugggcgaggccgcagccauauuuaugacggcgacgccaccugggaccgcagaagcauuuccacaaucuaaugcaccuauccaagacgaagaacgggauauaccugaacggucguggaacucuggaaaugaguggauuacugauuuuguggguaagacagucugguuuguuccuuccauuaaagcugguaacgauauagcuaacugccuacggaagaacgguaagaaaguuauucaacucucccguaaaacuuuugacacagaauaucagaaaacuagguuaaaugacugggauuucguaguaaccacagacauuucugaaaugggggcaaauuucaaggcagaccgagugaucgacccaagaagauguuuaaaaccaguaauauuaacagauggaccugagcgugucauuuuagcaggaccuaugccgguaacugcugcaucagcggcgcaacgaagaggcagaguugggaggaacccgcaaaaagagaaugaucaauacauauucaccggucaaccuuuaaacaaugacgaggaccacgcacacuggacugaggccaaaaugcuucuagauaauauaaauacuccugaaggaauuauuccagcucuauucgaacccgaaagagaaaaaucggccgcgauugauggugaauaccgacucaaaggcgaaucucggaaaaccuucguagaguuaaugaggagaggggaccuccccguauggcuugcacauaaagucgcuucggaaggaauaaaauauacugauaggaaguggugcuuugauggcgagcggaacaaccaaauccuugaagaaaauauggauguugaaauauggacgaaagaaggugagagaaagaaacuuagaccuagauggcuagacgcacgaacauauuccgacccauuagcgcucaaagaguuuaaagacuuugccgccgggcguaaaaguauagcuuuagauuugguuacagagauaggacgcguuccaucacaucuagcacaucguacaagaaacgcgcuagauaaucuggucauguuacacacguccgagcauggugguagagcguacagacaugccguugaagaacuaccugagacgauggaaacgcuuuuauugcuaggacugaugauccucuugaccggaggagcuaugcuauuuuugauaucgggaaagggaauaggaaaaaccucuauaggccuaauauguguuauaguuucuuccgggauguuauggauggcagauguaccgcugcaauggauugccucugcaauuguacuagaguucuucaugaugguuuuacuuauaccugaaccggaaaaacaacgaacuccccaagacaaucaacuggccuauguaguuauugggauucucacuuuagccgcaauagucacugcuaacgaaaugggauugcuggaaacaaccaaaagagaucuugggauguccaaagaaccagggguuguaagcccaacuucuuaucucgacguagacuugcaccccgcgucggcguggacuuuauacgcuguggccacaacugugauaacaccaauguuaaggcauacgauugaaaauuccacugcaaaugucucauuagcugcaauugcaaaucaagcuguagugcugaugggucuagauaaaggauggccaaucucaaagauggacuuaggggucccgcuauuagcauuaggaugcuauucucagguuaacccauuaacucucacagcggccguauuauugcucguaacacauuacgccauuaucgggccaggacuucaagcuaaggcaacaagggaagcacaaaagaggacugccgcgggcauuaugaaaaauccaacgguggacggaaucaugacaauugacuuagacccagugaucuaugauuccaaauuugagaaacagcuuggacagguaaugcugcuaguacuaugugcgguacaacuacuauugaugagaaccuccugggcauuaugcgaagcauuaacauuagcaacgggaccuauuacaacccugugggaggggucuccaggaaaauucuggaauaccacaaucgcuguaucgauggcuaacauuuuuagaggaucguaucucgccggugcaggccuagcauuuaguauaaugaaaucggugggaacgggaaaacgaggaacugguucacaaggagaaacccuaggcgaaaaauggaaaaagaaguuaaaucaacuuagcaggaaagaguuugaccuauauaagaaaagcgguauaacagaaguugauagaacggaagcaaaagaaggucuaaaaagaggagaaacuacccaucaugcaguuagucgcggaucagcgaaacuacagugguuuguagaaagaaacauggugauuccagagggacgaguuauagaucuuggaugcgggcguggaggauggucguauuacugugcgggacuuaaaaagguaacugagguacggggauacaccaaagguggaccuggacaugaggaaccaguuccaaugucgacguacggauggaauauuguuaaacuaaugagcggaaaagaugucuuuuaucuaccgcccgaaaagugugauacguuacuuugugacauaggagagaguucuccaucaccaacaguagaagaaucucgaacaauucggguacucaaaaugguagaaccauggcuuaagaacaaucaguuuuguauaaaaguacugaauccuuauaugccuacagucaucgaacaucuggaacgacugcaacgaaaacauggaggaaugcuuguucgaaacccacuuucucgaaauucuacacaugaaauguacuggaucaguaaugggaccggaaauauugucucuucaguuaacauggucagucgauuauuacuuaauagauucacaaugacccaucgccgacccacuauagagaaagauguagaucuuggggcaggaacaagacaugucaacgcugaacccgaaacgcccaauauggacguaaucggagaaaggauuaaacguauaaaagaagaacacucuaguacguggcacuaugacgaugagaauccguauaaaacuugggcguaucacgggagcuaugaagugaaggcaacaggaagugcaucaaguaugauaaacggugugguaaaguuacuuacgaaaccaugggacguaguaccaauggugacucaaauggcuaugacggacaccacucccuucggacaacagcgagucuuuaaagaaaaaguggacacaaggacaccacguccuaugcccgguacaaggaaggugauggaaaucacagcagaguggcuuuggagaacacugggacguaacaagagaccaagauuauguacacgcgaagaauuuacuaagaaagugagaacgaacgcugcuaugggcgccguguucacagaagaaaaccaaugggauuccgccagggcagcaguugaagaugaagaauuuuggaaauuaguagaccgugaacgcgaauuacauaagcuaggaaagugcggaaguugcguuuauaacaugauggggaaaagagagaagaaauuaggagaguucgguaaagcuaaagggucaagggcaauaugguauaugugguugggugcgcgguaccuggaauuugaagcucuugguuuucucaacgaagaccacugguuuucuagggagaauagcuauucagguguugaaggagaaggacuccacaaauuaggauacauacucagagacauuucaaagauaccagggggugcaauguacgccgaugauaccgcaggcugggauacucgaauaacagaagaugauuuacauaacgaagagaaaauaacacaacaaauggauccugaacaccgacaauuggccaacgccauauuuaaacuuacauaccaaaauaaaguuguaaagguacagcguccaacaccuaaggguaccgucauggacauaauuucacgaaaagaucaaagagguuccggacaagucgggacguaugguuuaaauacauuuacuaauauggaggcccaauuggugaggcaaauggaaggcgaagggguauuaucuaaaguugacuuggagaacccacaucuacuagagaagaaaauuacacaauggcuagaaaccaaagggguagaacgacuuaggcggauggccaucucuggcgacgauugcgugguaaaaccuauagaugaucgauucgcgaaugcucuacuagcuuuaaaugauauggguaaaguucgaaaagacauaccgcaauggcaacccucuaagggauggcaugauuggcaacaaguuccauuuugcucucaccauuuucacgaauugauaaugaaagacggacguaaacuugugguaccuugcagaccccaagacgaauuaauuggacgugcccguauuucgcagggagcaggauggucacugaaagagacagcaugucuagguaaagcauaugcacaaauguggagucuaauguauuuucaccggcgagaccuaagacuugcaucaaacgcaauuuguuccgcaguaccuguacauuggguaccaacuuccagaacaacauggucaauacacgcacaucaccaauggaugaccacugaggacaugcuaacaguauggaaucgaguuuggaucgaagacaaccccuggauggaagauaagacaccagugacaaccugggaagacguuccauacuuaggaaaaagagaagaucaaugguguggcucacuuauuggccuuacuucacgagcuacuugggcccaaaauauacuaacagccauccaacaaguacgcucuuugauaggagaugaagaguuucuggauuauaugccgucaaugaaaagauuucgcaaggaagaagaaagugagggugcgaucugguaa

SEQ ID NO: 23294 - RNA, 9873 nt, Artificial Sequence
  derived and/or modified CDS sequence (opt6) from DENV-3__GQ868593__SS-prME
acgucacuauguuugaugaugaugcuaccagcuacccuagccuuucaccuaacaaguagagacggugaaccgagaaugauuguggggaaaaaugaacgagguaaaucucuucuauuuaaaacagcuucaggaauuaacaugugcacuuuaauugcaauggaccugggggaaaugugugaugacacagucaccuacaaauguccccauauagcagaagucgaaccagaagauauagacuguugguguaacuugacaaguaccuggguaacauacggaacaugcaaucaagcaggagaacaucgaagagauaaacgcaguguagcacuggcaccacauguagguaugggucuugauacaagaacucaaacauggaugucggcagaaggagcguggaggcaaguugaaaaagucgaaaccugggcacuacgucacccagguuuuacaauccuugcuuuguuccucgcccauuauauuggaacaagucugacgcaaaaaguaguaauuuuuauccuucuaauucuaguuacuccuaguauggcuaugaggugcguaggagugggaaacagggauuucgucgaaggacuaaguggcgcuacguggguugauguuguucucgaacacggcggauguguaaccacuauggcgaaaaauaaaccaacucuugauauagaauuacagaaaacggaagcaacacaacuugcaacgcuccguaaacuuuguauagaaggaaaaaucacaaauauuacaaccgauucacgguguccaacgcaaggagaagcaauacugcccgaggaacaagaccaaaacuaugugugcaaacacacguacguagaucgcggcuggggaaaugguugcgggcuguucgguaaaggcucacuuguuaccugcgcuaaauuucaauguuuagaaucaaucgaaggaaaaguuguucaacaugagaacuuaaaauacaccgugauaauuacgguccauacgggcgaucaacaucagguagguaaugaaacgcagggagugaccgccgagauuaccccgcaggcuucaacgguugaggcaauccuaccggaauacggaacccuuggucuagagugcucaccucggacgggucuugacuuuaaugaaaugauacuacuuacgaugaaaaauaaagcauggaugguucacagacaaugguucuuugaucuuccuuuaccauggacgucuggggcaaccacagaaaccccaacauggaacagaaaagaacuauuagugacauucaaaaaugcucacgcuaagaaacaagaaguagugguauugggaucacaagaaggugcuaugcacaccgcccuuacuggugcuacagagauacaaaacaguggcggcacgucaauuuuugcuggacacuuaaagugcagauuaaaaauggacaaacuugaauugaaaggaaugucauacgcaaugugucugaauacuuucguccugaagaaagaaguuuccgaaacacagcauggaaccauccuaauaaagguggaguauaagggagaagaugcccccuguaaaauaccauucucuacggaggacggucaagguaaagcacacaacgguagauugauaacagcuaauccuguagucacuaagaaagaggaaccuguuaacaucgaagcagaaccaccauuuggagaaaguaauaucguuauaggaauuggcgacaaagcguugaagauuaauugguauaagaaaggcucaucuauaggcaaaauguuugaagccaccgcucguggugcaagaagaauggccauccuuggagauacagcuugggacuuuggaucagugggcggaguacucaauucguugggcaaaaugguacaccaaauuuucggaagugcauacacggccuuauucucugguguaucguggauuaugaaaauaggaauugguguuuuacuuacuuggauaggauuaaauuccaaaaauacaagcaugaguuuuucuugcaucgcgauaggaauaauuacuuuguaucucggugcgguuguacaagcugacaugggaugcguuauuaacuggaaaggcaaggaacuaaaaugcggaucagggaucuucguuaccaaugaaguacauacuuggacagaacaauacaaauuucaagccgacucucccaaacgguuggcgacggcaaucgcaggagcaugggaaaacggggugugcggaauaagaaguacuaccagaauggaaaauuuguuguggaagcaaauagcaaaugaacuaaauuauauccucugggagaauaacauuaaacuuacgguuguaguaggagauauaaucggagugcuagaacaagggaaaagaacacuuaccccucagccaauggaauuaaaauacaguuggaagacaugggguaaagcuaagaucguaaccgccgagacacagaacaguucuuucaucauagacgguccaaacacaccagaauguccaagugcuucacgagcauggaacgucugggaaguagaggacuacggguucggagucuuuacuacgaacauauggcuaaaacuacgagaaguguacacccaacuuugugaucacagguuaaugucagcugcuguuaaggaugaaagggcuguacacgcagacaugggauacuggauugaaagucagaagaacggguccuggaaauuagaaaaagcaucauuaauugaaguaaaaacuuguacuuggccgaaaucucacacacuauggucaaaugguguucuagaaagcgacaugauaauaccgaagagucuagccggucccauaucacaacauaaccauagaccaggauaucauacacaaacggcgggaccuuggcaucuaggaaaacuagaauuagauuucaauuauugcgaaggaacaacaguuguuaucacagagaauugcgguacuagagguccgagucuuagaacaacgacaguaucuggaaaacuuauccacgagugguguugucgaagcuguacgcucccaccgcuacgguauaugggcgaagacggaugcugguacgggauggaaauacgcccaauaaaugaaaaagaggaaaauaugguaaagucccuagcuucggcgggaucgggaaagguagauaauuuuacaaugggagugcucugccucgccauucuauuugaagagguaaugcgagguaaauuugguaagaaacacaugauagccggaguccuccuaaccuuuguacuucugcucuccgggcagauaacuuggcgagauauggcacauacucucauaaugauugguaguaaugccuccgauagaaugggcaugggaguaacauaccuugccuuaauugcaacguuuaaaauacaaccguuccuagcuuuaggcuucuuucugcgaaagcuaacgaguagagaaaacuuauuauugggaguggggcuagcuauggcaacaacgcugcaauuaccagaagauauagaacagauggcuaaugguauugcucuaggacugauggcucuuaaauugauaacacaauuugagaccuaccaauuauggacggccuuaguaagucuuacaugcaguaacacaauauucacgcuaaccguugcauggaggacagcaacucuuauauuggcgggcguaagccuauuaccgguaugucagucgucaaguaugcgaaagacagacugguuaccaauggcaguagccgcaauggguguacccccgcucccauuguuuauauuuagcuuaaaagauacacuuaagcgaagaagcuggccacuaaaugaagguguaauggcaguaggcuugguuagcauauuggcaagcucauuauuaaggaaugauguaccuauggcuggaccacuuguagcgggugggcuuuugauugcguguuauguuauaaccggaacuucagccgaucuaacagucgaaaaagcagcugauguaacaugggaagaagaagcagagcaaacaggcgugucacauaauuuaaugauaaccguggacgaugauggaacaaugagaauaaaggaugacgaaaccgagaauaucuuaacaguacuccuuaagacggcauuauuaauagucaguggaauuuucccuuauucaauaccagcaacccuccuagucuggcauacuuggcagaaacagacgcaaaggaguggaguauugugggauguacccaguccaccagaaacgcagaaggcggaacuagaagaaggaguguaucggauuaagcaacaaggaaucuuuggaaagacucaaguaggaguagggguucaaaaagaagggguguuucauacuauguggcacguaaccagaggagcaguacucacucauaauggaaagagguuagagccaaacugggcuaguguuaagaaagaucugauaagcuauggagguggauggcgacuuucugcacaauggcaaaagggugaagaaguacaagucauagcagucgaaccugguaaaaauccgaaaaauuuccagacaaugccagguauauuucagacuacaaccggugaaauaggggccauugcgcuugauuuuaaaccgggcacaucgggaaguccuauaauaaaucgagaaggcaagguaguaggauuguauggcaaugguguugucacuaaaaauggaggcuacgugagugggaucgcucaaacuaaugccgaaccggauggcccuacuccugaauuagaagaggaaauguuuaagaaaagaaaucuaacuaucauggaucuucaccccgggucaggcaaaacucggaaguaucuuccagccauaguacgagaagcgauuaaacgaagauuaagaacucugauauuagcacccacgagaguagucgcggcugaaauggaagaagcucuuaaaggauuaccuauacguuaccaaaccacugcaacgaaaucagagcauacuggaagagaaauuguagaccuaaugugucacgccacauucacaaugagguuauuaucuccgguucgaguacccaauuauaauuuaaucaucauggacgaggcacacuucacugauccugcaaguauugcagcucgcggguauauuagcacuagaguugguaugggugaagcugcugcaauauuuaugacugcaacuccaccuggaacagcagacgcauucccccaauccaacgcccccauccaagaugaggagagggauauaccugagcgaucauggaacaguggaaaugaguggauaacagauuuuguggggaagaccguaugguuugugccuuccauuaaagcgggaaaugauauugcgaacuguuugaggaaaaauggcaagaaaguuauucaacuuucaagaaaaaccuuugacacggaauaucagaaaacuaagcuaaaugauugggacuuugucguuacaacagacauuagugaaaugggugcaaauuuuaaagcagauaggguuauagauccaagacguugccuaaaaccuguaaucuugacggacggccccgagagagugauuuuggcggggcccaugccaguaaccgcugcaucagcggcgcaaagaagggggaggguaggucguaauccucaaaaggaaaacgaccaauauauauuuacuggccagccguugaauaaugaugaagaucaugcucauuggacggaagcaaaaaugcuacuagauaauauaaauacaccagaaggaaucauaccggcccucuuugaaccugagcgggagaaaagugcagcuaucgacggagaauacaggcuaaaaggcgaaagucgcaagacuuuuguggaauuaaugagacgcggagaucucccggucugguuggcccauaaagucgcuagugaggguaucaaauacacugauaggaaaugguguuucgauggggagagaaauaaucaaauauuagaggaaaauauggacguagaaauuuggacuaaggaaggugagaagaagaaacuucgaccuagauggcuugaugccaggacauacucagacccauuagcauuaaaagaauuuaaggauuucgcugcuggaagaaaaaguauagcacucgauuuagucacagaaauagggagaguaccaagccauuuagcacauagaacaagaaaugccuuagauaauuuaguuauguugcacaccucggaacauggcgggcgagcauauagacaugcaguagaagaacuaccagaaacgauggaaacuuuauuauuauugggcuuaaugauauugcuuacaggaggugcaauguuguuucuaauaaguggcaagggaauagguaaaaccuccauaggguuaaucuguguaauagcaagcagcgguauguuauggauggcagauguaccacuucaauggauagccucggcuauaguacuggaauuuuucaugaugguauuauuaauaccagaaccugaaaaacaacgaacaccucaagauaaucaacuggcuuauguuguuauuggaauauuaacauuggcagcaauaguugcagccaaugagaugggucuucucgaaacuacaaagcgagacuuggggaugagcaaggaaccuggcguaguaucaccuacauccuacuuggauguagaucuacaucccgcauccgcauggacauuguaugcuguggccaccaccguuauuacaccuaugcuuagacauacaauagaaaauucaacagcaaacguuagucuugccgcaauugcaaaccaagccguuguccuaaugggauuagacaaaggauggccaauaucuaagauggaccucggaguaccacuguuagcguuaggcugcuacagucagguaaauccccuaacucuuaccgcggcugucuuacuacuggcgacccauuaugcaauaauaggcccgggcuugcaagcgaaggcaacgagagaggcacagaagagaacagccgcggguauaaugaaaaauccaacaguagacgguauuaugacaaucgaucuagaccccgucauauaugacaguaaguuugaaaagcagcuuggacaagugaugcucuuaguauuaugugcaguccaauuauuauuaaugagaacuuccugggcacuuugugaagcauugaccuuggcuacagggccuauaacuacacugugggaagguucuccgggaaaauuuuggaacacgacaauagcaguuagcauggccaacauuuuuagaggguccuaccucgccggggcugggcuugcauuuucgauuaugaaguccguuggaacaggaaaaagaggcaccggaagucaaggggaaacuuugggcgaaaaguggaagaagaaacuaaaucaauuaucucgaaaagaguucgaucuauauaagaaaagugguaucacagaaguagauagaacagaagcgaaagaagggcuuaaaagaggcgaaauuacgagacaugccguaagcagagguuccgcuaaacuccaaugguucguggaacggaauauggugauaccugaggguaggguaauagacuuagggugcggaagaggugguuggucuuacuauugugccggucuaaagaaaguaacggaaguuagaggcuauacuaaaggugggccugggcaugaggaaccuguaccaaugucaacauauggcuggaacauuguaaaauuaaugaguggcaaagacguguuuuacuuacccccagaaaagugcgauacucuccucugugauauaggugaaagcuccccauccccaaccguagaagaaucaagaacaauaaggguacuuaaaaugguagaaccuuggcuuaaaaauaaccaguuuuguauaaagguauugaauccauacaugccaaccguaauugaacauuuagaaagacuacaacgaaaacauggcggaaugcuaguucgcaacccccuaucccgaaauucaacacaugaaauguauuggauuagcaacggaacaggaaauauaguuucuagcgucaacauggugucucgcuuauugcuuaauagauuuacaaugacgcauaggcguccaacaauagaaaaagacguagauuuaggagcagguacccgucacgucaacgccgaaccagaaacaccaaauauggacgucauaggagaacgaauuaaaagaauuaaagaagaacauaacucgacuuggcauuacgaugacgaaaacccguauaaaacgugggcauaucacggcaguuacgagguaaaagccacaggaagugcguccaguaugauaaauggcgucgucaaacucuuaacgaagccaugggauguuguaccuaugguuauucaaauggcgaugacagacacuacuccuuuugggcaacaacgagucuuuaaagagaaggucgacacccgaacuccacggccaaugccugguaccagaaaaguaauggaaauaacagccgaauggcuguggagaacacuaggacgcaauaagcguccaaggcugugcacucgcgaagaguuuacuaagaaaguccgaacaaaugcagcaaugggagccguauuuacagaggagaaucaaugggauagcgcuagagcagcuguggaggacgaagaguucuggaaguuaguagaucgugaaagggaauuacauaaacuugggaaauguggaaguuguguauauaauaugaugggcaaaagagaaaagaaauugggagaguuugguaaggcaaaaggaucccgcgccauaugguauauguggcuaggggcgagauaccuggaauuugaagcacuagguuucuuaaaugaggaccacugguucucacgugaaaauaguuacuccgguguggaaggagaggguuuacauaaauuaggguauauacuacgagauauaucaaaaaucccagguggugcaauguaugcggaugauacugcagggugggacacccgaauuacagaagaugaucuccacaaugaagagaaaaucacacaacaaauggauccugagcauaggcaauuagcaaacgcuauuuuuaaacucacuuaucaaaauaaaguggucaaaguucagagacccacaccaaaagguacaguaauggauaucauaucgagaaaagaccaacgggguucaggacaagucgggacauacgguuugaacacauucaccaauauggaagcucagcuagucaggcaaauggaaggugaaggcguauugucaaaggccgaucuugaaaauccacacuugcuugaaaagaagauaacgcaaugguuagaaacaaaaggagucgaacgauuaaaaagaauggcaaucuccggugacgacugugucguuaaaccuauagacgacagguuugcuaaugcacucuuagcguugaaugauauggggaaaguaaggaaagacaucccucaauggcagccaucaaaagguuggcacgauuggcaacaagugcccuuuugcagucaccauuuucaugaauuaauaaugaaagaugguagaaaauuaguaguccccugcaggccccaagacgaacuuauaggucgggcacgcaucucucaaggagcagguuggucuuuaaaagaaaccgcuugucucgguaaggcuuaugcccagauguggaguuuaauguacuuccaccgucgcgacuuaagauuagcaucaaacgcaauuugcagcgccgucccugugcacuggguaccaaccuccaggacgacauggagcauucaugcgcaccaccaguggaugacaacugaggauauguuaacaguuuggaacagagucuggauugaggacaauccauggauggaggacaaaacuccugucacuaccugggaagacguacccuaccuuggcaaaagggaagaccaguggugugguucacuaauuggccuaacaucaagagcaacaugggcacaaaacauauuaacagccauacaacaaguacggucauugaucgguaaugaagaauuucuagauuacaugccauccaugaaaagauucaagaaagaagaagaaagugaaggagcgauuugguaa

SEQ ID NO: 23295 - RNA, 9873 nt, Artificial Sequence
  derived and/or modified CDS sequence (opt6) from DENV-3__FJ898459__SS-prME
acaucuuuaugucuaaugaugauucuaccagcggcauuagcuuuucaucuaaccucuagagauggagaaccaagaaugauuguugggaaaaaugaaagaggaaaaucauugcucuuuaaaacagcgagcgguaucaacaugugcacauuaauagcaauggacuuaggugaaaugugugaugauacgguaacuuauaaauguccgcacauuacggaaguugaaccugaagauaucgauugcugguguaacuugacaucuacauggguaaccuaugguacaugcaaucaagcaggagaacaccgcagagauaagagaagugucgcacuggcgccacaugugggaaugggauuggauacaagaacacaaacuuggaugagugcagaaggggcauggcgccaaguagaaaaaguagaaacaugggcccuuagacauccgggauucacgauucuagcuuuauuucuggcccacuacauaggaacaucucuuacacaaaaaguggucauauuuauauuguuaaugcucgugacaccuuccaugacaaugcggugugucgggguagguaacagagauuucguugaagggcucagcggugcgacguggguggauguaguucuagaacacggagguugcguuacaacgauggcgaaaaauaaacccacacuggacaucgaacuacagaaaacugaagcuacacaauuagcuaccuuaagaaaauuaugcaucgaagguaaaauaacaaacaucacuacagauucgagaugucccacgcaaggcgaggcuguacuuccagaagaacaagaucaaaauuacguguguaaacauacguacguagaucgaggauggggaaacggcugcggcuuguuuggaaaaggaucacuuguaacaugugcaaaauuucaaugcuuggaaccaaucgaaggaaaaguaguccaauaugagaaucuaaaauauacaguaauaaucaccguccauaccggagaucagcaucaagugggaaaugaaacgcagggaguaacagcugaaaucacaccacaagcgucaacgacagaagcgauacugccggaauacgggacacucggauuggaaugcuccccgagaacaggacuagauuuuaaugaaaugauuuuacuaacgaugaaaaauaaggcuuggaugguacauagacaaugguucuucgaucuuccauugccguggacgagcggcgcaaccacggaaacacccaccuggaaucggaaagaauugcuaguaacauuuaaaaacgcgcaugcaaagaaacaagaaguuguaguccuagggucccaagaaggagcuaugcacacagcauuaacgggagcgacggaaauucaaaauucaggaggcacaucgauauucgcaggacaucucaaaugcagacuaaaaauggacaaacuugaacuaaaaggaaugagcuaugcaauguguacuaacacauucguacucaagaaagaaguuucagaaacacaacacggcacaauucuuauaaagguagaauauaagggugaagaugcaccaugcaaaaucccuuucucgaccgaagacggacaagguaaagcccacaauggaagguuaauuaccgcgaauccgguaguaaccaagaaagaagaaccaguuaacauagaggcugaacccccauucggugaauccaacauagugauagguauuggcgauaaugcgcuuaaaauaaacugguacaagaaaggaucaagcaucggcaaaauguuugaagcaacagccagaggugcaagaagaauggcuauccuaggugauacagcaugggauuucggaucagucggaggagucuugaacucauuaggaaagaugguccaucagauauuuggcagugcguacacagcauuauuuagcggagugaguuggguaaugaagauuggaauagguguauuauuaaccuggauuggauuaaauucgaaaaauacgucaaugaguuuuaguugcauagcuauuggaauuauuacccuuuaucuaggugcaguaguucaagcagacaugggauguguaaucaauuggaaaggaaaagagcuaaaaugcgggagcgggauauucguuacaaaugagguacauacuuggacagaacaauacaaauuucaagccgauaguccuaagaggcuagcaacagcaauagccggugcuugggagaauggaguuugcgguauacgaucuacaaccagaauggaaaacuuauuauggaaacaaauagcaaaugaacucaauuacauacuaugggaaaacaacaucaaacugacaguaguagugggagacaucauaggaguucuugaacagggaaaacgaaccuugacaccucaacccauggaacucaaauauaguuggaaaacuuggggaaaagccaaaauaguuacggcagaaacucaaaauaguucauucauaauagauggaccuaauacaccagaaugcccuucugcaagcagagcuuggaacguaugggaaguggaagacuacggcuucgguguuuuuacgacgaacauaugguugaaacuuagagaaguauacacgcaguugugcgaccacagauuaaugucagccgcaguaaaagaugaaagagcaguacaugcagacaugggguauuggauagaaagccagaaaaauggaaguuggaaacucgaaaaggcuagucuaauagaaguaaaaacauguacauggccaaagagccauacgcuuugguccaauggaguucuagagagugauaugauaauuccaaaaagccuggcugguccaauaucucaacauaaucauagaccuggcuaccacacucaaaccgcaggaccuuggcauuuaggaaaacuagaauuggacuucaauuacugugaaggaacaacaguaguuauaacggagaacugcggaaccaggggaccaucucuacgcacaaccacgguuucuggaaaacuaauccaugaauggugcugucgcaguugcacacuuccgccguuaagguauaugggagaagauggauguugguacggaauggaaauacguccaauuucagaaaaagaagaaaauaugguuaaaucuuuagucucagcagggucaggcaaaguggauaauuuuacgaugggggugcugugcuuagcaauacuauucgaagaagugaugaggggcaaguuugguaagaaacacaugauagcgggaguauucuuuacguuuguucuauuacuaucaggacagauuacauggcgugauauggcacacacguuaaucaugauugggucgaaugcaagugauagaaugggaaugggaguaacuuauuuagcauuaauugccaccuucaagguucaacccuuccuagcuuugggcuuuuucuuaagaaagcuaacaaguagagaaaaucuucuacucggugugggguuagcaauggcaaccaccuugcaauuaccggaagauauugaacaaauggcaaaugggaucgcauuaggccucauggcauugaaguuaauuacacaauuugagacuuaccaacuauggacugcguugauaucucuaaccugcaguaacacaauguucacccuaacuguagcuuggagaaccgcaacacuaauuuuagccggaguaucauuauuaccagucugucaaagcuccaguaugagaaaaacagacuggcuacccauggccguagcagcaaugggaguaccuccucuaccguuauucauauuuucucuaaaggacacucuaaaacgacgaaguuggcccuugaaugagggggugauggccguaggauuagucucgauccucgcaucuaguuuacucagaaaugauguuccaauggcagggccguuaguagcuggaggauuacuaauagcuugcuacguuauaacggggacgucugcugacuuaacugucgaaaaagccgccgauauuacuugggaggaagaggcagaacaaacuggaguaucacacaaucugaugaucacuguagaugacgacggaaccaugcgcauaaaggaugacgagacagaaaacauauuaaccguccuucuaaaaaccgcacuauuaaucguaaguggaguuuuuccguacagcauaccagccacucuacuuguauggcacaccuggcagaaacaaacacagagaaguggaguguuaugggauguaccaaguccaccagagacacaaaaagcggagcucgaagagggcgucuaucgaauuaaacaacaagggauauuuggaaagacucagguagggguuggcguacaaaaagaggggguguuucauaccauguggcaugucacacgcggagcaguacugacauauaauggaaagaggcuggaaccaaauugggcuucugugaaaaaggaccuuauauccuacggggguggauggagacugagcgcacaauggcaaaaaggagaagaaguucaagugauugcuguagagccugggaaaaaucccaaaaauuuucaaacgaugcccggaacguuucaaacuacuacaggagaaauaggcgcuauugcccucgauuucaagcccgguacuucugggagcccuauuaucaaccgugaaggaaaaguuguaggauuguaugggaacggcguaguaacuaagaacggcggauauguaucaggaauagcgcaaacuaaugccgaaccugauggaccaaccccagaacuagaagaagagauguucaagaaaaggaaucucacaauaauggaucuccauccaggaucugguaaaacucguaaauaccuaccugcuauagugcgagaagcuauuaaacgaagacuaagaaccuuaauccuugcacccaccagagucguugcagcugaaauggaagaagcguugaaaggacugccaauaagauaucaaacuacagcgacaaagucugagcauacgggucgugagaucguggaucuaaugugccaugcgaccuuuacuaugcgacuauuaagucccgucagggugccuaauuacaauuuaaucauaauggacgaagcccacuucacagauccugcuucuauugccgcaagaggauacauaucaacuagaguaggcaugggagaggcagcagcuauauucaugacugccacaccgccaggaacagcagacgcauucccucaaagcaaugccccaauucaggaugaggaaagagauauaccagaaagaucauggaacaguggaaacgaguggauuaccgauuucgcuggaaaaacaguaugguuugugccaucuauaaaagcggguaaugacaucgcaaauuguuugaggaaaaauggcaagaaaguaauucaauuaucacguaagaccuuugacaccgaauaccagaaaacuaaguuaaacgacugggauuuuguuguaacuacagauauuagugaaaugggagccaauuucaaagcugacagagugauagauccaagacgaugccuaaagcccgugauccugacugaugggccugaaaggguuauacuagcugggccaaugccgguuaccgcagcuucagcagcucaacgacgugguagggucgggcgaaauccucagaaagagaaugaccaauacauuuuuacggggcaaccccuaaauaaugacgaggaucaugcacauuggacagaggcaaaaaugcuuuuagauaacauaaacaccccagaagguauuauucccgcucuauuugagccagaaagagaaaaaucggcagcaauagauggggaauaccgcuugaaaggagaaucacgcaaaacauucgucgagcuaaugagacgcggagauuugccaguguggcuggcgcacaaaguugcuucagaaggaaucaaauacaccgauagaaaaugguguuucgacggucaacguaauaaccaaauucuugaagagaacauggacgucgaaauuuggacaaaagaaggagagaagaagaaauugcgacccagauggcuagacgcaagaacuuauagugauccucuugcauuaaaagaguuuaaggacuucgcagccggucgaaaaucuaucgcauuagaucucguuacggagauaggccgaguuccaucacaucuagcgcaucgcacaagaaaugcccuagacaacuuaguuaugcugcauacaucugagcaugguggcagagcauaucgucaugcaguugaagaguuaccagaaacuauggaaacacucuuauuacuuggcuuaaugauccuccuaacuggaggagcgauguuauucuuaauaucugggaaaggaauaggaaaaacguccauaggucuuauauguguaauugccuccucugguaugcuauggauggccgaaauuccucugcaauggauugcaagcgcaaucguucuagaguucuuuaugaugguacuacuuauuccugaacccgaaaagcagaggacaccacaagauaaccaacuagccuacgucguuauagguauucuaacacuggcagcuaucaucgcagccaacgaaauggguuuauuagaaacgaccaaaagagaucuugguaugaguaaagaaccugggguugugucccccacaucguacuuagauguagaccuucauccagcaucggcauggacacuguaugccguggcgacuacaguuauaacaccuauguugaggcacacaauagaaaauucuaccgccaacgugagcuuagcagcgaucgccaaccaagcuguuguguugaugggucuagauaaaggauggccaauaaguaagauggauuuaggaguuccauuauuagccuuaggauguuacagccaaguuaauccauuaacguuaacagcagcaguguuacuucucauuacacauuacgcaauuauuggucccgguuugcaagcaaaagcaacucgggaagcucaaaaacguacagccgcgggaaucaugaagaauccgacgguagauggaauuaugacuaucgaccuugacccuguuauauaugacagcaaauuugagaaacaauuaggacagguaauguugcuaguacuuugugccguacaguuguuacugaugcguaccucuugggcauugugcgaagcauuaacucuugcuacuggccccauaaccacccugugggaggggucgccaggcaaauuuuggaauaccaccauugcuguaaguauggccaacaucuucagaggcaguuauuuagcuggcgcaggauuggcauuuagcauaaugaaaagcguaggcaccggcaaacgggggacaggaucucaaggugaaacacuuggagaaaaauggaaaaagaaacucaaucaauugucccgaaaagaauuugaccuauacaagaaaagugguauuaccgaaguagauagaaccgaagcaaaggaaggauuaaaacgaggcgaaacgacgcaccacgcuguaagcagaggaucugcaaaauuacagugguuuguugagcguaacauggucauaccagaggguagggucauagaccuaggaugcggaaggggagguuggucguauuacugcgcaggacuuaagaaaguaacagaagugagaggcuauaccaaaggaggaccaggacacgaagaaccuguaccgaugagcaccuacggauggaacauuguaaaauugaugucuggcaaagauguauucuaucuuccacccgagaaaugcgacacgcuacuuugugauauaggugaaucaucaccaaguccaaccguagaagaaucacgcaccauccggguauugaaaaugguugaaccauggcuuaaaaauaaccaguucugcaucaaaguccuaaacccuuauaugcccacugugaucgaacaccucgagagacuucagcgcaaacacggaggcaugcuaguuagaaauccgcuaagccgcaauucaacacaugagauguauuggauauccaauggaaccggaaauauaguagcaagcgucaauauggucagccgguuauuauuaaacagauuuacaaugacucaucgccgacccacuauagagaaagacguagaucuuggcgcuggaacccggcaugucaaugcagaaccugaaacgccaaauauggacguaauuggggaaagaauaaaaagaauaaaggaagaacacaauucaacuuggcauuacgacgaugaaaaccccuacaaaacuugggcauaccaugguuccuaugagguaaaagccacagguagugccucaaguaugauuaauggugucgugaaauugcugacuaaaccaugggacguaguaccgaugguuacccaaauggcaaugacugauacaacgccauuuggucaacaaagaguauucaaggaaaaaguagauacuagaacaccaagaaguaugccaggaacucggcgggugauggguauuaccgcggaauggcuauggagaacguuagggcgaaauaagaagccuagauuaugcacucgugaagaauuuacuaagaaaguaagaacuaacgcggcgaugggagcuguguucacugaagaaaaccaaugggauucagcaaaagcugcuguggaggaugaagacuuuuggaaacugguagauagagaacgcgagcugcauaaauuggggaaaugugggucauguguauacaacaugauggguaagagagaaaagaaacuuggagaauuuggaaaggcgaaagggucacgcgcuauaugguauaugugguugggugcuagauauuuggaguucgaagcucuagguuucuuaaaugaagaccacugguucucuagagagaacucuuauucugguguagagggagaaggacuucacaaacuuggguacauacucagagauauuucuaaaauacccggaggugcaauguacgccgaugauaccgcaggcugggacacuagaauaacugaggaugauuuacacaacgaagagaaaauaacacaacagauggauccagagcaucgucaauuggcaaacgcgauauucaaacucacuuaccagaauaaaguagugaaaguccagcgaccaaccccaacaggaacuguaauggacauaauaucgcggaaagaucaaaggggaucaggacaaguaggaaccuauggacuaaauacauucacaaauauggaggcacaauuaauaagacaaauggaaggagaagguguacuuagcaaagcugauuuagaaaacccccaccuuccugagaagaaaaucacacagugguuagaaacaaaaggaguagaaagacuaaagcggauggcaauaucuggagaugacuguguagucaaacccauagaugaccguuuugcuaaugcccucuuggcccucaacgauaugggaaaaguacguaaagauauaccacaauggcagcccucuaaaggauggcacgacuggcaacaaguaccguucugcagucaucauuuccaugaauuaauaaugaaagauggacguaaacuggucguuccauguaggccacaagaugaguuaauuggacgugcucguauaagucaaggugccggguggagucuacgagaaaccgcgugucuaggaaaggcuuaugcgcagauguggucauuaauguauuuccacagaagagaucugagacuugcaucuaaugcuauauguuccgcagucccaguacauuggguaccuaccucaagaacaacuugguccauucacgcgcaccaucaauggaugaccacggaggauauguugacgguauggaacagaguauggauagaagacaauccguggauggaagauaagacuccugugacaacuugggaaaaugugccuuacuuaggaaaaagagaggaucaguggugcggaucguuaauaggacuaacaucucgugccacaugggcacaaaauauucccacugcuauacaacaaguacguucccuuauagggaacgaggaguucuuggauuauaugcccucgaugaaaagauuuagaaaggaagaagaaucagaaggggcgauaugguag

SEQ ID NO: 23296 - RNA, 9873 nt, Artificial Sequence
  derived and/or modified CDS sequence (opt6) from DENV-3__EU482555__SS-prME
acaagccuuuguuuaaugaugauuuugccagcagcuuuagcauuccaucuaacaucucgcgauggggaaccacguaugauuguggggaaaaacgaacgggguaaaucguuacuauucaaaacggcaucggguauaaauauguguacucugaucgcaauggaccuaggagaaaugugugaugacacugugacauauaaauguccucauaucaccgaaguggaaccugaagauauugauuguugguguaaccuuacuucuaccuggguuaccuacggaacauguaaucaagcuggagaacaucgacgugauaaacgcuccguagcuuuggcaccgcacguuggcaugggguuggacacacgaacacagacuuggaugagugcggaaggggcuuggcgccagguagaaaaaguagaaacaugggcucuacgucacccugguuuuacuauuuuagcacuauucuuagcucauuacaucggcacgagucuaacucaaaaaguagucaucuuuauacuacuuauguuaguuacuccaucuaugacaaugcgauguguuggggucgggaacagggauuuuguugaaggacuaucaggagcaacauggguagacguaguccuugaacauggcggaugcgucacuacuauggccaaaaauaaaccaacccuugauauagaauuacagaaaacugaagcaacacaacucgcuacauuacguaaacuauguauagaagggaaaaucaccaacauaacuacggacagucgauguccaacucaaggagaagcaguucugccagaagaacaagaucaaaauuauguauguaaacacacuuauguagacaggggguggggaaacggaugcggguuauuuggcaaaggcucguuggucaccugugcaaaauuccaaugcuuagaaccaauagaagggaaagucguccaauacgaaaacuuaaaauacaccguaaucauaacaguacauacaggagaucaacaucaaguuggcaacgaaacacaaggagucacagcggaaaucaccccucaagcaucuacgacugaggcaaucuugccugaauauggcacauuaggguuggaguguucaccacgaaccggguuggauuuuaaugaaaugauauuauugacuaugaaaaauaaagcguggaugguucaccgacaaugguucuuugaucugccacuaccauggacaucuggggcgacaaccgaaacaccaacuuggaaccgaaaagaacuauugguuacauuuaaaaacgcgcacgccaagaaacaggaagucguaguguuggguucucaagagggggcuaugcauacagcguuaacgggcgcuacagaaauacagaacagugguggcacuuccauauuugcaggccaccucaaaugcaggcuaaaaauggacaaacuggaauuaaaaggaaugucauacgccauguguacuaacacuuuuguauugaagaaagaagucucagaaacucagcacggaacaauauuaauuaagguugaguauaagggcgaagaugcuccaugcaagauucccuucagcacugaagaugggcaaggaaaagcacacaaugggagauuaaucacagccaauccgguaguaacaaagaaggaggaaccagugaacauagaggccgaaccucccuuuggagaaucaaauauuguaaucggaauuggugauaaugcuuuaaagauaaauugguacaaaaagggaaguuccauuggaaaaauguucgaagcgacggcaagaggggcccguaggauggccauauuaggagacacagcaugggauuuuggguccguuggagggguccuaaacucacuaggaaaaaugguucaccagaucuuuggcucagcauauacggccuuauuuucgggcgucucuuggguaaugaagauaggaauaggggucuuacuaacauggauaggauuaaauaguaagaacacuagcaugucauuuagcugcauagcgauaggaguaauaacgcuauaccuuggugcaguuguucaagccgauaugggauguguaaucaacuggaaaggaaaggaacucaaguguggaucaggcaucuuuguaacuaacgaagugcacacuuggaccgaacaauacaaauuucaggcugacucacccaagagauuggccacugcaauugcuggagcuugggagaauggagugugcgggaucaggagcacaacacgaauggagaauuugcuauggaaacaaauagcgaacgaacuuaacuacauucucugggaaaacaauauaaaacuaacagugguagucggagacauaaucgggguauuggagcaagguaaaagaacccuuacaccgcaaccgauggaauugaaauauucuuggaaaacaugggguaaagcuaagauugucacugcagaaauacaaaauucaucguucauaauagauggcccaaauacaccagaaugcccgagugcuuccagggcuuggaaugucugggaggucgaggacuauggauuugggguuuucacuaccaauauuugguugaaauuaagggagguauauacacaacuaugugaucauagacuuaugucugcagcuguuaaagacgagcgugccgugcaugcugauaugggcuacuggaucgaaucccagaaaaauggaaguuggaaacucgagaaagcaucucuuauugaagucaaaacuuguacauggccuaaaucgcacaccuuauggaguaauggaguucuagaaucugauaugauuaucccgaagucccuagcagguccaauaagucaacacaauuauagaccaggguaccauacacaaacagcaggaccguggcacuuagguaaauuagaccucgauuucaauuauugcgaagggacuacaguaguuaucacggagaauuguggcacccguggaccaucccuuagaacaaccacagugagcggcaaauuaauucaugaaugguguugcaggaguugcacacuuccuccucuaagauacaugggugaagaugguugcugguauggcauggaaauccggccaaucucagaaaaagaggaaaauaugguuaaaagucuuguaucugcagguucaggaaaaguugauaauuuuacgaugggcguuuuguguuuggcaauauuauuugaagaggucaugagggguaaguuuggaaagaagcauaugauugcuggugucuuuuucacguuugugcugcuucuauccggacagauuacguggagagauauggcccacaccuugauuaugaucgguagcaaugccucagauaagauggguaugggaguuacuuacuuagcucucauugccaccuuuaaaauacagccauuuuuagcccuuggguuuuuccugaggaaauuaacaaguagggaaaauuuauuacuuggagugggacuagccauggcuaccacauugcaacuuccugaggauauugaacaaauggcuaacggcaucgcucucggucucauggcucugaaacuaauaacgcaguucgaaacuuaccaauuauggacagcacuaauuucguuaacuuguuccaauacaauguuuacgcuuaccguugccuggagaacagccacacucauccuggcaggaguaucauuauuaccugugugccaaucuucgagcaugagaaagacugauugguuaccgauggcaguggcagcaaugggcgucccgccccugccccuauuuauauuuucauuaaaagauacauuaaaaagacguagcuggccucucaaugaggguguuauggcggugggauuagucucaauacuagccuccucccuucugcgaaaugacguacccauggcuggcccucuaguggcagggggacuuuugaucgcgugcuauguaaucacagggacaucagcggaccuaacaguagaaaaagccgccgacaucacaugggaagaagaagcugaacaaaccgguguuucccacaaucucaugauaacaguggaugaugacgggacaaugcggauaaaagaugaugaaaccgagaacauacucacugucuuacuuaaaacagcucugcuuauuguuucugguguauucccguauaguauuccggcaacacuguuaguauggcacacguggcaaaaacagacucaaaggucuggaguauuaugggauguacccucuccucccgaaacccaaaaggcagaacuagaagaaggaguuuauagaaucaaacaacaaggcauauuugggaaaacucaaguaggcguuggcguucagaaggaaggaguuuuucacacuauguggcauguuacgaggggugcgguacuaacauacaacgguaagcguuuggaacccaacugggccaguguuaagaaagacuuaaucuccuauggaggcggauggagacucagcgcucaauggcaaaagggggaggaaguacagguaauugcaguggaaccaggcaaaaauccuaaaaacuuccaaaccaugccuggaacauuccaaacaacuaccggugagauuggcgcaauugcgcuagacuuuaaaccugguacaaguggaaguccaauaauaaaccgugaagguaagguagucggacuuuacgguaauggagucguuacuaaaaauggcgguuacgugucugguauagcucagacuaaugcagaaccugacggaccuacaccagaguuagaagaagagauguuuaagaaacguaacuuaacgauaauggacuuacauccaggaucuggaaaaaccagaaaauaucuccccgcaauaguacgcgaagccaucaagaggagacugcgcacucugauauuagcuccuacaagggugguugcggcagaaauggaagaagcucuuaaaggacucccuauaagauaccaaacaacagcaacaaaaagugaacauacagguagagaaauaguagauuuaaugugucacgcaacauuuacaaugagauuacucaguccaguuagagugccuaauuauaacuuaauuauaauggacgaagcacacuuuacagaccccgccucaauagccgcacgcggauauauaucgacuaggguagggaugggagaggcagcagcgauauuuaugacugcaacaccucccgggacagcagaugcauuuccacaaaguaaugcacccauccaggacgaagaacgagacauaccagaaagaagcuggaacucuggcaaugaauggauuacagacuuugcugguaaaacaguaugguuuguuccauccaucaaggcugguaaugacaucgccaauugucuucgcaaaaauggcaaaaaggucauacaacucucucgaaaaaccuuugauacagaguaucagaaaaccaagcucaaugacugggauuuuguaguuacaacagacauaucugaaaugggugcuaacuuuaaagcugaucgggucauagauccucggcguugcuuaaagccuguaauauuaacagauggacccgagagggucauucuugcgggcccuaugccaguuaccgcagcgagugcagcacaacgaagaggaagaguaggacgcaacccacaaaaagaaaacgaucaauacauuuuuaccggacagccucuaaacaacgacgaagaucaugcucauuggacggaagcaaagauguuacuagacaauauaaauacaccagaagggauaauccccgcauuauucgaaccagagagggagaaaagugccgcgauugacggugaauacagauugaaaggagagucuagaaaaacauuuguugaauugaugcgaagaggggacuuaccuguuuggcuagcccauaaagucgcgagugaagguaucaaauacacugaucguaagugguguuucgacggacaacgaaauaaccagauauuagaagagaauauggacguugaaauuuggaccaaagaaggagagaagaagaaauuaagaccacgaugguuggaugcacgaacuuauucagacccgcuagcccuaaaagaauuuaaagacuucgcggcugggaggaagucaauugcgcuggauuugguuacggaaaucgguagaguaccuagucacuuagcucaucgaacucggaaugcauuggauaaucuuguuaugcuucauacauccgaacacgggggaagggccuaccgacaugcagucgaagaauuaccagagacgauggaaacauuauuauugcuggguuugaugauauuauuaaccgguggagcgaugcuauucuuaauaucggguaaagggauagggaaaacaaguauugguuuaauuuguguaauugcaucuuccgggaugcuguggauggccgagauccccuuacaguggauagcaagcgccauuguacuugaauuuuucaugauggucuuguuaauaccagaaccggaaaaacaaagaacaccccaggauaaccagcucgcuuaugucgugauaggaauacuaacccuagcagcuauaauugcggccaaugaaaugggucuauuagaaaccacaaagcgggacuuaggaaugaguaaagaacccggaguaguuucaccuacaaguuauuuagauguagaucuacacccugcaucagcguggacuuuguacgccgucgccacgacaguaauuacaccuauguuaagacauaccauugaaaauucuacugcuaaugugagccuagcugcaauagcaaaucaggcgguuguauuaaugggacuagacaaaggauggccaauaagcaaaauggacuugggugucccgcuucuagcauugggcugcuauagucaaguuaauccauuaacacuaaccgccgcaguacuucugcucauaacacauuacgcaauaauaggcccagggcuccaagcaaaggcaaccagagaagcgcagaaacguaccgcagcuggaaucaugaaaaacccgacugucgacggcauaaugacaauagacuuagaucccgucauauaugauucaaaauuugagaaacaauuaggacaagugaugcuacugguacuaugcgcuguacagcuauuacuuaugagaacaucgugggcuuuaugugaagcacugaccuuagcuacggguccaauaacaacacugugggaaggaaguccagggaaauuuuggaauacuaccauagcuguuucaauggcaaauauauuucguggaagcuauuuagccggagcgggcuuagcuuuuuccauaaugaaauccguaggaacaggaaagcgugguacuggaucccagggggaaaccuugggugagaaauggaagaagaaacuaaaucaacuuagcaggaaagaauuugauuuguauaagaaaucaggaauaaccgagguggacagaacagaggcaaaagaaggucuaaaacguggagaaacuacacaucacgcaguaucuagagggacagcuaaauuacaaugguuuguagagcgaaauauggucauuccggagggaagagugaucgacuuagguugugguagaggaggauggucauacuauugcgcaggccucaagaaagucacagagguccgcggauacacaaaagguggaccuggucaugaagaaccuguaccgaugagcaccuaugguuggaauauaguaaaacuuauguccggaaaagauguauuuuauuugccaccggaaaaaugcgauacguuguuaugugacauaggggaaaguucccccagcccaaccguugaagagucaagaacuauacgugugcuaaaaaugguagaaccauggcuuaaaaacaaucaauucugcaucaaagucuuaaaucccuacaugccgacugucauagagcaucuagaacgauuacagcgaaaacauggagguaugcucguacggaauccacugagucgaaauaguacacacgagauguauuggaucaguaauggaacaggaaauauaguggcuaguguuaacauggucagccggcuacuuuuaaaccgcuuuacaaugacacacagacggccaacaaucgaaaaagacguagaucuaggagcgggaacgcgacacguuaacgcagaaccggagacaccaaacauggauguuauaggugaaaggauuaaacggaucaaagaggaacauaauucaacuuggcauuacgacgaugaaaauccauacaagacuugggcuuaucaugguucauacgaagucaaagcgacugguucggcaucuucgaugauaaauggggucgugaaauuauuaacaaaacccugggacguggucccaauggugacucaaauggcaaugacagacaccacuccauuuggccaacagaggguauucaaagaaaaaguagacacccgaacaccaaggaguaugccaggaaccagaagggucauggggauaacugcagaaugguuguggaggacauugggaagaaacaagaaaccucgauuauguacacgcgaagaauuuacuaagaaaguccguaccaacgcagcuaugggagccguguuuacagaagagaaccaaugggauucagccaaagcugcgguggaagacgaagacuucuggaaacugguagauagagaacgagagcuacauaaacugggcaaaugcggaagcugugucuacaacaugauggggaaacgagagaagaaacucggugaguuuggcaaagccaaaggaucgcgcgcgauuugguacaugugguuaggagcaagauauuuggaguuugaggcuuuggguuucuuaaacgaagaccacugguuuucacgcgaaaacuccuauagugguguagaaggugaaggucuucacaaacuuggauacauucuucgugacauaaguaaaauaccugguggugcaauguaugccgaugacacagcuggaugggauacgcgaaucacagaagacgauuuacacaaugaagagaaaauaacacaacagauggacccugagcacagacaauuagcaaaugcgauauuuaaauuaacuuaucaaaauaagguggugaaaguacaacgaccgacuccaacggguacuguaauggauauuauaucucguaaagaucaacguggcucaggacaaguaggaacuuauggauuaaauacuuucaccaauauggaagcacagcugauuagacaaauggaaggagaagguguacuuucaaaggcagauuuagaaaacccucaccuucccgagaagaaaauuacccaguggcuagaaacaaaggggguugagcgacugagaagaauggccauaucaggagaugauugugucguaaagcccauugaugauagauucgcaaaugccuugcuggcuuuaaacgacaugggcaaaguaagaaaagauauaccgcaauggcaaccuucgaagggguggcaugacuggcaacagguccccuucuguucccaucauuuucaugaauuaaucaugaaagacggaagaaaauuaguaguaccaugccgcccacaggaugaauuaaucggcagggcuagaaucucacaaggagcuggguggucacucagagaaacagccugccugggcaaagcauaugcucaaauguggucacucauguauuuucaccgaagagaccugagauuagcgaguaacgcaauaugcucagcagugccagugcauuggguuccuaccagccgcaccacauggaguauucaugcacaccaccaguggaugacgaccgaagauaugcugacugucuggaauagaguauggauagaagauaacccauggauggaggacaaaacaccgguaacaacgugggagaacguaccauauuuggguaagcgagaagaccaaugguguggaucauuaauaggccucacgucacgugcaacuugggcucaaaauauacccaccgccauacaacaaguuagaucgcuaauaggaaaugaagaguucuuagauuauaugccaagcaugaagagguuucggaaagaagaagaaucagaaggagcuauaugguaa

SEQ ID NO: 23297 - RNA, 9873 nt, Artificial Sequence
  derived and/or modified CDS sequence (opt6) from DENV-3__EU529692__SS-prME
acaaguuuaugucuaaugaugauccuuccggcugcauuagccuuucaccugacaucuagggauggggaaccaagaaugauaguaggcaaaaacgaacgcgggaaaucucugcuuuucaaaacagcgagcgguauaaauaugugcacauuaauagccauggauuugggggaaaugugugacgauacuguuacguacaaauguccucauaucacagaaguagaaccagaagacaucgacuguuggugcaauuuaacaucgacuugggucacuuauggaaccugcaaccaagcuggagaacauagacgugauaaacgcucaguagcucuagcgccacaugucggaaugggauuagacacacggacucaaacuuggaugucagccgaaggugcuuggcgccaaguugagaaaguggaaacuugggcuuuacgucauccuggauucacaauucuugcacuguuccuagcacacuauauugguacaucacuaacucaaaaaguagucaucuuuauauuacuuaugcuggugacgccaucaaugaccaugaggugugucggagucgguaaccgagauuucguagaagggcuaaguggagcuacauggguggauguaguccuagaacaugguggaugugucacaaccauggccaaaaauaaaccgaccuuagacauugaacuacagaaaacggaagccacccagcucgcaacacuacgaaaauuauguaucgagggaaaaauuacgaacauaaccaccgauagcagauguccaacccagggagaagcaguacuaccagaagaacaagaccagaauuacguauguaaacacacauacguagacaggggguggggaaauggguguggucuauuuggcaaagggaguuuaguuacuugugcaaaauuccaaugucuagagccgaucgaagguaaaguaguacaauaugagaauuugaaauauacaguuauaauaacagugcauacaggagaucaacaccaagugggaaaugaaacgcaaggagugacggcugaaaucacuccacaagcgucaacuacggaagcaauccugccagaauauggaacacuagggcuggaguguagucccagaacgggauuagacuucaaugaaaugauucuucuuacgaugaaaaacaaagcguggaugguacaccgccagugguucuuugacuuaccuuuaccguggacgagcggagcgaccacagaaacccccacauggaauaggaaagaacuccuaguaacuuuuaaaaacgcacaugcgaagaaacaagaaguuguaguuuugggcagccaggaaggagcaaugcacacugcacuaaccggcgcaaccgagauucaaaacucgggugguacgagcaucuucgccgggcauuuaaaaugcaggcuaaaaauggacaaacuagaguuaaaaggcaugucguaugcaaugugcacaaauacauuugugcuuaagaaagaggucucggaaacucaacaugguacgauacuaaucaaaguugaauauaaaggcgaagacgcgccuugcaaaaucccguuuucgacugaagauggccaaggaaaagcgcauaauggacgucuuauuacggcuaaucccguaguaaccaagaaagaggaaccgguuaauauagaagcagaaccuccauucggagaaucuaacauuguuauagguauuggugauaacgcuuugaaaauaaauugguauaagaaaggcagcagcaucggaaaaauguuugaggccaccgcaaggggugcaagaagaauggcgauccuaggagauacugcgugggauuucggaucggucgguggagugcucaacucauuagggaaaauggugcaucaaauauucgggagugcguacacagcacuauuuucagguguauccuggguaaugaaaaucgguauagggguauuacuaaccuggauuggucuaaauaguaaaaauaccuccaugagcuuuuccuguauagcaauaggcgugauaacacuauaccuaggggcugucguacaagcagauauggguugcguaauaaauuggaaagggaaagaacuaaaaugugggagcggcauauuuguaacaaaugaaguacauacguggacggaacaguacaaauuccaggcugacucaccaaaacgacuugcuacagcuauagccggugcaugggagaauggaguaugcgguauuagaaguacaacgaggauggaaaauuugcuguggaaacaaauagcaaacgaacuaaacuauauacuaugggaaaacaauauuaaacuaaccgugguugucggcgacauaauuggaguauuagagcaaggaaaaagaacccugacaccccaaccaauggaacugaaguacaguuggaaaacuuggggaaaggccaagauugucacugccgaaauucaaaauaguaguuuuauuauagacgggccuaauacaccagaauguccgagugccucccgugcuuggaauguaugggaagucgaagacuauggcuuuggugucuuuacaaccaacauaugguuaaaacuaagggaaguauauacccaauuaugugaucaccgacugaugagcgcagcaguuaaagacgaaagagcuguacaugcagauauggguuacuggauagaaucacagaaaaaugggucauggaaacuagaaaaagccaguuuaaucgaagucaaaacguguacguggccuaaaagucauacguuguggucaaacggagugcucgaaucugauaugauaaucccuaagagcuuagccgguccgaucagccaacauaacuauaggccagguuaucauacucaaacagcagguccauggcacuuaggaaaguuagacuuggauuucaauuacugcgaggggaccacaguaguaaucaccgaaaacuguggaacucguggaccaucgcuuagaacaacgacgguuagcggaaaguuaauacacgagugguguugucgaucuugcacuuuacccccuuuacgcuauaugggcgaggauggaugcugguacggaauggagauucgucccauaagcgaaaaagaagaaaauauggucaaaaguuuaguuagugcagggucagguaaggucgacaacuuuaccauggggguuuuaugcuuggcaauacucuuugaagaggugaugagaggcaaauuuggaaagaaacacaugauagccgguguauuuuucacuuuuguacuucuuuugucgggccaaauuaccuggagggacauggcacauacauuaaucaugauagguucuaaugcaucggacaaaaugggaaugggaguuacuuaccucgcacuaaucgccaccuuuaaaauucaaccauuccuagcacucgguuucuucuuaagaaaacuuacaagccgagagaauuuauuacuagguguaggcuuggcaauggcaacuacccugcaacuacccgaggauaucgaacaaauggcaaacgggauagcucucgggcuaauggcauuaaaacuaaucacacaauuugaaaccuaccaacuauggacggcauugauuucauugacauguucgaauacaauguucacuuuaaccguagcuuggcguacggcuacgcuaauacuagcgggcgugucacuacuaccugugugucaauccucgucuaugcgcaagacagauuggcugccgauggccguagcugcgaugggugugccgccccucccacuuuuuauuuuuagucuuaaagacacauuaaaacggagaucauggccacuaaaugaaggaguaauggccgugggauuaguaucaauacucgcaaguagccuguuaagaaacgaugugccgauggcaggaccacuuguugcgggcggacuauuaaucgcguguuacguaaucaccgggacuucagcugaccuuacuguugaaaaagcagcugauauuacgugggaagaggaagcagaacaaacgggggucucucauaaccucaugauuacuguagaugaugacggcacaaugaggaucaaagaugacgaaacagaaaauauuuuaacgguacuauuaaaaacugcauugcuuaucguaucuggaguauuuccauauagcauaccagcaacauugcuuguauggcauacauggcaaaaacaaacucaacguagcggaguccucugggaugugccaagcccaccagaaacacaaaaagccgaauuagaggaaggaguguaccgaaucaagcaacaagguauuuuugguaaaacccaaguaggaguaggcguccaaaaagaaggaguguuccacacaauguggcacguaacucguggagcgguguuaacauauaacgguaaaagauuagagccaaauugggccucagucaagaaggacuuaauuucguauggugguggguggagguuaucagcucaauggcaaaaaggagaagaggugcagguaauagccguagagccaggcaaaaaccccaaaaauuuccaaacuaugccgggaacauuccaaacaacaacuggcgaaaucggggcuauagcuuuagacuuuaaaccgggaaccagugggagucccauuaucaacagggagggaaaagucguugggcuauauggcaauggaguaguuacuaaaaacggaggcuacguaaguggaauugcacagacaaacgcagaacccgacggacccacgccagaacuugaggaagaaauguuuaagaaaagaaauuugacuauaauggaucuucacccagggagcggcaaaaccagaaaauaccuuccagcaguuguccgggaggcuauaaaaagacguuuaagaacacuuaucuuggcuccuacacgaguaguagcagcggaaauggaagaagcacuuaaaggacuaccaauucgauaucaaaccacugcaacgaaguccgaacauaccggacgcgaaauaguggacuuaaugugccaugcaaccuucacaaugcgauuacugagccccguaagagugccaaauuauaacuuaaucauuauggaugaagcccauuucacggaucccgcaucaauugcugcaagaggcuauauuucaacucgaguuggcaugggugaagcagcagcaaucuucaugacagcaacaccaccagggacugcggacgcauuuccucaaucuaaugcgccuauccaagaugaagaaagggacauaccagaaagaucuuggaacucagguaaugaauggauuacagacuucgcuggcaaaaccguaugguuuguuccaucuauuaaagcaggaaaugauauagccaauugccuuaggaaaaauggaaagaaaguaauucaacucucaaggaagacuuucgacacagaauaucagaaaacaaaauugaacgauugggauuuugugguaaccacagacauaucagaaaugggcgcaaauuuuaaagccgauagaguuaucgaucccaggagaugucuaaaaccuguaauuuugacugaugguccugagcggguaauacuggcuggaccaaugccagucacugcagcauccgcagcacaaagacguggaagaguaggacgaaacccucaaaaggagaacgaucaguauauauuuacuggacaaccacuaaauaacgacgaagaccacgcucacuggacggaagccaaaauguugcuagauaacauaaacaccccagaaggcauuauaccagcuuuauuugaaccggagagagagaaaucagcagcgauugacggggaauauagguuaaaaggugagucacggaagacguuuguagagcuaaugcgucgaggugacuugccugucuggcuugcucacaaaguagcaucagaaggcaucaaauauacagacagaaaaugguguuucgauggacagagaaauaaucaaauacucgaagaaaauauggacguagaaaucuggacaaaagagggcgagaagaagaaacuaagaccgagguggcuggaugcgagaacauauucagaccccuuagcacugaaagaauuuaaagauuuugcagcaggaaggaaaucgaucgcgcucgauuuagucacagagauaggaagaguaccaagucaucuugcacauaggacccgcaacgcacuugauaaccuaguuauguuacauacaagugagcacgguggacgggcguaucgacaugcaguagaagaauuaccagagaccauggaaacacuucuguuauuaggauuaaugaucuuacucacggguggagcaaugcuguuucuuauuuccgguaaaggcaucggaaaaacaagcaucggucuuauaugcguaauugcuaguucagggauguuguggauggcugaaauaccacuacaauggaucgcaucagcaauuguccucgaguucuucaugaugguuuuacuuauacccgaaccugaaaaacaacgaaccccgcaagauaaucagcuggccuauguagugauaggcauucugacuuuagcugcuaucauagcugcgaaugaaaugggucuacuagaaaccaccaagcgggaucugggaaugagcaaggaaccagguguuguuagccccaccagcuacuuggaugucgaucuucauccugcgagcgcauggacucuauacgccgucgcgacuacuguuaucacuccaaugcuacgccacaccauagaaaauucgacugcaaaugucucccucgcagcuauugcaaaucaagcugucguccuaauggguuuagauaaaggauggccaaucucuaaaauggaucuaggugugccccugcuggcguuaggaugcuauucucaggucaauccacuuacuuuaacugcugcaguucucuuacuaauaacacauuaugcuauuauagggccaggguuacaagccaaagcaacgagagaggcucagaaaaggaccgcugccgguauaaugaagaaccccaccguagauggaauaaugacaauagacuuggauccaguuauauaugacagcaaauuugaaaaacaauuaggacaaguuaugcuccuaguccuaugugcugugcaacuacucuuaaugagaacauccugggcauuaugcgaagcacugacacuugcaacugggccuaucacgacccugugggaaggaucuccagguaaauuuuggaauacgacuaucgccgucucuauggcuaacaucuuucgcggaucauaucuagcaggcgcaggccuugcuuucucaauaaugaaaagcguagguacgggaaaacggggaaccgguucucaaggagaaacguuaggcgaaaaauggaagaagaaacuaaaccagcuaaguaggaaagaguuugauuuauauaagaaauccggaauuaccgaaguagauagaacagaggcaaaagaaggacuuaaaagaggagaaaccacacaccaugcuguuucucguggcacugcaaaacuacagugguucguagaacgaaacauggugauuccugaaggacgaguaauugaccucggcugugggcgaggcggcuggucauauuauugcgcaggucucaagaaaguaacagaagugcguggauauaccaagggagguccaggccaugaagaaccaguaccuaugucaacauacggauggaauauaguaaaauuaaugagugggaaggauguauucuaccuaccucccgagaaaugugauacacuacuaugugacauaggugaaucuagcccaucaccaacgguugaagagucacgaacaauaagaguccugaaaaugguagagccauggcucaagaauaaucaguucugcauaaaaguacuaaacccuuacaugccaacugugauagagcauuuagaacgccuucaaagaaagcacggagggaugcuuguacgaaauccguuaucgcgcaauucaacccaugaaauguauuggaucuccaacggaacaggaaacaucguagcgagcguuaacauggugagcagacuucuacuaaaccgauuuacuaugacacauagaaggccaaccauagaaaaagaugucgauuugggugcagguaccagacauguaaaugcggaaccugagacuccgaacauggauguuauaggagaacgcaucaaacguaucaaggaggaacauaauucaacauggcauuacgaugaugaaaauccuuacaagacaugggcguaccacggauccuaugaaguuaaagcgacaggcuccgcaaguucaaugauuaauggagucgugaaauugcucacgaaaccaugggaugucgugccaauggucacucaaauggcaaugacugacacgacuccuuuuggccaacaacgcguauucaaagaaaaaguagacacaagaacuccgcguucuaugccugggaccaggcgcgucauggggauuaccgcugaauggcuuuggagaacgcuaggccgaaauaagaaaccacggcuuuguacucgugaagaguuuacuaagaaaguaaggacaaacgccgcuaugggcgcugucuuuacagaagaaaaccaaugggacuccgcaaaggcagcuguugaggaugaagauuuuuggaagcuaguggaccgagaacgagaauugcauaaacuggggaaauguggguccuguguauacaacaugaugggaaaacgagagaagaaauuaggggaguucggaaaggcaaaaggaucuagggcaauaugguacauguggcugggcgcaagauaccuagaguuugaggcauuagguuucuuaaacgaagaucacugguucucaagagaaaauagcuauucgggaguagaaggagagggauuacacaaauuagguuacauauuaagagauaucucaaaaauaccugguggugcaauguaugccgacgauacugcaggaugggacacccgaaucacagaagaugacuuacauaaugaagagaaaauaacucagcaaauggacccugaacaccgucagcuagcuaaugcaauauucaaacuuacguaccaaaauaaagucguaaaaguccaaaggccuacaccuacaggaacagucauggauauuauuaguagaaaagaccaaagagguucggggcagguuggaacuuauggauuaaauacguuuacaaauauggagguacaacuaauacgucagauggaaggagaaggggucuugaguaaagccgaccuggaaaauccccauuuaccagagaagaaaauaacacaauggcuagagacuaaaggagucgagagauuacguagaauggcaauuucuggggaugauuguguaguaaagccaauagacgauagauuugcaaacgcauuacuagcguuaaaugauaugggaaagguaaggaaagauauaccacaguggcaaccuaguaaaggguggcaugacuggcaacaagucccauucugcucacaccauuuccacgaacuuauaaugaaagauggacgaaaauuagugguucccugcaggccacaagaugaacuaauaggcagagcaagaauaucucagggggcagguuggucucuaagagaaacagcgugucuuggaaaggcguacgcucaaauguggucucugauguacuuccauaggcgcgauuugagacuagcaaguaacgccauaugcagcgcuguccccguccauuggguaccaacaagucgaacaacauggucaauacacgcccaucaccaguggaugaccacugaggauauguuaacugucuggaauagaguauggauagaggauaauccauggauggaagauaaaacaccaguuacuacuugggagaaugucccguaucucgguaagagagaagaucaauggugcggcucacuaauaggauugacuucccgggcaacaugggcacaaaauauacccacagcaauccaacaaguuagaucacucaucggcaaugaggaguuucuugauuauaugccuucaaugaaaagguuucgaaaagaggaggaauccgaaggcgcgauuugguaa

SEQ ID NO: 23298 - RNA, 9873 nt, Artificial Sequence
  derived and/or modified CDS sequence (opt6) from DENV-3__EU482558__SS-prME
accucuuugugccuaaugaugauacuacccgcagcacuagcauuucacuuaaccucacgagacggggaaccuagaaugauaguagguaaaaaugaaaggggaaaaucuuuguuguuuaaaaccgcaaguggaauuaauauguguacauuaauugcaauggauuuaggagaaaugugcgaugauacagucacuuacaaaugcccacacaucacagaaguugaacccgaagauauagauugcugguguaaucuaacgucaacuuggguaacguaugguacauguaaccaagcuggagaacaccgucgcgacaaacgaaguguugcgcuggcaccucacguagguaugggucucgacacuagaacccaaaccuggaugagugcagaaggugcuuggagacaaguugaaaaagucgaaacaugggcauuacgucaucccggcuuuacaauacuugcccucuuccuugcucauuauauaggaacauccuuaacccaaaaagucguuauauuuauauuauuaaugcuagucacaccuuccaugacuaugcgaugugugggcguaggaaaucgugauuucguagaaggauugucuggagcaacauggguugacguuguuuuagaacacgguggaugcgugacaaccauggccaaaaauaaaccaacguuggacaucgaacugcagaaaacugaagcgacucagcuugcaacgcuacguaaauuaugcaucgaaggaaaaaucacgaauauaacaacagauucucgcugucccacccagggggaagccguccuuccugaagaacaagaucaaaacuauguuugcaaacacacauauguagaucgugguuggggaaauggguguggucuuuuugguaaagguucuuuaguuacaugcgcaaaauuccaaugccuagaacccauagaagggaaaguaguacaguaugaaaaucuuaaauacacuguuaucauaacaguucauaccggagaucaacaucagguaggaaacgaaacacagggagugacagcagaaauuacgccacaagcaaguacuacagaagcaauacugccugaguacgguacacuuggauuagaaugcaguccuagaacgggucuagauuuuaacgaaaugauccuucugacaaugaaaaauaaggcuuggaugguacacagacaaugguucuucgaccuuccacuuccauggacuuccggagcaacuacugaaaccccuaccuggaacaggaaagaauuguuaguuacguuuaaaaaugcccacgccaagaaacaagaagucguagucuugggaucccaggaaggggccaugcacacugcuuuaaccggugcaacagagauacaaaauuccgggggcacaucuauauucgccggucauuuaaaauguagauuaaaaauggacaaauuagagcuaaaaggcaugucauacgcuauguguacgaacaccuucgugcuaaagaaggagguaucagagacccagcaugggacaauauuaauaaaaguagaauauaagggagaagauguuccauguaaaauacccuuuucaacagaggacggucagggcaaagcccauaaugguagauuaauaacagcaaacccgguugugacuaagaaagaagaacccguaaauauagaagcugagccaccuuucggugaguccaauauuguaauaggcauuggugauaaugcacuaaaaauaaauugguacaagaaagguucgucuauuggaaaaauguucgaagcuacggcacgaggcgcacggcggauggcaauacuaggagauacugcuugggacuucggcagcguuggcggcguuuuaaacaguuuggguaaaaugguucaucagaucuuuggaucagcauacacugcacuguuuucuggaguaucuuggguuaugaaaauagggauuggaguucucuugaccuggauuggucuuaauagcaaaaauaccaguaugucuuuuagcuguaucgcuauuggaauaauaacgcuauaucuaggagcugugguucaagcugacaugggauguguuauaaacuggaaaggcaaagaacuaaaauguggaucagggauuuuuguaacaaaugaagugcauaccuggacagagcaauauaaauuccaagcugacucacccaaaagguuagcuacagcuauugccggugcaugggagaacggggucuguggcaucagaucgaccacacgaauggaaaaccuacucuggaaacaaauagcuaacgaguugaauuacauacugugggaaaacaauauaaaacuaacaguuguuguaggugauauaauaggagugcucgaacaggggaaaagaacacuaacaccucaaccaauggaauugaaauacagcuggaaaaccuggggaaaagccaaaauuguuaccgcggaaacgcaaaauagcuccuuuaucauagaugggccgaauacucccgaguguccgucggccagcagggcguggaacguaugggaaguagaagauuauggauuuggugucuuuacuacuaacauauggcuaaaauugagggaaguauauacucaauuaugugaccaccgcuuaaugagugcagcuguaaaagaugaaagggcuguucacgcugacaugggauacuggaucgagagucagaaaaauggaucauggaaacucgaaaaggccagucuaaucgagguaaaaacauguacuuggccaaaaagucacacacuuuggaguaacggaguuuuagagucggacaugauaaucccuaaaaguuuagcgggcccaauuucucaacauaauuauagaccaggauaccauacacagacggcagggccauggcauuuagguaaacuagaauuagauuuuaacuauugugaaggaacgacggucguuauaacagaaaauugcgguacaagagguccuucauuaaggacuacaaccguaucagggaaauuaauccacgaaugguguugcagguccuguacacuuccuccccugagauauaugggagaagacggcugcugguaugguauggaaauaagaccuauauccgaaaaagaagaaaacaugguaaagaguuuaguuucggcgggaucgggcaaagucgacaauuuuacaaugggcguuuuaugucuagcaauacuuuuugaggaggucaugagagggaaguucggcaagaaacauaugauugcagggguauucuuuacguuuguacuacuauugaguggucaaauaaccuggagggacauggcacacacacuuauuaugauaggcaguaacaccucagaccguauggguauggggguaacuuauuuagcuuugauagcaaccuucaaaauccaaccauuuuuagcauuaggauucuuccucaggaaacugacgaguagagagaaccuccuucucggaguaggucucgcuauggcgacuacgcuucaauuaccugaggacaucgaacaaauggcuaaugggaucgccuugggcuuaauggcguuaaagcuaauaacacaauucgaaacuuaucaauuauggacugcauugauuucguuaaccugcaguaacacaauauuuacauuaacuguggcauggcguacugcaacacuaauacuagcaggaguaaguuuguuaccuguuugucaaucgucaucgaugagaaaaacggacugguuaccaaugacugucgcugcaaugggcguacccccacuuccguuauucauauuuaguuuaaaggauacucucaaaaggagaucuuggccgcucaaugagggaguuauggccguggggcuggucaguauacuagcuuccucucuauuacguaaugauguaccgauggccggaccucuaguagccggaggacuauuaaucgcuugcuauguaauaacuggaacgucagcagauuuaacuguagaaaaagccgcagaugucacaugggaagaggaggcagaacaaacaggagucagucacaaucuuaugauuacuguagacgaugacggcacuaugagaauaaaagaugaugagaccgaaaauauauuaacagucuuacuuaaaacagcucuacuaauuguuagcgguaucuucccuuauaguauucccgcuacacuguuaguauggcacacauggcaaaaacaaacacaacggaguggaguauuaugggacguuccuagcccgccagagacucagaaagcggaacuugaagaggguguguauagaaucaagcaacaaggaaucuuuggaaaaacccaaguggguguaggaguucaaaaggaaggaguguuucauacaauguggcauguaacccguggugcgguacuaacauauaauggaaaaagacucgaaccaaauugggccaguguuaaaaaggaccucauaucguauggaggcggguggagacugucagcccaauggcaaaaaggagaagagguacaaguuauugccguggagccggguaaaaacccaaagaacuuccaaacuaugccugggacauuccagacgacgacaggagaaauaggggccauagcuuuagacuucaaacccgguacaucaggcaguccaauaauaaaucgcgagggaaaagucguagggcuuuaugggaauggugugguaacaaagaaugguggcuacguaucaggaauugcucagacaaaugcggagcccgauggaccuacuccagaauuggaggaagaaauguucaagaaaaggaacuuaacaauuauggauuuacauccuggaucagguaaaacuagaaaauaucucccugcgauaguaagggaggccauaaagagaagacuacgaacauuaauacuugcgccaacaagaguaguggcagcagagauggaagaggcucuuaaaggcuugccuauuagauaucaaacgacagcaacaaaaagcgaacauacgggcagggaaauagucgauuugaugugccaugcaaccuucacaaugagauuauuaucacccgugagaguuccgaacuacaaucuuauaauaauggaugaagcacauuucacagacccagcgucaauugccgcacgagguuacauaucaacaagagugggcaugggcgaggcagcagcgauuuucaugacggcgacaccaccugguacagcugacgcauucccucaaucgaaugcuccaauacaagacgaggagagagauauaccagaaagaucuuggaacuccgguaacgaauggaucaccgacuuugcuggaaaaaccgugugguuuguaccuucaauaaaagcaggaaaugacauagcgaauugucuucgaaagaacggcaagaaagugauucaauuauccagaaagacuuuugauacugaauaccagaaaacaaaacucaacgacugggauuucgucguaacaacggacauaucagagaugggugcuaauuucaaggcggacagggugauugauccgaggagaugucuuaaaccaguaauacuaacggauggaccagaacgugucauccuagccggcccuaugccuguuacagccgcgagugcagcccagcggcgcggaagagucggaaggaacccucagaaagaaaacgaucaguacauauuuacuggucaaccacuaaauaaugaugaagaucacgcccacuggacagaggcgaaaaugcuuuuagauaauauaaacacgccggagggaauaauuccggcauuauuugagccggaacgugagaaaagugcagcaauugauggagaauaccgauuaaaaggagaaucaagaaaaacauuuguagaacucaugaggcgaggugaccuaccaguaugguuggcucauaaaguagcaagcgaagggauuaaauacacggaucgcaagugguguuucgauggacagcgcaacaaucagauccuugaagaaaacauggacguagaaauuuggacaaaggaaggugagaaaaagaaacucagacccagaugguuagacgcuaggacuuauagcgauccacuugcgcuaaaagaauuuaaagacuuugcagcaggaaggaaaaguauagcucuugauuuaguuacagaaauaggcagaguaccaucccacuuagcacauagaacaaggaacgcacuagauaaucucguaauguugcauaccuccgaacauggcggaaaggcuuacagacaugcaguagaagaacuaccugaaacuauggaaacauuacuacuauuaggucuuaugauuuuguuaacagggggugcaaugcucuuucucauaucaggaaaaggaauugguaaaacaaguauaggccuaauuugcguaauagcgagcagcggaaugcuuuggauggcagaaauuccccuacaauggauagcauccgcuaucgugcuggaauuuuucaugaugguccuacucauuccggagccagaaaaacaaagaacaccucaagauaaccagcuagcuuacguaguaauugguauauuaacacuagcagcuauaauugcagcuaacgagaugggccuucuagaaacaaccaaaagagauuuagguaugaguaaggaaccaggaguagucucacccaccucguacuuagacguagaccuucauccagcuagcgcauggacacuauaugcaguagcuaccaccguaauaacuccuauguuaaggcauacgaucgagaacuccacugcgaaugucagccuugcagcaauugcaaaccaagccguagugcuaaugggauuagauaaaggauggccaaucucuaagauggauuugggagucccgcucuuggcgcugggauguuacagucaaguaaauccguugacauugaccgcugcagugcuacugcucauaacccacuacgcaauaauaggcccgggacugcaagcuaaagcaacucgcgaagcucaaaaacgaacagcagcuggaauaaugaagaauccuacagucgauggaauaaugacgauagauuuagacccuguaaucuacgacucaaaauucgaaaaacaguuaggacagguuaugcuguuaguacuuugcgcagugcaacuacuauuaaugcguaccuccugggcccuaugugaagcauugacguuagcuacaggaccaauuacaacacugugggaagggaguccagggaaauuuuggaacacuaccauagcggucagcauggcaaacaucuuccgggguuccuauuuagcaggcgccgggcuggcauucucgaucaugaaauccguuggaacaggaaaacgcggaacaggcucucagggagaaacacugggagagaaauggaagaagaaauugaaccaacugucucgaaaagaauuugaccuauacaagaaaucagguauaacggaaguagauaggacagaagccaaagagggauugaaaaggggugagaucacucaucaugccguuaguagaggcagcgcgaagcugcaaugguucgucgagcgaaauaugguuauuccagaaggucgcguaauagacuuaggcugugguaggggcggcuggaguuauuacugcgcagguuuaaagaaaguaacugaaguccguggauacacuaaagggggaccaggccacgaagaaccaguaccaaugaguaccuacggguggaauauaguaaaauuaaugagcggaaaagauguuuucuaucugccgccagaaaaaugcgauacucuacuaugcgauaucggagaaucuagucccucaccaacgguugaggaaucaagaacgauuaggguccuaaaaaugguggaaccaugguugaaaaacaaucaauuuugcauuaagguauuaaauccuuauaugccgacagucauagaacaccuugaaagacuccaaagaaaacauggaggcaugcuuguaagaaauccucuuagcagaaauucuacccacgaaauguacuggauaucuaacgguaccgggaacaucguggcgagcguaaacaugguaucaagacuccuacuuaauagauucacaaugacucaucgucguccaacgaucgaaaaagauguagaccuuggugccggaacgcgacacguaaaugcagaaccugaaacaccuaauauggaugugauuggugaaaggauuaaaagaaucaaggaagaacauaauaguacuuggcauuaugacgaugaaaacccauauaaaacuugggccuaucauggaucauaugaagucaaggcaacagguucagcgagcucaaugauuaacggagugguuaaauuacuuaccaaaccaugggacgugguuccuaugguuacucagauggcaaugacagauacuacacccuuuggacagcaaagaguauucaaggaaaaaguagauacaagaacaccuaggucuaugcccggaacaagacgagucaugggaauuacggcagaguggcuauggaggacacuaggccgaaacaaaaagccgcguuuaugcacaagggaagaguucacuaagaaaguaaggacaaacgccgcaaugggagcuguuuucacggaagaaaaucaaugggacagcgccaaggccgcuguagaagacgaagacuuuuggaaauuaguggacagagagagagaacuacacaagcucggaaaguguggaaguugugucuauaauaugaugggaaaacgagagaagaaauugggagaguuugguaaagcaaaaggaucgagagcgauuugguacaugugguuaggagcgcgauaccuagaauuugaggcuuuaggauuuuugaaugaggaccauugguucucaagggaaaauagcuauucgggcguagaaggagaaggauugcauaaauuggguuacauauuacgagacauuuccaaaauaccaggcggagcaauguacgcagaugauacggcuggcugggauacucgcauaacugaagacgaucuacacaaugaggagaaaauaacccaacaaauggacccugaacacagacaacucgccaaugcgauauuuaaguugacguaccaaaacaaaguaguaaagguucagcgaccaacccccacagguacugugauggacaucauaucgagaaaggaccaacgcggaucagggcagguuggaacauacgguuuaaacacauucacaaauauggaggcgcaguuaauacgucaaauggaaggugaagguguucucucgaaagccgaucuggaaaauccacaucuuccugagaagaaaauaacucaaugguuagagacaaaggggguagagagacuaaaaaggauggcuauuaguggagaugauuguguuguuaaacccauagaugauagguucgcuaaugcgcugcuagcuuuaaacgacauggguaaggugagaaaagacauaccucaauggcagccgaguaaagguuggcacgacuggcagcaaguaccauuuugcagccaucacuuccaugaauuaauuaugaaagaugggagaaaacucgugguaccaugcagaccacaagacgaauuaauuggaagggcucguauaucacaaggcgcaggauggagccuaagagaaacugcauguuuaggcaaagcauaugcccaaauguggagccugauguacuuucacagacgugaucuaagacuugcgucaaaugccauauguuccgccgucccgguacauugggucccuacuucgcggacaacauggucaauacacgcgcaucaucaauggaugacaacugaagauauguuaacaguauggaaccgaguauggauagaagacaauccguggauggaggauaaaaccccugucacaacgugggaaaacguaccuuaucucgguaaacgagaagaucaauggugcggauccuugauaggacucacaaguagagcuacaugggcucaaaauaucccuacugccauacaacagguaagaucacugauaggaaaugaagaguuccuggacuauaugccaucaaugaagagguuuagaaaggaagaggaauccgaaggcgccauaugguaa

SEQ ID NO: 23299 - RNA, 9873 nt, Artificial Sequence
  derived and/or modified CDS sequence (opt6) from DENV-3__EU482563__SS-prME
acuuccuuaugucuaaugaugauacuaccagcagccuuggcguuccauuuaacgagcagggauggugaaccacgaaugauuguggguaaaaaugaaaggggaaaaaguuuacuauucaaaacagccaguggaauaaauaugugcacguuaaucgcuauggaucuaggagaaaugugugaugauacgguuacguauaaauguccccacaucgcggaaguugaaccugaagauauagacugcuggugcaauuugacaaguacauggguaacauacgguacuuguaaucaagccggagaacacaggagggacaaacguaguguagcucuugcuccacaugugggaaugggucuagacacaagaacacaaacauggaugagcgcagaaggagcauggcgucagguagaaaaaguagaaacgugggcguuaaggcaucccggguucacuauuuuagcucuauuucuugcgcauuauauugguacaagccucacccaaaaaguaguuauauuuguccuacuuauguuagugacaccgucgaugacaaugaggugcguggggguagggaaccgcgacuucguagaagguuuaucaggcgcaaccuggguugacgugguacuggaacaugguggaugugucacuacaauggccaaaaauaaaccuacauuagauauagaacuucagaaaaccgaagcaacacaacuagcuacguuacggaaacuauguauagaagguaaaaucaccaauaucacaacagacucaaggugcccaacccaaggggaagcuguucugccagaagaacaggaccaaaacuacgucuguaaacacacuuauguagaccguggguggggaaacggcuguggucuuuucggaaaaggcagcuuaguaaccugugcaaaauuucaaugucucgaaccaauugaaggaaaaguaguacaguaugaaaaccucaaauacacugucauuauaacuguacauacuggggaucaacaccaaguaggcaacgaaacucaaggagucacggcugagauuacaccucaggcaagcacuacugaagcaauauuacccgaguacggaacguuaggauuagaauguuccccacggacaggucuagauuuuaacgagaugauauuauuaacaaugaaaaacaaggcuuggaugguccauagacaaugguucuucgacuuaccucucccuuggacaucaggcgcuacgacagaaacaccgacguggaaccguaaagaauuauuaguaacauuuaaaaacgcgcacgcgaaaaagcaagaaguuguagugcuagguagccaggaaggcgcuaugcacaccgcucuuacuggagccacagaaauucaaaauucgggagggaccucuauauuugccggucacuugaaaugccguuugaagauggauaagcuagagcuaaaagggaugagcuaugcgauguguacaaauacguucgugcuaaagaaagaaguauccgaaacccaacauggaacaauccucauaaaagucgaguauaagggagaagaugcucccuguaaaauaccauuuucuaccgaagauggacagggaaaagcgcauaacgggaggcuaauuaccgcgaacccuguuguaacgaaaaaggaagaaccaguaaacauugaggcagaaccuccuuuuggagagucgaauaucguaauaggcauaggagacaaugcguugaaaauaaauugguacaagaaagguucgucuaucggaaaaauguucgaagcuacagccagaggagcccgucguauggcuauccuaggggauacugcuugggauuuuggaagugugggagggguuuugaauagccugggaaagaugguacaccaaauauucggcagcgcuuacacagcauuauuuucaggugucaguuggguaaugaagauagguauaggaguuuuacuaaccuggaucggccuuaauaguaaaaacacauccaugucauuuaguugcauagcgauaggaauaauaacuuuauauuugggagcggucguacaagccgauacagggugcguaauaaauuggaaaggcaaagaacucaaaugugguucugguauauucgucacuaaugaaguccauacauggaccgaacaguacaaauuucaagccgauaguccgaaacguuuggccacagcuaucgcgggagcuugggaaaacggcguaugcggaauaaggagcacaacacgaauggaaaaccugcucuggaaacaaguagcaaaugaauuaaauuauauacugugggaaaauaauauaaaacuuacgguaguagugggugauauaauaggaguauuagagcaaggaaaaagaacacugacuccccaaccgauggaacuaaaguauucauggaaaacauggggaaaagcaaaaauaguuacggccgaaacacaaaauagcuccuuuauaaucgaugggccuaauacaccugaaugcccaucggcgagucgagcauggaaugugugggaaguugaagacuauggguuugguguauuuacaacgaauauaugguuaaaacugagagaagucuauacucaauuaugcgaccauagauugaugagugcggcuguuaaagacgaacgggcuguacaugccgacaugggauauuggauagaaucucagaaaaacggaucauggaaacuugaaaaggccagccuuauagagguaaaaacuuguacauggccuaaaagucauacucuauggaguaaugguguacuugagucggauaugaucauaccaaagagcuuagccgguccgaucagccaacacaacuauagaccagguuaucauacacaaacggccggcccauggcaucuaggcaaguuggaacuugacuucaauuauugugaaggaaccacggucguuauuacggaaaacugcggaacccgugguccaucgcuacguacuacaacgguuagcggcaaacugauucaugaauggugcuguaggagcugcacccugccaccgcuaagauauaugggagaagaugguugcugguaugguauggagauacgcccuauuagugagaaagaggaaaauaugguaaagagcuuagugagugcagguagugguaaaguagacaacuuuacaauggguguccugugcuuagcgauacuauucgaggaggucaugcgcggaaaauucggcaagaaacacaugauagccggaguauuuuucacauuuguuuuacuauuaagcggccaaaucacauggcgggauauggcucacacucuuauuaugauaggauccaacgcgucagacaggaugggaaugggaguaacuuaucuggcacuaaucgccaccuuuaaaauccaaccuuuccucgcccucggauuuuucuugaggaagcuaacuucaagagaaaaucuauugcugggugugggccuagcgauggcaacaacauuacaauuacccgaggacauagaacagauggccaauggaaucgcuuuaggucuaauggcgcucaaauuaauaacacaauuugaaacauaucaauuauggaccgcacuaaucagcuuaaccuguagcaauacaauauuuacacuaacaguugcauggaggacugcgacacuaauacuagcaggaguuucauugcuuccagugugucaaaguucaucaaugagaaaauccgauugguuacccaugacuguagcagcaaugggcguacccccauuacccuuauuuaucuucucacuaaaggacacacuaaaacgaagauccuggccacuaaacgaggggguaauggcggugggccuaguguccauacuagccucaucuuuauuaagaaacgaugugcccauggccgguccucuagucgcaggaggguuauuaauagcuuguuaugucauuaccggaacaagcgcugaucugacaguagaaaaggcugcugauguuaccugggaagaagaagcagaacagacaggaguaucccacaauuuaaugauuacuguugaugacgacggcacaaugcgaauaaaagaugacgagacggagaauauccuaacuguuuuauuaaaaacagcauuauuaauagucucggguaucuuccccuacaguauuccugccacccuauugguauggcauaccuggcaaaaacaaacaagaagaucugggguauuaugggacgucccaucaccaccagaaacacaaaaggcagaacuugaagagggagucuauagaauaaagcaacaagguauauucggaaaaacacaaguuggagucgguguccaaaaagagggaguguuccauacuauguggcauguaacaagaggagcaguacugacauacaacgguaaaaggcuggaaccaaacugggcgaguguuaagaaagacuuaauuucauauggcggcggcuggagacuaagugcccaauggcaaaaaggagaagagguucaaguaaucgcaguagagccuggcaaaaaucccaaaaauuuucaaacaaugccagggacuuuccaaacaacaacaggcgaaauaggcgcaaucgcuuuggacuuuaaaccaggaacauccggaucuccaaucauuaaccgagaagguaaagugguaggcuuauaugggaauggaguuguaaccaaaaaugguggcuacguaucaggaauugcacaaacaaacgcagaaccggacggcccaacaccagaauuagaagaagaaauguuuaagaaacgaaaccucacaauuauggaucuacauccaggaagcgguaaaacgcgaaaauaucugccugcaauaguacgggaagccauaaaaaggagacuacggacccuuauucuagcaccaacgcgaguaguugcggcagaaauggaggaagcucucaaaggacuuccaaucagguaucaaacaacugcuacaaagagcgagcacacagggagagaaauagucgacuuaaugugucaugcaacauucacaaugcgacuccucaguccuguacggguaccaaacuauaaucuuauuauaauggacgaggcccauuuuacagaucccgcuucgauagcugcaagagguuauauaucaacuagagucgguaugggagaggccgcggcaaucuucaugacagccacgcccccaggaacagcggacgcauuuccacaaaguaacgcuccaauucaggaugaggaaagggacauaccugaacguaguuggaacucaggaaaugaauggauuacagacuuugcaggcaagacgguaugguuuguaccgaguauuaaggcuggcaaugacaucgcaaacugucugaggaaaaaugggaagaaaguaauccaacucuccagaaagacuuucgacaccgaguaucagaaaacgaagcugaaugauugggacuuuguugucacaaccgauauuagcgaaaugggugcuaauuuuaaggcagacagagucauugacccacgaagauguuugaaaccagugauauugacugacggacccgaaaggguuauucuagcagggcccaugcccgugacagcggcuucugcugcacagcgccgcggucggguagggcggaacccucaaaaagaaaaugaucaauauauauuuacgggucagccucugaacaaugacgaagaccacgcccauuggacugaagcaaaaauguuacuagauaacauuaacacaccugaaggaauaauucccgcacucuucgaaccagaacgagagaaaagcgcagcaauagacggggaauacagacugaaaggagagagccgaaaaacuuuuguugaauuaaugcggcggggagaucugccgguuuggcuggcacauaagguggcaagugaggggauaaaauauacggauagaaagugguguuuugacggucaaagaaauaaucagauuuuggaggagaauauggauguagaaauauggacuaaggaaggcgagaagaagaaacugcgaccacgauggcuagaugcccguacauacagugaucccuuagcuuuaaaagaguuuaaagauuucgcugcaggucguaaauccauugcuuuagauuuagucacggagauugggcggguccccucucaccuagcucaucguacaagaaaugcguuggauaaucuggugaugcuccauacuucagaacaugggggaaaggcuuauagacaugcuguagaagaauugccagaaacgauggaaacguuacuuuugcugggacuuaugauacuuuuaacaggaggugcaaugcucuuucuuauuucuggaaaaggaauugguaaaacgaguauaggacucauaugcguaaucgcaaguucugguauguuguggauggcagaaauuccccuucaguggauugcaagugcaauaguuuuagaguucuuuaugaugguauugcugauuccagaacccgaaaaacaacgaacaccgcaggauaaucaauuggcauauguuguaauugguauccucacacuagcggcaauaauagcggcaaacgagauggguuuacuagagacaacaaaacgugacuuaggaaugaguaaagaacccgguguugucucuccgacgucuuaucuggacguagaccuucaucccgcuucugcguggacguuauaugcaguagcuacaacgguuauaacgccuaugcuccgccauaccauagaaaacucgaccgcgaauguaagucuggcugcaauagcaaaccaggccguaguauuaauggguuuagauaagggcuggccaauuaguaaaauggaccuaggaguuccccuuuuagcucuaggguguuacucacaaguuaacccacuaacauuaacagccgcuguauuacuucugauaacgcauuaugcaauaauagggcccggauuacaagcaaaggcuaccagggaggcacaaaagcgcacagcagcugguauaaugaagaauccaaccguugacggcauuaugacuauugaucuugacccaguuauauacgauuccaaguuugaaaagcaacuugggcaaguuauguugcuaguacuaugugcugugcaacugcuguuaaugaggacaagcugggcacuuugugaggcuuuaacauuagcaacugggccaauaaccaccuuaugggaaggaucacccggcaaguuuuggaacacgaccauagccguaagcauggccaacaucuuccgcgguucguacuuggccggagcuggacuagcguuuaguauaaugaaaucggugggaacgggaaaaagggguacagggagucagggagaaacauuaggagagaaauggaagaagaaauugaaucaauuauccagaaaggaauuugaucuauauaagaaaagcgguauuacagaagucgacagaacagaagcaaaggagggauugaagagaggagaaauaacgcaccaugcagugagcaggggcagugccaaguuacaaugguucguagaaagaaauaugguuauuccggaaggccgcguuauagauuugggaugcgggagaggagguuggagcuacuacugugccggauuaaagaaagucacggaaguccguggauauacaaaaggaggaccagggcaugaagaaccagugccaaugaguacauauggcuggaauauugucaaacuuaugagcggcaaagacguauuuuaccuaccaccugaaaaaugugauacacuuuuaugugauauaggagaaagcucacccuccccaacaguugaggagaguagaacgauacgggucuuaaaaaugguagaaccuuggcucaaaaauaaccaauucugcauaaaaguucuaaaucccuacaugccaacaguaauagagcacuuagaaagacuacagcguaagcaugguggaaugcuaguacggaacccacucucuagaaauucaacacaugagauguauuggauaagcaaugguacugguaacauaguugcuucaguaaauauggucucaagacuauugcugaaccgauuuacgaugacccauaggagaccgacaauagaaaaagauguugaccuuggagcagggacucgacaugugaacgcggaaccagagacaccaaauauggaugugauuggagaaagaauaaaacguauuaaggaagaacauaacaguacuuggcacuaugacgaugaaaauccauauaaaacuugggccuaccacggaucauacgagguaaaagcaacgggaucggccucaucuaugauuaacgggguaguaaaacugcucacaaaaccgugggacgugguuccuaugguaacacaaauggcaaugaccgacacgaccccuuuugggcaacaaaggguauuuaaagaaaaaguagacacacguacaccucgaaguaugccaggaacacggcgcguaaugggcauaacugcggaaugguuauggcggacauugggucgcaacaagaaaccgcgacuauguacgcgugaagaauuuaccaagaaaguccggacaaaugcagcgaugggggcaguuuuuacggaagagaaucagugggauuccgccaaggcagcaguggaagaugaagauuucuggaagcuaguagauagagaaagagagcugcauaaacuugggaaauguggaagcugcguuuauaacaugaugggcaaaagagagaagaaauugggggaguuugggaaggcaaaggggucaagggcuaucugguacaugugguuaggagcaagauauuuagaauuugaagcacuaggguuucugaaugaagaucacugguuuucccgggagaauaguuauuccggaguggagggagaaggauugcacaaauuagguuauauacuccgagacauaucgaagauaccugguggagcaauguaugccgacgauacugcagguugggacacaaggaucacugaagacgaccugcauaacgaagagaaaauaacacaacagauggauccagaacaucgacagcuugcaaacgcaauauuuaaauugacauaccagaauaagguaguaaagguucagagaccuacaccaacuggaacaguaauggacauuaucucgaggaaggaccagagagggagcgggcagguuggcacuuacggauugaacacuuuuacaaacauggaagcgcaauuaauucgacaaauggaaggcgaggggguguuaaccaaagcggaccuugaaaauccgcacuuauccgagaagaaaaucacucaaugguuggaaacgaaaggggucgaaagauuaaagagaauggcaauaagcggagaugauugcguuguaaagccaauugacgauagguucgcaaaugcauuauuggcgcucaacgauauggggaaggucaggaaagauauaccacaauggcaacccucuaaagguuggcacgauuggcaacaggucccuuuuuguucucaucacuuucaugaacuaaucaugaaggauggaaggaaacugguuguaccgugucguccucaggacgaacuaauaggucgugcucggauuucucagggggcagguuggucauuaagagaaacggccugcuuaggcaaggccuaugcgcagauguggucucuaauguauuuucaucgacgggauuuaagauuagcaaguaacgcuauuuguagcgcugucccugugcauugggugcccaccucuaggacaacuuggaguauccacgcacaccaccaauggaugacaaccgaagacaugcuuacaguguggaauagaguauggauagaagauaacccguggauggaagacaaaacaccuguaacaaccugggagaauguccccuauuugggaaagcgugaagaucaauggugcggaagucucauaggacucaccaguagagcaacaugggcucaaaauauuccaacagcaauucagcaagugagaucauugauaggaaaugaagaguuccuggauuacaugccaaguaugaaaagguuuaggaaagaagaggaaagcgaaggcgcaauaugguaa

SEQ ID NO: 23300 - RNA, 9873 nt, Artificial Sequence
  derived and/or modified CDS sequence (opt6) from DENV-3__EU529696__SS-prME
acaaguuuaugucuaaugaugauacugccagccgcgcuagcuuuucaccucacuagcagagauggggaaccccguaugaucguagggaaaaaugaaagaggaaaaucacuauuguucaaaacugcaaguggaaucaauauguguacacuuaucgcuauggaucuaggggaaaugugcgaugauacggucacguacaaauguccgcauauuacagaaguugaaccggaagacaucgauuguugguguaacuuaacaaguacauggguaacguauggcacguguaaccaggcuggggaacauaggcgagacaaacggaguguggcacuggcaccacacguggguaugggguuagacacacguacgcaaacauggaugagugcggaaggagccuggagacaaguggaaaaaguugaaacaugggcgcuuaggcauccagguuucacaauacuagcacuauuuuuagcucacuauauagggacaucccuaacacaaaaagucguuauuuucauauuacuaaugcuagucacgccuaguaugaccaugagauguguuggugucggcaaccgagauuucguagaaggacugagcggagcuacauggguggacguuguccuagaacauggugggugcguuacaaccauggccaaaaacaaaccuacacuggauaucgagcuccagaaaacugaagcuacucaacuagcaacucucaggaaacugugcaucgaaggcaaaauaacgaauaucacaacagacagcagauguccuacacaaggggaagcuguacugccggaggaacaagaccaaaauuauguauguaaacacacauacguggaucguggaugggguaacgguugugguuuguucggaaaaggaagccuaguuacaugcgcaaaauuccaaugccuagaacccauugaggguaaaguaguccaauacgagaacuuaaaauauacaguuaucauaacaguacauaccggagaccaacaucaagucggcaaugaaacacaaggaguuacagcugagauuacuccucaggcuaguaccacagaggcuauacuccccgaauauggaacgcuggggcuagaauguucuccuagaacugguuuggauuucaacgagaugauuuuacuaacaaugaaaaauaaggcuuggauggugcaucgacaaugguucuuugaccuaccgcuuccauggaccucuggagcaacaacagaaacucccacuuggaacaggaaagaauuauuaguaacauucaaaaaugcacaugcaaagaagcaggaggucgucguauuaggcagucaagaaggagcaaugcauacagccuugacgggcgccacagaaauucaaaacaguggaggaacaucaauuuuugcgggacaucuuaaauguagacucaaaauggauaaacuggaacugaaggguaugagcuacgcuauguguacaaauacuuuuguccugaaaaaggaaguaucugaaacucaacaugguacaauucuaauaaaaguagaauauaagggugaagacgcaccaugcaagaucccuuucucuacagaagauggacaaggaaaggcccauaacggccgacuaauuacggcaaaucccgucguaacaaagaaagaagaacccgucaauaucgaagcagaaccucccuuuggagaaagcaacaucguaauuggcauuggugacaaugcccuaaaaauaaauugguacaaaaaggguaguuccauaggcaaaauguuugaggcgacagcccgaggagcaaggaggauggcaauauuaggagauacugcaugggauuucggaaguguugguggcguacuaaauucacugggaaaaaugguacaccaaaucuucggcagcgccuacacagcacuuuucaguggugucucuuggguaaugaaaauuggaauaggaguuuuauuaacuuggauaggacugaauaguaaaaacacgucaauguccuuuucuugcauagcgaucggugugaucacccuuuaccuaggugcaguugugcaggcagacauggguugugugauaaauuggaaaggaaaagaacuuaaauguggaucuggaauuuucguuacuaacgaaguccauaccuggacagagcaauacaaguuucaagcggacagcccuaagcgacuagcaacagcuauagcaggagcuugggaaaauggcguaugcgggauacgaaguacuacuagaauggaaaauuuacucuggaaacaaauugccaacgaacuaaacuauauccuaugggaaaauaauauuaagcuaaccguaguggucggagauauaauaggaguauuggaacaaggcaaaagaacguugaccccacaacccauggaauuaaaguauaguuggaaaacaugggguaaagcaaaaauagucacagcugaaauacaaaacucuuccuuuauaauagauggacccaauacgccugaauguccaucugcgaguagagcguggaacguaugggaaguugaggacuacggauuuggcguauucacuacgaauauauggcuaaaacuuagggaagucuauacucaauugugcgaucauagacuaaugagugcugcaguaaaagaugagagagcggugcaugcagauaugggauauuggaucgagucacagaaaaaugggagcuggaaguuagaaaaggcuucccuuaucgaagugaaaacgugcacuuggccuaaaagccauacucuuuggaguaaugguguccuagaaucagauaugauaauuccuaaaucacuagcaggcccuauuagucaacauaauuaucgcccaggauaucauacucagacagccggaccauggcaccucggaaaacuugacuuagauuucaauuauugcgaaggaaccaccguuguuaucacugagaacuguggcacuaggggaccgagucuucgcaccacaacggucucgggaaaauugauccaugagugguguugcagaucuugcacccuuccaccgcuuagauacaugggagaagacgggugcugguacggaauggaaauacgcccuaucagugaaaaagaggaaaauaugguaaaauccuuagucagugccggaaguggaaaaguagauaacuuuacuaugggugucuugugcuuagcuauuuuguuugaagaaguaaugcgaggaaaauuugguaagaaacacaugauagcaggggucuuuuucacauuuguuuuauuauuaagcggucaaauuacauggagagauauggcccauacacuaaucaugauuggaucgaacgcaucagacaagauggguaugggugugacauacuuagcguuaauagcaacauuuaaaauacaacccuuucuugcgcuuggauuuuucuuacgaaaacuaaccucuagagaaaacuugcuauuaggaguaggauuggccauggcgacgacucuacaauuaccagaagacaucgaacaaauggccaauggaaucgcacuuggcuuaauggcacugaaauuaauaacgcaauuugaaacauaccaauuauggacggcccuaaucuccuuaaccugcuccaacacaauguucacauuaacaguggcauggaggaccgcaacacucauccuagccggggucuccuugcucccugugugccaaaguucuucgaugagaaagacagauuggcuuccaauggccguugccgcuaugggaguuccuccccugccuuuauuuauauuuucccuuaaggauaccuuaaaaagacggucguggccacucaaugaaggagucauggcaguaggcuuagugaguauccuggccagcucacuucuucgcaacgacguuccgauggcaggaccauuaguagcaggagguuuacucauugccuguuauguaaucacggguacaucagcagaccucacgguugaaaaagccgcugauauaaccugggaagaagaggcagaacagacuggugugagccacaauuuaaugauuaccguggacgaugacgggacgaugcguauaaaagaugaugaaacugaaaauauacuuacaguucuguuaaaaaccgcacucuuaauaguaucgggaguuuuuccuuauaguauaccugcaacccuauugguauggcauaccuggcagaaacaaacacaaagauccggcguauuaugggauguuccgucaccuccggaaacccaaaaggcggaguuagaagaaggaguguacaggauaaaacaacaaggaauuuuugggaaaacucaaguaggaguaggaguacagaaggaagguguuuuucacaccauguggcacguaacgaggggcgcuguacuaacuuacaauggcaaaaggcucgaaccuaacugggccuccgucaagaaagacuuaaucaguuaugguggaggcuggcgccuuucggcgcaauggcagaaaggggaagaaguccagguaauagccguagaaccuggcaagaauccaaagaacuuucagacuaugccaggaaccuuccagacaaccacaggcgaaauaggugcaauagcacuagauuuuaaaccagguacaucaggauccccaauaauaaaucgagaaggcaaagucguuggauuauauggaaacgggguuguuaccaaaaauggcggauaugugagugguauagcacaaacaaacgcagaaccagacggacccacaccagaacuagaagaagaaauguuuaagaaacguaaccucacaauuauggaucuucaucccggaagcggcaaaacgaggaaguaccuacccgcaguaguacgugaagcaauuaaacgacgacucaggacgcugaucuuagcacccacaagaguaguagcagcggagauggaagaagcucuaaaaggacuuccuauaagauaucaaacaacagcuacuaaaucagaacauaccggcagagaaauaguagacuuaaugugucacgcuacauucacgaugagacuauuaaguccaguccggguuccuaauuauaaucugauuauaauggacgaagcccacuucacggauccagcaucuauugcugccagaggauauauuucaacaagggugggaaugggcgaagcagcugcuauuuuuaugacugcuacaccacccggcacugcagacgcuuuuccacaauccaaugcaccuauccaagacgaagaaagggacaucccagagagaucauggaacucagggaacgaguggauaacagauuucgcugguaaaacaguaugguucgucccuaguauuaaagcaggcaacgauauugcaaauugucuaaggaaaaauggcaagaaagucauucagcugucaagaaagacuuucgacacagaguaucagaaaacgaaauuaaaugauugggacuucguugucacaacugauauuucagaaaugggugcaaauuuuaaagcggacagagucaucgacccaagaaggugcuuaaaaccagucaucuuaacagauggcccagaaaggguuauccuugcaggaccaaugcccguaaccgcggccagcgcugcacaacgacggggaagaguagguagaaauccacaaaaggaaaacgaucaguacauauucacuggacaaccuuuaaauaaugaugaagaucacgcccacuggacugaagcuaaaaugcuacuugauaacaucaacacaccagagggaauuauaccagcuuuauuugagccagaaagagaaaaguccgccgcuaucgauggagaauauaggcuaaaaggagaaagccguaagaccuucguugaacuuaugcgcagaggugaccugccaguuuggcuagcacacaagguggcgucagaaggaauaaaauauaccgaccgaaaauggugcuucgacggccaaagaaauaaccaaauacuugaagaaaauauggauguggaaaucuggaccaaagaaggcgaaaagaagaaacuucgcccacgcugguuggaugcacgaacguauagcgauccccuugcuuuaaaggaguuuaaagauuuugcagcuggacgaaagucaauugccuuggauuuaguaacugaaauuggccguguaccaagucaccuagcacaccgaacaagaaacgccuuagacaaucucgugaugcugcauacaagugagcaugggggccgagcguauagacacgcuguugaagaacuacccgaaacuauggaaacucuauuacuucuaggacugaugauacuuuuaacaggcggagcuaugcucuuuuuaaucucaggaaaaggaauaggcaaaacgagcaucggucugaucugugucauugcaagcucggggauguuauggauggcugagauaccauuacaauggauagcaucagcaauuguacuggaauuuuucaugaugguccuucucauccccgagccagaaaaacagcguacuccucaagacaaucaauuggcuuauguggucauaggaauuuuaacgcucgcugccauuauagcagcaaaugagaugggauuguuagaaacuacgaaaagagauuuagguaugucuaaggaaccaggcguaguguccccuacaagcuacuuagauguagaccugcaucccgccucugccuggacccuauacgcgguagcaacgacgguaauuacacccaugcuaagacacacuauagagaacaguacugcaaaugucagcuuagcggcaauagcaaaucaagcaguuguauugaugggauuagauaaagguuggccgauuucuaagauggauuugggaguaccacuucuugcacuagguugcuauucacaagugaacccguuaacguuaacagcugcaguuuuauuauugaucacacacuaugcaauaauagguccuggccuucaggcaaaagcaacacgagaagcccaaaagagaacggcagcugguauaaugaaaaacccaacgguggauggaaucaugacgauagauuuggacccggugauauacgauucuaaauucgaaaaacaacuagggcaaguaaugcuauugguacuuugcgcaguacaacuacuuuuaaugagaaccucaugggcguuaugugaggcgcuaacacuagcuacggggcccauaacuacauugugggaagggucuccaggaaaauucuggaacacaacaauagcgguuucgauggcaaacaucuuuagaggaucuuaucuagcuggagcuggguuagcuuuuagcauaaugaaaagcgucggaacagggaaacgaggaacuggcagccagggggaaacacuaggcgaaaaauggaagaagaaauuaaaccaacuaucucgcaaagaguucgauuuauauaagaaaaguggaaucacugaaguagauaggacagaggcuaaagaagggcucaaaaggggagaaaccacucaucacgcuguaucgcguggaacagcaaaacuacagugguucgucgaaagaaauaugguaauaccagaaggaagagugauugauuuagguugcggacgaggagguuggucauacuacugugcgggucuuaaaaaggucacagagguuagaggauacacuaaaggggguccugggcaugaagaaccuguuccaaugucaacuuauggcuggaauauaguaaaauugauguccgguaaagacguauuuuaccuuccuccagaaaaaugugacacgcuuuugugcgauauuggagaaucaaguccaucuccaaccgucgaggagucacgaaccauuagaguuuuaaagauggucgaaccauggcugaaaaauaaccaauuuugcauaaaaguucuaaauccguauaugcccaccguuauagaacaccuagagcgacuacaaagaaaacacggagguauguuggucaggaauccauuaucacgaaauucaacacaugaaauguacuggaucagcaacggaacaggcaauauuguagccaguguaaauaugguaucaagacuucuacucaacagauucacaaugacacaucggaggccuacuauagagaaggacgucgaccuuggugcaggaacuagacauguuaaugcagaacccgaaacuccgaacauggacgucauaggagaacguauuaaaagaauaaaggaggagcauaacuccaccuggcauuacgaugacgaaaauccauauaaaacgugggccuaucauggcucuuacgaaguuaaagcaacugggagcgcaucaaguaugauaaauggaguaguaaaacucuuaacuaaaccaugggacgucgucccaaugguaacccaaauggccaugacggauaccacaccauucggucaacagaggguguuuaaagagaaaguagauacaagaacaccuagaaguaugccaggcacacgaagggugaugggaauaacagcagaaugguuauggcggacccuagggagaaauaagaaaccccgguuaugcacaagggaagaauuuacuaaaaagguuaggaccaacgcugcgaugggagccguauuuacugaggagaaucaaugggacuccgcaaaagcagcaguugaagaugaagauuucuggaaacuuguagaucgugaacgugaacugcacaaguugggaaaaugugguucuuguguuuacaacaugaugggcaaaagggaaaagaaauuaggcgaguucgggaaagcuaaagguagcagggcuauaugguauaugugguuaggcgcccguuacuuggaguuugaggcgcuaggcuuucuaaaugaagaucauugguuuucucgugagaacucauacuccggaguugaaggcgaaggacuucauaaacugggguauauauuacgugauauaaguaaaauaccuggaggggcuauguaugcagacgacacagcaggaugggauacccgcauaacagaagacgaucugcauaaugaagagaaaauaacucagcaaauggauccggaacacaggcaacuagccaaugcaaucuuuaaacugacauaucagaauaaagugguuaaaguucagcggcccacaccaacgggaacaguaauggacaucauaagcagaaaagaucaaagagguagcgggcaagugggcaccuacggacuuaauaccuucacgaauauggaagcucagcuaauuagacaaauggagggugaaggaguucucagcaaagcggaucuggaaaacccgcacuugccugaaaagaagauuacccagugguuagaaacaaaaggcguagaaagacuaaggagaauggcgauaucuggugaugauugcguaguaaaaccuaucgacgauagauucgccaaugcacugcuugcucugaacgacaugggcaaaguaagaaaagacauaccacaauggcaacccucgaagggcuggcacgauuggcaacaaguaccguucuguagucaucauuuucaugaauuaauaaugaaggacggcagaaaauuagucgugccaugucggccacaggacgaacuaaucggaagggcaagaaucucccagggugcugguuggagccuaagagaaacagccuguuuaggcaaagcauaugcccaaauguggagucuaauguauuuucauagaagggacuuaagauuagcuagcaacgcaaucugcuccgccgucccgguacacugggucccaacgucccguacaacauggagcauucacgcacaccaucaauggaugacaacagaagacaugcucacuguauggaacaggguuuggauagaagauaacccuuggauggaggauaagaccccaguuacuacgugggaaaauguaccuuaucucggcaaacgggaagaucaaugguguggcagcuuaaucggauuaacaaguagagcuacaugggcgcagaauauaccaacggcaauacaacaggugaggucccuaauaggaaaugaagaauuucuagacuauaugcccaguaugaaacguuucagaaaagaagaggaauccgagggagcaaucugguag

SEQ ID NO: 23301 - RNA, 9873 nt, Artificial Sequence
  derived and/or modified CDS sequence (opt6) from DENV-3__EU529697__SS-prME
acuagccuauguuuaaugaugauuuugccugcugcgcuugcauuucaucucacaagucgugacggagaaccaagaaugauuguaggcaaaaaugaacguggaaaaucauuguuauucaaaaccgcaagugggauaaacauguguacgcugauugcgauggauuuaggagaaaugugcgacgauacuguuacauacaaaugcccccauauagcggaaguggagccggaagacauugauugcugguguaaucuaacuucaacgugggugacuuaugggacuugcaaucaagcuggugaacacaggcgugauaaaagaucuguagcuuuagcaccucacguagguaugggauuggauacccguacgcaaacauggaugucagcagaaggagcuuggagacaaguggagaaaguggaaacaugggcauugagacauccuggcuuuacuauucuggcccucuuucuggcacacuauauaggaacuucucuaacgcaaaaaguugucauuuucguccuguuaaugcuaguaacuccaucuaugaccaugagauguguagggguaggaaacagggacuuuguggaaggucucucaggggcaacuuggguugacguagucuuggaacauggaggcuguguuacuaccauggccaaaaauaaaccuacccuagauauugaacuucagaaaacugaagcaacacaauuagcaacccuuagaaaacucuguauagagggaaaaaucacaaauaucacuacggauucccgaugcccaacacaaggcgaagcggcguugccggaagaacaagaccaaaauuacguuuguaaacacacuuauguugauagaggauggggaaauggauguggacuauucggaaaaggaagccuagucacuugugcaaaauuccaauguuuggagcccauagaaggcaaagugguacaauaugaaaauuuaaaauacaccguaauaauuacuguacauacaggggaucaacaucaaguaggcaacgaaacacaaggaguaacugccgaaauaacuccacaggcuucgacaacggaagcaauucucccugaauacggaacgcuaggacucgaauguaguccaagaacgggacuagacuuuaaugaaaugauacuguuaaccaugaaaaauaaagcauggaugguacauagacaaugguuuuucgaucuuccacugccauggacuucaggugcaacuacugaaacgcccacauggaacagaaaagaauugcucguaacauuuaaaaaugcgcaugccaagaaacaagaagugguuguacucgggucccaagaaggagcuaugcauacagcacuaacuggugcuaccgaaauccaaaacucugggggaacaaguauauucgcaggacacuuaaaaugucgcuuaaaaauggauaaacucgagcugaaaggaaugagcuacgcaauguguacaaauacuuuuguucugaagaaagaaguaucagaaacgcagcauggcacgauuuuaauaaaaguagaauauaaaggggaggacgcccccuguaaaauuccauucagcacagaggauggccaaggaaaagcccauaacggaagacuaauuacugcgaauccuguggucacuaagaaagaggaaccaguuaacauagaggcggaaccgccauucggagagucaaacauuguaauagggaucggugacaacgcacuaaaaaucaauugguacaagaaaggaagcucaaucggaaaaauguuugaggccacugcaagaggagcaaggcgaauggcgauccucggggauacugcaugggauuuugggucagucggcgggguuuugaacagucugggaaaaaugguacaucagaucuucgguagugcuuacacugcauuguuuagcggcguuagcuggguaaugaaaauugguauuggagucuuacucacauggauagguuuaaauaguaaaaacacaagcaugucauucagcuguauagcaaucgguauuauuacucuguauuuaggcgcaguaguacaggcugauaccggaugugugauaaauuggaaaggcaaagaacuuaaauguggaucaggaaucuuugucacaaaugaaguacauacauggacagaacaguauaaauuucaagcggacagcccgaaaagacuagcgacugcuauagcaggagccugggaaaauggagucuguggcauuagaagcacaacgcgcauggaaaaucuauuauggaaacaaguugcgaacgaacuuaacuauauauuaugggaaaacaauauaaaacucacugucgucgucggugauauaaucggcguacuugagcagggaaaaagaacgcuuacaccccaacccauggaacuaaaauacucuuggaaaacaugggggaaagcaaaaauugucacagcagagacucaaaacaguucuuucauaauugacggaccgaacacaccagaaugcccaucugcuucaagagcauggaacgugugggagguggaagauuauggcuuugguguguucacaacaaacauaugguuaaaacuucgugaagucuauacacaacuaugugaucaccgacuaaugucggcagcgguaaaagacgaacgagcaguucacgcugacauggguuauuggaucgagucgcagaaaaaugggagcuggaaacuugaaaaagcuagccuuaucgaaguuaaaacuugcacauggccaaaaucacauacacuguggagcaacggaguccuugagagcgauaugauuauucccaaaucauuagcuggacccauaagucaacacaauuaucgaccaggauaccauacucagacggcagguccuuggcacuuaggcaaauuggaguuagauuuuaauuauugcgaagguacaacaguggucauaacagaaaacugcggaacaagaggaccaucgcuacggaccacgacggucagcggcaaacugauacaugaauggugcugcaggucauguacauugccaccauuacgauauaugggcgaagauggaugcugguaugggauggaaauucgaccgauuucugaaaaggaagaaaauaugguuaaaagccucgugagcgcagggucggguaaaguugacaauuuuacaauggguguauuaugcuuagcuauauuauuugaagaggugaugagaggaaaguuuggcaagaaacauaugauagcugggguguucuuuaccuucguguuauugcugucuggccaaauuaccuggcgagauauggcacauacuuugauaaugauuggaucuaacgcaucugauaggaugggaaugggcguuacgcauuuggcauuaauugcuacguuuaaaauacaaccauuuuuagcacuagguuucuucuuacgaaagcugacgaguagagagaaccuguugcucggcgugggacucgcaauggcaacaacccuccagcuaccagaagacauagaacagauggcaaauggaauagcacuuggccuaauggcauuaaagcuaaucacgcaauucgaaacguaucaguuauggaccgcucucaucucauugacaugcucgaacacaaucuuuacccuaacgguagcuuggcggacugcuacuuuaauacuagcaggaguuucgcuccugcccgugugccagucgucuucgaugcggaaaagcgacuggcuuccgaugacgguggcugcaauggguguucccccauuaccacuguuuauauuuucacuuaaagauacguuaaagagaagaaguuggccgcuuaaugaaggaguaauggcaguaggauuggugaguauccuggcuucuucauuacuucgaaacgaugucccaauggccggaccauugguggccggaggcuuacuaauagccuguuauguuauaacagggacaagugcugaucuaacggucgaaaaagcagcggacgucacuugggaggaagaagcagaacaaacaggugugagucacaaccuaaugauaacuguugaugacgauggcacaaugagaauuaaagacgaugagaccgaaaacauuuuaacaguauuguuaaaaacagcgcuacuaauugugagcgggauuuuuccuuauagcauaccagcaacacuauuaguauggcauaccuggcaaaaacaaacucgaagaaguggcguacuaugggauguuccuagcccaccugaaacccagaaagccgaacuagaagagggagucuacagaaucaaacagcaagggauauuuggcaaaacacaaguaggagucggcgugcagaaagagggaguauuucauaccauguggcauguuacuagaggagcaguacuaacauauaauggaaaaagauuagaaccaaauugggccagugucaagaaagauuugauaagcuacggagggggauggaggcugagugcucaguggcaaaaaggggaagaaguacaaguaaucgcaguggaaccgggcaaaaaccccaaaaauuuucaaacuaugccugguaccuuucaaacgacuacgggagagauaggugcaauugccuuggacuucaaacccgguacgagugguucuccuauaaucaacagagagggaaaaguagucggacuauauggaaauggugucguaacuaaaaauggaggauauguuuccggaauagcgcaaacaaacgcagaacccgaugguccgacgccggaguuagaagaagagauguuuaaaaagagaaaucuaaccauuauggaucuccauccagggucugguaaaacaagaaaauaucuaccagcaauaguaagggaagcaaucaagcguagauugagaacacucauacuagcgccuacgagaguaguugccgcugaaauggaagaagcucuaaaaggguuacccauaagauaucaaacaacggcgacgaaguccgagcacacagguagagaaaucgucgaucuaaugugucacgcaaccuuuacaaugcguuuacuuagucccguccggguaccaaauuacaaccuuauaauuauggaugaggcgcacuuuacagacccggcuucaauagcugcuagaggauauauaaguacuagaguuggaaugggagaagcagcagcgaucuuuaugacugcaacgccaccaggaacggcggaugcuuucccccagucuaaugccccgauacaagaugaagaacgagacauuccagaacgauccuggaacuccggcaaugaauggaucacugauuucgcaggaaagacugugugguuuguaccuucaauuaaagcaggaaacgacaucgcaaacugucuaaggaaaaaugguaaaaaggugauacaguuaagcagaaagacauucgacaccgaauaucagaaaacgaaauuaaacgauugggauuuuguaguaacgacagacauuucugaaaugggagccaacuuuaaagcugauagaguaauagauccaagaagaugucuaaaacccgugauacuuacagaugggccagaaaggguaauacuagccggaccaaugccaguuaccgcagccuccgccgcgcaacgacguggcaggguuggccguaauccucaaaaggaaaacgaucaguacauuuuuacgggucagccuuugaacaaugaugaagaucaugcucacuggacagaagccaaaaugcugcuugacaauaucaauacaccagagggaauuauucccgcucucuucgaaccagaaagggagaaaagcgcagcaauagacggagaguaucgucugaagggagaaagucgcaagacguucguagaacucaugaggagaggugaccuucccgucuggcuugcacacaagguugccagugaggggauaaaauacacugacaggaagugguguuucgauggccaaaggaauaaucaaauacuugaagaaaauauggauguggaaauuuggacgaaagagggggaaaagaagaagcuacgaccaagauggcuugaugcgagaacauauuccgauccucuagcccuaaaagaauuuaaagacuucgccgcaggaagaaaaaguaucgcacuugaccucguaacugagaucggaaggguuccuucgcaucuagcgcaucgaacacggaaugcgcuagauaacuuaguuaugcuucauacaagugaacacggggguaaggcuuauagacaugcuguagaagaacuaccugagaccauggaaacacuauuacucuuaggacuaaugauucuccuaacaggaggugccauguuauuuuuaauaucugguaaaggcauagggaaaaccucuauagggcugauuugugucauugcaucaagcggcauguuauggauggcagagauaccguuacaguggaucgcuagugccauagugcuugaguucuuuaugaugguguuacugaucccagaaccagaaaaacaaaggacaccucaagauaaucaacuagcauaugugguuauaggaauauuaacacuugcggcaauaauugcagcgaaugaaaugggucuacuagaaacuacaaagagagaccuaggcaugaguaaagagccuggggucguaaguccuacaagcuaucuagauguagaccuacacccggcuucagcauggacccuauaugcuguagcgacgacgguaauaacgcccauguuaagacacaccaucgaaaacaguacagcaaauguaucauuagccgcuauugcaaaucaagccguaguguuaaugggacuuaauaaaggauggccaaucucgaagauggauuuaggaguuccucuauuagcgcuagggugcuauucacaaguaaauccccuaaccuuaacugccgccguguuacuacuaauuacacacuaugcaaucauaggaccaggauuacaagcuaaagcaacuagagaagcgcaaaaacgaacagcugcagggauaaugaaaaauccaacaguggauggaauaaugaccauagaccuagauccaguaauuuaugacucaaaauuugaaaaacaauuaggacaaguaauguuauuaguauuaugugcaguucaauugcuuuuaaugaggacauccugggcccugugugaagcauuaacccuugcaaccggaccaauaacaacuuuaugggaaggcuccccaggcaaguuuuggaacacuacuauagcagugucgauggcaaauauuuuucgaggaagcuaccuggcuggagcuggucuagcauuuucgauuaugaaaucgguuggaacgggcaagagagguacaggaucgcaaggggaaacauugggagagaaauggaagaagaaacuaaaucaauuaucucgaaaagaguuugauuuauauaagaaaaguggaauaacagagguggaccguacugaggccaaggagggccugaaaagaggcgagaucacacaucaugcaguaucaagagguucagcaaaauuacaaugguuuguagaacgaaauauggugauuccagaaggacgcgugauagacuuagguuguggcagaggcgguuggaguuacuacugugcgggacugaagaaaguaacagaaguaaggggguacacaaagggugguccgggacaugaggaacccgucccgaugucgaccuacgguuggaacauaguaaaauugauguccgguaaagacguuuucuacuugccucccgagaaaugcgacacauuguuaugugauauaggggaaucgaguccguccccaacgguggaggaaucucgcacuauaaggguucuaaaaaugguagagccguggcucaaaaauaaucaauuuugcauaaaaguacuaaaucccuauaugccuacagucauagaacaucuagaacguuuacagcguaagcacgguggaauguuaguaagaaacccucuuucuagaaauaguacucaugaaauguacuggauaucuaacggaacagguaauaucguugcaagugucaauaugguaucucgccuauugcuaaaucgguuuacaaugacucaucgcagaccaacuaucgagaaggacgucgaccuaggcgccggaacucgacacguaaaugcagaaccagaaacuccaaauauggauguaauuggagaaagaaucaaacgaauaaaagaggaacauaacucuacauggcacuaugaugaugaaaauccguauaaaacaugggccuaccacgggagcuacgagguaaaagcgacggguagcgcuucaaguaugauaaaugguguugucaaacuguugacuaaaccaugggauguaguaccaaugguaacccaaauggcaaugacugauacaacaccuuuuggacagcaaagaguuuuuaaagagaaggucgacaccaggacgccgagaagcaugcccggcacgagaagagucaugggcauaacugcagaauggcuuuggcgcacgcuaggaagaaacaaaaagccaagauugugcacgcgugaagaauuuacuaagaaagugagaaccaaugcagccaugggugcgguguucacagaagagaaucaaugggauagcgcuaaggccgccguugaggacgaagauuucuggaaauugguugauagagaaagggaauuacauaaacuaggaaaaugcgguagcugcguguacaauaugaugggaaagcgcgagaagaaacugggagaguucggcaaagccaaagguagcagagccauaugguauauguggcuuggcgcacgauaccuagaauuugaggcuuugggcuuuuuaaaugaagaucauugguuuagcagagaaaauucuuauagugguguugaaggagaaggauuacauaaacuaggauacaucuuacgugauauaagcaagauaccuggcggagcaauguaugcggacgacacggcuggaugggauacaagaauaacugaagacgaucuucauaaugaggagaaaauuacacaacagauggacccagaacacagacaauuagccaacgcuauauuuaaacuaaccuaucaaaacaaggucguaaaggugcaaagaccgacacccacggggacaguuauggacauuauaaguagaaaggaccaacgaggcagugggcaagucggaacauauggguuaaauacauucacaaauauggaagcccagcuaauacgacaaauggaaggugaaggaguucuuacuaaggcggaucuugaaaauccacaucugagugagaagaaaauuacacaguggcuugaaacuaaaggcguugaacgacugaagcgaauggcuauaagcggagaugauugugugguuaaacccaucgacgauagauuugcaaaugcacuacuagcuuugaaugacaugggaaaagucagaaaagacauuccacaguggcaaccaucuaaaggauggcaugauuggcaacaaguaccuuuuuguucacaccauuuccacgaacuaauaaugaaagauggacguaaauuaguaguucccugcagaccccaagaugaacuuauugggcgagcaagaaucucgcaaggagccgguuggucucuaagagaaacagcaugcuugggcaaagcguaugcacaaauguggucacuaauguauuuccauagaagagauuuaagguuagcaagcaacgcaauuuguucugcgguuccgguucacuggguaccaacauccaggacaacuuggaguauacaugcacaccaccaguggaugacuacggaggacaugcuuacuguuuggaauagagucuggauugaagauaaucccuggauggaagauaaaacuccagucacaacuugggaaaacguuccuuaccuggguaagagagaggaucaguggugugguucauugauaggauuaacuucucgggcaacuugggcccaaaauauaccuacagcaauccaacaaguacgcagccucauugggaacgaagaauuucucgauuauaugccaucaaugaaaagauuuagaaaagaggaagagucagagggagcaauaugguag

SEQ ID NO: 23302 - RNA, 9873 nt, Artificial Sequence
  derived and/or modified CDS sequence (opt6) from DENV-3__EU482564__SS-prME
accucauuaugucuaaugaugauucuaccggcugcauuggcauuucaucugacuucacgcgauggagaaccacgcaugauuguugggaaaaacgaacgcggaaaaucuuugcuuuuuaaaacugccuccgggauuaacaugugcacuuugauagcaauggaucuaggagaaaugugcgacgauacuguaacguauaaauguccacacauuacagaaguagaaccugaagauauugacugcugguguaaccuuaccagcaccugggugacuuauggcacauguaaucaagcaggcgaacaucgucgagauaaacguucagucgcuuuagcaccacauguagggauggggcucgauacuagaacucagacauggaugagugcagagggcgccuggcgacaaguagaaaaaguugaaacaugggcucuaagacacccuggcuuuacaauacuagcacuuuuccuggcacauuacauuggaacaucacuuacucaaaaagugguaauuuucauacuacuaauguugguaaccccuucuaugacaaugagaugcguaggaguaggaaauagggacuucguggaaggauugucuggugccaccugggucgacgucguucucgaacaugggggcugugugaccacuauggccaaaaauaaaccaacauuggauauagaguuacagaaaacggaggccacgcaacuagcuacacuacgaaaauugugcauagaaggaaaaauaacaaauauuacaaccgacagccgguguccuacccaaggcgaagcaguuuuaccggaagaacaagaucaaaauuauguuuguaaacacaccuauguagaucgagguuggggaaaugguuguggguuauucgguaaagggaguuuggucacaugugccaaauuucaguguuuagaaccuauugaaggaaaaguaguucaauacgaaaauuuaaaauauacggugauuauuacaguacacacuggagaucaacaccagguaggcaaugagacacaagguguuacagcagaaauaaccccacaagcguccacaacugaggcuauuuuacccgaauaugguacgcuaggcuuggaaugcuccccaagaacagggcuagauuuuaaugaaaugauuuuacuaacaaugaaaaauaaagcauggaugguacauagacaaugguucuucgaccucccauuaccauggaccucaggagcuacaaccgagacgccgacauggaacaggaaagaacuauuggucaccuucaaaaacgcucaugcuaagaaacaagaaguggugguacuaggaucccaagaaggugcuaugcacacugcucuaacuggggccaccgagauucaaaacaguggagggacuagcauuuuugcaggucaucuuaaaugucgccucaaaauggauaaacuggaacuaaaaggaaugaguuaugccauguguacuaacaccuuuguauuaaagaaagagguaucagaaacccaacacggaacgauauuaauaaaagucgaauauaaaggagaagaugcacccugcaaaaucccuuucaguaccgaagacggacagggcaaggcgcauaauggaagauuaauuacggcaaaucccguuguuacuaagaaagaggaaccuguuaacaucgaggccgaaccacccuuuggggaaagcaauaucguaauagguaucggcgacaaugcauuaaaaauaaacugguauaagaaagguucaaguauuggaaaaauguuugaagccacggcuagaggcgcucgcagaauggcuaucuuaggagacaccgccugggacuuuggauccgugggcggagucuugaauaguuuagguaaaaugguccaucaaaucuucgggagcgcguauacagcucuauucagugguguuaguuggguuaugaaaauaggcauagggguccuccuaacuuggaucggucucaauaguaaaaacaccaguaugucuuucucuugcauagcuauaggugucauaacccuauaucugggugcaguugugcaagcagacaugggaugcgugaucaacuggaaagggaaagaacuaaaaugcggaagugguauauuugucacaaacgagguacauacuuggacugaacaauauaaauuucaggccgauucuccaaagagguuagcuacggcuauagcuggugcuugggaaaacggcguguguggaauuaggucaaccacuaggauggaaaauuuguuguggaagcaaauagccaaugaauuaaauuauaucuuaugggaaaauaacauaaaacuaacugugguugucggagauauuauagguguuuuagaacaaggcaaaaggacauuaacaccacaacccauggagcugaaguauucauggaaaacuuggggaaaagcgaaaauugugacugcagaaauccaaaauagcaguuucauaauagacgguccuaauacuccagaaugcccaucggccucaagagccuggaacguaugggagguagaggacuaugguuuuggaguauuuaccacaaauaucugguugaaauuacgugagguauauacacaacugugugaucacagguuaaugagcgcagcaguuaaagacgaaagagcaguacaugcagauaugggauauuggaucgaaagccagaaaaauggaucuuggaaauuagagaaagccuccuuaauagagguuaaaacuugcacauggccaaaaagucauacacuauggucaaauggaguucuugagagcgauaugauuauaccgaagaguuuggcagguccaaucucucaacacaauuaccgaccaggauaccacacucaaacugcagguccauggcacuuagguaaacucgaccucgacuuuaauuauugugaaggaacgacaguagucauuacugaaaacuguggaaccaggcgacccagcuugcgcacuacaacuguaucugggaaacuaauacaugaaugguguugccggaguugcacucuaccucccuuacgauauaugggcgaagacggauguugguauggaauggaaauccgaccaauuucagagaaagaagagaacauggugaaaagucucguaagugcagguaguggaaaaguggauaauuuuaccaugggugucuuauguuuggccauuuuauucgaagaaguuaugagagggaaauuuggcaagaagcacaugaucgcaggaguauucuuuaccuuuguacuucuauuaucgggacaaauuacuuggcgcgauauggcgcacacacucauaaugauaggcaguaaugcauccgauaaaaugggaaugggcguaacauaucucgcgcucauagcaacauucaaaauacaaccauuucuugcucuaggauucuuuuugcguaaacuuacaagucgagaaaacuuauuauuggguguugguuuagcuauggcaacaacccuucaacuuccagaagauauagagcaaauggcuaacggaaucgcguuagggcuaauggcauuaaaacuaauuacacaauucgaaacuuaccaguuauggaccgcccuaaucagcuugaccugcucuaauacaauguucacauuaacaguggcguggaggaccgcaacccucauacuagcggggguuuccuuacuuccgguaugucaaaguucuagcaugaggaaaacagauuggcucccaauggcuguagcagcaaugggagucccgccauugccgcuauucauuuucucacuuaaagacacgcuuaaacgcagaaguuggccauuaaacgaaggggugauggcagugggacuuguaucaauacuugcuagcuccuuguuacgaaacgauguuccgauggcagguccauuaguggccgguggacuauugaucgcauguuacguuauaacugguacaucugcagaucuaaccguagagaaagcagcugacaucaccugggaagaagaggcggagcaaacaggcguuucacauaaucuaaugauaacaguagaugaugaugguaccaugcguauuaaagaugacgaaacggaaaacaucuuaacgguacuauuaaaaaccgcauuacuuauaguaucaggcgucuuuccuuauucuauaccagccacauuauugguguggcacacuuggcaaaaacagacacaacgcucagggguuuuaugggacgugcccucgccuccugagacacagaaagcugaguuggaagagggcguuuaucguaucaaacaacaagggaucuucgggaaaacccaaguggguguugggguucaaaaagaagggguauuucauacgauguggcaugugaccaggggcgccguacuaaccuauaacgguaaacgccuugagccuaauugggcgagcgucaagaaagaccuuauuuccuauggaggaggguggaggcuuagcgcacaauggcaaaagggcgaggaaguacagguaauagccguagaaccaggcaaaaacccuaaaaauuuccaaacaaugccuggcaccuuucagacaacuacaggugagauaggggcuaucgcacuugacuucaagccuggaacaucuggguccccuauuauaaauagagaaggaaaaguugugggguuauaugggaacggaguaguuacuaaaaauggggguuaugugucaggaauagcacagacaaacgcggagccagacggaccuacaccagaguuggaagaagaaauguucaagaaacgaaauuuaaccauaauggaucuacacccuggaaguggaaaaacucgaaaauaucugccagcaguagugcgagaagcuauaaaaagacgucugagaacacuaauccuagcaccuacaagaguuguggcagcggaaauggaagaagcgcuuaaaggucuucccauaagauaccagacgacagcaacgaagagugaacauacagguagagagauagucgaucugaugugucaugccacauuuaccaugcggcucuugucaccagucaggguuccaaacuacaaucuaauuauaauggacgaagcgcauuuuacugauccggcuucuaucgccgcacgaggauacauaucuacuagaguagggaugggugaagcugccgcgauauucaugacggcaacacccccuggaacggcugacgcguuuccccaaucaaaugcaccaauacaagaugaagaacgugauauuccagaacggucuuggaacucaggaaacgaguggauaacugauuuugcgggcaaaacggugugguucguaccuucaauaaaagcgggaaaugauaucgcaaauugucuacggaaaaacggcaagaaaguaauucaauuaucaaggaaaacuuuugauacugaguaucagaaaacaaagcucaacgauugggauuuuguugucacaacagauauaucugagaugggagcgaacuuuaaagcagauaggguaauugacccccgacguuguuuaaagccuguuaucuugacggacgggcccgagagagucauauuagcaggacccaugcccguaaccgcagcuuccgcagcacaaagaaggggucgaguaggaagaaacccccagaaagagaaugaucaauauaucuucaccggacaaccauuaaacaaugaugaagaccaugcucauuggacggaggcaaaaaugcuguuagauaacauaaacacccccgaaggaauuauucccgcucuguuugaaccugaaagagaaaaaucagcagcuauugacggagaguaccgauuaaagggugagagucgcaaaacuuuuguugaacuuaugcguagaggagaucuuccaguuuggcuugcucauaagguggcgucugaagguauaaaauauacagauagaaaaugguguuuugauggucaacgcaacaaccagauuuuagaagaaaacauggauguagaaauauggacgaaggaaggcgagaagaagaaacuucguccucgaugguuagaugcacgcaccuauucagauccccucgccuugaaagaauuuaaagauuucgcagcaggaagaaaaucaauagcucuggacuuaguaaccgaaauaggccgagugcccucacacuuagcacaucggacucgcaacgcucuggauaaccuuguaaugcuacauacaucugagcauggaggucgggccuauaggcaugcuguugaagaacucccagaaacaauggaaacgcuucugcuucuaggauuaaugauccuguuaaccggcggagcaauguuauuccucauaaguggcaaagggauuggaaaaaccucuauagguuugauauguguuaucgcaucaagcggaaugcucuggauggccgaaauccccuugcaauggauagcuucugcuauaguauuggaauuuuucaugaugguguuauuaauaccugagccagaaaaacaacgaacaccucaagauaaucaacucgcuuauguaguuauuggaauacuuacacuugcggcgauaauagcagcgaaugaaaugggccuacuagagacgacgaaacgugacuuagggaugucgaaggaacccggaguugucagcccaacuuccuaucuagaugucgaucuccacccugcgucagcauggacauuauaugcugucgcaacuacuguaauuacaccuauguugagacacacaaucgagaacuccacagcaaacguuaguuuagccgcaaucgcaaaccaggcgguagugcuuaugggguuagauaaaggauggccuaucucaaaaauggacuuagguguaccucuacucgcacuuggauguuauucacaaguuaauccacuaacuuuaaccgcugcuguauuauuauugauaacucauuacgccauaauaggcccaggauugcaggcaaaagcuacgagagaagcacagaaaaggacagccgccgguauaaugaaaaacccaacaguagaugggauaaugacuauagacuuagacccagucaucuaugauucuaaauuugaaaaacaguuaggccaaguaaugcuccucguucucugcgcuguucaacuacuguuaaugagaacaaguugggcucugugcgaagcguuaacucucgcgacaggaccaauaaccaccuuaugggagggguccccagggaaauucuggaauacuacgauagcagucucaauggcuaacauauuccgagguucauaucuugccggcgcuggucuagccuucucuaucaugaaauccgucgguacaggaaagagggguacaggcucacaaggggagacgcucggcgaaaaauggaagaagaaacuuaaucaacuuaguagaaaagaauuugacuuauauaagaaaagcggaauaacggaaguggauagaacugaggcaaaagaaggacuuaaaagaggcgaaacuacacaucacgcggucaguagggggacugcaaaacuacaaugguucguggaacgaaauaugguaauacccgaagguaggguuauagaucuagggugugggcgcggaggcuggagcuauuauugcgcuggucucaagaaagugacugaaguccgaggauacacuaaaggggguccugggcaugaggaaccgguaccgaugagcacguacgguuggaauaucguuaaacuuaugucaggaaaagaugucuucuacuuaccaccagaaaaaugcgauacacuccuaugugauauuggggaaaguagccccagccccacuguagaagaaucaaggacgauacguguauuaaaaaugguugagccuuggcucaaaaauaaucaguuuugcauuaagguauuaaauccguacaugccaacugucauagaacauuuagaacgacuacagagaaaacacggaggaaugcuaguacggaauccucuuucacgaaacagcacacacgaaauguauuggauaucaaacggaacaggaaauaucgucgccucagugaacaugguuucgagacuacuacuuaaucgcuucaccaugacucaccguagaccuacuauagaaaaagacguggauuuaggggcagguacacgucacguuaaugcagaaccagaaacuccaaacauggauguaauuggugaaagaauaaaaagaauaaaggaagaacauaauucuacauggcacuacgacgaugaaaaucccuauaagacaugggcauaccauggcucuuaugaggucaaagcuacagguucagcaucaaguaugauaaauggaguugucaaauuacuuaccaagccuugggaugucguaccaaugguaacccagauggcaaugacagacaccacucccuucggccaacagagaguguucaaggaaaagguugauacgagaaccccuagauccaugccugguacaaggagaguuauggggauuaccgcagaauggcuuuggcgaacuuuaggacggaauaagaaaccgagacucuguacuagagaagaguuuacuaagaaaguacgaacuaaugcagcaaugggcgcgguuuuuaccgaagaaaaucaaugggauagugcaaaagcagcaguggaagaugaggauuuuuggaaauugguagauagggaacgagaguuacauaaauuaggaaaaugcgggucaugcguguauaacaugauggggaaaagagagaagaaacuuggagaguucgguaaagcuaaaggaucuagagccauaugguauaugugguugggagcaagauauuuagaauuugaagcacuuggauuuuuaaaugaggaucauugguuuagucgcgagaauagcuauaguggaguugaaggugaaggccuucauaaacuggguuauauacuuagagauauuucuaaaaucccagggggagcuauguaugcggacgauacagcagguugggauacgaggauaacagaagacgaccugcacaaugaagagaaaauuacucagcagauggauccagaacacagacaacuagcuaaugcuauauuuaaacugacuuaucagaacaaaguugugaaggugcaacggccuacaccaacaggcacuguuauggacauuauaagcaggaaagaccagagagguaguggacaaguagggacauacggacuaaacacuuuuacaaacauggaagcacagcuaauaaggcagauggaaggagaggguguguuaaguaaagcggauuuggaaaacccgcaccuacccgaaaagaaaauuacacaaugguuagagacaaaaggaguggaaagacuucguagaauggcaaucucuggugaugacuguguugugaaaccuauugacgaccgcuucgcaaacgcccuacuagccuuaaacgauauggggaaaguaaggaaggacaucccacaauggcaaccaucaaaaggauggcaugacuggcaacagguucccuucuguucccaucauuuccaugaauuaauaaugaaagaugguagaaagcuaguagucccauguagaccgcaagacgaacuuauuggucgugcaagaauaucucaaggggcaggguggucauuaagagagacggcaugucuugguaaagcauaugcgcaaauguggucauuaauguauuuucauaggcgagauuugagauuggcuucgaaugcaaucugcucagcugucccagugcauuggguuccaacaucaagaacgaccuggucaauucaugcacaccaucaguggaugacgacagaggacaugcucacugucuggaacaggguguggauugaggauaacccauggauggaggauaaaacgccaguaaccacuugggaaaaugugccauaucuuggaaagagggaagaccaauggugcgguagccuaauuggauuaacaagucgugccacaugggcacaaaauauuccuaccgccauucaacaaguaagaaguuuaauaggaaaugaggaauuuuuagauuauaugccgucaaugaagcgauucaggaaagaagaggaaagugaaggcgcaaucugguga

SEQ ID NO: 23303 - RNA, 9873 nt, Artificial Sequence
  derived and/or modified CDS sequence (opt6) from DENV-3__EU529699__SS-prME
accucacugugcuugaugaugauacugccagccgcucuagcuuuucaucuuacuucaagagauggcgaaccacguaugauuguagguaaaaaugaaaggggcaaaucccuguuauucaaaacagcaagcggcaucaacaugugcacacucauugcgauggauuuaggggaaaugugcgacgacacaguuacauauaaaugcccccauauaacugaaguugaaccggaagacaucgauugcugguguaacuuaacaagcacaugggugacauacgggaccuguaaucaagccggagaacauaggcgagauaaaaggucugucgcguuggcuccucaugucgggauggggcuugacacacgaacccaaacguggaugagugcggaaggagcauggagacaagucgaaaaaguagaaacaugggcacuucgacacccuggauuuacaauuuuggccuuguucuuagcgcauuauauaggaacuucacuuacgcaaaaaguagucauauuuauacucuuaauguuagucacaccgucaaugaccaugcgcuguguuggcguaggaaauagggacuucguagaaggucugucgggugcaacaugggucgacguaguccucgaacacggagguugcguaacuacuauggcgaaaaauaaaccaacauuggacauugaacuccagaaaacugaagcgacccaacuugcuacucugagaaaacuauguaucgaaggaaaaaucacgaauaucacuacagauagucggugcccuacucaaggagaagcaguucugccugaagaacaagaccaaaauuacguaugcaaacauacauauguggaucgaggaugggguaacggguguggcuuauucgguaaagggaguuugguaacuugugcuaaauuucaaugucuugaaccuauagaagguaaaguagugcaauaugagaaucugaaauauaccguuauaauuacuguucacacgggagaccaacaccaagugggaaaugagacacaagguguaacugcugaaauuacuccacaggcaucuacuacggaagcaauccuaccagaguaugguacauugggauuagaguguagccccagaacagguuuagacuuuaacgaaaugauacuauuaaccaugaaaaacaaagccuggaugguccaucgucaaugguuuuucgaucuaccuuugccauggacguccggcgcuaccacagaaacgcccacuuggaacaggaaagaauuauuaguuacuuuuaagaaugcucaugccaaaaagcaagaaguagucguacuugggucacaagagggagcuaugcauacagcucucacgggggcgacagaaauacaaaacuccggcggaacaucuauuuuugcaggacauuugaaaugccgucuaaaaauggauaaauuagagcuaaaagguaugucuuacgcuauguguacgaauacuuuuguccuaaagaaagaaguguccgaaacccaacaugguacaauucuuauaaaaguagaauacaaaggagaagacgucccauguaaaaucccauuuucaaccgaggauggucagggaaaagcgcacaacggaagauugauuacagcaaauccaguuguuacgaagaaagaagaaccaguaaacauagaggcagaaccuccauuuggugagaguaacaucguuaucggaauuggagauaaugccuugaaaauaaacugguauaagaaagggucaagcauagggaaaauguuugaagcuacggcgagaggagcuagaagaauggcuauucuaggagauaccgcgugggauuuugguuccguuggaggaguauuaaauagccucggaaaaaugguucaccagauuuucggaucugcauauaccgcgcuauucucggguguaucaugggugaugaaaauuggaauagggguacucuugacguggauuggccuaaauaguaaaaacaccucaaugucuuucucauguauagccaucggaauaauuacguuauaucuuggagcgguggugcaagcggauauggggugcguaauaaacuggaaaggaaaagaacuuaaauguggcucaggaauuuuuguuacaaaugaagugcauacguggaccgaacaguauaaauuccaagcagauagcccaaaacguuuggcuacugcaauugccggagccugggaaaacggcguauguggaauacgcaguacaacccgaauggaaaaucuccuuuggaaacagauugccaacgaacuaaauuacauccuaugggaaaauaacauaaaacuaacuguaguaguaggagauacuauaggggugcuagagcaaggaaaaagaacacucacuccacaaccgauggaacugaaguauucauggaaaaccugggggaaagcaaaaauuguaacagcugaaacgcaaaacagcucuuucauaauugauggaccgaacacuccagagugcccaagugcaucuagagcuuggaauguaugggaaguagaagacuaugguuucggagucuuuacaacaaacauuugguuaaaacuacgggaaguauauacucaauuaugcgaucaucgauuaaugagcgcagccguaaaagacgaacgcgcaguacaugcugauauggguuacuggauugagagccaaaagaaugggaguuggaaacuagagaaagcgagccuaauagaaguaaagacaugcacauggccuaaaucgcacacccuauggagcaaugggguauuagagucagacaugauaauaccaaaaucacucgcgggccccauaagccaacauaauuacagaccaggauaccacacacaaacagcggguccuuggcauuuaggaaaacuagaacuugauuuuaauuauugugagggaacuacuguaguuaucacagaaaacugcggaacucggggcccaagucuaagaacgacaacaguaucaggaaaauuaauacacgaauggugcugccguuccugcacguuaccucccuuaagauacaugggagaagauggauguugguaugggauggaaauaagaccgguguccgaaaaggaagaaaacauggucaaaagucuggugucugcgggaagcggaaagguagauaacuuuacaauggggguacucugucuagcuauuuuauucgaagagguaaugagagggaaauuugggaagaaacauaugaucgcaggaguauucuuuacauuuguuuuauuacugagcggccaaauaaccuggcgugauauggcucacacgcuuaucaugaucgguucaaaugcaucugaccguauggggauggguguaacuuaucuagcuuugauagcuaccuuuaaaauacaaccauucuuagccuuaggauuuuuccuaagaaaacugacaagccgugaaaaucuccuauuaggagugggguuagcuauggccacgacccuucaacuaccagaagacauagaacaaauggcgaaugguaucgcuuuagguuuaauggcauuaaagcuaauuacucaauucgaaaccuaucaauuguggaccgcgcuaauuucccugacauguagcaauacuaucuucacauuaacgguugccuggcguacagcuacucucauacuagcuggagucucauuauuaccaguuugccaaaguagcucaaugaggaaaacugacuggcuaccaaugacaguggcagcaaugggaguaccuccauuaccuuuguucauuuuuagucucaaagacacacuaaaacgucgaaguuggccuuuaaaugaaggagucauggcaguaggguugguaagcauucuugccaguucuuuacuuagaaaugacguacccauggcuggcccuuugguagcaggaggacucuuaauagcaugcuaugucauuacaggcaccucugcugaucuaacaguggaaaaagcggccgacguaaccugggaagaagaagcugaacaaacaggggucucccauaaccuuaugauuacuguggacgaugauggaacuaugagaauuaaagacgacgaaacagaaaauauucuaaccguacuguuaaaaacugcucuccuaauuguaaguggaauuuucccguacagcauuccagcuacuuuauuaguauggcauacauggcaaaaacagacucaaaggucaggagucuuaugggaugucccaucucccccggaaacucaaaaggccgaacuggaggaagguguauauagaauaaaacaacaaggaauauuuggcaaaacucaaguugguguagguguacaaaaggaaggugucuuccauacaauguggcaugugacgaggggcgcaguacuaacauauaaugggaagcgucuugaacccaauugggccaguguuaaaaaggaccuaauaucauauggugguggauggcgauuaagcgcacaauggcaaaaaggugaagaaguacaaguuaucgcaguagaaccaggaaagaacccgaaaaacuuccaaacaaugccgggaacuuuucaaacgacuacaggggaaauuggagcaauugcacuagauuucaaaccuggaacaagugguuccccaauaaucaaucgggaaggaaaagucgucggucucuacggaaauggaguaguuacgaaaaaugguggauacgucucggguaucgcucaaacaaacgcugaacccgaugggccaacgccugaguuagaggaggaaauguucaaaaagcgaaaucuaaccauaauggaccuacauccuggaucaggcaaaacaagaaaauauuuaccagcgauugucagggaggcuauaaaaagaagacuccguacuuuaauauuagcgccaacccggguaguagcagccgaaauggaagaagcguugaaaggauuaccaauucgguaucaaacgacggcuacaaaaagugaacauacggguagagaaauaguagauuuaaugugccacgcaacauuuacgaugcgacuucuaagcccuguccgaguaccgaacuauaauuugauuaucauggaugaagcacauuucacugacccugccucgauugcagccagagguuacauaucaacgagagucggcaugggugaagcggcagccauauucaugacagccacaccaccggggacggcugaugcguuuccacaaucaaaugcucccauucaagaugaagaaagggacauuccugaacgcucguggaacuccgggaaugaauggauaacagauuuugcuggaaaaaccguaugguucguacccagcauuaaggcagguaaugauauagcaaauugccuucgcaaaaacggcaagaaaguaauucaauuaagccguaaaacuuuugauaccgaauaucagaaaaccaaacucaacgauugggacuuuguuguaacaacagauaucucggaaaugggcgcgaauuucaaggcugaucggguuauugaucccagaagguguuuaaaacccgucaucuuaaccgaugguccagaacgggucauacuugcuggcccuaugccaguuaccgcagcgagugcggcacaacgacgggggagaguaggcaggaauccucagaaggaaaacgaccaguauauauuuacaggucaaccgcuuaacaaugaugaagaccacgcacacuggacagaagcgaaaaugcuacucgacaauaucaauacccccgaagggauuauuccagcacuauucgaaccagaaagagagaaaagugcagcgauagacggugaguauagauuaaagggugagagccgaaaaacauuuguugaguuaaugcgacguggagaucuaccagucugguuagcgcacaaaguggccucagaagguauaaaguauaccgacagaaaguggugcuuugauggccaaagaaauaaccaaauucuagaagaaaauauggauguugaaauauggacuaaagaaggagagaagaagaaacuacggccgagguggcucgaugcacgaaccuauucagacccccuagcuuugaaagaauuuaaggacuucgcagcggggaggaaaucaauagcccuagaccuagucacagaaauuggacguguaccuagccauuuggcucauagaacucgcaaugcguuagacaacuugguaauguuacauacuucagagcaugggggaaaggcuuaucgacaugcuguugaagaauuaccagaaacgauggaaaccuuauuguuguuaggauugaugauacuuuuaaccggaggagccauguuauuucugauuuccgguaagggaauuggaaaaaccucaaucgguuuaauaugugucauagcaagcagcggaaugcuauggauggcugagaucccacuccaauggauagcuagcgcuauuguacucgaauuuuucaugaugguucuauugauaccugaaccggaaaaacaaagaacuccucaagacaaccaacuagcuuacgucgucauuggaauauugacucuagcugcuaucauugcugcaaacgaaaugggcuuguuagagacuacuaaacgagaccuaggaaugaguaaagaaccaggaguaguaaguccuacaagcuacuuagacguugauuuacacccugcaagcgcuuggacucuauaugccguagccacaacuguaauaacuccaauguugaggcacacaaucgagaacucaacugcaaacguuuccuuggcggccauagcaaaccaagcagucguucuaaugggucucgacaaaggcuggccaauuuccaaaauggaccugggaguaccguugcuggcauuggguuguuauagucaagucaaccccuuaacucuaacagccgcaguucugcuacucauuacacacuaugcuaucauagggccaggguuacaggcuaaagcaacuagagaggcccagaaaagaacugcagcggggaucaugaagaacccaacuguugacggaauuaugaccaucgauuuggacccuguuaucuaugacucuaaguuugaaaaacaauuaggacaagugauguuauuaguucuuugugcagugcaguuacugcuuaugagaacaucgugggcucuaugugaagcauuaaccuuagcuacaggaccuauuacuacguuaugggaagguucacccggcaaauuuuggaauacaacgauagcaguaagcauggcgaacauauuuagggguaguuauuuagcuggcgcugggcuggcguucucaauuaugaaaucaguugggacaggaaaaagaggaacugggagucaaggagaaacuuuaggugaaaaguggaagaagaaauugaaucaguuauccaggaaagaauuugacuuauacaagaaaucagguaucaccgagguagaccgaacagaagccaaagagggauuaaaacggggagaaauuacccaucaugcuguaucucgugguagugcuaaguuacaaugguucgucgaaagaaacauggucauaccugaaggucgcguaaucgauuugggauguggaagaggugguuggagcuacuauugugcaggacuaaagaaagugacggagguacgaggauacacaaaaggaggcccagggcaugaagaaccagugccaaugagcacauauggguggaacauugucaaacuuaugagcgggaaggauguauucuaccuuccaccugaaaagugugauacgcuuuuaugugauaucggggaaagcucaccaaguccaacugucgaagaaucuagaacaauccgaguauuaaaaaugguggaaccguggcuuaagaacaaucaauucuguaucaaaguacucaaucccuauaugccgacagugaucgaacauuuagagagauugcaacggaagcacgggggaaugcuagugcgaaacccacucagucguaacagcacacacgaaauguauuggauaucaaaugguacuggaaacaucguagcaucaguaaacaugguaucuagacuacuauuaaaccgguuuacaaugacgcaucgaaggccaacgauagagaaagacguugaccuuggugcuggaacgcgccaugucaaugcagaaccagaaacuccuaacauggauguaauuggugaacgaaucaagagaaucaaagaagaacacaauuccacauggcacuaugaugaugagaacccauauaaaacaugggcuuaccacggaagcuacgaagucaaagccaccggaucggcaagcucgaugauaaauggaguugugaaacuacuaaccaaaccuugggauguuguuccaauggugacacaaauggcuaugacagacacgacgccguuuggucaacagcgaguguuuaaggaaaaaguagacacaaggacuccuaggucaaugccaggcacccggagaguaaugggaauuacugcagagugguuauggcgcacuuuaggccguaacaagaaaccaagguuaugcacaagagaagaguucacuaagaaaguucgaaccaaugccgccaugggagcugucuuuacugaagaaaaucaaugggacagcgcuaaggccgccguggaagaugaggauuuuuggaaguuaguggacagagaacgugaacugcauaaacugggaaaaugugguagcuguguuuacaacaugauggguaaaagggagaagaaauuaggggaauuuggcaaagcgaaggggucacgcgcaauuugguauauguggcugggugcgcgauacuuggaguucgaggcgcuaggcuuucuuaacgaagaccauugguucucccgagaaaacaguuauucugguguugaaggggaaggucuacauaaguugggguauauacucagggauauaagcaaaauaccaggaggcgcaauguacgccgaugauacagccggcugggauacccguaucacugaagaugaccuccauaacgaagagaaaauaacacagcaaauggacccagagcauaggcaacuggcgaaugcgauauuuaagcuaacauaccagaacaaagugguuaagguacagcgaccaacaccuacagguacuguuauggacauuauaagcagaaaggaccaacggggauccggucaaguaggaaccuacggacucaauacuuuuacuaauauggaggcacaacuaauccgacagauggagggugaaggcguacucaguaaagcggauuuagaaaauccacacuuaccagaaaagaaaauuacccaaugguuggaaacgaaagguguggaaagguuaaaaaggauggccauaucaggagacgauuguguuguaaagccgauagaugauagauucgccaacgcccuucuugcgcuaaaugacaugggaaaaguaagaaaggauauaccucaauggcaaccaucgaaagguuggcaugauuggcaacaaguaccuuuuuguagccaccauuuccaugagcuuauuaugaaagacggacgaaagcucgugguaccgugccguccccaagaugagcuuauagggagagcaagaauuagucaaggggcagguuggucucuaagggagacagcuuguuuaggcaaagccuaugcgcagaugugguccuuaauguacuuucaccgacgugacuugagauuagcuuccaacgcaauaugcagugccguaccuguccacuggguaccuaccucccgcacuaccuggucuauucaugcacaccaccaauggaugacaaccgaagacauguugacgguuuggaauagaguauggauugaagacaacccauggauggaagauaagacccccguaaccacaugggaaaauguaccguaccuuggcaaacgagaggaucaaugguguggcucccuaaucgggcuaacuucacgagcaacuugggcucaaaauauucccaccgcaauacaacaagugcguagccuaauaggcaacgaagaauuucuagauuacaugccaucuaugaaaagauuuagaaaagaagaagaaagcgagggggcaauaugguga

SEQ ID NO: 23304 - RNA, 9873 nt, Artificial Sequence
  derived and/or modified CDS sequence (opt6) from DENV-3__EU482566__SS-prME
acuucccucugccuaaugaugauuuuaccagcagcuuuagcauuucacuugacaaguagagauggagaaccacgaaugaucguuggcaaaaaugagagaggaaaaagccuucuuuuuaaaaccgcaucaggaauuaauauguguacucucauagccauggacuuaggagaaaugugcgacgauacagucacguacaaaugcccacacauuacugaagucgaaccagaagauauagauugcugguguaaucugacaaguacuuggguuacauaugggacauguaaucaagcuggugaacaucguagagacaaacgaucuguugcauuagcgccccacguugggaugggacuugauacaagaacccaaacauggaugucggcggaaggagcuuggcgacagguagaaaaaguagaaacuugggcacuuagacacccaggguucacaauauuagcuuuauuuuuagcucauuauaucgguacuucgcuuacacaaaaaguuguuauauuuacuuuauuaauguuaguaacuccgucuaugacaaugaggugugucggaguagguaauagagauuuuguagaaggauuauccggagcuacguggguugacgucguacuggaacacggagguugcgucacuacuauggccaaaaauaaaccgacauuagauauugaauugcagaaaacugaagcgacacaauuagcuacucuacgaaaacucugcauagaaggcaaaaucaccaauauuacaacggauucuagaugcccuacucaaggugaagcaguucuaccggaagaacaagaucaaaauuacguaugcaaacacacguauguggauaggggguggggaaauggcugcggucuguucggaaaaggaagccuaguaacaugcgcuaaauuucaaugcuuagagccgauagaaggaaaaguaguacaguacgagaaccugaaauauacugucauuauaacuguccacacgggagaucaacaccaaguagguaacgaaacacaaggcguaacugcagagauuacaccacaagcaucaacaacagaagcuauucuaccggaguacgggacucucggacuugaaugcaguccccgcacuggacuggauuucaacgagaugauauuacuaacuaugaaaaauaaagcauggaugguacaccggcaaugguucuuugaucucccacuuccguggacaagcggagcgacuacugaaacuccuacauggaauaggaaagaacuauuggucacauuuaaaaacgcucaugccaagaaacaagaagucguuguguuagguucacaagaaggagcgaugcauacggcuuuaacaggcgcuacugagauucaaaacucgggaggaacgagcauauucgcaggacacuuaaaauguagauuaaaaauggacaaacucgaacuuaaaggaaugaguuaugcuaugugcacuaauacguuuguacuaaagaaagaaguuucagaaacucaacauggaacaaucuugauaaaaguugaguauaaaggggaagauguaccuugcaaaauacccuucagcacagaagacggccaagggaaagcacauaacgguaggcuuaucacagcgaacccuguugugacuaagaaagaagaacccgugaauaucgaggcugagccaccguuuggagagucaaauauaguuauuggcaucggcgauaaugcacuuaaaauaaacugguauaagaaagguaguucaauugguaaaauguuugaagcaaccgcucgaggggcaagaagaauggcuaucuugggagacacagccugggauuuuggcuccguaggugguguccucaacagcuuaggcaaaaugguccaucaaauauuuggcagugcauacacagcauuauucucgggaguaaguugggugaugaaaaucgguauuggaguccuacugacguggauaggacucaacucgaaaaauaccaguaugucuuucagcuguauagccauugguauuaucacauuguauuugggggcagucguucaggcugauaugggaugcgucauaaacuggaaaggcaaagaacucaaaugcggcuccggaauauuuguaacuaaugaggugcauacauggacagaacaauacaaauuccaggcagacucgccaaaacgccuagcuacggccauagccggugcuugggaaaaugggguauguggcauacguucuacaacacguauggaaaauuuacuguggaaacaaauugccaaugaacucaacuacauacugugggagaacaauauuaaacugacaguugucguaggggacauaauagguguucucgaacagggaaaacggacucugacaccacaaccgauggaauuaaaauauucuuggaaaacaugggguaaagcuaaaauuguaacugcggaaacccaaaauucuucauuuauuauugacggcccaaauacaccagaauguccaucugcuaguagggccuggaaugucugggaaguagaagauuacggauuuggaguuuuuacaacaaauauauggcugaaauuacgagaaguuuacacacaauuaugcgaucacagacuaaugucagcugcgguaaaagaugaacgugcgguucaugcugauaugggauauuggauugagucccagaaaaauggaaguuggaaacuagagaaagcaucauugauagaagucaaaacgugcacauggccuaaaucccauacuuuauggagcaacggcguauuagaaagcgauaugauuaucccuaaaagucuggcaggcccaaucucacaacauaacuaucgaccuggcuaucacacucaaaccgcaggaccguggcaucuaggaaaacuagaauuagacuuuaauuauugugaggggacgacaguaguaaucacugaaaauugcggcacaaaaggcccgagcuuacguacuaccaccguaucugguaaacuaauacaugaauggugcugucgcucaugcacgcuuccuccauuacgauacaugggcgaagacgggugcugguauggaauggaaauuagaccaaucuccgaaaaagaagaaaacauggucaaaagccuaguaucggcaggaucgggcaagguagauaauuuuacuaugggaguucucugcuuagcuauccuguuugaggaaguuaugagaggaaaauucgguaagaaacauaugauugcuggaguuuucuucacguuugucuuacuauugucuggucagaucacauggagggacauggcacacacacuuauaaugauugggucgaaugcaagugacagaauggggauggguguaacuuacuuggcuuugauugccacuuucaagauacaacccuuucuggcucuaggcuucuuuuuaagaaaacugaccucgcgagagaaccuucuucuaggaguuggguuagcuauggccaccacuuuacaacugcccgaggauauagaacaaauggcaaacgggauugccuuagguuugauggcccucaaacuuauuacccaauuugaaacuuaucagcuauggacagcgcuaauuucccuaacaugcaguaauacaauuuuuacauuaacggucgcguggagaacagcaacgcugauccucgcugguguauccuuguuaccuguaugucaaaguucaucuaugagaaaaacugacuggcuuccaaugaccgucgcggcgaugggagugccucccuuaccauuguuuauauuuucgcuuaaagauacauugaagaggagaucauggccucucaacgaaggcguuauggccguaggcuuaguuagcaucuuagcgucuucguuguuaagaaaugaugugccuauggcaggcccuuuaguagcgggaggucuuuuaauagcuuguuacgucaucacaggaacaucugcggauuuaacaguggaaaaagcagcagaugucacgugggaagaagaagcugaacaaacuggcguaagccauaacuugaugauaacuguugacgacgacggaacgaugagaaucaaagaugaugaaaccgaaaacauucugacaguacuacuuaaaacugcuuuauuaauaguuucagguauauuuccauacucuauaccugcgacacuauuaguauggcacacauggcaaaaacaaacacaaagaucaggaguguuaugggauguuccaucaccaccagaaacucaaaaagcagaacuggaagaagguguauacagaauaaaacagcaaggaauauuuggaaaaacacagguagguguaggaguucaaaaagaaggcguauuucacacgauguggcacguuacuagaggggcuguucuuacauacaauggcaagcgguuagagccuaacugggcuucugucaagaaagacuuaauaagcuacggaggagguuggaggcuuucagcucaauggcaaaaaggagaggaaguacagguaauagcugucgaaccugguaaaaaccccaaaaacuuucagacuaugccugguacguuccagacuaccacuggagaaauaggugcaauagcccuagauuuuaagccaggcacuucuggaagcccuauuauaaauagagagggaaaaguugucggauuauaugggaauggcgucguuacuaagaacggcgguuacguaaguggaaucgcacagacaaacgcagagccggacgguccgacaccagaacuagaagaggagauguuuaagaaaagaaaucuuaccauuauggaucuacacccgggcucagguaaaaccaggaaauauuuaccugcuauuguuagggaggcgauaaaaagaagacugagaacacucauucuagcuccuacgagaguaguagcugcagaaauggaagaggcuuuaaagggauuaccuauccgguaccaaacuacugcuacaaaguccgaacacacaggacgagaaauuguugauuuaaugugccaugcgacuuuuacuaugcgacuauuaaguccagucagaguccccaauuauaacuugaucauaauggaugaagcacauuucacagauccugcuucuauugccgcacgaggcuauauuucaacacgagucggcaugggugaagcagcagccaucuuuaugacagcaacuccuccuggaacagcagaugcuuuuccacaaucuaacgcucccauccaagacgaagaaagagacauuccagaacgaucuuggaacucgggaaaugaauggaucacugauuuugcuggaaaaacaguaugguucgucccuagcauuaaagcgggaaaugauauugcaaauuguuugaggaaaaaugggaagaaaguuauucaacuuucacggaaaacguuugacacugaauaccagaaaacuaaguuaaaugauugggauuuuguaguaacgacagacauaagcgaaaugggcgccaauuuuaaagcagacagggugaucgauccucgaagauguuuaaaaccaguaauauuaaccgacgguccagagcgagugaucuuagcaggcccaaugccaguuacggcagccucggccgcacaaaggcgcggcagaguuggucgaaauccgcagaaggaaaaugaucaguauaucuuuacaggacaaccguuaaacaaugacgaggaucacgcacauuggaccgaagcuaaaaugcucuuggauaacauaaacacucccgaaggaauuauaccugcauuauuugaaccagaaagagagaaaucugccgcgauagauggugaauaucguuuaaaaggagaaucacgaaaaacuuucgucgaacugaugagaagaggagacuuacccgucugguuagcgcacaaaguugcuucagaagggauaaaauauacagacaggaaauggugcuucgacggacaaaggaacaaucaaauuuuagaagagaauauggacguagagauauggaccaaagagggagagaagaagaaauuaagaccacgauggcuagacgcucggacauauagugaucccuuagcccucaaggaauuuaaagauuuugcggcaggacguaaaucuauugcacuugaucugguaacagaaauaggacgcguaccaucccaucuggcccaccgaacacggaacgccuuagacaacuuagucaugcugcacaccagcgagcaugguggcaaagccuauagacaugccguagaagaguuaccagaaacaauggaaacguuauuauugcuaggccuuaugauacuacuaacagguggcgcaaugcuuuuucuaauaagcggcaaaggaauuggaaaaacuucuauuggacuuauauguguaauagcaucuagcggcauguuauggauggcagaaauaccguuacaauggauugcuagcgcuaucguacuagaauuuuucaugaugguccucuugauaccagagccugaaaaacaacguacgccccaggacaaccaguuagccuacguagucaucggaauacuaacacuagcggcuaucauugcugcuaaugaaaugggccuauuagaaacaacaaaaagagaccucggaaugucaaaagaaccaggaguaguuucgccaacaaguuacuuagauguagauuuacacccugcgagcgcauggacucuauaugcuguugcuaccaccgucaucacuccgaugcuucgacauacuaucgaaaauaguacugcuaacgucucucucgcugcaauugcuaaucaagccguaguauuaaugggauuagauaaaggguggccuauaagcaaaauggauuugggagucccuuugcuagcauuagguuguuauucucaagucaauccauuaacccuaacagcugcaguuuuauuacuaaucacacauuaugcaaucauuggaccuggucuacaagcgaaagcuacacgagaagcacaaaaacgaacugcagccggaauuaugaagaacccgacuguggauggaauaaugacgauugaccuugauccaguaauauaugauuccaaguuugaaaagcaacuaggccaaguuauguuauuaguauuaugugcaguacagcuccuguugaugaggacuucgugggcucuuugugaagcccuuacucucgcaacaggaccaauuaccaccuugugggaaggaagcccagguaaauucuggaauacaaccauagcagugucaauggcgaauauauuccgcgguucauacuuagcuggcgcagggcuagcauuuaguaucaugaaaucaguaggaacggggaagagaggaacaggaagucagggugaaacgcuaggagaaaaauggaagaagaaacuaaaucaacuuucccgaaaagaauuugacuuauauaagaagagugguauaaccgagguugacagaacggaggcaaaggagggacuuaagcggggagaaaucacacaccacgcagugucgaggggaucugcgaaacuccaaugguuuguagagaggaacauggugauaccugaagguagaguuaucgauuugggcuguggaagaggagguuggucauauuacugugcuggucuaaagaagguuaccgagguuaggggauacacuaaaggaggaccuggucacgaggaaccaguaccgaugucuacauauggauggaacaucgucaaacucaugagcggaaaagauguauucuaucuacccccagaaaagugcgauacguuguugugcgacauaggugaaucaaguccaaguccaacgguagaagaaucucgaaccauuagggugcuaaaaauggucgaaccuuggcuaaagaacaaucaauuuuguaucaaagugcuaaauccauacaugccuaccguaaucgagcaccuagaaagauugcagagaaagcacggaggaaugcugguucgcaauccucuaagccgcaauagcacucacgaaauguacuggauauccaaugggacgggaaauauuguagcaagugugaauaugguuucccgacuucugcucaacagauuuacaaugacacaccguagaccaacaaucgagaaagauguagaucugggagcggggacucgacacguaaacgcagagccggagaccccgaauauggauguaaucggagaaagaaucaagcgaauaaaggaagaacacaauaguacauggcauuaugacgaugagaauccuuacaaaaccugggcauaucauggaaguuacgagguuaaagcuacuggaucagcuaguucaaugauaaaugguguaguaaagcuacuuacuaaaccuugggauguaguaccuauggugacucagauggccaugacagacaccacaccuuucggacaacaacgcguuuucaaagaaaaaguugauacuaggacuccccggucuaugccagggacaagacgcgugauggguaucacagcugaguggcuauggcgaacacuuggcaggaauaagaaaccaaggcucugcacacgugaagaauuuacuaagaaaguucgaaccaaugcagcaaugggagccguauucaccgaagaaaaccaaugggacucagcaaaagcugcagucgaagacgaggacuucuggaaacuggucgaccgagagcgggaacuucauaaauuaggaaagugugggagcugugucuacaauaugauggguaaaagagagaagaaacugggagaauuuggaaaggccaaggggucaagagcaauaugguauauguggcuaggugcucguuacuuagaauuugaagcauuagguuuucucaacgaagaucacugguucucgagggagaauaguuauucagguguagaaggugaaggacuucacaaacuuggauauauucuacgugacauauccaaaauuccagggggagcaauguacgccgacgauaccgcaggaugggacacuagaauaacugaagacgaucuacacaaugaagaaaagauaacacagcaaauggauccagagcaccggcaguuagccaaugcaauuuucaaacucacauaccagaauaagguaguuaaaguacagagaccgacuccuacaggaacggucauggauauaauaagucguaaggaucagaggggaagcggucagguggggacauacggauuaaacaccuucacaaauauggaagcacaauuaaucagacaaauggaaggagaaggagucuuaucuaaagcagaucucgagaauccacaccuuccugagaaaaagauaacucaaugguuagaaacgaaaggggucgagagguuaaaacgcauggcaauuagcggcgacgauugcguggucaaaccaauagaugauagguuugcuaacgcacuauuagccuuaaaugauauggggaaaguacguaaagauaucccccaauggcaaccuucaaaaggauggcaugauuggcaacaaguacccuuuugcagccaccauuuucacgaauuaauaaugaaagaugggagaaaauuaguuguaccuugucguccacaagaugaacuaauuggcagagcaaggauuucacaaggugcaggauggucauugagagaaacggccugucugggaaaggcauaugcucaaauguggaguuuaauguauuuucauagacgugaccuaaggcuggcaaguaaugcuauauguucggccguccccguacauuggguaccuaccagucggacaacuuggucaauacacgcgcaccaucaauggaugaccacggaagauaugcuaacaguauggaaucgugucuggauagaggauaauccauggauggaggauaaaacaccugugaccacaugggaaaacguuccauauuugggcaagcgcgaggaucaauggugcgggucguugauaggauuaacaucucgagcuacgugggcacaaaacaucccaacggcuauacaacaaguuaggucauugauaggcaaugaagaguuuuuagauuacaugccgaguaugaaaagguuccgaaaagaagaagaauccgagggugcaauuugguaa

SEQ ID NO: 23305 - RNA, 9873 nt, Artificial Sequence
  derived and/or modified CDS sequence (opt6) from DENV-3__EU529702__SS-prME
acgucauuaugucugaugaugauucuuccagcagcuuuagcguuucacuuaacuagcagagauggagaaccaagaaugaucguagggaaaaacgaaagaggaaaaucauuacuuuuuaaaacagcuucaggaauaaacaugugcacacuaaucgcaauggaucuaggagaaaugugugaugauacaguaacuuacaaaugcccacauaucaccgaaguagaaccagaagauauagauuguugguguaauuuaacaucaacauggguaacuuaugggaccugcaaccaagcaggagaacaccguagagauaaaagaucaguugcguuagcuccucaugugggaaugggauuagauacgcguacccaaacauggaugucagcagaaggagcuuggcgacaaguggaaaaaguagaaaccugggcgcuucggcaccccgguuucacaauucuggcgcuauuuuuagcucacuauguuggaacaucucuuacacaaaaagucguaauuuucauacuacugauguuaguaacaccaucuaugacaaugagaugcgucggaguugguaaucgggauuuuguagaagggcuaaguggggccacuuggguagacguugugcuugaacauggcggauguguuacaacaauggcgaaaaacaaaccaacauuggacauagaacuucagaaaacagaagcaacacaacucgcuacgcuuaggaaauuauguaucgaaggaaaaaucacaaauauaacgacagacaguagguguccuacucaaggagaagcaguccugccugaagaacaagaucaaaacuauguauguaaacauacuuacguagaucgaggauggggaaacgggugcggucucuuuggcaaagggucauugguaacgugugcuaaauuccaauguuuagaacccauagaggggaaaguaguccaauacgaaaaucuuaaauacacagugaucauaacaguucacacuggugaucaacaucaaguagguaaugagacccaaggagucacagccgagauuacaccccaagcgaguacgacagaagcaauuuugccugaauacggaacacucggacuggaguguucucccagaacaggguuggauuuuaaugaaaugauauuauuaaccaugaaaaauaaggcuuggaugguacaucgacagugguucuuugacuuaccacuaccauggacaucaggagcaaccacggagacaccaacauggaaccgaaaagagcuauuggucacauuuaaaaacgcucaugccaagaaacaagaaguagucguacuagguucgcaggaaggagcaaugcauacugcccugacuggagccacagaaauccaaaacagugggggaacuucgauauuugcaggccaucugaaauguagguuaaaaauggacaaacuagaauuaaaaggaaugaguuaugcaauguguacuaauacauucgugcucaagaaagaagugagugaaacucagcacggaacaauauuaauaaaaguggaguacaaaggagaagauguuccauguaaagugccguuuucaacagaggacggacaaggaaaagcgcauaacgguagauuaaucacagcaaauccaguugucaccaagaaagaggaaccaguuaauaucgaagcagaaccuccauuuggcgaaucuaauauaguaauaggaaucggugacaaugcgcuaaaaaucaacugguacaagaaagggaguucuauaggaaaaauguucgaagcuaccgcacgaggagccagacggauggcuauuuuaggugacacugcaugggacuuuggaucuguuggagggguacuaaauagccuagguaaaaugguucaucaaauuuuuggaucugcuuauaccgccuuauucaguggugucaguuggguaaugaaaauaggcauagggguuuuguuaacguggauugguuuaaacuccaaaaacacaucgaugucuuuuagcuguauugucauaggaauaauaacccucuaucuuggagcagucgugcaggcugacaugggaugcguaauuaauuggaaaggcaaagaauugaaaugugggucagggauuuuugugacuaaugaaguccauacuuggacugaacaauauaaauuccaggccgauucuccuaaaagauuagccacagccaucgcgggagcaugggagaacggaguaugcggaauuagaucuacaaccagaauggaaaaucuuuuauggaaacagauagcaaaugagcuaaauuauauacuaugggaaaacaacauaaaauugaccguaguaguaggugauauaauagguguucuugaacaggggaaaaggacacucaccccacaaccuauggagcuaaaauacucauggaaaaccugggggaaagcaaaaaucgucaccgccgaaacccagaauaguuccuuuauaauugacgggccuaacaccccagaaugcccaagugcaaguagagcuuggaacguuugggagguugaagacuauggcuucgguguauucucuacuaauauauggcuaaaauuacgcgaaguuuacacccagcuuugugaucacagacugaugagugcagcaguuaaagacgaaagggcaguacacgcagauaugggcuauuggaucgagagucagaaaaaugguucauggaaacucgagaaggccaguuuaauugaaguaaaaacguguacuuggcccaaaucucauacacuauggaguaacggcgucuuggaaagugacaugauaauaccuaagagccucgcggggcccaucucccaacacaauuacagaccgggcuaucauacacaaacggcagggccauggcaucuggguaaacucgagcuagauuuuaacuauugcgaaggcacaacaguaguaauaacugaaaauugcggaacccguggcccuucauuacgaacaacuacggucaguggaaaacucauccacgaaugguguugccgaaguuguacacuuccaccucugagguauaugggugaagacggcuguugguaugguauggagaucagaccuauaucugaaaaagaagagaacaugguaaagucgcuaguuagcgccgguaguggcaaaguagacaauuuuacuaugggagcccugugucuagccauuuuguucgaggagguaaugcgaggaaaauuuggcaagaaacauaugauugccggcguauucuuuacuuucguccuacuucuaagugggcaaauuacuuggagagacauggcacauacucuaauaaugauuggaaguaaugccagugauaggaugggaauggguguuacuuacuuggcauugauagcaaccuucaaaauccaacccuuuuuagcauuaggauucuuucuaaggaaacugaccucucgagagaaccuucuuuuaggaguagguuuagcuauggccacgacauuacaauuaccagaagauaucgaacaaauggcaaaugguauagcacuuggacuuauggcacuaaagcuaauaacacaauucgagacauaucaguuauggaccgcauuaauuuccuuaaccugcucuaacacaauuuucaccuuaacaguugcuuggcguacugcuacacuaauccuugcaggagugaguuuacuacccguaugccaaucaucuucgaugcgaaagaccgauugguugccgaugaccguagcugcaaugggaguucccccgcucccgcuuuucaucuucucguuaaaggauacauugaaacgacgaagcuggccccuaaaugaagguguaauggcuguaggccuugugagcauacuggccucaaguuuauuacgcaaugauguucccauggcugggccauuggucgcaggaggacuccuaauagccuguuacgucaucaccggcacaagugcugaucuaacaguugaaaaagcagcagaugucacaugggaggaagaagccgaacaaacaggugucucgcacaauuuaaugauaacagucgaugacgacggaacaaugagaauuaaagacgacgaaaccgaaaauauucugacugucuugcucaaaacagcccuucuuaucgucucaggaauuuuuccauauagcauuccggccacccuucuuguauggcauaccuggcagaaacaaacacaaaggagcggaguauuaugggacguuccuuccccaccugagacacaaaaggccgaauuggaagagggcguuuaucggaucaaacaacagggaauauucgggaagacacagguagguguugguguacaaaaagaagggguuuuucauacaauguggcauguaacucgaggugcuguacuaacauacaacggaaaaagacuagaaccuaauugggcaagugucaagaaagaccucaucagcuacggaggcggauggaggcucucggcgcaauggcaaaaaggcgaagaaguucaaguaauugcaguugaaccuggcaaaaaucccaaaaauuuccaaacuaugccuggcaccuuucaaacaacaacuggcgaaauaggagccaucgcauuagacuucaaacccggaacaucggggaguccaauuauaaacagagaaggcaaaguggugggacuauauggaaauggaguaguaaccaaaaaugguggauacguaagugguauugcucaaaccaaugcggagcccgacggaccaacgccggaauuggaagaagagauguucaagaaaagaaacuuaacaauuauggauuuacauccggguagcggaaagacccggaaauacuuaccagcuauaguuagggaagcuauaaaacgacguuugagaacacucauauuagcaccgacaagagugguugcagcugagauggaagaagcauugaaaggguuacccauacgguaccagacaacagccacaaaaucugaacauacaggcagagaaauaguagauuugaugugucacgcgacuuucaccaugagauuauuaucaccaguuaggguuccaaauuacaaccuuauaauaauggaugaggcccauuuuacugauccugcgucgauagcggcacgagguuauauuucaacccgaguaggcaugggagaagcggcugcaauuuucaugaccgcuacaccaccugguacggcugaugcguuuccacagagcaaugcuccgauucaagaugaagaacgugauauaccugaaagauccuggaacucuggaaacgaauggauaacagauuucgcagguaaaacaguuugguucguaccuucaauaaaagcagggaaugauauagcaaauuguuuaagaaagaacggcaagaaaguuauacaguugucgagaaagacguucgacacagaguaucagaaaacgaaacuuaaugacugggacuuuguaguaacaacugauauuucagaaaugggugcaaacuuuaaagcugaccgagucauagauccaagacgaugcuugaagccagucauuuuaacagacgggccugaacguguaauuuuagccggcccuaugccaguuacugcggcaagcgcagcacaaagaagaggacgaguaggucgaaacccucaaaaagaaaacgaccaguauauauuuacaggccaaccgcucaauaacgacgaagaucacgcacacuggacugaggcaaaaauguuguuagauaauaucaacaccccagaaggaauaauaccggcccuuuucgaaccugaacgagaaaaaucugccgcuauagacggagaguauagauuaaagggugaaucucgcaaaacauuuguagaguugaugaggagaggagaccugccgguauggcucgcacacaaagucgccagcgaagggauaaaauauacggauaggaaauggugcuucgacggccagaggaauaaucaaauacuagaagagaauauggacguugaaauauggaccaaggaaggcgaaaagaagaagcucaggccaagguggcucgacgcgcgaaccuauuccgaucccuuagcguugaaagaguucaaagauuuugcugccgguagaaaguccauugcacuugaccucgugaccgaaauaggaagaguuccaucgcaccuagcgcaccgaacgaggaaugccuuggacaacuuagucaugcuccacacaagcgaacauggcggcaaagcauacagacaugccguagaagaguuaccugaaacgauggagacgcuuuuacugcucggauugaugauauuacuuacgggcggugcaauguuauuccugauaucagguaaaggaaucgguaaaacaagcauuggacuaauaugugugauagcaucgucagggaugcuguggauggcagaaauaccucuccaauggaucgcaucagcaauugucuuggaguucuuuaugaugguuuuacuaauuccugaaccagagaaacaaaggacaccacaagacaaucaauuagcauacguaguaaucggcauuuugacacuugcagcaauaauagcagccaacgagaugggacuacuagagacgacaaaacgagaucuagguaugucuaaagaaccgggaguaguuaguccaacuucuuaucucgauguagaccuucaucccgcuucagcuuggacacuuuacgcaguagccacgacggucauaaccccgauguuacgccauacaauagaaaacagcacagcaaacguaucucucgcagcaauugcaaaccaagcuguugucuugauggggcuggacaaagguuggccaauaaguaaaauggacuuaggggucccgcuacucgcucuaggauguuacagccaaguaaauccacucacucucacagcagcaguacugcucuuaaucacacauuacgcaauuaucggacccgguuuacaagcuaaagcaacgcgagaagcgcagaaaaggacugcagcuggaauaaugaaaaauccgacgguugaugguauaaugaccauugacuuagaccccgucauauacgauucaaaauuugaaaaacaguuaggacaagugauguuacucgucuuaugcgcuguucagcuucuguugaugcgcacgucaugggcuuuaugugaggcgcuuacgcuagcaacuggaccaauaacaacguugugggaaggaucaccugguaaauuuuggaauaccaccaucgccguguccauggcaaauauauuucgagguuccuaucuugccggugcaggguuagcuuuuucgauaaugaaaagugucgguacaggaaaacgagguacuggaucacaaggcgagacauuaggagaaaaauggaagaagaaauuaaaucaacuaaguaggaaagaguucgaucuauacaagaaaagcggaauaacagagguagaucgaacagaagcuaaagaaggcuugaaaagaggcgaaauuacucaucacgcgguaucacguggaucagcaaaacuucagugguucgucgagagaaauauggugaucccggaaggucgagucaucgaucucgguuguggucgagguggauggucguauuacugcgcaggucuaaagaaagucacugaaguaaggggauauacaaaaggaggaccuggacaugaagaacccguaccgaugucuacauacggguggaauaucguaaagcuaaugagcggcaaggacguauucuauuuaccaccagaaaaaugcgauacccugcucugcgacauaggagaaucauccccuagcccaacaguugaagagagccguacgauuagaguauuaaaaaugguagaaccauggcuaaagaauaaucaauuuuguaucaaaguguugaauccguauaugccaaccgugauugaacacuuagagcgauuacaaagaaaacauggcgggauguuagugcgaaacccccucuccagaaacuccacacaugaaauguauuggauuagcaauggaacugguaauauaguagcuucagugaacaugguaagucgacuucuucugaaccguuucacuaugacacaccgaaggccgaccauagagaaggacguugauuuaggggcagguacacggcauguuaacgccgaaccugagacccccaauauggauguaaucggagaaagaaucaaaagaauaaaagaggaacauaauucaaccuggcacuaugaugaugaaaauccuuauaaaaccugggcauaccacgggucguacgaagucaaggcuaccgguucugcuucaagcaugaucaaugggguaguaaaacugcuaacuaaaccaugggauguagugccaaugguaacccagauggcaaugacugauacuacaccuuuuggacaacagcgcguauuuaaggaaaaaguugauacucguacuccgaggucaaugcccgggacgcgcagagucaugggaauuacagcugaauggcuuuggagaacuuuaggacgcaauaagaaaccccgacuauguacccgagaagaguucacaaagaaaguacggacgaaugcagcuaugggugcaguguucacagaagaaaaucaaugggauagugcgaaagcggcaguggaggaugaggauuuuuggacccuuguagacagagaacgugaguuacacaaauuaggaaaaugcgggucauguguauauaauaugaugggcaagagagagaagaaauugggcgaauuuggcaaagcaaaggguucccgagcaaucugguauauguggcugggggcgcgguaccucgaguucgaagcauuaggauuuuuaaaugaagaucauugguuuagcagagagaacuccuauuccggaguugaaggcgaaggucuacauaaacugggauacauucuaagagacauuucaaaaaucccaggaggggcaauguaugcggacgauacagccggaugggauacgagaauaacggaagaugauuuacacaacgaggagaaaaucacccagcaaauggaccccgaacaucgacaauuggcgaacgcaauauuuaaacuaacuuaucaaaauaaaguuguaaagguacaaagaccaacgccaacuggcacggugauggauaucaucucacgcaaggaucaaaggggaaguggacaaguagguacauacggucuaaauacauucacuaauauggaagcgcaacuuaucagacaaauggaaggugagggaguguuaucaaaagccgauuuagagaauccacaucugccagaaaagaaaaucacucaauggcuugaaacgaaagguguggaaaggcuuaaacgcauggcaauuaguggggaugauugcguuguaaaaccuaucgaugacagauucgccaacgcauuacucgcucuuaaugauaugggcaaagucagaaaagacauuccccaauggcaaccaagcaagggguggcacgacuggcaacaaguuccguuuuguagucaucacuuucaugaguuaauaaugaaagacggaagaaaauuaguggucccuugcagaccacaagaugaacuaauaggcagagcucguaucucacaaggagcaggcuggucccuaagggaaacugcuugccuggggaaagcauaugcucaaauguggagccuaauguacuuucacaggagagacuugcguuuagcaucaaacgcaauuugcagcgcagucccaguacauugggugcccacaucacguacaacuuggucaauccaugcacaccaccaauggaugacuacggaggacaugcuuacuguguggaauagaguauggauagaggauaacccuuggauggaagauaaaacccccguuacgacuugggaaaacgugccauauuuaggaaaacgcgaagaucaaugguguggcagcuuaauuggacuaacgucacgggccacuugggcgcaaaacauaccaaccgcgauucaacaaguaagaucuuuaauuggaaaugaagaguucuuggacuacaugccgaguaugaagagauuuagaaaggaagaagaauccgaaggggcuauuugguaa

SEQ ID NO: 23306 - RNA, 9873 nt, Artificial Sequence
  derived and/or modified CDS sequence (opt6) from DENV-3__EU529703__SS-prME
acuucccucuguuugaugaugauauuaccugcugcguuagcuuuccaccugaccuccagggauggagaaccccggaugauaguagguaaaaaugaaaggggaaaaagucuauuauucaaaaccgcaucaggcauaaauaugugcacccuaaucgcaauggaucuaggugaaaugugcgacgacacuguuaccuacaaauguccacauauuacggaaguagaacccgaagacauugacuguugguguaaccuuacgagcacauggguaacauaugguacaugcaaccaagcaggggaacaccgacgcgacaaaagaaguguugcuuuggcgccucauguagggaugggacuugauacuagaacacaaacguggaugagugcagaaggugcuuggcgacagguagaaaaaguagaaacuugggcccucagacacccaggauucacaauacuagcauuauuccuugcacacuacauuggaacgucucuuacacaaaaaguagucauauuuauacuauuaaugcuaguaaccccuucaaugacaaugagaugcguaggaguagggaauagagauuucguagaagggcugaguggugccaccuggguugaugucgucuuagaacaugguggauguguuacaacaauggcuaaaaacaaaccaacuuuagacaucgaacuccagaaaacagaggcuacacaacuugcuacacuuaggaaacucugcaucgaaggcaaaauaacaaauaucacuacagauagccgauguccaacccaaggagaagcagcacuuccugaagaacaagaccaaaauuacguauguaaacauacguauguagacagaggauggggaaaugggugugguuuauuuggaaaaggcucccuaguaacaugcgcuaaauuccaaugccuagaaccuauugaggguaaaguaguacaauaugaaaacuuaaaauauacaguaauaauuacaguucauacgggagaucaacaucaaguuggcaacgaaacccaggggguaacggcggaaauaacaccacaagcgaguacaacagaagcgauauuaccugaauacggcacccucggacuagaguguucaccucggacagggcucgacuucaacgagaugauauuauuaacaaugaaaaacaaagcauggaugguccacagacagugguucuuugaccuaccacuaccauggacaaguggagcgacgacagaaacacccacauggaauagaaaagaacuauuaguuacuuucaaaaaugcccaugcuaagaaacaagaaguugucguauuagguagucaggaaggugccaugcauacagcccuaacgggcgcaacagaaauucaaaauucagggggaacaucaaucuuugcaggucaucuuaaaugucgacuaaaaauggauaaauuagaguuaaaagggauguccuacgccauguguacgaauacauucguccucaagaaagagguaagugagacccaacaugguacuauuuuaauuaaaguggaauauaaaggagaagaugcaccauguaagauaccguuuucaacugaagacgggcaggggaaagcacauaauggaagauugauaacugcgaacccaguugucacgaagaaggaagaaccagucaauauagaagcagagcccccauuuggggaaucaaacauaguaauaggaauaggcgacaaugcccucaaaauuaacugguacaagaaaggaucuaguauagguaaaauguuugaagcuacagcgagaggggcccgcagaauggcuauauugggcgacacugcgugggauuucgguagugucggagguguccuaaacucacuuggaaaaauggugcaucaaaucuuugggucugcauauaccgcuuuauuuucgggugucucauggguaaugaagaucggcauagggguauuacucacauggaucgguuugaacagcaaaaauacaaguaugucuuuuagcugcauugccauaggaauuauuacacuauauuuaggugcaguugugcaagcagauaugggcugcgugauaaacuggaaagggaaggagcuaaaauguggcucugggaucuuuguaaccaaugaaguacauacauggaccgaacaauauaaauuccaagcagacaguccuaaacguuuggcuacggcaauugcuggugcaugggaaaauggaguuugugguauucgaagcacaacaagaauggagaaucuucuuuggaaacagaucgcuaaugaacugaacuacauuuugugggaaaauaauauuaaacuuaccguaguggugggcgauauaaucggcguguuagaacaaggcaaacgaacauugacaccacaaccaauggaacuaaaguauucuuggaaaacaugggguaaggcaaaaauaguaacagcggaaacgcagaacucuucguuuauaauagacgguccaaauacgccagagugccccagcgcaucuagggccuggaacgugugggaaguagaagacuacgguuuuggaguuuuuacuacuaacauauggcuaaaauuaagagaaguauauacgcaauuaugugaccaucgacuaaugagcgccgcugugaaagaugaacgagccguucaugcugacaugggcuacuggauagaaucucagaaaaacggcucguggaagcuagaaaaagcaucacuaauagaaguuaaaacgugcaccuggccaaaaucacacacguuauggucaaacggaguccuagaaagcgacaugauuaucccuaaaucguuggccggcccaauaagucaacacaaccaccguccuggcuaccacacacaaacugcuggacccuggcaccuggguaaauuagaguuagauuuuaacuacugcgagggaaccacuguaguaauaacagagaauuguggaacaagaggaccaaguuuaaggacaacgacagucagcggcaaguuaauucaugaauggugcugcagaucaugcacacuacccccuuuacgguauaugggcgaagauggguguugguaugguauggaaauaaggccgauaagcgaaaaagaagaaaauaugguaaagagucuggucucagccgguagcggaaaagucgauaauuuuaccaugggcguauuaugcuuagcuauacuuuucgaagaggugaugcgagguaaguuuggcaagaaacacaugauugcgggaguauucuuuacuuucguguuacuccuaucuggucagauuaccuggcgagauauggcgcacacacucaucaugauaggauccaacgcaagcgauaggauggguaugggaguaacauacuuagcguuaaucgcaacauucaagauccaaccauuucuagcauugggauuuuuccuucgaaaacugacuucacgagagaaucugcuccuuggaguaggacuagcaauggcaacaacccuacaauugccagaagacauugaacaaauggcgaauggaauugcuuuaggacuuauggcucugaaacuaauuacccaauucgaaacguaucaguuauggacggcuuuaauaucccucacaugcucaaauacgauauucacauuaaccguagccuggcgcacagccacacuaauauuagcugggguaaguuuauugccaguuugccagucgucgaguaugagaaagacugacuggcuaccgauggcaguagcagcaaugggaguuccuccauuaccauuauucaucuucaguuugaaagacacguuaaaaagaagaagcuggccccuaaacgaaggugugauggccguaggcuugguaaguauucuugccaguuccuuacuuagaaacgacgugcccauggccggaccucuuguagcuggaggucuauuaauagcaugcuacguaauaacugguaccuccgcugaucuuacaguagaaaaagcagcugacauaacgugggaagaagaagcugaacaaacaggggucucacauaaucuaaugauuacaguagacgaugauggcacaaugagaauuaaagaugaugaaacggagaauauacuuaccguacuccuuaaaacggcccuacuuauuguaagcggaauauuuccauacagcauaccagcaacgcuguuagucuggcauacuuggcaaaaacagacacaacggagugguguucucugggauguaccuucaccaccggagacacaaaaagcagaacuagaagaaggcguauauagaaucaaacaacaagggauuuucggaaaaacucaaguugguguggggguucagaaagaaggaguguuucacacuauguggcacgucacacgaggugcgguacuaacauauaacggaaagagauuggaaccaaacugggcaagcgucaagaaagaccuuauaaguuaugguggaggcuggcgauuaagcgcacaauggcaaaagggugaggaagugcaaguaauagcaguagaaccagggaaaaacccuaagaauuuucaaacgaugccuggaaccuuucagacaacaacaggagaaauaggugccauugcguuagauuucaaacccggaacuagcgggagucccauaauuaaucgagaaggaaaaguuguaggguuauauggaaacgguguugucacuaaaaauggaggauacguaucagggauugcgcagacuaaugcagaaccagaugggccgacgccagaauuagaagaagagauguucaagaaacgaaaucuaacgauaauggaucuucauccgggcucgggaaaaacacgaaaguaccuaccagcaaucguucgugaagcuauuaaaagaagauuaagaacauugauccucgcuccaacccgaguaguugcggcugagauggaggaagcauugaaaggauuaccaauccguuaccaaacaacggcgacuaaaucugagcauacuggccgcgaaaucguagaucuaaugugucaugcaaccuucacaaugagacuccuuagcccaguuagaguuccuaauuacaacuuaauuaucauggaugaagcacauuuuacagauccagcaucaaucgcugcuagaggcuauauaucaacaagagucgguaugggagaagcagccgcaauauuuaugacagcaacuccgcccggaacagcagacgcauucccgcagagcaaugcucccauacaggacgaagaaagagauauuccggagaggagcuggaacagcgguaaugaguggauuacagacuucgcuggaaagacaguaugguucguacccaguauaaaagcuggcaaugauauagcaaauuguuuaaggaagaaugguaagaaagugauucaauuaagucgcaagacuuuugacacugaauaucagaaaacaaaauuaaacgauugggauuuuguaguuacaacugacauauccgaaaugggugcuaacuuuaaagcugauagaguaauagauccgcgcagauguuuaaagccaguaaucuugacagaugguccugagcgagugauccuugcaggaccuaugccuguaacagcagcaagugcagcacaacgaagaggacgaguuggacgaaacccacaaaaagaaaacgaccaguacauauuuacgggacaaccacuaaacaacgacgaagaucaugcacauuggacugaagccaagauguuacuagacaauaucaauacuccagaaggcauaaucccggcauuauucgaaccugaacgagagaaaagcgccgcaauugacggagaguacagguugaagggugaaucaaggaaaaccuuuguagagcuaaugcgcagaggggacuuaccaguuuggcuagcacacaaggucgcgucugaaggaauaaaguauaccgauagaaaaugguguuucgauggccaaaggaauaaucagauuuuagaagaaaacauggacguugaaauauggaccaaagaaggagagaagaagaaacugcguccgagauggcuugacgcccgaacuuauucagauccgcuggcacuaaaagaauuuaaagauuuugccgcugggcggaaaucaauagcacuagacuuaguaacagagauaggaagaguaccuagucauuuagcacaccgaaccaggaacgcguuagacaacuuaguaaugcuacauacaagugagcauggcgguagggcuuacaggcacgccgucgaagaacuccccgagacgauggagacccuauuacuccuagguuuaaugauacugcuaacaggaggggcaauguuauuuuuaauuucaggaaaagguauugguaaaaccaguauuggucuaauauguguaauugcuucaucaggaauguuauggauggcagaaauaccauuacaauggaucgccucagcuauuguucuagaauuuuucaugaugguucuacuaauaccugaaccagaaaaacaaagaacaccucaagauaaucaauuagcguacguagugauaggaauccuaaccuuagcagcaauaaucgccgcaaaugaaaugggccuucucgaaacgacaaaacgggaccuaggaaugucgaaagaaccugguguuguaucaccaaccagcuauuuggauguagaccuacauccugcaagugcauggacuuuguaugcuguagccacaaccguaauaaccccaauguuaagacacacaauagaaaauucaaccgccaauguaucauuagcagcuauagcuaaccaagccguaguauuaaugggacuggauaaagguuggccaauaucuaaaauggaccuuggcguaccccuacucgcccuuggaugcuauagucagguaaauccucugacauuaacggcggcgguccugcuacuaauuacacacuacgccauaauaggaccuggauugcaggcuaaagcuacgagggaggcacaaaaacggacagcugcaggcauaaugaaaaauccaacaguagacgguaucaugacuaucgaccuagaccccguaauauacgacucaaaauuugaaaagcaacuaggccaaguaaugcuccuagucuugugugcaguacaacuucuccuuaugagaacaucuugggcgcuuugcgaagccuuaacgcuagcuacggggcccauuacgacucugugggaagguucaccuggcaaauucuggaauacuacaauagcgguaagcauggccaacaucuuuagaggguccuaccuggcuggugcaggccuugcauucaguauaaugaaaagcguagggacuggcaaacggggcacuggaucucagggagagacucuuggugaaaaauggaagaagaaauuaaaucaauugucuagaaaagaauuugaucuguacaagaaaucaggaauaacagaaguggaucgaacugaggcaaaagaaggucuaaaacgaggagaaauaacacaucaugcugucaguagaggaucggcuaaauuacaaugguucguggaacguaacaugguaauaccagaaggaagaguaauagaucucgguugcggucgcgggggcuggucauauuacugcgcuggucuaaagaaagucacugaaguaagaggauauacaaaagguggaccaggucaugaggaaccaguuccgaugucaacuuaugguuggaauauagucaaacuaaugucagggaaagacguauuuuaccugcccccugaaaaaugugauacauuauuaugugauauaggcgagaguucaccaucgccgaccgucgaggaaagucguaccauucgcguccugaaaauggucgaaccgugguugaaaaacaaccaauucuguauaaaaguucugaauccuuauaugccuacagugauagaacaccuggaacguuugcaaagaaaacauggagguaugcucguaagaaacccauuaagccguaauucuacgcaugaaauguauuggauaucaaacggaaccgggaacauaguggcaucugugaauaugguaucacgauuguugcuaaaucgcuuuacaaugacccauagaagacccacaaucgagaaggauguagacuugggagcgggaacacgacauguaaaugcugaacccgagacccccaauauggacguaauaggagaacgaauaaaacgaauaaaggaagaacauaauaguacauggcauuacgaugaugaaaauccauacaagacaugggcauaccaugguucguacgaagucaaggcuacagguucagcaaguagcaugauaaacgguguaguaaaacucuugacuaaacccugggaugugguuccaaugguuacucaaauggccaugacagauacgacuccguucgggcagcagagaguuuucaaagaaaaaguagauacgagaacuccuagaucaaugccuggaacuagaagaguaauggggauaacagccgaauggcucuggagaacacuagguagaaauaagaagccccgacucuguacuagagaagaauuuacuaagaaaguaagaacaaacgcagcuaugggugcuguguuuacugaggaaaaucaaugggauucagcuaaagcagcgguggaagaugaggauuuuuggaaacuugucgaccgugaacgugagcugcauaaauuaggaaaaugugguucgugcguauacaacaugaugggaaaaagagagaagaaauuaggugaguucgggaaagcaaaaggauccagagcuauaugguauaugugguuaggugcgagauaccuagaauuugaagcgcucggcuuuuuaaaugaagaccacugguucagcagagagaauaguuacucagguguggaaggugaaggauuacauaaacuaggauacauucuuagggacauaucaaagauaccaggaggagccauguaugcagacgacacugcaggcugggauacgaggaucacagaggaugauuuacauaaugaagaaaagaucacccaacaaauggacccagaacauagacaauuagcgaaugcuauauuuaaauuaacuuaucaaaauaagguaguuaaaguccagaggccaacaccgacaggcacaguuauggauauuaucaguagaaaagaccaaagaggauccggacagguuggcaccuacgguuugaauacguucacaaacauggaggcccaauuaauucgccaaauggaaggcgagggaguuuuaaguaaagcagauuuagagagucaccaccuucccgagaagaaaauaacucaguggcuugaaacaaaaggaguugaaagacugaagagaauggcaauauccggggaugacugcguuguaaagccgauagacgacagguuugcaaacgcauuacuagcguuaaaugauaugggaaaaguacgcaaagacauaccacaauggcaaccgucaaagggauggcaugauuggcaacaaguuccguucuguucacaucauuuucaugaauugaucaugaaagacggccggaaguuaguaguuccgugucggccacaagacgagcuaaucgguagagcaagaaucucccaaggugcgggauggagucuaagagaaacagcuugucuaggaaaagccuacgcucaaauguggucacuaauguauuuccauaggagagaucuacgacuagcauccaaugcuauaugcagcgcuguaccuguucacuggguaccuacuucgagaaccacuuggaguauacaugcccaccaccaauggaugacuaccgaagauaugcuaacaguuuggaauagaguauggauagaagacaacccuuggauggaggauaaaacgccugucacaacuugggagaacguaccuuaccuaggaaagagggaagaucaauggugcggcucccugauagguuugaccucacgugcaacaugggcacagaauauaccaaccgcuauacaacaagucagaucgcucaucggaaaugaagaguuccuagacuauaugccaucuaugaagcgauucagaaaagaagaagaaagcgaaggggcaauaugguaa

SEQ ID NO: 23307 - RNA, 9873 nt, Artificial Sequence
  derived and/or modified CDS sequence (opt6) from DENV-3__EU529705__SS-prME
acaucuuuaugcuuaaugaugauuuuaccugcggcacuggcguuucaccuaacaaguagggacggagaacccagaaugauagucggcaaaaacgaacgcggaaaaucacuauuauuuaaaacagcguccgguauaaacauguguacuuuaauagcuauggaucuuggugaaaugugugaugauacuguaacauauaaaugcccacacauaacagaaguugaaccggaagacauagacuguugguguaaccugacaucaacgugggugacuuauggaacuugcaaucaagcaggagaacaucggcgugacaaacggaguguggcccuagcuccacaugucggaauggguuuagacacucgcacacaaacguggaugagugcugaaggagcauggcgucagguugagaaaguggaaacaugggcucuaaggcauccaggauuuacgauuuuagccuuauuucuggcacacuacauugguacaucucuaacacaaaaaguaguaauauucauuuuacuaaugcuaguuacaccuaguaugacuaugcguugcguuggaaucgggaaccgagauuucguagaagguuugucgggugcgacauggguugacguggugcuagaacacgguggaugcguaacuacuauggccaaaaacaaaccgacacuagauauugaacuacagaaaacagaagcaacacaguuagcaacgcuaaggaaacuaugcaucgaggguaaaauuacaaauaucacgacagacucccgauguccgacgcaaggggaagccguuuugcccgaggaacaagaccagaauuacguuugcaaacacacguauguagaccguggguggggaaacggcugcgguuuguucggaaaaggaucauugguaacaugcgcuaaauuccagugcuuagagccaauagaaggcaaaguagugcaauaugagaaccuuaaauauacuguuauaaucacaguucacacuggugaccaacaucaaguuggaaacgagacacaaggcguaacugcagaaaucacaccacaagcaagcacuacugaagcaauuuuaccugaauauggcacacucggcuuagaguguucaccucguacuggccuagauuuuaaugaaaugauuuuguuaacuaugaaaaacaaagccuggauggugcaccgacaaugguucuucgauuuaccacucccguggaccucaggcgcaacaacugaaacaccaacauggaaucguaaagaacuucuagucacauuuaaaaacgcacacgccaagaaacaggaaguuguuguucuagguucgcaggaaggugccaugcacacggcguuaaccggcgcuacagaaauacagaacaguggcggaacgaguauuuuugcagggcacuugaaaugccgcuuaaaaauggauaaacugggguugaaagguaugagcuacgcgaugugcacaaacacuuuuguucucaagaaagaagugucugaaacacaacauggcacgaucuuaauaaaaguagaauauaaaggggaggacgucccguguaaagucccauucaguacagaagauggacaggguaaagcacacucuggacgcuuaauaacugccaaucccguaguaaccaagaaagaagaaccaguaaauauagaagcugaacccccauuuggagagucgaauauugucaucggaauuggagauaaugcacuaaaaaucaacugguauaagaaagggaguagcaucggaaaaauguucgaagcaacggcgagaggagcaagacgaauggcaauacuaggagauacggcuugggauuuuggaucagucggggguguucuaaauagucuagggaaaauggugcaccaaaucuucgguagugcauacacagcccuauuuucaggaguuucuuggguaaugaaaauagguauaggaauccuacucacauggauaggacuaaauagcaaaaauacuuccaugagcuuuucaugcauugugauaggcauaaucacucuauaucuaggagcagucguacaggcagauaugggauguguaauuaauuggaaaggaaaagaauuaaaaugugguucgggaauauuugucacaaaugaaguacacacauggaccgagcaguauaaauuucaagccgacagucccaaaagauuggcaaccgccaucgcaggggcuugggaaaacggcguauguggaauacguagcacuacccgaauggaaaauuuauuauggaaacaaauagcgaaugaauuaaauuauauucuaugggaaaacaauauaaaacuaacaguuguagucggcgacauaauuggaguauuagaacaaggcaaacgcacacuuacaccccaaccaauggaauuaaaauauaguuggaaagcaugggguaaagcgaaaaucguaaccgcagaaacacagaacagcagcuucauaaucgauggaccaaacacaccagaauguccaagugccucacgagcauggaacguaugggaaguugaagacuacggauucggaguauuuaccacgaacauuuggcuaaaauugcgcgaagucuacacgcaauuaugcgaucauaggcucaugucagccgcgguuaaagacgaaagagcaguccaugcugauaugggcuacuggauagaaucucagaaaaacgguagcuggaaacuagaaaaagcaagucucauagagguuaaaacauguacuuggccaaaaagucauacacuuuggucaaaugggguauuggaaucugauaugauuauaccuaagagcuuggcaggacccauaagucagcauaacuaucguccgggauaucauacucaaacugcgggaccguggcaccuagguaaacuggaacuugauuuuaacuauugugaaggcacgacagucgucauaacugaaaacugcggaacucguggcccuaguuuacgaaccacuacaguuagcggcaaacugauacaugaaugguguuguagauccuguacguuacccccacugcgauacaugggagaggauggauguugguacgguauggaaauacggccuauuagcgaaaaagaagaaaacaugguuaaaucucuaguauccgcggguucgggcaaaguagauaacuuuacaauggguguauuaugccuugcaauccuuuuugaagaagucaugagagggaaauuuggcaagaaacacaugauugccggaguguucuuuacauucguccucuuguuaucaggacaaaucacauggagagacauggcacacacauuaauaaugauugguaguaaugcgucugacagaaugggcaugggaguaacauaccuggcacuuaucgcaacauucaaaauccaaccauuucuagcacugggguucuucuuacggaaacuaacaucccgagaaaaucuucuauuggggguaggacuagcgauggccaccacgcuucaacuucccgaggacauugagcaaauggccaaugguauagcgcuaggucucauggcucuaaaauugauaacacaauucgaaacuuaucagcuauggacugcgcucauuucgcuaacauguucaaauaccauuuuuacgcuaacaguggcauggaggacagcaacauuaauacuugcugggguaucauuauuaccaguuugucaaagcuccagcaugagaaaaacagauugguuaccuaugacagucgcagcaaugggcguaccaccauuaccguuauuuaucuucucacuaaaagauacacuaaaacguagaaguuggccucuaaaugaaggaguuauggcugugggguuagucucaauacuagcuagcucccucuuaaggaaugacguuccaauggcaggaccccuaguagccggaggucuccuaaucgccuguuauguuauuaccggcacgagcgcagaucucacggucgagaaagcggcagacgugaccugggaagaagaagcugaacaaacuggcguaucacacaaccuaaugauaaccgucgaugaugacggaaccaugcguauaaaagacgaugagaccgaaaauaucuuaacaguucuucuaaaaacagcuuuacuaauagugagugguauauuuccauauuccauucccgcgacucucuuaguauggcacacuuggcaaaaacaaacacaaagaaguggcguccucugggaugugccgagcccaccugagacccagaaagcagagcuggaagaagguguauaucguaucaaacaacaaggaauauucggaaaaacacagguaggagucggaguacaaaaagaagguguauuccauacgauguggcaugucacacgaggagcaguacuaacuuacaaugguaagagacuugagccaaauugggccagcguuaagaaagaccuuaucucauacgggggaggauggcgccuaagugcacaguggcagaaaggugaagaaguccaaguaauugcugucgaaccuggaaagaaccccaaaaacuuccaaacgaugcccggaacguuccaaacaacgacgggugaaauaggagcuauagcucucgacuuuaaaccuggaacaucugggagcccaauaauaaauagggaaggcaaaguuguaggucuauacggaaaugguguuguuaccaaaaauggaggauacguuuccgggauagcucaaacuaacgcugagccggauggcccaacaccggaacuagaagaggaaauguuuaaaaagcggaaucuaacaaucauggaucuacacccaggaagcgggaagacccguaaauaccuaccagcuaucguacgggaagcaaucaaaaggagguugcggacuuuaaucuuagcaccgacgagaguuguagcugcugagauggaagaggcuuuaaaaggauuaccaaucagguaccaaaccacagcuaccaaaagugaacauacaggaagagaaauaguugauuuaaugugucaugcaaccuuuaccaugcggcuguuaucgccaguaagaguuccuaauuauaaccucaucauuauggacgaagcacacuuuacugauccugccuccauagccgcacguggcuacaucucaacaagaguagggaugggggaggcagcagcuauuuuuaugacagcuacgccaccaggaacagcagaugcauucccucaaagcaacgcaccuauucaggaugaagaaagagauauaccggaaagaucauggaauaguggcaaugaauggauaacagacuuugcgggaaaaacugucugguuuguccccaguauaaaggcgggaaaugauauugcgaauugcuugcggaaaaaugguaagaaaguaauacaauuaagcagaaaaacuuuugauacggaauaccagaaaacuaaguugaaugacugggacuucgucguuacaaccgacauuagcgagaugggagcuaacuuuaaagcagacaggguaauagauccucggaggugucucaaaccagucauucucaccgauggaccugagagaguaauauuagcuggaccaaugcccguaacggcugcuagugccgcucaacguagaggaagaguaggcaggaauccgcagaaggagaacgaccaauauauauuuacaggacaaccucuaaauaaugaugaggaccaugcccauuggacugaagcaaaaauguuguuagacaauaucaauacuccagaagggauaauaccugcucucuuugaaccagaaagagaaaaaucggcagccauugauggagaauaucgacuuaagggcgaaaguagaaaaacuuucguagaauuaaugaggcguggugauuuaccaguuuggcuggcucauaaagucgcaucagaggguauaaaauacaccgaccgaaaauggugcuucgacggccaacguaauaaucagauucuagaagaaaacauggauguagaaauauggacgaaagaaggagaaaagaagaaacuacgcccgcgauggcuagaugcaagaaccuauucagauccauuagcguuaaaagaauuuaaagacuuugcugcagguagaaaaucuauagcgcuagaccucguaacagagauaggacgggugccaucucaucucgcacauagaacaagaaacgcuuuagacaacuuaguaaugcuccacacuucugaacacgguggccgugccuaucgucacgcuguugaagaacuccccgaaacuauggagacccugcugcuacugggauuaaugaucuuauugacuggcggagccauguuguuuuuaaucucugguaaaggcauagguaaaacaucuaucggauugauauguguuauagccagcaguggaaugcuauggauggcggagauaccacuucaauggauagccagugcaauaguauuagaauuuuucaugaugguccuauuaaucccggagccugaaaaacaacguacaccgcaagauaaccaguuggcuuauguaguaaucgguauucugacacuagcagcgauaaucgccgcuaacgaaaugggauuauuagaaacaacuaagcgugaccucgguaugaguaaggaacccgggguagucucaccgacuucuuaccuugacguggauuuacauccggcaagugccuggacguuguacgcaguagccacaacaguaauaacacccauguuaaggcauaccauagagaacucgacagcuaacguaaguuuagcagcaauagcaaaucaggccguaguuuuaauggggcuagacaaagguuggccaauaucaaagauggaucugggggugccacuacuugcccucggaugcuauucacagguaaacccuuuaacauuaacugcggccguauuacuuuuaauaacucacuaugcuauaauagguccgggauugcaagcuaaagcaacucgugaggcacaaaaacgaacagcugcagguauuaugaaaaaccccaccguagauggaauuaugacuauugauuuagauccgguaauauaugauaguaaauuugagaaacaauuagggcagguuaugcuuuuaguacuaugcgcaguacaacuuuuacuuaugcgaacgucgugggcuuugugcgaagcucuaacgcucgcuacuggaccaauaacaacacuaugggagggaagcccgggaaaguucuggaauacgacaauugccgucaguauggcaaacaucuucagaggaaguuaucucgcgggcgcuggauuggcguucaguauaaugaaaucaguaggaacaggaaaacggggcacuggaagucaaggugaaacccuuggagaaaaguggaagaaaaagcugaaccaauuaucccgaaaggaauuugacuuauacaagaaaucgggaauaacggagguagauagaacugaagcuaaggaggguuugaaaagaggugaaauaacccaccacgcuguuucaagggguuccgcgaaacuacaaugguucguagaacggaacaugguuauucccgaaggucgggucauugaccuugguuguggaaggggaggcuggucguacuauugcgccggucuaaagaaaguuacagaggugaggggcuacacaaaagggggccccggucacgaggagccugucccuaugagcacuuauggauggaauauugucaaacuuaugucaggaaaggauguauucuaucucccaccagagaagugugauacacuccucugugacauaggagaaaguucaccaaguccgacuguagaagaauccagaacaauucgugugcugaaaaugguagagccuugguugaaaaacaaucaauucuguauaaaggugcuaaacccuuacaugccgacaguaauugaacauuuagagcgcuuacaacgaaaacauggagggaugcucguacgaaauccacuaagcagaaacucaacgcaugaaauguacuggauaucuaacggcacggguaauaucgucgcaucaguuaauaugguaucuagauuacuacuuaacagauuuacuaugacacacaggagacccacuauugaaaaggacgucgaccucggagcaggaacacgacaugucaacgcggaaccugaaaccccaaauauggaugucauaggugaaagaauaaaaagaauuaaggaggaacauaacaguacauggcauuaugacgaugagaacccuuauaaaacaugggcauaucacgggucauacgagguaaaagcaacuggcagugcauccucaaugauuaauggagucguuaaauuacucacuaaaccaugggacguggugccuaugguaacacagauggcuaugacagauacaacaccuuucggacaacagcgcgucuuuaaagagaaaguagacacccggacaccccgaucaaugccggggacccgacggguaaugggaauuacagcagaaugguuauggcguacauuaggacggaauaagaaaccacgacuauguacuagagaagaauuuacgaaaaagguaagaacaaaugcagcaaugggugcgguuuuuacagaagaaaaucagugggacucagcaaaagccgcaguugaagaugaagacuuuuggaucuuaguugaucgagaaagagaauuacacaaguuaggaaaguguggaucuugcguuuauaauaugauggguaaaagagagaagaaacuuggagaauuugguaaagcuaaagguucuagagcaauaugguacauguggcuuggggcccgauauuuagaauuugaagcucuaggauuuuuaaacgaagaucacugguuuagucgagaaaacucuuauuccggaguugaaggggaaggauuacauaaacuaggcuacauuuuaagggacauaucuaagauaccugguggagccauguacgcggacgacacagcaggaugggauacucguauuacggaggacgauuugcauaacgaagagaaaauaacccaacaaauggaccccgaacaucgacaacuggcuucugccauauucaaauuaacuuaccagaacaaaguugucaaaguucaaagacccacaccaacgggcacuguaauggacauuauuucuagaaaggaucagagagguuccggacaggucggaacuuacggauuaaauacguucacgaauauggaggcgcagcuaauaagacaaauggaaggagaagggguucucaguaaggcugaucuggaaaauccacaucuuccugagaagaaaauaacacaaugguuagaaacaaaaggcguagaacggcuaaaaaggauggcaauuaguggcgacgauugugugguaaaacccaucgaugacagguuugcaaaugcuuuauuggcucuaaaugauauggggaaaguuaggaaggacauaccucaguggcaaccaucuaaaggcuggcaugauuggcagcaagugccuuuuuguagucaccauuuucacgaguuaauaaugaaagauggccgaaaacuuguaguucccugcagaccacaagacgaacuuauaggacgagccagaaucucacaaggagcaggguggagcuuaagggaaaccgcaugcuuggguaaagcguacgcucaaauguggucacuaauguauuuucacaggcgggaccuucgauuagcguccaaugcaaucugcucugcaguuccaguacauuggguaccgacaagccgaacaacauggucaauacaugcacaccaucaauggaugacaaccgaagacauguuaacgguauggaauagaguuuggauugaagacaauccuuggauggaagauaagacaccugucacaacaugggaaaacguucccuaucucggaaaacgcgaagaccaguggugugggucauuaauaggguugacgaguagagccacgugggcgcaaaauauaccuacagcaauacagcagguacgcagccucauaggaaaugaagaauuucuagauuacaugccgucaaugaaaagauucagaaaggaagaagaaagugaaggagcuaucugguaa

SEQ ID NO: 23308 - RNA, 9873 nt, Artificial Sequence
  derived and/or modified CDS sequence (opt6) from DENV-3__EU596492__SS-prME
acaucgcuguguuuaaugaugauucuaccagcagcguuagccuuucaccuuaccuccagagauggcgaaccaaggaugaucguagguaaaaaugaacgcggcaaaucuuuacuguuuaaaacagcaagcggaaucaacauguguacguuaaucgcaauggauuugggggaaaugugugacgauacuguaacauacaaauguccacauauugcagaaguugaacccgaagauaucgauugcuggugcaaucuuacgucgacauggguaaccuauggcacaugcaaucaagcaggcgaacacagaagagauaaaagaaguguggcauuagcuccucauguagguaugggauuagacacacgaacucaaacauggaugucugcugaaggggccuggagacaaguugaaaaaguagaaacaugggcucuacgacauccaggauuuacgauauuagccuuguuucuugcacauuacauugggacgaguuuaacccaaaaaguggucauuuuuguccuacuuaugcuuguaaccccauccaugacaaugagaugcguuggaguuggaaacagagauuucguagaaggauuaaguggugcaacaugggucgacguaguucuggaacacgggggaugugucaccacuauggccaaaaauaaaccaacguuggacaucgaacuacagaaaacugaagcaacacaacuagcaacacuuagaaaauuauguauugaaggaaaaauaacaaauauuacgacugauaguagguguccuacucaaggggaagcagccuugccugaggaacaagaccaaaacuaugucugcaaacauaccuacguugacagagguugggguaacggauguggacuuuucgguaaaggaucccuaguuacgugugcgaaauuucaauguuuagaaccaaucgaaggaaaaguaguacaauaugaaaaccucaaauacacaguuauaauuacaguccacacgggugaccaacaucaaguggguaaugagacccaaggaguuacagcagaaaucaccccucaggcguccacaacagaagcuauacuuccugaauaugguacauuaggguuagaauguagcccucggacuggucuugacuucaaugaaaugauucuccuaacaaugaaaaauaaagcguggaugguacacaggcaaugguuuuucgaccuuccauuaccuuggacuucaggggccacgacagaaacaccuacguggaaucgaaaagaacuacucguaacauuuaaaaacgcacaugcaaagaaacaagaagucgucgucuuagggagucaagaaggggcaaugcauaccgcccuaacaggggcuaccgagauucaaaacaguggaggaacuucgauauuugcuggacaucugaaaugccgccuaaaaauggauaaacuagaguugaaagggaugaguuacgccauguguacaaauacauuuguacucaagaaagaaguaucugaaacucaacacggaaccauacucauaaaaguugaauacaaaggugaagacgcucccuguaaaaucccuuuuuccacagaagauggucaagggaaagcacauaacggacgacucaucacagcaaacccuguagugaccaagaaagaagaaccaguaaacauugaggcggaaccuccuuucggggaaucgaauauagugaucggaauaggagacaacgcccuaaaaauaaauugguacaagaaagguucaaguauaggaaaaauguucgaggcuacugcacggggcgcuagacgaauggcaauccuaggugacacugcuugggauuuugguuccguagggggaguucuaaauucacuagguaaaaugguacaucaaauauuugguucugcauauaccgcacuuuucucagguguaucguggguuaugaaaauagguaucgguguucuacuaacuuggauaggauuaaauaguaaaaauacgaguaugaguuuuucgugcauugcaauagguauaauaacuuuauaucuaggugcaguagugcaagcugauacaggguguguugucaauuggaaaggaaaagaauugaaaugcggaaguggaauauuuguaacgaaugagguccauacauggacggaacaauacaaauuucaagccgacagucccaaacgacuugcaacugcaauagcgggugcaugggaaaauggaguuugcgggauaagguccacgacaagaauggagaauuuauuauggaagcaaguugcaaaugaauuaaacuauauauuaugggagaacaauauuaaauuaacaguggucgugggcgacauaaucggaguucuugaacaaggcaaaagaacccuaacaccacaaccaauggaacuuaaauauaguuggaaaaccugggguaaagcaaaaaucgucacugcggagacucaaaauucuaguuuuaucaucgauggcccuaauacaccugagugcccgucagcaucaagagcauggaacgucugggagguagaagacuacggcuuugggguauuuacaacaaauauuuggcuaaaauuaagagagguguacacucaacucugcgaccacagauugaugucagcugcaguuaaagacgagcgcgccguacaugcagacaugggauauuggauagaaucgcagaaaaauggaucauggaagcuagaaaaagcaucuuuaauagagguaaaaacuugcacuuggccaaaaagucauacauuaugguccaacgggguucucgaaucagacaugauaauucccaaaucacuugcaggaccaauaagucaacacaacuauagacccggcuaucacacacaaacagccggaccauggcaccuagguaaguuggaauuagacuuuaacuauugugagggaaccacaguagucauaacugaaaauugugggacuagagguccaucauuacgcaccacaaccgucucuggaaaacuuauucaugagugguguugccgaucuugcacuuuaccacccuuacgguauaugggugaagaugguugcugguacggaauggagauaagaccaauaucagaaaaggaagaaaacaugguaaaaagccuuguuucugcaggaucagguaaagucgauaauuuuacuaugggaguacuauguuuagcuauacuuuuugaggaaguaaugagaggaaaauuugggaagaaacauaugauagcuggggucuuuuucaccuuugugcucuuacuaucggggcaaauuacauggcgugauauggcucauacacuaauuaugauaggaucaaacgcuuccgaccgaaugggaauggggguaacauauuuggcgcuuauugccacauucaaaauccagccauuccucgcacuaggauucuuucucaggaaauugacauccagagaaaauuuauuauuaggcguaggucuugcaauggcaacaacauuacaacuuccagaagauauugagcagauggccaaugggaucgcacuaggccuaauggcauuaaaacuaauaacacaguuugaaacuuaucaacuauggacagcccuaaucucacuuaccuguucuaauaccauauucacccuaaccguagcauggaggacugccacucugauucuggcaggcguuaguuuguuaccaguaugccaauccucgucaaugcgaaaaagcgacuggcuaccuaugacugucgcugcuauggguguuccaccgcucccgcuauucauauuuucacuaaaagauacgcuaaaaagaagguccuggccuuuaaacgaagggguaauggcaguaggauuggucucaauucucgcuucuucgcuuuuacgaaaugauguaccgauggcaggucccuuaguagcaggaggucugcuaauagcguguuauguuauaacuggaaccucagcugaucuaacaguagagaaggcagcggauguaacaugggaagaggaagcagagcaaacaggaguaucccacaaccuaaugauaacaguggaugaugacggaacgaugcguauaaaggaugacgaaacggagaacauacucacaguucuacuaaaaacugcccucuugauuguuuccgguaucuuucccuauagcauaccagcaacacuguugguauggcacacuuggcaaaaacaaacccgccgaucagguguucuaugggaugugccguccccaccugaaacacaaaaggcugagcuugaagaaggaguauauagaauaaaacagcagggaauauucgggaaaacgcaaguaggaguaggcguacaaaaagaaggcguauuucacacuauguggcaugugacaagaggcgcaguacuaaccuauaacggaaaaagauuagagccuaauugggcaagcgucaagaaagaucuaauaagcuacgggggcgguuggaggcugagugcccaauggcaaaaaggugaggaagugcaagucauagcugucgagccggggaaaaacccgaagaacuuccagacuaugccugguacauuucaaacuacgacuggagaaaucggggcgauagcauuagauuuuaagccugguacgagugggaguccaauaauaaaccgagaaggcaaaguugugggguuauacggaaacggugugguaacuaagaauggcggauauguaaguggaauagcucaaacaaacgcagaacccgacgggccaacuccugaguuggaagaggaaauguuuaaaaagagaaauuugacuauaauggaucuccauccagguucaggaaaaacccggaaguaucucccugccauuguuagggaggcgauaaaacgacgguuaaggacauugauauuggcaccaacaagaguaguugcugcagaaauggaggaagccuuaaaagggcuuccgauucgauaucaaacaacagcaacaaaaucagaacauacagguagggaaauugucgacuugaugugucaugcgacuuucacaaugcgacuguuaucuccuguacgagugccgaauuauaaccucaucaucauggacgaagcacacuuuaccgacccugcuucuauagcagccaggggauauaucucuacgagagucggaaugggugaagcagccgcaauauucaugacugcgaccccgccgggaacagccgacgcauuuccccagagcaaugcaccaauucaagacgaagaacgagauauacccgaacggucuuggaacucgggaaaugaauggauaacagauuuugcuggaaagacuguuugguucguucccucaauuaaggccggcaacgacaucgcgaauugcuugcgaaagaacgguaagaaaguaauacaacugagcagaaaaaccuuugacacagaauaucagaaaacuaaacuaaacgacugggacuuugucguaacuacugauauaucugaaaugggugcuaacuuuaaggcagaucgaguuaucgauccuagaagaugccugaagccuguaauacugacagauggacccgaacgaguaauauuagcaggcccuaugccagucacggcugcuuccgcagcgcaaaggcgagggcguguggguagaaauccacaaaaagaaaaugaccaguacaucuucacgggacaaccguuaaauaacgacgaagaccaugcacacuggacugaagcuaaaaugcuacuagauaacauuaacacucccgaagggauaauccccgcauuauucgaaccagaaagggagaaaucagcugcuauagacggagaauauagguuaaaaggagaaucaaggaaaacuuuuguagaauuaaugagaagaggagaccuaccaguauggcuugcacacaaggucgcgagcgagggcauuaaguacacggaucgaaaauggugcuucgacggucaacgcaacaaucagaucuuagaagaaaacauggauguggaaaucuggacuaaagaaggcgagaagaagaaauuaagaccgagaugguuggaugcacgaacauauucagauccacucgcauuaaaagaauuuaaagauuucgccgcggggcguaagucaauagcauuagauuuaguuacagaaauaggccgaguaccaucucaucuagcacauagaaccagaaaugcuuuagauaaccuaguaaugcugcauaccucagagcauggagggaaagcguacagacacgcaguugaagaacuucccgaaaccauggaaacacucuuauuauugggccuuaugauauuacuaaccgggggagcaauguuauuucuaauaaguggcaaagguauagggaagacgagcaucggauuaaucuguguaauagcgucaagugguauguuauggauggcagaaauuccgcuacaauggauagccucugcaauaguauuagaauuuuucaugaugguucuucucauucccgaaccagagaaacaaaggaccccacaggacaaccaguuagcauacguaguuauagguauuuugacauuagcugcaauuauagcggcaaaugaaaugggucucuuggaaaccacuaagcgcgauuuaggaaugucgaaagaacccggaguaguuucccccacgucuuaucuagauguagauuuacacccagcaucggcauggacucuauaugccguugcgacuacagugaucacaccaaugcucagacauacgauagaaaacucuacagcaaacguuucuuuagcagcaaucgcgaaucaagcaguaguacuaaugggacuuaauaaaggauggccaauuucuaaaauggauuuaggaguaccacuacuugcauuagggugcuacucgcaagucaauccgcuaacacuuacugccgcuguguuacuuuuaauuacgcauuaugcaauaauaggaccagggcuucaagcuaaagcgacaagagaagcccagaaaagaacagcagcugguauaaugaagaauccaacagucgauggaauaaugacaauagauuuagauccaguuauuuaugacaguaaauuugagaaacaacucggucaggucauguuauuagugcuuugcgcaguucaauuauugcuaaugcggaccagcugggccuuaugcgaggccuuaacacuugcaacaggcccgauaacaacgcuuugggaagggucgccgggaaaguuuuggaacaccaccauagcagucagcauggcuaauauauuucguggauccuacuuagccggcgcgggacuugcuuuuaguauaaugaagucaguuggaacaggaaaacgcggaacuggaucacaaggggaaacucuuggagagaaauggaaaaagaaacucaaccaguugucacggaaggaguucgauuuguauaagaaauccggaaucacugagguugauaggacagaagcaaaagaaggacucaagcgaggagaaauuacucaucaugcuguaucacggggaucugcgaaacuucaaugguuuguggaaagaaauauggucauucccgaaggcagggucauagaucuaggaugcgggaggggcggauggaguuauuacugugcgggucuaaagaaaguuacagaaguccgagguuauacuaagggugggccagggcaugaggaaccuguaccaaugucgacguacggcuggaauauagugaaauuaaugagugggaaagauguguucuaccuaccaccagaaaaaugugacacacuacucugugauauaggcgaaucaaguccaucaccaacaguugaggaaucgagaacaauucgcgucuuaaaaaugguugaaccauggcugaaaaauaaccaauuuugcauaaaaguacuaaauccauauaugccgacaguuaucgaacaucuagaaagacuacaacgcaagcauggagguauguuggucagaaauccuuuaaguaggaacaguacccaugagauguauuggaucagcaacggaacuggcaauauuguagcuucagucaacauggugucaaggcuuuugcuuaaucguuuuacaaugacgcaccgacggcccacgauagaaaaggaugucgaucuaggagcagguacgcgccauguaaaugcagaaccggaaacuccuaacauggacguaauuggagaacguauuaaaagaauaaaggaagaacacaauucaacauggcacuacgacgaugagaacccuuauaaaaccugggcguaucauggaucguacgaaguaaaagcaacaggaagugcuaguuccaugauaaauggggucgucaaguuacuaacuaaaccaugggaugucguucccaugguuacccaaauggccaugaccgauaccacuccauuuggucaacaaagaguauuuaaggaaaaaguugauacuagaacgccaagaaguaugccuggaacacguagaguaaugggaauuacugcugaauggcuauggcgaacccuaggucggaacaagaagccucgacuuuguacaagagaagaguucacaaagaagguucgcacaaacgcagcgaugggagcgguguucacugaggagaaucaaugggauucugccaaagcugcuguagaagacgaagauuucuggaaacuuguugaucgcgaaagggaacuacauaaacuagggaaauguggaucauguguauauaauaugauggguaaaagagagaagaaacucggugaguucggaaaagcgaaggggagcagggcaauaugguauauguggcucggugcaagguauuuggaauuugaggcacucggguuucuuaaugaagaccauugguuuaguagagaaaacucauacucaggugucgagggagaaggacuccauaagcuaggauauauacugcgagauauuaguaagauaccaggaggggccauguaugcugacgauaccgcuggaugggauacucgaauaacugaagaugaucuacauaaugaagagaaaauaacacaacaaauggauccagaacaucggcaacuagcgaaugcaauuuuuaaacuaacauaucaaaacaaaguuguaaagguacaaagaccaaccccgacugguacaguaauggauauaaucucgaggaaggaucagcgcggaaguggucaaguugguacauacggacuuaauacguuuacaaacauggaggcacaauuaauucggcaaauggaaggugaggguguccuaacaaaagcugaccuagaaaauccgcaccuaucagagaagaaaaucacacaguggcuugagacuaaaggcguagaaagacuuaaacguauggcgauuaguggagaugauugcgucguaaagccaauagacgaucguuuugcuaaugcccugcuagcacucaacgauaugggaaagguucgaaaagacaugccacaauggcaaccuucgaagggauggcaugacuggcaacaaguccccuuuuguucucaucacuuccacgagcucauaaugaaagauggcagaaaacuuguaguucccuguagaccacaggaugaacuaaucggcagagcuaggaucucucaaggcgccggcuggucucugcgggaaacggcuugucuugggaaagcauaugcacaaauguggucacucauguauuuucaucgacgggacuuaagguuggcuucuaaugccauauguucagccguuccugugcacugggucccaacaucuagaacgacguggaguauccaugcacaucaccaauggaugacuacugaagacaugcucacgguguggaaccgaguuuggauugaagauaaucccuggauggaagacaaaacuccaguaacaacgugggaaaauguuccguaccucggaaaacgagaagaucaauggugcggcagccuuauaggauuaacaucaagagcaacaugggcccaaaacauuccaacggcuauucaacagguacgaagucuaauaggaaaugaagaguuccuagauuauaugccuucaaugaaaagguucagaaaagaggaagaaagugagggugcuauaugguaa

SEQ ID NO: 23309 - RNA, 9873 nt, Artificial Sequence
  derived and/or modified CDS sequence (opt6) from DENV-3__EU596493__SS-prME
acaucuuuaugcuuaaugaugauauuaccugccgcauuggcauuccaucuuacaucacgugauggugaaccccguaugauaguagggaaaaaugaacguggaaaaucguuacucuucaaaacagcuucugguauaaauaugugcacuuugauagcaauggauuuaggcgaaaugugugaugacacugugacuuauaaauguccucacauagcagaaguugaacccgaagauaucgauugcugguguaaucugacgaguacauggguuacguaugguacuugcaaucaagcaggagaacauagaagagauaaaagaucagucgcccuggcuccgcaugugggaaugggccuggacacgcguacgcaaacauggauguccgcugaaggagcuuggcggcagguugaaaaaguagaaaccugggcacuacgacauccugguuucaccauuuuagcgcuauuucuagcgcacuauauaggcacaucacuuacacaaaaaguugugauauuuguguuacugaugcuagucacuccuaguaugacuaugcgauguguaggagugggaaauagagacuuuguggagggcuuaagcggcgcaacuugggucgacgugguacucgaacauggaggaugugugacaacuauggccaaaaauaaacccacccuugacauagaacuccagaaaaccgaagccacacagcucgcgacauugagaaaauuauguauugaagguaaaaucacuaauauaaccacggacuccagauguccuacacagggagaagccguauuaccggaagaacaggaccaaaacuauguauguaaacauacuuauguugauagaggauggggaaauggcuguggucucuuugggaaaggaucauugguaacgugcgcaaaauuucaaugccuggaaccaauagaagguaaagugguucaauaugaaaauuuaaaauauacuguaauaauaacaguucauaccggcgaucaacaucaaguuggaaacgaaacucaaggggucacagcagaaauaaccccgcaagcgucaaccacagaagcaaucuuaccggaauacggaacguuaggccucgagugcuccccacgcacaggauuggauuucaaugaaaugauacuuuuaacuaugaaaaauaaggcuuggauggugcauagacaaugguucuuugauuuaccacuuccuuggaccucuggagcaacaacugaaacgccgacauggaaucguaaagagcugcuggugacuuuuaaaaacgcacaugcuaagaaacaggaagugguaguacuugguucucaagaaggugccaugcauacggcacuuacaggagcaacggaaauacaaaauucaggagggacaaguauauuugcaggacaccuaaaaugccgauuaaaaauggacaaacuugaacucaaaggaaugaguuaugcuaugugcacaaauaccuucguccuaaagaaagaaguuagugaaacccaacacgguacaaucuuaauuaaaguagaauauaaaggugaggacgcuccauguaaaauaccuuuuaguaccgaagacggccagggaaaagcucauaacgguagguuaauaacugcuaacccaguagugaccaagaaagaagaaccaguuaacauagaggcugaaccgccauucggggaaucaaauauaguaaucggaauaggcgacaaugcccuaaaaauaaauugguacaagaaaggaaguaguauuggaaaaauguucgaagcuacggccaggggagcacgcagaauggcaauucuaggugauacugccugggacuuuggauccguagggggaguacuaaauucuuugggaaaaauggugcaucaaauauucgguucugccuauacggcgcuuuuuaguggaguaucgugggugaugaaaauugguaucggagugcuccugacuuggauuggauuaaacaguaaaaacacgucuauguccuucagcuguauagcaauagguaucauaacacuauauuuaggagccguaguacaggcagauacaggauguguaaucaacuggaaagguaaagaacugaaaugcggaucugggauuuuugucacaaaugagguacacaccuggaccgaacaguauaaauuccaagcagacagcccaaagcgacuugcgacggccauagcuggugcaugggagaaugguguaugugggaucagaagcaccacacggauggaaaaucugcuguggaaacaaguugcaaaugagcugaacuacauacuaugggaaaauaacauaaaauuaaccgucgucgucggagauauuauugggguguuagagcaaggaaaacgaacauugaccccacaaccuauggaauuaaaauauagcuggaaaaccuggggaaaagcaaaaaucguaacggcagagacacaaaacagcucuuuuauuauagaugguccgaauacacccgaauguccuagugcaucgcgagcuuggaaugugugggaaguagaggauuacggcuuuggcguguuuacuacuaauaucugguugaaguuacgagaaguauacacacaauugugugaucacagacuaaugagugcggcuguaaaagacgaaagagcugugcaugcagacaugggcuauuggauugaaucacagaagaauggaucauggaaacuggaaaaagccucccugaucgaaguuaagaccugcacguggccaaagucacauacguuauggaguaacggaguccuagaaagugacaugauaaucccuaagaguuuagccgggcccauaagucaacacaauuaucgaccuggauaccacacacagacagccggaccauggcaucuuggaaaacucgaguuggauuucaauuauugugaagguacgacgguugucauaacagaaaacugcggaacuagagggccaaguuugaggaccacaaccguuagcgguaaauuaauucaugagugguguuguagaagcuguacauuaccaccgcuucgguauaugggugaagauggaugcugguacggcauggaaauacgaccuauuucggaaaaggaagaaaacaugguaaaaagccuaguuucggccggaucugggaaaguagacaauuucaccaugggcguacuaugccucgcaauauuauuugaagaaguuaugagaggaaaauucggaaagaaacauaugauagcugguguauucuuuacuuuuguucuccuccuaaguggucagaucacuuggagggacauggcccacacucuuauaaugauagguucgaaugccagcgauagaauggguaugggagugacauaucuagcuuuaauagcaacguuuaaaauucaaccuuuccuagcacuaggcuuuuucuuaagaaaauugacaagccgcgaaaauuugcuucuaggggucggucuagcaauggcuaccacccugcaauuacccgaagacauagagcaaauggcuaaugguaucgcauugggauugauggcccuuaaauugauaacacaguuugagacauaccaacucuggacugcucuaauuucacuaacguguucaaacacaaucuuuacccuuacaguggcauggcggacagcaacacuaauauuagcuggaguaagccuccucccgguaugucagucaucgucaaugcgcaaaagugacugguugccgaugacgguagcagccaugggagugccaccacuaccacuguucauauuuucacuaaaagacacuuuaaaaaggcggucuuggccuuuaaaugaaggaguaauggcugugggucuaguaucaauuuuagcgucaucccuuuugagaaaugacgucccgauggcgggaccuuuaguagcaggagggcuuuuaauagcuugcuauguuaucacuggaacgucagccgacuugacugucgaaaaagcagcugaugucacaugggaagaagaagcagaacaaacagguguaucgcauaaccuuaugauaacgguagacgaugaugggacgaugagaauaaaagaugacgaaacggaaaacaucuugacaguauuacuaaaaacugcuuuacucaucgucaguggcauuuucccuuauucuauaccagcaacgcuucucguuuggcauacauggcaaaaacaaacuagaaggagcgggguacucugggauguuccgucaccaccggaaacacaaaaagccgaauuggaagaggguguauacagaauuaaacagcaaggcauauuuggaaaaacccaggucggaguagggguacagaaagaaggugucuuccauacgauguggcauguuacgcgaggagcugucuuaacauacaacggaaagagauuagaacccaacugggcgagugucaagaaagauuugauuucguauggaggugguuggagacuuaaugcacaauggcaaaaaggagaggaaguucaaguaauagccguggagccgggcaaaaacccuaaaaauuuccaaacaaugccagggacauuucaaacuacuacaggggaaauaggcgcaauagcguuagauuuuaaaccgggcacgaguggaucaccuaucauuaauagagaagggaaaguagucggguuguacgguaauggcgugguaacgaaaaauggaggauaugugaguggaauagcgcaaaccaacgcugaaccugaugggccuacacccgaacuggaagaggaaauguucaagaaaaggaacuuaacaaucauggaucuacauccuggcuccgguaaaacaagaaaguauuugccugcuaucguacgagaggccauaaaaagaagauugcgaacauuaauacuagcacccacuagaguagucgcugcagaaauggaagaggcccuaaaaggccuaccaauacgcuaccaaacuacugcuaccaaaagugaacauacggggagagaaaucguagaucuaaugugccacgccaccuuuaccaugagauuacuuucaccaguccgcgugccaaauuauaauuuaauaauaauggacgaagcgcacuucacugaucccgccagcauagcagcccggggauacaucaguacaagggucggaaugggagaggccgcggcgauauucaugacagcaacgcccccagggacugcagaugcauuuccacaaucaaacgcaccaauucaagacgaagaaagggauauuccggaacgcucguggaacucagguaacgaauggaucacggauuuugcugguaaaacagucugguucguucccuccauuaaggcuggaaaugauauugcaaacugucuacguaagaacgggaaaaaggucauacaacuuuccagaaaaaccuuugauacggaauaucagaaaacaaaauuaaacgauugggacuuuguugucaccacagacauaucagaaaugggagcaaauuucaaggcggaccgaguaauugaucccaggagauguuugaagccuguuauacuuacggacggaccugaacguguuauacucgccgguccaaugccaguuaccgcugcuuccgcggcacaaagacguggucgagucgguaggaauccacagaaggaaaacgaucaguauauauuuacaggacaaccccuuaacaaugaugaagaccaugcacacuggacugaggcaaaaauguuacuagauaauaucaacacaccagaagguauaauuccagcauuauucgagccugaaagagagaaauccgcggcaauagauggggaauaucgauuaaaaggggaaucaaggaaaacguucguagagcucaugaggagaggugaucuucccguauggcuagcucauaaaguagcgagcgaggguauuaaauauacugauagaaaguggugcuuugauggacaacguaauaaucagauauuggaagaaaauauggacgucgaaaucuggacaaaagaaggagagaaaaagaaauugcgaccacgauggcuagacgcacggacuuacucagauccguuagcucuaaaagaauuuaaggauuuugcagcugggcgaaaauccauugcacuagacuuagucacugaaauaggccgcgucccaucucaccuggcgcaucgaacucguaacgcacuagauaaucuuguuaugcuacauacuucggaacacggugguaaagcguaccggcaugcuguagaagaacuaccagaaacaauggaaacucuacuucugcuaggauuaaugauacugcucacugguggcgcaaugcucuuucuaauaagcggaaaaggcauaggaaagacaaguaucggucuuauauguguaauugcgucuucugggauguuauggauggcagaaauuccacugcaauggauugcaucagcuauaguacuggaguucuuuaugauggucuuacuuauuccagaacccgaaaaacagagaacaccgcaggauaaccagcuagcuuauguaguaauuggaauuuuaacuuuggcugcaauaaucgcggccaaugaaaugggacuacuagaaacaacgaaacgagacuuaggaaugucuaaagaaccgggaguggucagcccuacuuccuaccuugauguggacuugcacccugccagugcguggacacuuuaugcgguggcuacaacaguaaucacaccuaugcuacgacacacaauugaaaacucaacagcuaacguuagucuggcagcgaucgcaaaccaagcaguaguucuaaugggacuagauaaagguuggccaauuuccaaaauggaucuaggaguacccuuauuagccuugggauguuauagccaaguaaauccacugacauugaccgcagccguuuuauuauuaaucacccauuaugcgaucauuggaccaggcuugcaagcaaaggcaacucgagaggcucaaaagagaacagccgcaggaauaaugaaaaauccaacugucgaugggauaaugacaauugaucuggauccaguaaucuacgauucuaaauuugaaaaacaacucggacaaguaaugcuacucgucuuaugcgcgguccaauuauuacuuaugagaacauccugggcauugugugaagcguuaacccuagcgacaggcccgauaacuacucuaugggaaggcagcccaggaaaguucuggaacaccacaauugcaguaucuauggcaaauauuuuucgcgggaguuacuuagccggagcaggucuagcauucagcauaaugaaaucuguagguacggggaaaagaggaacagguucacagggagaaacguuaggggaaaaauggaagaagaaacucaaccaacuuucuagaaaagaguuugaucuauauaagaaaagcggaauaacugaaguugauagaacagaagccaaagaagguuugaaaagaggagagauaacucaucacgccgucucgagggggucagccaaacuacaaugguuuguggaaagaaauaugguaauaccagaaggaagaguaaucgauuuaggauguggaagaggaggguggaguuacuauugugcgggacuuaagaaaguaacagaaguaaggggcuauaccaaagggggaccgggacaugaagaacccguuccaaugucuacuuacgguuggaacauagugaaauuaaugagcggaaaggauguuuucuaccuaccgccagaaaaaugcgauacccuucugugugacaucggagaaagcucuccuuccccuacagucgaagaaucuaggaccauccgcguucuaaagaugguagaaccauggcuuaagaacaaucaauucugcaucaagguauuaaaucccuauaugccgacagugauugaacauuuagagagacuucaaagaaaauauggaggaaugcuaguccgaaauccuuuaagccgaaacucaacgcacgaaauguauuggauuucuaauggaacgggaaauauaguagccagugugaacauggucucaagacugcuauuaaauagauucacaaugacacaccgucgaccuacgauagaaaaagacguugauuugggagcgggcacaagacauguaaaugcagaaccugaaacuccgaacauggauguuaucggagaacggauuaaaagaauaaaagaagaacauaacucuacauggcacuaugacgacgagaacccauauaaaaccugggcauaucauggcuccuaugaagugaaagcgacgggcagcgcaucaucuaugauuaauggggugguaaaauuauugacuaaaccaugggaugucguuccaauggugacucaaauggccaugacugauacaaccccguucggacagcagagagucuucaaggaaaaaguagauaccagaacuccaagaucaaugccaggcacaaggcggguaauggguauaacugccgaauggcuauggagaacauuaggaaggaauaagaaaccccgacuguguacacgcgaagaguucacgaaaaagguaagaacaaaugcugcaaugggagcgguguucaccgaagagaaccaaugggacagugccaaagcagcaguggaagaugaagacuucuggaaauuagucgaucgagaaagagaauuacauaaacugggcaaaugcggauccugcguauauaauaugaugggaaaaagagagaagaaacugggcgaguuugguaaagcaaaaggcuccagagcuauaugguacauguggcuaggagcuagguauuuggaguucgaagcgcucggcuucuuaaaugaagaucauugguuuagccgugagaauaguuacucggggguugaaggugaaggucuacacaaacuaggcuacauauugagagauauuucaaagaucccagggggagccauguaugcagaugauacggcugggugggauacccgcauaacagaagacgaucugcacaaugaggagaagauuacacagcaaauggacccggaacauaggcaauuggcgaacgcuauauuuaaauugaccuaccaaaauaaaguggugaaagugcaacgaccgacaccgacugguacaguaauggauauaauuucccgaaaagaucaaagaggaagcggacaaguaggaacuuauggacuaaacaccuucacuaacauggaagcccagcucauaaggcaaauggaaggagaaggcguccugacaaaggcagacuuagagaauccacauuuaagcgagaagaaaauaacccaaugguuggaaacgaaggguguagaaagacuaaaaaggauggcuauaucuggcgaugauuguguagucaaaccaauugacgauagauucgcaaacgcauugcuagcacucaacgauauggguaaaguaagaaaagauauaccacaguggcagccaucaaaaggcuggcaugauuggcagcaaguaccuuuuugcucacaucauuuccacgaacucauaaugaaagacgggagaaaguuagucguaccguguagaccacaagaugaacucauaggaagggccagaauuucgcaaggcgcagguuggucucugagggagacagccugucuaggaaaagcauaugcccaaauguggucguugauguacuuccauagaagagaccuacgccuagcuaguaaugcaauaugcagcgccguaccugugcauugggugccaacaucaaggacaacauggucuauacacgcucaccaucaauggaugacuacggaggauaugcuaacaguauggaauaggguauggauugaagauaaucccuggauggaagauaaaaccccagugacuaccugggaaaauguuccuuacuuaggaaaacgggaagaucaguggugugguucacucauaggguugacaucacgugccacaugggcccaaaacauaccaacggcaauacaacaggugagaucacuaaucggcaacgaagaguuccuagacuacaugccaucuaugaagcguuucaggaaagaagaagaaagugaaggcgcaauuugguaa

SEQ ID NO: 23310 - RNA, 9873 nt, Artificial Sequence
  derived and/or modified CDS sequence (opt6) from DENV-3__EU596494__SS-prME
accagcuuaugcuugaugaugauauuaccggcagcacuggcuuuccacuuaacaucccgagacggagaaccuagaaugauuguaggcaaaaaugaacgugguaaaucgcuuuuauuuaaaacggcaucagggauaaacauguguacucuuauagcaauggaucuaggagaaaugugcgaugauacuguuacauauaaaugcccucauauagcagaaguugaacccgaagacauagauuguuggugcaaucuuacauccacauggguaacauacggaacuuguaaccaagcaggagaacaucgaagagacaaacgaucuguugcacucgcaccccacguggguaugggacucgacacaaggacacaaacauggauguccgccgaaggagcuuggcggcaaguugaaaaaguggaaaccugggcguuaaggcauccaggauucacaauacucgcauuauuucuagcucacuauauagguacaaguuuaacacagaaaguagucaucuucguguugcuaaugcucguuaccccuucuaugacuaugagaugugucgguguggguaaucgugauuuuguggaaggccuaucaggggcgacuuggguagauguaguuuuagaacacgguggcugugugaccaccauggccaaaaacaaaccaacacuugacauagaacuacagaaaacugaagcuacucaacuugcuacauugagaaagcuaugcaucgaagggaagauaacaaauauaaccacagauucacggugcccuacucaaggagaagcgguacuaccagaagaacaggaccagaauuauguuuguaaacacacauauguagaccguggauggggaaauggguguggccuauucgggaaagggagcuuaguaacaugcgcuaaauuccaaugccuugaaccaaucgaaggaaagguggugcaauacgaaaacuuaaaauauaccguaauaauaacuguucacacaggugaucagcaucaaguaggaaaugaaacccaaggaguaacugcagaaauuacaccacaagcaucaaccacagaggcgauauugccugaauacggaacgcucggguuagaaugcaguccuaggacaggucuagacuucaacgaaaugauacuuuuaacaaugaaaaauaaggcuuggaugguucauaggcaaugguucuuugauuugccucuccccuggacaagcggagcuacuaccgaaacuccuacauggaacaggaaggaacuauugguaacuuucaaaaaugcacaugccaagaaacaggaaguaguagugcuaggaagucaagagggggcuaugcauacagcucuaacuggcucaacagaaauucaaaauucuggaggcacaucaauauucgcuggccaucucaagugcagacuaaaaauggacaaauuagaauuaaagggcauguccuaugcaauguguaccaacaccuuuguacuaaagaaagaaguuucagagacacaacauggcacaaucuugauaaagguggaauauaaaggggaagacgccccuuguaaaauaccuuuuagcaccgaagauggacaaggcaaggcccauaacgggaggcuaauuaccgcuaauccgguaguaacaaagaaagaagaaccuguaaauauagaggcagagccgccuuuuggugaguccaacauugucauugggauaggggauaaugcuuuaaagauaaacugguacaaaaagggaagcucaauuggcaaaauguucgaggcgacagcuagaggugcgaggcgaauggcuauacugggagacacagcgugggauuucggaagugucgguggaguacuaaauucacuugguaaaaugguucaucaaauauuuggaucagcguauacagcucuuuucagcggcguaucguggguaaugaaaauuggcauagguguguugcugacauggauuggacuaaauagcaaaaauacgaguaugagcuuuucauguauugcgauagguaucauaacauuauaccuaggagccgucguacaagcugauaccgguuguguuauuaauuggaaagguaaagaacuuaaaugcggaucuggaauauuuguaacaaaugagguacauacauggacggaacaguauaaauuucaagcugauucaccuaaaagacuugcaacagcgauagcuggcgcgugggaaaaugggguuugugguauuagaucgacgacgaggauggaaaauuugcuuuggaaacagguagccaaugaguuaaauuauauuuuaugggaaaauaacauaaaacucacaguaguugugggugauauaauagguguguuggaacaagguaaaaggaccuugaccccucagccaauggagcucaaguauaguuggaaaacuuggggaaaagcgaagauugucacggcagaaacacaaaacucgucuuuuauuauugauggaccaaacacgccagaguguccgucugccagcagagcauggaacguaugggaaguagaagauuacggauuugggguuuucacaacaaauauuugguugaaauugagagaaguauauacucaguuaugugaucauagguuaaugucugcggcuguuaaagaugaacgugcaguacacgcagauaugggauacuggauagagagccaaaagaacggcaguuggaagcuggaaaaggcgagccucauagaagugaagacaugcacauggccaaaaagucauacacuuuggagcaauggcguacuagagucagauaugauaauaccaaagaguuuagcugggccaauaucccaacauaauuauaggccagguuaucacacacaaacagcuggaccuuggcaccucggcaaacuagaguuagauuucaauuauugugaagguacaacaguaguuauuacagagaacuguggaacgagaggcccaucgcuacgaacaacuaccguuucggggaaacuuauucaugaauggugcugucggucguguacacuaccacccuuaagguauaugggugaagacggcugcugguaugguauggaaauaaggccuaucagcgagaaggaagagaacaugguuaaaucccugguguccgcuggaagugguaaaguggacaauuucacuaugggaguucuuuguuuagcaaucuuauuugaagaaguuaugagggguaaguucgguaaaaagcauaugaucgcugguguguucuuuacauuuguacuacuacuaaguggacaaaucacauggcgagacauggcgcacaccuuaaucaugauugguaguaaugcaucagaucgaaugggcaugggaguuacguauuuagcuuuaaucgcgacguuuaaaauacagccguuucucgccuuaggcuucuuucuaagaaagcuaaccaguagagaaaaucugcuacuaggcgucggacuugccauggcgacaaccuuacaauugccagaagauauugaacaaauggcaaaugguauugcauuaggguuaauggccuuaaagcuaauaacacaguuugaaaccuaccaauuauggacggcuuuaauuucacuaaccuguucaaacacaaucuucacucucacaguggcguggcguacggcuacacucauacuugcggggguaaguuuauuaccgguaugucaaucaucuuccaugagaaaaucugacuggcuaccgaugacgguagcagcaaugggugucccaccacucccauuauucauauuuucauuaaaagauacauugaaacgcagaucauggccccuuaaugaaggaguaauggcaguaggacucgucaguauuuuagcgucaucacuacuuagaaacgacgucccaauggcuggaccuuuagucgcaggaggauuguuaauugcauguuaugugaucacagguacaucggccgaccucacgguagaaaaagccgcugauguuacuugggaagaggaagccgaacaaacagggguaagucacaaucuuaugauaacaguggaugaugacggaacuaugagaaucaaagaugacgaaacagagaauauccucacgguccuuuuaaagaccgcuuuacugauaguaucaggaauauuuccuuauucaauuccugcuacacuauugguuuggcacacguggcaaaagcagacgaggaggagcggaguccugugggauguucccagcccgccggaaacccaaaaagcagaauuagaagaaggcguauaucgaauaaagcagcaaggaauuuuuggcaaaacacaaguagggguaggaguucaaaaggaaggcguuuuccauacaauguggcacguaacccguggugcaguuuuaaccuacaauggaaagcgacuagagccaaacugggcaucagucaagaaagauuuaauauccuaugguggaggguggcgucuaucagcacaguggcaaaagggugaagaaguccaaguaauugcaguugagccaggaaagaacccuaaaaauuuucagacgaugccuggaacauuccaaaccacaacgggagagauaggagcaauugcauuagauuuuaaaccugguaccagcgggagcccuauaauaaaccgcgaggguaaaguugucggacuauacgggaacggggucguuacgaaaaaugguggcuacgugaguggcaucgcacaaacaaacgcagagccagaugguccaacgcccgaauuagaggaagaaauguuuaagaaaagaaaccuaaccauuauggaccugcauccaggaagugguaagacaagaaaauaccuaccagcaauuguaagagaagcuauuaagcgacgauuaagaacacuaauucuugcuccgacaagaguaguggcugccgagauggaggaggcacuuaaaggauuaccaauacgauaccagacgacggcuacacgaucugaacacacggguagagaaauaguugacuugaugugucaugcaacauuuacaaugaggcuauuaucacccguaagaguacccaauuacaaucucauuauaauggaugaggcacauuuuaccgauccagcgucuauugcagcucgcgguuacauuaguacaagagugggaaugggagaagcggcugcuaucuucaugacagccacaccuccggguacagcugacgcguucccacaauccaaugccccuauacaagaugaagaaagagauauaccagaacgguccuggaacagcggaaaugaguggauuacagacuuugcgggaaaaacuguaugguuuguuccuagcaucaaggcgggaaacgacauagcaaacugcuuaaggaaaaaugguaagaaaguaauacaauugucaaggaaaacguuugacacagaauaccagaaaaccaaacucaacgacugggauuuuguugugacaacugauaucagcgaaaugggagcaaauuuuaaagcagaccggguaauugauccacgaagaugucugaagccagucauacuaacagauggacccgagcguguuauuuuggcuggcccuaugccggugacugcagcuucagcggcacaaaggagggggagagucggaaggaauccacaaaaagaaaacgaccaguacauuuuuacuggucagccauugaauaacgaugaggaucacgcucauuggacugaggcgaagauguuacuagauaacauaaauaccccugaaggcaucauuccagccuuguucgaaccagaaagggaaaaaucagccgcuauagacggggaauaucgguugaaaggagaaucacguaaaacauucgucgaacuuaugagaaggggcgaccugccgguuugguuggcccauaaaguugcuagugaaggaauaaaguacacagauagaaaguggugcuuugauggucaaaggaauaaucagauuuuggaggaaaacauggacgucgagauauggacgaaagagggagagaagaagaaauuaagaccacgaugguuagacgcacgaacuuauagcgauccucuugcauugaaagaauuuaaagauuucgcagcuggacggaaaaguaucgcucuugauuuaguaacugagauaggccgaguuccaucucauuuggcacauaggacacgaaaugcauuagauaaucucguaaugcuucacacuagcgaacacggcgguaaagcauauagacaugccgucgaggaauugccagagaccauggaaacacuccuguuauuaggcuugaugauucuucuaacugguggagcuauguuauuuuuaauuucuggaaaggguauagguaagacgucaauaggauugauauguguaauugcgucaucagguaugcuauggauggccgagaucccguugcaguggauugcaucagcuauaguccuggaguucuuuaugaugguauuacuaauaccagaaccugaaaaacaacguaccccacaagauaaccaauuagcauauguaguaauagguaucuuaacuuuagcugcaauaauugcagcgaacgaaaugggacuccuggaaacuacaaaaagagauuuggguaugaguaaggaaccgggugucguuucuccgacaaguuaucuugauguagaccuacacccggcaucagccuggacauuguaugcaguagcuacaacaguuauuacuccgauguuacggcacacaauagaaaacucaacugccaacgugucacuugcagcuauugcgaaccaggccguagugcuaauggggcuagauaaaggauggccgauaagcaaaauggacuuaggcguuccacuguuagcccucgguuguuacucacaagugaacccacuaaccuuaacagccgcuguacugcuccuaauaacccauuaugcuauuauagguccuggacuccaagcuaaagccacacgggaagcccagaaaagaacagcugcuggaaucaugaaaaauccuacaguagauggaauaaugacaaucgauuuggauccaguuauauacgauaguaaauucgagaaacagcucggacaaguaaugcugcuuguacuuugugcaguacaauuacugcugaugaggacaucgugggcacucugugaagcacuaacuuuagcaacuggucccaucaccacucuaugggaaggcagccccggcaaauuuuggaauacgacaauagccguaaguauggcuaauauuuucagagggagcuaccuagcaggcgcaggauuggccuuuaguauaaugaagaguguugguacaggaaagcgcggaacaggaagucaaggggaaaccuuaggugagaaguggaagaagaaauuaaaucaacucucucgaaaggaguucgacuuauacaagaaaucuggaauaacugaagucgauagaaccgaagcaaaagaaggguuaaagagaggugaaauaacacaccaugcaguaagucgagguagcgcaaaauuacaaugguuugucgaacgaaauauggucauaccagaagguagggugauugaucuagguugcggccguggaggauggucuuauuacugugcugguuugaaaaagguuacagaaguacgcggauauacaaagggaggcccuggacacgaagaaccgguacccaugaguacauauggauggaauaucguuaaauuaauguccggaaaagacguauucuaccuaccacccgaaaaaugugauacccuguugugugauauaggagaaagcucacccucuccaacuguagaagagaguagaacaaucagaguucuaaaaaugguagaaccuuggcucaaaaauaaccaguuuuguauaaaaguacuaaauccuuauaugccaacugucauagaacacuuggagcgcuugcaaagaaagcauggcgguauguuaguaagaaacccacucaguaggaacucuacucacgagauguacuggauuagcaaugguacagggaauauuguggcuuccguaaacauggugaguaggcuauugcuaaauagauucacuaugacacacagaagaccuacaauagaaaaggauguagauuuaggagcgggaacacgucacguuaaugcugaaccugaaacaccuaauauggacgucauuggagaaaggauaaaacgcauaaaagaggaacauaacucaacauggcauuacgacgaugagaacccauacaaaaccugggcauaucaugguucguacgaaguaaaagcuacggggagugcaaguucuaugauuaacggagucgugaaacuucuaacaaaaccuugggauguaguaccgaugguaacacaaauggcgaugacugauacuacaccuuuugggcagcaaaggguguuuaaagaaaaaguggacacccguaccccucguagcaugcccggcacacgaagagucauggggauaacugcagaauggcuguggagaacacuagguagaaacaaaaagccgagacuauguacacgcgaagaguucacuaagaaaguuagaacaaacgcggcgaugggagccguuuuuacagaggagaaccaaugggauagcgcaaaagcugcaguggaagacgaggacuucuggaaauuaguggauagagaaagagaauuacauaaauuagguaaaugcggaucaugugucuacaauaugauggguaagagagaaaagaaacuaggagaguuuggaaaagcaaagggaagucgggcuauaugguacaugugguugggggcuagauaccuagaauuugaagcauuaggauuucuaaaugaagaucauugguucucaagagaaaacaguuauagcggaguagaaggugagggauuacauaagcucggauacauacuaagggauauuuccaagauacccggcggugcuauguacgccgaugauacagcaggaugggauacaagaauaacggaagaugacuugcauaacgaagagaaaaucacgcagcaaauggacccagagcaccgucagcuugccaaugccauuuuuaaauugacauaccagaacaaaguaguuaaaguacagagaccaacuccaacaggcacuguaauggauauaauaagccggaaagaccaaagagggagcggacaaguggguaccuauggguuaaauacauuuacgaacauggaagcccaacugauaaggcaaauggaaggugaaggcguccuuacuaaagcggaccuggaaaacccccaucuaagugagaagaaaauaacgcaguggcuagaaacaaaaggcguagaacgauugaaacgaauggcaauuucaggugacgacugugucgugaaaccaauugaugaucgauucgcaaacgcauuauuagcacuaaaugacaugggcaaagucagaaaagacauuccacaauggcagcccucuaaaggauggcacgauuggcagcaaguuccguucugcagucaccacuuucacgaacugauaaugaaagacggacgaaaauuaguggucccauguagaccacaagaugagcugauugggagagcaaggauuagccaaggagcuggguggucacuucgagaaacagcaugucugggaaaagcauacgcacagauguggucguugauguauuuucauagaagagaccuucgacucgccagcaaugcaauuugcagcgccguacccguacacugggugccgaccaguagaacuacauggaguauucaugcacaucaccaguggaugacgacugaggauauguuaacaguauggaacagggucuggauagaggauaacccauggauggaagacaaaacuccugugacaacuugggagaacgugccauauuuagggaaacgagaagaucaguggugcgguucacucauuggacugacaagcagagccaccugggcacaaaacauaccaacggcgauacaacaaguacgaucguugaucggaaacgaagaguucuuagauuauaugcccagcaugaaaagauuuagaaaagaggaggaaagcgaaggcgcuauaugguga

SEQ ID NO: 23311 - RNA, 9873 nt, Artificial Sequence
  derived and/or modified CDS sequence (opt6) from DENV-3__EU687218__SS-prME
acuucgcuuugccucaugaugauuuuaccggcagccuuagcauuucauuuaaccucacgcgacggugaaccgcguaugaucguagggaaaaaugaaaggggaaagagcuugcucuuuaaaacugccagcggaaucaacauguguacuuuaauugcaauggaccugggagaaaugugcgacgauacagucacauauaaaugcccccacauaacagaaguugaaccggaagacaucgauugcuggugcaacuuaacaucuacguggguuaccuauggcacuuguaaucaagcaggagagcacagaagggauaaacguucuguagcacuagcaccacacguugguaugggauuagacacuaggacacagacauggaugucggcagaaggagcguggcgccaaguagaaaaaguugaaacaugggcacuccgacauccaggauuuacaauacuagcauuauuuuuagcgcauuauaucgguacaucauugacacaaaaaguaguaaucuuuauuuuacuaauguuaguuaccccgagcaugacuaugcgaugugugggaguaggaaauagagauuuugucgaaggauugagcggagcaacauggguugacguaguauuggaacacgguggauguguaacaacaauggcuaaaaauaaaccuacacucgacauagaauuacagaaaaccgaagcaacgcaauuagcaacacuacgaaaauuaugcauagaaggcaaaauaaccaacauaacuacugacucacgauguccaacgcaaggugaggcagucuuaccugaagaacaagaucagaauuauguuugcaaacacacuuauguagaucgaggcuggggaaacggauguggauuauuugggaaagguucacucguuacuugcgcuaaauuucaauguuuagaacccaucgaagguaaagugguucaauaugaaaauuuaaaauauacuguaauuaucacagugcauacaggagaucaacaucaagucggaaaugaaacucaagguguaacagcugaaauuacgccucaggccucuacaacagaagcgaucuuaccagaauacggaacucucgggcuagaaugcucaccgcgaacuggccuagacuuuaacgaaaugauucuguuaacaaugaagaacaaagcauggauggugcacagacaaugguucuuugaucuuccacuaccuuggacaaguggcgcuaccacagaaacaccuacauggaaucguaaggaguugcuuguaacauuuaaaaacgcccacgcaaagaaacaggaagucguaguacuuggaucacaagagggcgcuaugcacacagcacucacaggggcaacggaaauacaaaauucgggcggcacaaguauuuuugcaggccacuugaaaugucgauuaaaaauggauaaacuagaauugaaaggaaugagcuaugcgaugugcaccaacacauuuguacucaaaaaggaaguuucggagacacaacaugguacaauauugauuaaagucgaauacaagggugaagacguaccgugcaaaauaccauuuaguacagaagauggccagggaaaggcucauaacggacgauuaaucaccgcaaacccaguugugacaaagaaagaggagccuguuaauauugaagcugaaccacccuuuggugaaagcaacauaguuauuggaauuggagacaaugccuugaagauuaauugguauaagaaaggaaguucaauagguaagauguuugaagcaaccgcucgaggcgcacggagaauggcuauacugggagauacggcaugggacuucggaagugugggcgguguauuaaauucauuaggcaaaaugguacaucaaauauucgggucggcuuacacugccuuauuuaguggagugaguugggugaugaaaauugguauugggguauuacuaacguggauuggccuaaauuccaagaacacgaguauguccuucucguguauugccauagggauuauaaccuuauaucucggugcgguaguucaagcagacauggguugugugauuaauuggaaggguaaggaauuaaaguguggaucaggaauauucguaacaaacgaaguccauacauggaccgaaaaguauaaguuucaggccgauaguccgaaacgcuuggccacagcuauugcuggagcaugggaaaaugguguuugcggcauuagaucaacaacaaggauggaaaaccuauuauggaagcaaauugcuaaugagcuaaauuauauauugugggagaacaauauaaaacugacaguagucguuggugauauaauuggaguauuagaacaaggaaaacguacgcuaacaccacaaccaauggagcuuaaauauaguuggaagaccuggggaaaagcuaagaucguuacagcggaaacucaaaauucaucguuuauaauugauggaccuaacacacccgaauguccuucugccucaagagcauggaauguuugggaagucgaagacuauggguuugggguauuuacuacuaauauuuggcuuaaguuacgagaagucuauacacaauugugugaucaucgacuuaugucagcugcaguaaaagacgaacgugcugugcaugcagacaugggauacuggaucgagagucagaagaacggcagcuggaaacuugaaaaggcuucauugauagaagugaaaacguguaccuggccaaaaucucacacguugugguccaauggcguacuugaaucagauaugaucaucccuaaaucguuagcagguccaauuagccaacauaacuauaggccaggauaccauacccaaacagcaggaccguggcacuuaggcaagcuagagcuggacuuuaauuacugugaagguacuacgguugugaucacggaaaacugcgggaccagagguccgucucucagaacaaccacaguaucagguaaauugauacacgaauggugcugucguucuugcacacuuccaccuuuaagauacaugggugaagacggcuguugguauggaauggaaauacgaccuauuucugaaaaggaagaaaauaugguaaaaagucuaguaucugccggaagcgguaaaguagauaauuucacaaugggaguuuuaugucuagcuauacuuuucgaggaagugaugcgggguaaguuugguaagaaacacaugauugccgggguguucuucacuuuuguguuauuauuaagcggacaaauaacuuggcgagacauggcucauacauuaaucaugauugguucaaacgcaagugaucgcauggggaugggagucacauaccuagcgcuuaucgcaacguucaagauacagccauucuuagcguuaggcuucuuucuacgaaaauugaccagcagggaaaaucuuuuauugggaguaggucucgccauggcuaccacacuacaauuaccagaagacauugaacaaauggcaaacggaauagcacugggacucauggcauuaaaacuuauuacgcaauuugaaacauaccaauuguggacagcuuuaauuagcuuaaccugcaguaacacaauauucacgcucacagucgcauggcguacagcgacguugauccuugccgguguaaguuuacugcccgugugucaaucuaguagcaugcguaaaacagauuggcucccgaugacgguugcugcaaugggaguacccccgcuaccucuuuucauauuuucgcugaaagacaccuuaaaacgucggagcuggccgcuuaaugagggggucauggcuguuggucuugugucuauccuagcgaguucacuucuccgcaaugauguuccuauggccggcccucuugucgccgguggacuccugauagccugcuauguuauaacuggaacuucggccgacuuaacuguagaaaaggcagcagacguaacaugggaagaagaagcagaacaaacgggcguaucucauaauuuaaugauuacuguagaugaugauggcacaaugagaauaaaagaugacgagacagagaacauauuaaccguauuacuaaaaacagcucuacuaauaguguccggaauuuuuccguauucaauaccugcuacuuugcugguauggcacacuuggcaaaagcaaacacaacgcagcggugugcugugggacguaccaucgccuccggaaacccaaaaagcagaauuagaggaaggcguuuauagaauuaaacaacagggaauauuuggaaaaacucaaguagguguggggguacagaaggaaggaguauuucauacaauguggcacguaacaagaggagcaguauuaaccuauaaugguaaaagacuugagccaaacugggcgucagucaagaaagaccuaauaucauauggcggcgguuggagguuguccgcucaauggcaaaaaggcgaagaaguacaagucauagccguggagccaggcaaaaaucccaaaaacuuucaaacuaugccaggaacauuucaaacaacuacaggcgaaauuggagcaauagcccuagauuucaagccugggacuagcggaagccccauuaucaaccgagaaggcaaagucguaggauuguacggcaacggaguugucacuaagaacggcggcuacguuuccgguauagcgcaaacgaacgcagaaccugacgguccuacucccgaauuggaagaggaaauguuuaaaaagagaaaucuaacaauaauggauuuacauccuggaucaggcaaaacacggaaauacuuaccagccauagugagagaagcuaucaaaagacgacuacggacacuaauauuagcaccgacucguguaguggcugcugaaauggaggaagcucugaaaggacuaccuaucagguaucagaccaccgcuacgaagucagaacacacaggucgagaaauuguagacuuaaugugucacgcuacuuuuacgaugcggcuuuuaagcccagucagagucccuaauuauaaucucauaauaauggaugaagcacauuuuacggacccagcaucaauugcagcaagggguuauauuagcacaagaguggguaugggagaagcugcggcuauuuucaugacggcuacuccuccagggacugcagaugcuuucccccaaagcaacgcccccauccaggacgaagaacgagacauaccagaaagaucauggaacucggggaacgaauggauuaccgauuuugcagguaaaaccgugugguucgugcccucuauuaaggcaggaaaugacauugcuaacugucuuaggaaaaauggcaagaaaguuauucagcuaaguaggaaaacguuugacacggaauaucagaaaacuaagcuaaacgacugggauuuuguaguaacgacugauauuucagaaaugggugcuaauuuuaaagccgacagaguaaucgauccacggagauguuuaaaaccugucauacuaacggaugguccugaacguguaauacuagcgggaccaaugccuguaacggcagcaucugccgcucaaagaagggggaggguuggacguaacccacagaaagaaaacgaucaauauaucuuuacaggucaaccuuugaacaacgacgaagaucaugcucauuggacagaagcuaagaugcuauuggauaauauaaauacgccugaagguauuauaccagcuuuauuugaacccgaacgagaaaaauccgcagccauagauggggaauauagacuaaaaggcgaaucuagaaaaaccuuuguggaacugaugagacgcggcgacuugccaguauggcucgcucauaaaguagcaucagaggggauaaaguauacagauagaaaaugguguuuugauggacaacgaaauaaucaaauacuugaagaaaauauggauguugagauauggacaaaagaaggugagaagaagaaacuaagaccgcgauggcucgacgcuaggacuuacucagauccucuagcguugaaagaguuuaaggacuuugccgcuggcagaaaaagcauugcacuagacuuaguuacggaaaucggucgaguuccaucacaccuagcccaucgcacuaggaacgcucuagauaaucuuguaaugcugcauaccagugaacacggagggaaagcauacagacacgcuguugaagaacucccagagacuauggaaacuuuauugcuuuugggucugaugauauuacuuacaggcggagccaugcuuuuccuaauaagcggaaaaggaauaggaaaaacaucgauuggacuuaucuguguuauagcuucgucaggcaugcuauggauggcagagauaccucuccaauggauagccagugcuauaguccuggaguucuuuaugaugguauuauugauuccggaaccggaaaagcaacgaacuccacaagacaaucaauuagcauauguaguuauaggcauacuuacacuugcagcaauaauagccgcuaacgaaauggggcuacuagaaacuacaaagcgagauuugggcaugaguaaagagccgggcguggucucaccuacaucguacuuagacguggacuuacauccagcuucagcguggacuuuauaugccguugccacaacaguaauaaccccaaugcuaagacauacaaucgaaaauaguacagcaaauguaucuuuggccgcaauugcaaaucaggcgguugugcuaauggggcucgacaaaggauggcccauaucuaaaauggaccugggaguaccuuuguuagcauuagguugcuauagccaaguaaacccacugacucuuacggcugcggucuugcuauuaauaacacauuaugcuauaauagguccgggauugcaggcuaaagcgacccgcgaggcacagaagagaacagcggcagguauaaugaagaauccgacaguagauggcauuaugacaauagauuuggacccugugauauaugacuccaaauuugaaaaacaacuaggccaagugaugcugcuagugcuaugugcaguacaauuacucuugaugaggaccaguugggccuuaugugaagcgcucacccuagcuacgggaccaauuacuaccuuaugggagggaaguccgggaaaauuuuggaacacaacgauugccguauccauggcaaacauauuucgggguucauauuuagcaggagccggacuugcauucucaauaaugaaaagcguaggcacaggcaaaagagguacagggucgcaaggcgaaacgcugggagaaaaguggaagaagaaauuaaaucaacugagucgcaaagaauuugacuuauacaagaaaagcggaauuacugagguugaccgaaccgaagccaaagaaggacuaaagaggggagaaauaacacaucacgcgguuagucgagguagugccaaguugcaaugguuuguagaaagaaauaugguuauucccgaggggagagucauagaccuuggcuguggccgagguggaugguccuauuacugugcuggauugaagaaaguaacggaaguaagaggauauaccaaaggaggucccggacacgaggaaccuguuccuaugucuacauacgguuggaauauaguaaaauugaugucaggaaaagacguguuuuaucugccaccugaaaagugugacacuuuauugugugauauaggcgaauccaguccuucuccgaccguagaagaaucacgaacaauaagaguucuaaagaugguugaaccguggcuuaaaaauaaccaauuuuguauuaaaguguuaaacccuuacaugccuacggugaucgaacaucuugaaagauuacaacgcaaacaugggggaaugcuaguaagaaacccccuaaguagaaauucuacucaugaaauguauuggaucucgaacggaacagguaauauagucgccaguguuaacaugguuagcaggcucuugcugaacagauuuacaaugacacacaggcgucccacgauugaaaaagauguagauuuaggggcagguacuagacacguaaacgcugaaccagaaacuccaaauauggauguuauaggggaaagaauaaagagaauuaaagaagaacacaacaguacauggcacuacgacgaugaaaacccauauaagacgugggcguaccacgguaguuacgaaguuaaggcaacagggagugcuagcagcaugauaaauggcguaguaaaacuccuaacgaaaccgugggacgucguucccauggugacucaaauggcuaugacggauacaaccccguucggacagcaacguguauuuaaagaaaaaguagacacccgcacaccacguagcaugccugguaccagaaggguaaugggaauaacugcugagugguuauggcgaacguuaggaagaaauaagaaaccacgauuauguaccagagaagaauuuacuaagaaaguuaggacuaaugcggcaaugggcgcaguauuuacugaagagaaucaaugggauucugcaaaggcggcaguagaggaugaagauuucuggaaauuaguugaucgagagcgagaguuacauaaacuaggaaaauguggaucuuguguuuauaauaugauggggaaacgggagaagaaacuaggugaguucgggaaagccaaagguucacgugcaauuugguauauguggcuaggugcaagauauuuagaauuugaagcacuuggguuccuuaaugaagaucacugguuuagcagagaaaauaguuauuccgggguugaaggcgaaggucuccauaaauugggauacauacucagagauauaaguaaaauaccuggaggagcuauguaugcugaugacacggcugguugggauacacguaucacagaagaugauuuacauaaugaagagaaaaucacacagcaaauggauccagaacauagacaacuagcgaaugcaauuuuuaaauuaacauaucagaauaaaguagucaaaguucagagaccaacuccaacagguacuguaauggauauaaucucaagaaaagaccagagaggaucaggacaaguuggaacauauggacugaauaccuuuacgaauauggaagcacagcuaauuagacaaauggaaggugaagguguguuaucaaaagccgauuuagaaaacccacauuuacccgagaagaaaaucacacagugguuagagaccaaaggcgucgaacgacugaaaaggauggcaaucaguggcgaugacugcgucgucaaaccgauagacgauagauuugcuaaugcccuacuugcauuaaacgauauggguaaagugagaaaggacauaccgcaauggcagcccucaaaaggcuggcaugauuggcaacaaguuccguucuguucacaucacuuccaugaguugauaaugaaagacggucgaaaacucguaguuccuuguagaccucaagaugaauugauuggacgugcaagaaucagccagggugccggauggagucuucgagaaaccgcguguuuagguaaagcauacgcgcagauguggagccugauguauuuccaucguagggauuugagacuugcaaguaacgcaauauguucugcagugcccguacauuggguuccaaccucgagaacaaccuggucaauacacgcucaccaccaauggaugacaaccgaagauauguuaacgguuuggaaucguguuuggauugaagauaauccguggauggaggacaaaacgccaguuacuacaugggaaaacguaccuuauuuagguaaaagagaagaucaaugguguggcagucucauaggacugaccucgcgugcaacgugggcgcaaaacauacccacugcgauacaacaaguacguucauugaucgguaaugaagaauuucucgacuacaugccaucaaugaagagauuuagaaaagaagaggagucugaaggagcaauaugguaa

SEQ ID NO: 23312 - RNA, 9873 nt, Artificial Sequence
  derived and/or modified CDS sequence (opt6) from DENV-3__EU726772__SS-prME
acaucuuuaugcuuaaugaugauauugccugcagcacuggcauuucauuuaacaucgcgagauggagaaccucgaaugauaguagguaaaaaugaaagagguaaaagucuacuuuuuaaaacggcuucuggaaucaauaugugcacauuaauagcaauggaccuaggggaaaugugugacgauacggugacuuauaaaugcccucacauuacggaaguggaaccugaagacauagauuguuggugcaaucuaacaucaacauggguuaccuacggaacauguaaucaagcuggagaacauaggagagacaaaagaagcguagcucuagcgccgcacgugggaaugggacuggauacacguacgcaaacuuggaugagcgcagaaggugcuuggcggcaaguagaaaaaguagaaacgugggcacuaaggcauccgggauuuaccauucuggcgcuauuucuugcacacuauaucggaacuagcuuaacucaaaaaguuguaaucuuuauauuguugauguuaguaacacccucaaugacgaugcgcugcguaggaguaggaaacagggacuuuguagaaggacuaucaggagcaacauggguugauguaguccuagaacauggggguugcguaaccacuauggccaaaaauaaaccgacacuugacauagaauuacagaaaacagaagcgacucaacuagcaacccuccgaaaacuauguauagaagguaaaauaacuaacauuacuaccgauuccagguguccgacgcaaggcgaagcaguacucccagaagaacaagaucaaaacuauguauguaaacauaccuauguagaccguggaugggguaacggguguggacuguuuggaaaaggcagccuagucacaugugcaaaauuucaauguuuggaaccuauagaagggaaagucgugcaauaugagaacuuaaaauauacaguaauuauaacuguacacacuggagaucagcaucaaguuggcaaugaaacacaaggaguuacggcagaaaucaccccacaagcaaguacgaccgaggcuauuuugccagaguacggaacucucggauuagaauguaguccgcggacaggcuuagacuuuaaugaaaugauucuguuaacuaugaaaaacaaagcauggauggugcacagacaaugguuuuucgauuuaccccuaccuuggacaucuggugcgacuacggaaacgccgacuuggaaucguaaagaacuauuaguuaccuuuaaaaaugcucaugcaaagaaacaggaagucguaguacugggcucacaggaaggagccaugcacacugcauuaaccggugcaacugagauucaaaauagcggaggcacaaguauauuugcuggacauuuaaaauguagauugaaaauggacaaacuagaacucaaaggaaugucauaugcgaugugcacgaacacuuuuguuuuaaagaaagaggucucagaaacgcagcauggcacaauuuuaauaaaaguagaauauaaaggugaagacgugcccuguaagauaccuuucucaaccgaagauggucagggaaaagcucauaacgguagacuaauuacugcuaauccagucguaacuaagaaagaagaacccguuaauauagaggccgaaccgccauuuggcgaaucgaacauuguaauaggaaucggggauaacgcccucaaaauuaacugguauaagaaaggaucuucgauugggaaaauguuugaagccaccgcgcgaggagcacguagaauggcuauacugggggacacugcgugggacuuugguucaguaggggguguacuuaauagucuuggaaagaugguacaccaaauuuucgguucggcuuacacggcacuuuucagcgggguaucaugggucaugaaaauaggcauaggaguucuguugacauggauagguuuaaacuccaaaaauacuagcaugucauucaguugcauagcuauaggcauaauaacccuuuaucuaggugcaguagugcaagcagauauggguugcguuauuaauuggaaggggaaagaacucaaaugugggaguggaaucuucguaacaaaugaaguccauacguggacugagcaauacaaauuucaagcggauaguccuaaaagacuugcuacggcaauagccggugccugggagaauggaguuugugguauaagaucuacuacaagaauggaaaauuuauuguggaaacaaauagcaaacgaacuaaauuauauucuaugggaaaauaacauuaaacuuacgguugucguaggugacauaauugguguauuagaacaagguaagcggacuuuaaccccacaaccaauggaacugaaauacuccuggaaaaccuggggaaaggccaaaauagugacagcagagacccaaaacuccucguucauaauugauggcccuaacacgccugaaugcccuucugccagcagagcauggaauguaugggagguagaggauuauggcuucggcguguucacgacaaauauauggcuuaaacuucgcgagguauauacacaacuuugcgaccaccguuuaaugagcgcagcaguuaaagaugaaagggcaguccaugcggacaugggguauuggauagagagccaaaagaauggaucguggaaguuggaaaaagcgaguuugauagaaguaaagaccuguacauggcccaaaucgcauaccuuauggucgaauggcguccucgaaucagacaugaucauacccaaaaguuuagcuggaccaauaucacagcauaauuauagacccggguaccacacacaaaccgccggcccauggcaccucggcaaacuugaauuagauuucaauuauugcgaaggcacaacugugguaauaacugaaaauugugguacaagaggcccauccuuacguacuacaaccgucagugguaaauuaauacaugaauggugcuguaggucuugcacuuugccaccccuaagauacaugggagaagacggguguugguaugggauggaaauacgacccauuagugagaaagaggaaaauaugguuaaaucccuugugagcgcgggaaguggcaaagucgacaauuuuacaaugggaguccucugcuuagcaauauuguucgaggaaguuaugcgagguaaauucgggaagaaacauaugaucgcgggagucuucuuuacguucguauuguuacugagugggcaaauaacuuggagagauauggcacauacacugaucaugauuggcucaaaugcaucagauagaaugggaaugggagucacauaccuagcauuaaucgcuacguuuaaaauucaaccuuuucucgcguugggauucuuuuugagaaagcucaccaguagagagaaucuccuucuugguguaggucuagcaauggccaccacucuacaguugccggaagacauagaacaaauggcaaaugguauagcucuaggacucauggcauuaaagcugauuacacaauuugagacauaucaauuauggacagcacuaaucaguuugacauguagcaauaccaucuucaccuugacuguugccuggaggacggcaacuuuaauauuggccgguguaaguuuacuaccaguuugccagucuucuucuaugcggaaaacagacugguuaccuaugacuguugccgcaauggguguaccaccuuuaccuuuauuuauauucucguuaaaagauacgcuaaagcguagaucauggccauuaaaugaagguguaauggcuguaggguuagugucuauccuggcgucuucgcuauuaaggaacgauguacccauggcaggaccauuaguagccggaggccuguuaaucgcauguuauguuauaacagggacaucggcugauuuaaccgucgaaaaggccgccgauguuacaugggaagaagaggcugagcaaacagggguaucgcauaaccucaugauuacuguggaugacgauggcaccaugcggauaaaagaugaugaaaccgagaauauauuaacaguauuacuaaaaacugcucuacugauagugaguggcauuuuuccuuauucuauacccgcaacgcugcuuguuuggcauacuuggcagaaacagacacagcggagcgggguccucugggacgugccuuccccaccggaaacucaaaaggcagaauuggaagaaggaguuuacagaauaaagcaacagggaauauucggaaaaacacaagugggagucggagugcaaaaagagggagucuuccauacuauguggcauguuacgcguggcgcagucuuaacuuauaaugguaaaagguuggaaccuaacugggccagugucaagaaagacuuaauaaguuauggggguggauggcgacuuuccgcacaauggcaaaaaggagaagaaguccaaguuaucgcagucgaaccgggcaaaaauccuaagaacuuccagacuaugccuggaacauuucaaacaaccacaggggaaauuggagcaauugcccuggauuuuaagccuggaaccucagguucuccaauaauuaacagggaagguaaagucguugguuuauauggaaacggggugguaacgaagaauggaggcuauguuucagggauagcacaaaccaaugcagagcccgacggaccuacaccagaauuggaagaggagauguucaagaaacguaacuugacaaucauggacuuacaucccggcagcgguaaaacaagaaaauauuugcccgcaauuguacgugaagcgaucaaacgaagacuuagaacgcuuauccuagcacccacaaggguuguugccgcagaaauggaagaggcuuuaaaaggacugccaauuagguaccaaacuacugcaacuaaauccgagcauacuggacgugaaauagucgaucuuaugugccaugcaaccuucacgaugcgacugcuaucucccguaagagucccaaacuauaaucucaucauaauggacgaggcacauuuuacagauccagcuagcauagccgcacgagguuauauaucuacaagaguuggaaugggagaggcagcggcaauuuucaugacagcaaccccaccaggaacugcugaugcauuuccacaaagcaaugcgccgauccaagacgaggaacgagauauuccagagcgaucauggaacucaggcaaugaauggauaacagauuuugcugguaagacaguaugguuuguaccaucaauaaaagcagguaacgauauugcaaauuguuugcguaaaaaugggaagaaaguaauacaacuuucccgcaaaacuuucgauaccgaauaucagaaaacgaaacuaaacgauugggacuucgucguaacaacugacauuucggaaaugggugcaaacuuuaaagccgaucgaguuauagauccaaggagauguuugaaaccaguuauauugacagacggaccugagagggugauauuagcaggacccaugccugucacugcggcuucugcugcgcagagaaggggaagaguaggaagaaacccacagaaggaaaacgaucaguacauuuuuacgggacagccauuaaacaaugaugaggaccaugcucauuggacagaggcaaaaauguugcuugacaauauuaacacaccggaaggcauaauucccgcacuuuucgaaccugaacgagaaaaaucugcagcaauagauggggaguaucgacuuaaaggggaaucacggaaaaccuuuguagaacuaaugcgucguggcgauuuaccgguuuggcuagcgcauaaaguggcgucagagggcauaaaauauacggaucgaaaaugguguuuugauggacaaagaaacaaccagauucuugaggagaacauggauguugaaauauggaccaaagaaggagagaagaagaaacugagaccacgauggcuugacgcaagaacguacuccgauccauuggcacucaaagaauuuaaagauuucgccgccggucgaaaaucaauagcuuuagaucuaguaaccgagauaggaagagucccuucgcaucuagcccauagaacuagaaaugcuuuggacaaccuagugaugcuccauacaagugaacauggugguaaagcauacagacaugcaguggaagaacuacccgaaacaauggagacuuuguugcuauuagggcuaaugauacuccuaacagguggugcaaugcuguuucuaauaucagguaaagggauaggaaagacgaguauaggccuaauaugcgugauugcuuccagcgguauguuguggauggcagagauuccacuccaauggaucgcaagugccauagucuuagaguucuucaugauggugcuccuuauuccugaaccugaaaaacaaaggacaccucaagacaaccaguuagcauauguagugaucggcauucuuacccuagcagcaauaauugcugcuaacgaaaugggacucuuagaaacaaccaaaagagaucucggcaugaguaaggagccgggugugguaaguccaacaucauaccuagacguagaucuacauccagcauccgcguggacgcuauaugccguugcaacaacagucauaacaccuauguuacgccauacgauugaaaauucaacugcaaauguuucccuagcagcuauagccaaucaagcgguugucuuaaugggacuagacaaaggauggccaaucaguaaaauggaucucggugucccguuguuagcucuugguuguuacagucaaguuaacccgcuuacauugacugcugcagucuuacucuuaauaacgcacuaugcaaucauagguccaggucuccaggccaaggccacaagagaagcacaaaaacggacagcggcuggcaucaugaaaaacccaacaguagauggaaucaugaccauagaucuagauccgguaauauaugacucuaaauuugaaaaacagcucggacagguaauguuguuaguccuuugugcuguucaguuauugcuuaugcggacgagcugggcacuuugugaggccuugacucuagcgacagguccgauaaccacuuuaugggaaggaucaccaggcaaauucuggaauacaaccauagcuguauccauggcaaacauuuuuagagggagcuaccucgccggugcaggacuagcguuuucaauaaugaaaucaguaggaacgggcaaaagggguacaggaucgcaaggggaaacacuaggagaaaaauggaagaagaaauuaaaucaauugucacggaaagaguucgaucuauauaagaaaucgggaaucacggaaguggacaggacugaagccaaagaaggacugaaacguggugaaauaacacaucaugcugugucccguggcucagcaaaauuacaaugguucguagaaaggaauaugguaauaccagaaggcagaguaauagauuuagggugugguaggggcggguggagcuauuacugugcagggcuaaagaaaguaacugaaguucgaggguacacaaaagguggacccggacacgaagaaccgguaccaaugucaaccuacggcuggaacaucguaaaacuuaugucagguaaagauguauucuauuuaccgccagaaaaaugcgauacgcuauugugugacauaggugaaucgagucccucacccacaguagaagaaucacguaccauacggguucugaaaauggucgaaccauggcucaaaaacaaccaguuuuguauaaaagugcugaauccauacaugccgacaguuauugaacacuuagaaagauugcaaagaaaacacggaggaauguuaguucgaaacccacugaguagaaauaguacucaugaaauguacuggauaucgaacgggacagggaauaucguagcuagugugaacaugguaucaagauuacuauugaacagauuuacgaugacgcacagaaggccuacuauagaaaaagauguggacuuaggagcaggaacaagacauguuaaugcugaaccugaaacgccuaauauggauguaauuggagaacggauaaaaagaauaaaagaggaacauaauaguacauggcacuacgaugaugaaaacccauacaaaacaugggcauaucauggaucauacgaaguuaaagccacgggguccgcaucaucaaugauaaacgggguaguuaaauuacugacaaaaccgugggauguaguaccaaugguaacacaaauggcaaugacggauacaacgcccuuuggccaacaaaggguuuucaaagaaaaaguagacacaagaacuccgcgguccaugccgggaacuagacgaguaaugggaauaacagcagaguggcuuuggagaacacuggguaggaacaagaaaccaagacuuuguacaagggaggaguuuacaaagaaaguucgcacaaacgcugcgaugggagcuguauuuacugaagaaaaucagugggauagcgccaaagcggcgguagaggaugaagauuuuuggaaauuagucgauagggaaagggaacuucauaaacuggggaagugugguagcuguguguauaacaugaugggaaagagagagaagaaacuuggagaauuuggcaaagccaaaggcuccagggccauuugguauaugugguuaggugcuagauacuuagaguuugaagcauuaggcuuccugaaugaagaucacugguucucucgugaaaacaguuauucaggcgucgaaggcgagggauugcacaaauuaggauauauacuaagagauaucucuaagauaccaggaggagcaauguaugcagacgauaccgccggaugggauaccaggauaacagaagaugaucuacacaaugaagagaaaauaacacaacagauggacccugaacaucggcaacuagcgaaugcaauuuuuaagcuaaccuaucaaaauaaaguaguuaaagugcaaagaccaacaccuaccgggacggucauggauauuauaucacguaaggaucaaagaggaaguggacaaguuggaaccuauggauuaaauacguuuaccaacauggaagcccagcuuauacggcaaauggaaggugaaggggugcuaucaaaggcggaccuagagaauccacaccuaccagagaagaaaauuacacaauggcuagagacaaaaggcguugaacgucugaaaaggauggcaauaaguggagaugauugcguuguaaagccaauugacgacagauuugcuaaugccuuauuagcuuuaaaugacauggguaaaggucggaaagacaucccacaauggcaacccucgaaaggauggcacgauuggcaacaggucccauuuuguucucaucauuuucaugaacucauaaugaaagauggaagaaagcucguugugccauguagaccgcaagacgaacuaauagggagagccagaauaucacagggcgcagguuggucacugcgugagaccgcaugccuagggaaggcuuacgcucagauguggucacucauguauuuucaccgaagagaucuuagauuggcaaguaaugccaucugcucugcaguacccguccauuggguacccaccucgaggacaacguggucgauacaugcacaccaucaauggaugacgacagaggauaugcugacgguguggaauagagucuggauugaagauaacccuuggauggaagauaaaacccccguaacaaccugggaaaauguaccauauuuaggaaaacgugaagaucaaugguguggcucauugauagguuuaacaucucgcgcuacgugggcacagaauauaccgaccgcgauacaacaaguccgaucuuuaauagguaaugaagaauuucuggacuacaugccaucuaugaaacgcuuccgcaaagaagaagaaucugagggcgccauuugguag

SEQ ID NO: 23313 - RNA, 9873 nt, Artificial Sequence
  derived and/or modified CDS sequence (opt6) from DENV-3__FJ182013__SS-prME
accaguuugugcuuaaugaugauuuuaccggcggcauuagcauuucaccuaacuucccgggacggagaaccccggaugauaguaggcaaaaaugaacgcggaaaaagucucuuauucaaaacagcuagcgguaucaauaugugcacguuaauugccauggauuuaggugaaaugugugacgauacugugacauacaaaugcccccauauuacagaaguggaaccagaagauauagacugcuggugcaauuuaacgucuacauggguaaccuacgguacauguaaccaagcaggagaacacaggagggauaaaagaucaguagcacuagcuccucauguugguauggggcuugauacccgcacacaaacuuggauguccgcagagggagccuggcgccaaguagagaaaguugaaaccugggccuuacgacauccugguuuuacaauauuagcuuuguuucuugcccacuauguaggaacaucacugacacaaaaagucguaaucuucauacuauuaaugcuagugacaccgucaaugacgaugcguuguguugguguaggaaaucgagacuucguagagggacucagcggcgcuacuugggucgacgugguucuagaacacgguggcugcguuacaacgauggccaaaaacaaaccaacuuuagacauugaacuccagaaaacagaagcgacacaacuagcaacacugagaaaauuaugcauagaaggcaaaauuacgaauaucacaacagauucuagauguccuacacaaggagaagcuguguuaccugaggaacaagaucaaaauuacguuugcaaacauacuuacguugacagagguuggggcaauggcugcggucuauuugguaaagguucauuaguaacaugugcaaaauuccaaugucuagaaccgauagaaggcaaagucguacaauaugaaaaucuaaaauacacgguaauaauaaccguccacacuggcgaccaacaccaaguuggaaaugagacacaagguguaacagcugaaaucaccccacaagcgucaaccacagaggcaauacuaccugaauacggaacacuugggcuugagugcucgccucguaccggucuagauuuuaaugaaaugauauugcucaccaugaaaaacaaagcguggauggugcauagacaaugguucuuugaucuaccucuuccauggacuucaggagcuaccacugagacaccuaccuggaaucgaaaagagcuauuaguuacguucaaaaacgcgcacgcgaagaaacaggaagugguaguacuaggaucacaagaaggcgcaaugcauacugcauugaccggcgcgacagaaauacaaaauucagguggaacaaguaucuucgcuggccaucuuaaaugccgauuaaaaauggacaaacuugaguuaaaagguaugucauaugcuauguguaccaauaccuucguacugaagaaagaaguaucagaaacgcagcauggaacuauauugauaaaagucgaguauaaaggugaagacguaccaugcaaaauccccuucucaacagaagacggucaaggaaaagcucauaaugguagacuaauaacagcuaauccagucguaacgaagaaagaagaacccgugaauauugaagcagaaccuccauuuggcgaaagcaauauuguuauagggauuggagauaaugcauuaaaaaucaauugguauaaaaaggguucuucaaucggaaaaauguucgaggcgacggcgagaggugcacgcaggauggcaauacuuggggauaccgcaugggauuuuggaagugugggaggaguacuaaauucauugggaaaaaugguacaccaaauauuuggaagcgcauacacagcauuauuuucggguguguccuggguuaugaaaauagguaucgguguguuauuaacauggauaggauuaaauuccaaaaauacaucaaugaguuuuaguuguauugcaauagggauuauaacacuauauuuaggagccguaguucaagccgauauggguugcgucauaaacuggaagggcaaagaauuaaaaugcggcucgggaauuuucgucacaaaugagguucauacauggacagaacaauauaaauuccaggcggauaguccaaagagguuggcaaccgcuauagcaggcgcgugggaaaacgguguuugcgguauuagaaguacaaccagaauggaaaauuuauuguggaagcaaauugcaaaugaauugaauuauauccuuugggaaaacaauauaaaacuuaccguagugguaggcgauauaauaggaguauuagagcaggguaaacggacgcuuacuccucaaccgauggaauuaaaauacucauggaaaacuuggggaaaggccaaaauaguaaccgcagaaacccagaacagcucuuuuauaauagaugguccaaauacuccugaguguccgagugcaucucgcgcauggaauguuugggaagucgaggacuauggcuuuggaguguuuacuaccaauauuuggcuaaaacuacgugagguauacacccagcuaugugaccaucgucuuaugagcgccgcaguaaaagacgaaagagcaguccaugcggauaugggauauuggaucgagucucaaaagaacggaaguuggaagcuagaaaaggcauccuuaauagagguaaaaacgugcacguggccaaaaucucacacgcucuggagcaacgguguauuagaaucugauaugauaauaccaaaaagucucgcugguccaauuucgcaacauaacuaccgacccgguuaucacacacagacugcaggccccuggcaccuaggcaaauuagaacuggacuuuaacuauugcgaagguaccacaguuguuauaacggagaauugcggaacaagaggcccuucuuuaagaacgaccacuguuucugggaaacuuauccaugaguggugcugucguuccuguacuuuaccaccgcuuagauauaugggagaagauggauguugguacgguauggaaaucagaccuauuagcgaaaaagaagaaaauauggugaagucauugguaucugcagguagcggaaaaguugauaauuuuacaaugggcguucucugccuagcaauucucuucgaagaaguaaugcgagggaaguucgggaagaaacacaugauagcuggaguguucuuuacauucguauuauugcuaucggggcaaaucacauggcgugacauggcacacacguuaauuaugaucggaucaaaugccucagaucgcauggguaugggugucacuuaucuugcauugauagcuacauuuaaaauacagccauuucucgcacuaggauuuuucuugcguaaauuaacaucgcgagaaaaucuauuacuaggagugggccuugccauggcaacaacucuacaauuaccagaagacauagaacaaauggcaaaugguauugcacuuggauuaauggcucucaaacuaauaacacaguucgaaacauaccaacucuggaccgcguuaaucucuuuaacuuguucaaauacgauuuuuacgcuuacaguggccuggaggacagcgacauugauucuagcgggaguaagccuccuuccaguaugccaaagcucaucuaugagaaaaacugauuggcuuccaauggcaguugccgcaaugggugucccuccauuaccguuguuuaucuuuucccuaaaagauacacuuaaacguagaucauggccgcuaaaugaaggugugauggcugugggauugguaagcaucuuagcaaguagucugcuacgcaaugacguaccaauggcaggaccguuaguugcagggggauuauuaauagcguguuaugugauaacaggaacuucugcugacuuaacgguggaaaaagccgcggauguaacaugggaagaggaggcugaacagaccgggguuucucacaaucuuaugauuacaguggacgaugacggcacuaugagaauaaaagacgaugaaacagaaaauauacugacaguuuuauuaaaaacugcacuccuaauaguaucugguauauucccguauaguaucccugcaacauugcuagucuggcacacauggcaaaaacaaacccaacgaaguggaguuuugugggacguaccuucaccgcccgaaacacaaaaggccgaauuagaagaaggaguuuaucgcauuaaacaacagggaauauuugguaaaacacaggucggaguaggcguacaaaaagaagggguauuucauacaauguggcauguuacaaggggugcuguauuaaccuauaacgguaaaagguuagagccaaacugggcuagcgugaagaaagacuuaauaaguuaugggggaggguggagauuaucugcacaguggcaaaaaggagaggaaguccaagugauagcugucgaacccggcaaaaauccuaaaaauuuucagacgaugccaggaacuuuucagacaaccacgggagagauaggggcuauagcucuugauuuuaagccgggaacaucuggcuccccgauuauuaauagggagggaaaaguagucggccuuuacggaaacggggucgucaccaagaacggcggauacguuucaggcaucgcucaaacgaacgccgagccggacggcccgacgcccgaauuggaagaagaaauguuuaagaaaaggaauuuaacaauuauggacuuacauccaggaucugggaagacucgcaaguacuuaccagcgaucguuagagaagcuauuaagcgacgguuacgaacccuuauccuagccccgacgagaguaguugcagcugaaauggaggaggcacuuaaagguuuacccauaagguaccaaacaacagcuacaaaaucggaacauacaggcagagaaaucguagaccucaugugccacgcgacauucaccaugcgacuccuaucgccaguuagagucccaaacuacaaucugaucauaauggacgaagcacauuucacggacccagcgagcauagcugcgagaggguacauaagcacuagaguaggaaugggagaagcagccgcaauuuuuaugacggcaacaccacccggcacugcugacgcuuucccgcaauccaaugcgccaauacaagacgaagaaagggauauaccagaacguucguggaacucaggaaaugaauggauaacagauuuugccggaaaaaccgugugguuuguacccaguauaaaagcugggaacgacauagcaaacugccuaagaaagaacggcaagaaaguaauccaauugagcagaaaaacuuuugauacagaauaucagaaaacaaaguuaaaugauugggacuuuguagucacuacugauauaagugaaaugggugcaaauuucaaagcagacagagucauagacccacggaggugucuuaagccagugauacuuacggaugggcccgaacgagucauuuuggccggcccuaugccuguaacugcagcaucugccgcacaaagacgaggcagaguagguagaaacccacaaaaagaaaaugaccaauacauauuuacuggccaacccuuaaacaacgaugaagaccacgcgcauuggacugaagcaaaaauguuauuagacaacauaaauacaccagaagguauuauacccgcuuuauuugaacccgaacgagagaaaagugcggcaaucgauggugaauauagacucaaaggugaaaguaggaaaacauucguagaguuaaugagaagaggugaucugccaguauggcuagcacauaaagucgccucugagggaauaaaguacacagaucgcaaaugguguuuugaugggcaaagaaacaaccaaauauuagaggaaaauauggacguggagaucuggacaaaagaaggcgagaagaagaaacuacguccaagguggcuugaugcacguacauauagugauccacuugcuuuaaaggaauuuaaagauuucgccgccggaagaaaaucaauagcacuagaucucgucacagaaauagggagaguaccaucgcauuuagcacauagaacgcgcaacgcucuagauaaucugguaaugcuacauacaucggagcauggcggcaaagcauacaggcaugcuguagaagaauuaccagagacaauggaaacuuuauuacucuuagggcugaugauauuacugacgggcggagccaugcuauuucuaaucucagguaaaggaauaggaaaaacgaguauaggccucaucuguguaauagcgagcagugggaugcuuuggauggccgagauuccauuacaauggaucgccagugcgauaguacuggaguucuuuaugaugguuuugcuaauacccgaaccugaaaaacaacggacaccucaggauaaccaacucgccuaugugguuauugguauauuaacauuagcagcuauaauagcagccaaugaaaugggauuauuagagaccacgaaacgugacuuagguaugaguaaagagccggguguagucaguccuacaaguuacuuagauguagaucuccaccccgcguccgcauggacucucuacgcaguugcgaccacaguaauaacacccaugcuucgacauacaauugaaaacagcacugcaaacguauccuuagcugccauagcaaaucaggccguugugcuuaugggauuagacaaagguuggccaauaaguaagauggauuuaggagucccgcucuuagcacuagguugcuauagucagguaaauccauuaacccugacagcagccguacuucucuuaauuacgcacuaugcaauaauaggccccggacuucaagccaaagcaacgcgagaagcgcaaaaacguacggcagcugguauaaugaagaauccuaccguagaugguaucaugaccauagauuuagauccgguuauuuaugacucaaaguucgagaaacagcuuggacaagucauguugcuaguauugugcgcuguacaauugcugcuuaugcgaaccaguugggcucugugugaagcucuuacucuagcuacuggaccuauaacaacccucugggaaggcaguccugguaaauuuuggaauacaacgauugcaguuucgauggcaaauauuuucagggguagcuacuuagcuggagcuggccuugccuuuaguauuaugaaauccguagguacaggaaaacgaggcacaggaagccaaggugaaaccuuaggugaaaaauggaagaagaaacuaaaucaacuaucaagaaaagaguucgaccuauauaagaaauccggaaucacggaaguagaccgaacugaagcgaaggaagguuuaaaacgaggcgaaaucacucaucacgcaguaucaagaggaucagcuaaacuacagugguucguggaacguaacauggucauuccugaaggaaggguuauagacuugggcuguggaagaggaggguggaguuauuacugcgcaggacuuaagaaagucacagaaguaagagguuauacuaaaggagggcccgggcaugaagaacccgucccgaugucuacuuaugguuggaauauaguaaaacucaugaguggcaaggacguauuuuauuuaccaccggagaaaugugacacauuauugugcgauauaggagaguccuccccaaguccuacugucgaagagucaaggacaauacgcguacucaaaaugguagaacccuggcucaaaaacaaucaguuuuguaucaaaguuuuaaauccuuauaugccaacggugauagaacauuuggaacgauuacaaaggaagcacggagggaugcuggucagaaauccccuaucuagaaauuccacccaugaaauguacuggauauccaacggaaccgggaauaucguugcuucuguaaacauggucagucggcuauuacucaacagguuuacgaugacccaccgcagaccuacgauagagaaagauguggacuuaggagcagguaccaggcacgugaaugcagaaccggaaacuccaaauauggauguuauaggggagagaaucaagcguauaaaagaagaacauaauaguacauggcauuaugacgaugaaaacccuuacaagacaugggcuuaccaugguucauacgaagugaaagcaacugggucagcgucuucuaugauaaauggaguaguuaaacugcuaacgaaaccaugggacguuguaccaauggugacgcaaauggcaaugacggacacaacaccauucggccagcaaagagucuucaaagaaaaaguagauacaaggacucccaggagcaugccggguacucgccguguuaugggaauaacugcugaauggcucuggaggacccucggacguaacaagaaaccaagauuauguacuagagaagaauuuacuaagaaaguaagaacaaacgcugccaugggagcuguguucacagaagaaaaccaaugggauucagccaaagccgcaguugaagacgaagauuuuuggaaguuaguagacagggagagagaauuacauaaacucggaaaauguggaaguugcguguauaacaugaugggaaaaagggaaaagaaguugggagaauuuggaaaagccaaagguucaagagcuauaugguacaugugguuaggugcacguuauuuagaguuugaagcccuaggguuucuuaacgaagaccauugguuuucgagggaaaacucuuauaguggaguagaaggugaaggacugcacaaacucggauauauucugcgagacauuucuaaaaucccgggcggagcuauguaugccgacgauacagcuggaugggauaccagaaucacugaggaugacuuacacaaugaagagaaaauaacucaacagauggacccagaacaucgucaacuagcuaacgcaaucuuuaaacuaaccuaccaaaauaaagucgugaaaguucaacguccgacaccaacuggaacaguaauggacauaaucaguagaaaagaucaacguggaucuggccaagucgggacuuauggacuuaauacauuuaccaacauggaagcccaacuaauaagacagauggaaggagaagggguucucagcaaggcugauuuggaaaacccacauuugccagagaagaaaauaacacaguggcuagaaacuaaaggaguugagagacuaaaaagaauggccauaaguggagaugauugcguuguuaagcccauagacgaccgauuugcuaaugcuuuguuggcucuaaaugauaugggaaaagucagaaaggacauaccacaauggcaacccucuaaagguuggcaugacuggcaacaaguaccguucugcagucaccauuuccaugaacuuaucaugaaagacggccgaaaacuuguugugcccugccguccccaagacgaacuaaucgguagagcaagaaucucacaaggagccgguuggaguuuaagagaaacugcauguuugggaaaagcauacgcucagauguggucccuuauguauuuucaucguagagacuuaagguuagcuaguaaugccauaugcagugcagugccuguucacuggguaccuacuucgcgcacuacguggaguauucaugcacaucaucaauggaugacuacagaagacaugcuaacaguauggaacaggguuuggauugaagacaauccuuggauggaagauaaaacuccaguuacgacaugggagaacguuccauaccucggaaaacgcgaagaccaauggugcggaagucugauaggccuaacuucacgugcuacaugggcacaaaauauaccuacggccauacaacaaguuaggagccuaauugguaaugaagaauuuuuagauuacaugccaaguaugaaaagauuucguaaagaagaagagucugagggagcaaucugguga

SEQ ID NO: 23314 - RNA, 9873 nt, Artificial Sequence
  derived and/or modified CDS sequence (opt6) from DENV-3__EU781136__SS-prME
acuucacuuugucuuaugaugaucuuaccugcagcgcuggcuuuucaucuaaccaguagggauggugaacccagaaugaucgucgguaaaaacgaaaggggaaaaucccuucuauuuaaaacagcaucggggaucaauauguguacacuaauugcgauggauuuaggagaaaugugugacgacacuguuacguacaaauguccccauauaacugaaguagaaccagaagauauugauugcuggugcaaucuuacaaguacaugggucacauacggaaccuguaaccaagcuggugaacauagacgugacaaacguucuguugcacuagcaccacaugucggaaugggauuagacacaagaacacagaccuggaugagcgcagaaggugcauggcgacaaguggaaaaaguagaaacuugggccuuacgacacccuggguucacgauucuagcacuguuucucgcacacuacauuggaacuagcuuaacucaaaaagucguuauauuuaucuuacugauguugguuacccccaguaugacuaugcgaugcguaggagugggaaaccgugauuucgucgaaggacugucuggggcaacauggguugaugugguccucgaacacggagggugugucacuacaauggcuaaaaauaaaccuacacucgauauugaacuucagaaaacagaagcuacacaacuugcaacacuacgcaaauuauguauagaaggaaaaauaacuaauaucacuacagacaguaggugcccaacgcaaggugaagcugucuuaccggaagaacaagaccagaauuacguuugcaaacacacauauguagauagaggauggggaaauggauguggauuauuugggaaagguucacucgucacaugugcuaaauuucaaugccuagaaccaauagaaggaaaaguaguucaauaugaaaaccuuaaauauacagucauaaucacaguucacacaggggaucagcaucaaguaggaaacgaaacgcaaggagucacugcugagauaacaccacaagcaaguaccacagaagcuauacucccagaguauggcaccuuaggauuagaauguagcccccgaacaggucuggauuuuaaugaaaugauuuuguuaacaaugaaaaacaaagcauggaugguccacagacaaugguuuuucgauuugccacuaccuuggacaucuggagccacgacagaaacaccgacauggaaccguaaggagcuauuagucacauuuaagaaugcccacgccaaaaagcaagaaguugucguacuagguucacaagaaggagcuaugcacacagcucuaaccggcgccaccgagauacaaaauucugguggaacauccauauuugcuggacauuuaaaaugucggcuuaaaauggauaaauuagaacugaaaggaaugucauacgcgauguguacaaauacuuuugugcuaaagaaagaaguaucggagacucagcaugggacuauacucauaaaaguugaauauaaaggugaagauguaccauguaaaauuccauucucaacagaagauggucaaggaaaggcccacaaugggagacuaauaacugcuaauccagugguaaccaagaaggaagaaccagucaauauagaagcugaacccccuuucggagaaagcaauauaguuaucggaaucggagauaaugcucucaagaucaacugguauaagaaggguucaucaauaggaaagauguucgaagccacagccagaggcgcccguagaauggcaauccuaggagauacugcuugggauuucggaagcguagguggaguccuuaauucccuaggaaaaauggugcaucaaaucuuuggaucggcauacacugcacuuuucagugguguuucauggguaaugaaaauuggaauuggcguucuccugacuuggauagggcuuaauagcaaaaauacguccaugucauucaguuguaucgcaauagguauaauaacguuauaucuuggagcgguggugcaggcugacauggguugcguaguaaacuggaaagggaaagaguuaaaaugcgguucaggcauauuuguaacaaaugaaguccauacuuggacugagcaguacaaauuucaagcagacuccccuaaaagacuggcaacugcaauugcuggcgcgugggaaaauggaguauguggaauaagguccacaaccagaauggaaaauuuacuauggaaacagauagccaacgaacucaacuacauacucugggaaaauaauauaaaauuaacugugguaguuggagauauaauagggguccuugaacaagggaagaggacuuuaacuccccagcccauggaauuaaaauauucauggaaaacuuggggaaaagcgaagauaguaacugcagaaacucagaacaguucauuuauuauagauggaccaaauacuccugaaugucccagugcuucacgagccuggaacguaugggaaguagaagauuauggauucggagucuucacuacaaauauuugguuaaagcuacgagaaguguauacacaguuaugugaucaucgauuaaugucagcagcugugaaagacgaacgagcaguucaugccgauauggguuacuggauagaaucucagaaaaacgguucauggaaacuggaaaaggcuucauuaauugaaguaaaaacaugcacauggccaaaaucucauacuuuauggucaaacgguguacuagaaucagauaugauuauaccaaaaucucuagcagggccaauaagucaacauaacuauaggcccggauaccauacgcaaacugcugguccauggcaucuaggcaagcuagaauuagauuuuaacuacugcgaaggcacaacaguaguaauaacggaaaauuguggaacaagggguccaucucuccgcacaacgacuguuuccgggaagcuaauacacgaauggugcuguaggucaugcaccuuaccaccacuacgauacaugggcgaggauggaugcugguaugggauggagauaaggcccauaagugaaaaggaagaaaauaugguaaaaagucugguaagcgcagggucugggaagguagacaacuuuacuaugggaguacucuguuuggcaaucuuauuugaagaaguuaugagagggaaauucggcaagaaacacaugauagcuggcguauucuuuacauucguucugcuacuaucagggcagauaacauggagagauauggcgcacaccuuaaucaugauaggcuccaaugccucggaccggaugggaaugggagugacguauuuagccuuaaucgccacauucaaaauacaaccguuuuuagcccuugguuucuuccugagaaaguugaccaguagagaaaaccuauuacuugguguugggcuugcaauggcaaccacuuuacaacuacccgaagacauagaacagauggcgaacgguauugcucugggcuuaauggcgcuaaaguuaauaacgcaauuugaaacguaucaguuauggacggcauuaauaucauuaacauguagcaacacgauauucacuuuaacgguugcguggcgaacagcgacgcucauacucgccggggucucacuguugcccgugugccaaucaaguaguaugaggaaaaccgauugguuacccaugacaguagcagcgaugggggugccuccuuuaccgcuguucauauuuucauugaaagauacucuaaaaagaagaucauggccacuuaaugagggaguaauggcagucggguuaguaagcauauuagccagcucacuucugcgaaacgauguccccauggcuggaccucuuguagccgguggacuguuaauagcauguuacguuauuacuggaacuagcgcggaucuaacaguugaaaaagcugccgacguuacuugggaagaggaagcugagcagacaggugucucucauaaucuuaugauuacaguugacgaugauggaacgaugagaauaaaagaugaugagacggaaaauauccuuaccguucuuuugaaaacggcucuguuaauuguaaguggaaucuuccccuauagcauaccugcuacacuucucgucuggcacacauggcaaaaacagacacaaagaucuggaguucuaugggaugugccuaguccacccgaaacucaaaaggccgaacucgaagaagguguauaucgaauaaaacagcaaggcaucuuuggaaaaacacaagugggugugggaguucaaaaagagggaguauuccauacaauguggcacguaacgcgcggugcuguucuuaccuacaauggaaaacguuuagaacccaauugggcaagcguuaaaaaggaccugauauccuaugggggugguuggcgauuaucugcucaauggcaaaagggugaagaaguucagguaauagcaguugaaccaggcaaaaaccccaagaauuuccaaacgaugccaggcacauuucaaacaacuacuggugagauaggagcuauugcacuggauuuuaagccagggacuucagggaguccgauaauaaaccgagaggguaaaguaguaggcuuauauggaaacggcgugguuacgaaaaaugguggauaugucaguggaauagcacaaacaaacgccgaaccagacggaccuacaccagagcuggaagaggaaauguuuaagaaacgaaaucucacgaucauggauuugcacccuggcaguggcaaaaccagaaaguaucucccggcaauaguaagagaagcgaucaaaaggcguuugaggacgcuuauucuagcgccgacaagagugguagcugccgagauggaagaagcauuaaaaggucuccccauucgcuaccaaaccaccgcuacaaaauccgaacauacuggaagagaaaucgucgacuuaaugugucacgcaaccuuuacuaugcgacucuuaaguccuguaagagugccaaauuacaaucugauaauuauggaugaagcucauuuuacggauccugcaucgauagcggcacgaggauauauaagcacacgaguagguaugggagaagcggccgcuauuuucaugaccgcuacgcccccagguacggccgaugcauucccccaaaguaacgccccgauccaagaugaagaacgagauauaccagagagaucauggaacucugggaaugaauggaucacagacuucgcugggaagacaguuugguuuguuccuucuauaaaggcagggaaugauaucgccaacugucuaagaaagaacggcaagaaaguuauacaguuaucgagaaaaacauuugacacagaguaucagaaaacaaaauuaaacgacugggauuucgugguaacaacagauauuagugaaaugggggcaaauuuuaaggcagaccgagucauagauccaaggagaugucugaaacccgugauccucaccgaugguccggaaagaguaauauuagcugguccgaugccaguuacagcugcaucugcggcccaacgaagggggagaguagguaggaacccacaaaaagaaaacgaucaauacaucuucacuggacagccgcuuaacaacgaugaagaccacgcccacuggacagaagccaaaauguuacuagacaauaucaacaccccagaaggcauaauaccagcguuguucgaaccagagcgggaaaaaucggcagccaucgauggggaauauagauuaaaaggagaaucaaggaagacauuuguagaauugaugagaagaggcgauuuaccugucuggcuagcgcacaaaguugcaagcgaagguauaaaguacaccgaccgaaaaugguguuuugacggucaaaggaauaaucaaauuuuagaagaaaauauggacgucgaaauauggacgaaagagggcgagaagaagaaauuaagaccgagauggcuagacgcccgaacguacagcgacccccuagcacuuaaagaguucaaagacuucgcagcuggaaggaaaagcaucgcacuggacuuaguaacugaaauuggaagagucccaucccacuuggcacauagaacaagaaaugcccuagauaacuuaguaaugcuacauacuagcgaacacgggggaaaagccuauaggcaugcggucgaggaguugccugaaacaauggagacucuucuauuacuaggucucaugauacuacucacugguggugcaaugcuguuccuaauuaguggcaaaggaaucggaaaaacaagcaucggacuaauuugugugauugcaucguccggaaugcucuggauggcugaaauaccauuacaauggaucgcuagcgcuaucguacuggaguucuucaugaugguuuugcuaauaccggaaccagaaaaacagagaaccccacaagacaaccaauuagcauacgugguuauagguauacuaacgcuagcagcaauaauugcugcaaacgaaaugggauuacuugagacaacuaaacgagaucucggaaugucgaaagaaccagggguuguuagccccaccagcuaucuagacguagaccuccauccagccucagccuggacuuuguacgcugucgcaacgacuguaaucacgcccaugcuuagacauacuauugaaaacagcaccgcuaacguaucucuggcugcuauugccaaccaggcagucguauuaaugggucucgauaagggauggcccauauccaagauggaucuugguguaccucuuuuggcccuaggauguuacucacaaguuaaucccuuaacauuaacagcagcgguacuacuucuuaucacucauuaugcaauaauuggcccaggacuacaggcaaaagcgacaagggaagcgcaaaaacgaaccgcagcggggauaaugaaaaauccgacaguugaugggauaaugacuauagauuuggauccuguaauuuaugauucaaaauuugaaaaacaauuaggacaagugaugcuccuaguucuuugcgccguucaacucuuacuuaugagaacaucaugggcuuugugugaagccuuaacuuuagcaacagguccaaucacaacguuaugggaaggaucgccgggaaaguuuuggaauaccacgauugcagugucuauggcuaauauuuuuagagguucuuaccuagcuggggcaggacucgcuuucaguauuaugaaauccguaggaacuggaaagcgagguacuggaucccaaggagaaacguuaggggaaaaauggaagaagaaauuaaaucaacuuuccaggaaagaguucgaucuguacaaaaagucuggaauaacugaaguggauagaacggaagcgaaagagggcuugaaacgcggagagauuacccaucacgcaguaagucguggcagugcaaaauuacagugguuuguugagagaaauauggucauaccagaaggacgcgucauagacuuagguugugggaggggagguuggagcuauuauugugccggacuaaagaaaguaacagaagugaggggauauaccaagggcggcccaggucaugaagaaccaguaccuaugagcaccuacgguuggaauauuguaaaacucaugagcgggaaggauguauuuuaccuaccuccagaaaaaugcgacacucuucuuugcgauauaggugaauccucaccauccccgacaguagaggaaucaaggacaaucagaguuuuaaaaaugguagaaccuuggcuuaaaaauaaucaguucuguaucaaagucuuaaauccauauaugccaacaguaauagaacaccuagagaggcuacaacgaaaacauggaggaaugcuaguucgcaacccacuaucaagaaauucuacucaugaaauguauuggauuuccaacggaacagggaauauuguagcgucaguaaauaugguuagucgccuccuucuuaauagauucaccaugacucaucgaagaccaacgauugaaaaagacguagaucugggugcugggacacggcauguuaacgcagagccagagacaccaaauauggauguuauaggagaaagaauaaagagaauaaaggaggaacacaacucaaccuggcauuaugaugacgagaacccauauaaaacuugggccuaucauggaaguuaugaaguuaaagcuacagguucagcgucuuccaugaucaauggaguaguuaaacuccuuacuaaaccuugggacguggugccaaugguuacucaaauggccaugacugacaccacacccuucggacagcaacgaguauuuaaagagaaaguagauacaaggacucccaggucaaugccgggcaccagaaggguaaugggaauaacugcugagugguuauggaggacauuagggagaaauaagaaaccgcgguuauguacuagagaggaguucacaaagaaaguucguacgaacgcugcuaugggagcugucuuuacggaagagaaucaaugggauucugccaaagccgcuguggaagaugaagacuuuuggaaacuuguagaccgugaacgcgaacugcacaaauuagguaaauguggaagcuguguuuauaacaugauggggaaaagagagaagaaacuaggugaauuugggaaagccaagggaucaagggcaauuugguauauguggcucggugcaagauaccuagaguucgaggccuuaggauuccuaaaugaagaccauugguucagcagggaaaacucauacaguggaguagaaggggagggucuccauaaguuaggcuauaucuugagggacauaucaaagauacccggaggcgcaauguacgcagaugauacggcagguugggacacacgaauuacagaagacgaccuucacaaugaagagaaaauuacucaacaaauggaccccgaacacagacaauuagcaaaugcuauauucaaguugaccuaucaaaacaaaguagucaagguacagcgaccaacaccaacaggcacaguaauggauauaauuagcagaaaggaucaacgaggguccggacaggucgguacauauggacucaauaccuuuacaaauauggaagcacaacuuauccgacaaauggaaggagaaggagucuugagcaaagcagaucuggaaaacccgcaucuaccugagaagaaaaucacacaaugguuagaaacaaaaggugucgaaaggcuuaaacguauggcaauaagcggagacgacugcgucgugaaaccaauugaugaccgguucgccaacgcauuacuagcacuaaacgauauggggaaaguaagaaaggacauaccucaauggcaaccgaguaaaggauggcaugauuggcaacagguuccguuuuguagccaccacuuccaugagcuuauaaugaaagauggaagaaaauuaguaguaccauguaggccucaagaugaguuaauaggacgagcuaggaucagccaaggggccggauggucgcuuagagaaacugccugucuuggaaaagcguaugcacaaauguggagccuaauguacuuccacagaagagauuugcgauuagcaucgaacgcaauauguucagcugugccgguccacugggucccaacaucucgcaccacaugguccauacacgcacaucaucaauggaugacuaccgaagauaugcugaccgucuggaaucguguauggauagaggacaacccuuggauggaagacaaaaccccugugacuaccugggagaauguccccuauuuagguaaacgcgaggaucaaugguguggaagucuuauuggacuaaccagcagagccacaugggcgcaaaauauaccuaccgcaauacaacagguaagaucacugauuggcaaugaagaguuccuugacuauaugccuagcaugaaaagauucaggaaggaagaagaaagcgaaggggcaaucugguag

SEQ ID NO: 23315 - RNA, 9873 nt, Artificial Sequence
  derived and/or modified CDS sequence (opt6) from DENV-3__EU781137__SS-prME
acgucuuuauguuuaaugaugauccuuccagcugcacuagccuuucaucuaacaucacgagacggugaaccgcgaaugauuguagguaaaaaugaaagagguaaaagucuauuauuuaaaaccgcgucaggaauuaauaugugcacuuugaucgccauggacuuaggugaaaugugcgaugauaccguuacauauaaauguccucauauuacagaaguggaaccagaagacauagauuguugguguaacuuaacaagcaccuggguaacuuauggaacaugcaaucaagcaggagaacauagacgugauaaaagaaguguugcgcuugcaccccauguuggcaugggauuggacaccaggacacaaacguggaugagugcagaaggagcuuggagacagguugaaaaagucgaaacaugggcucuuagacauccaggauuuacuauacuagcccuuuuucuugcccauuauauaggcacaagucuaacucaaaaagucgucaucuucacucuacuaaugcuugugacucccaguaugacgaugcguugcguaggaguuggaaacagagauuuuguagaaggucuuucgggcgcuacauggguggacguaguuuuagaacacggaggaugcguuacuaccauggcgaaaaacaaacccaccuuagauaucgaacuccagaaaacagaagcaacucaacucgcaacauuaaggaaacuuugcauagaaggcaaaauaacaaacauuaccacugauagucguuguccaacacaaggagaagcaguucuaccugaagaacaagaccaaaauuacguaugcaaacauacauaugucgauagaggcugggguaaugguugugggcuuuucgggaaaggauccuuaguaacaugugcuaaauuucaauguuuagaaccaauugaaggaaaagucguacaauacgaaaaccuaaaauauaccguuauaaucacaguucauaccggagaccaacaucaagucgggaaugaaacgcaggggguaacugcagaaauaacuccacaagcgagcacgaccgaagcgauacuacccgaauacgggacacucggucuggaauguaguccacggacaggacuggauuucaacgaaaugauuuuauuaacaaugaaaaacaaagccuggauggugcaucgacaaugguucuuugauuuaccgcuuccauggacaucaggugcgacuaccgagacgccaacauggaacagaaaagaacuauuaguaacuuucaaaaacgcacacgcuaagaaacaggaaguaguuguacuaggaagccaggaaggcgccaugcauacugcacuuacuggagccacggaaauucaaaacaguggaggcacuagcaucuuugccggucacuugaaauguagguuaaaaauggacaaauuagagcucaaagguaugaguuaugcgaugugcacaaacacguucguacucaagaaagaaguuuccgaaacccaacauggcaccauauuaauaaaaguugaauacaaaggagaagauguaccuuguaaaauuccauuuucaacggaagacggacagggaaaagcucacaacggcagacugauaacagcuaauccaguaguaacuaagaaagaagaaccaguaaauaucgaggcagaaccaccauuuggggaaaguaauaucgugauagggauaggcgauaacgcccuaaaaauaaacugguacaagaaagguucaaguauagggaaaauguucgaagcgacugccagaggugcacguaggauggcaauucugggggauacagcaugggacuucgggagcguaggaggaguuuuaaauucacucggaaaaaugguucaucaaaucuuuggaagugcuuacacugcacuauuuucuggugugagcuggguuaugaaaaucggaauaggugucuuauuaacauggauuggacuuaauagcaaaaauacaagcaugucauuuagcuguauagcgauaggaauaauuacucuauaucuaggagcaguagugcaggccgauaugggaugcgucauaaauuggaaaggaaaagagcugaaauguggcucgggaaucuuugucaccaacgaaguucacacauggaccgaacaauacaaauuucaggcggacagcccgaaacgauuagcaacugcaauagcaggagcgugggaaaacggagugugugggauacgaucaacaacuagaauggagaaucuccuuuggaaacagauugccaaugaacuaaauuauauacucugggaaaauaacauaaaacuaacuguaguaguaggcgacaucaucgggguuuuggaacaaggaaaaagaacuuugacaccucagccuauggaguugaaauacucuuggaaaacauggggcaaagcaaaaauaguuaccgccgaaacccaaaauucguccuucauaaucgacggaccgaacacaccagaaugcccaucagcaucccgcgccuggaauguaugggagguggaggauuaugguuuugguguguucacuaccaacauuugguuaaaacuacgugaaguuuauacgcaauugugugaucaucgacuaaugucagcugcuguaaaggacgaacgagccgugcacgcggauaugggcuauuggauugagucgcagaaaaacggaucauggaaauuggagaaagcgucauuaauugaaguaaagacgugcacguggccaaaaucacacacuuuauggucuaauggcguauuagaguccgauaugauaauuccuaaaaguuuagccggaccgauaucgcagcacaauuaccggccaggguaucauacacaaacggcugguccauggcacuuagguaaauuagaacuggacuuuaacuauugcgaggguacaacugucguaauaacugaaaauugcgguacgcgugguccgucauuacgcaccacuacaguaucuggaaaacuaauacaugaaugguguugcaggucauguacucuacccccauuacgauacaugggggaagacggauguugguauggaauggagauuagaccuauaucggaaaaggaggagaacaugguuaaaucuuugguuucagcggggucaggaaaaguagauaacuuuacgaugggcguucucugucuggcgauauuguucgaggaagugaugagggggaaguuuggcaagaaacauaugauugccgguguauucuuuacauuuguuuugcuucuuaguggacaaauuacauggcgcgauauggcgcacacuuuaauuaugauuggaucaaaugcaucagacaggauggggaugggcgugacuuauuuagcgcugauagcgacauuuaaaauccaaccauucuuagcgcugggauucuuucugcgaaaauugaccagucgggaaaaucuucuauuaggcguaggacuggccauggcuacaaccuugcaacucccagaagacauagagcaaauggccaacggaauagcguuaggauugauggcuuuaaaacuuauaacacaauuugagacuuaucaauuauggacugcucuaauuucuuugaccuguucaaacacaauauuuacauugaccguugcauggagaaccgccacccuuauacuagcuggcguaagucuauuaccgguaugucaaaguucaaguaugagaaaaacagauuggcuaccuaugacugucgcagcuaugggaguuccaccuuuaccccuauucauuuucucauuaaaagauacgcuaaagcgcagaucauggccacuaaaugaggggguuauggccgucggucuugugaguauauuggcuucaucauuacuaagaaacgauguuccgauggcagguccucuuguagcaggcggguuauuaauugccuguuaugucaucacugggacaagcgcggacuuaacaguagaaaaagcugcggauguaacuugggaggaagaggcagaacagacagguguaucccacaacuuaaugauaacgguagacgacgauggcacaaugaggauaaaagaugacgagacggaaaacauauugacaguucugcucaaaaccgccuuacuaauaguaucaggaauuuuuccguauagcauaccagcaacucuauuaguuuggcacaccuggcaaaagcaaacacaaagauccggagugcuaugggaugucccaucaccaccggagacucagaaagcugaacuagaagaagguguauauaggauuaaacaacagggaaucuucggcaaaacucaaguggggguaggcguucaaaaagaaggaguauuucacaccauguggcacgugacucguggagcaguccuuacuuauaauggaaaacgccuugaaccuaauugggcaucaguuaagaaagacuugauauccuacggaggcggauggcggcuaucagcacaauggcaaaaaggagaggaagugcagguaauagcaguggaacccggcaaaaacccuaaaaauuuucaaacaaugccagggacauuucaaacuacuacuggggaaauuggagcgaucgcucucgacuucaaaccaggaacuucaggcaguccgauuauaaauagagaaggaaaaguuguaggucuuuauggaaacggagucguaacuaaaaacgguggauauguuucgggcauugcccaaaccaacgcugaaccggauggaccaacgccugaacuagaagaggaaauguucaagaaaagaaauuuaacuaucauggaucuacaucccgguagcggaaaaacgagaaaauauuugccagccauuguuagagaagcaauaaagcgaagacuuaggacauuaauacucgcgccaaccagagugguagcugcugaaauggaggaggcccuuaagggacuuccuaucagguaucaaacaacagccacuaagucugaacauaccgguagagaaauaguugaucugaugugucaugcuaccuuuacaaugagauuauuaucuccuguuagggucccaaauuauaaucucauaauaauggaugaagcgcacuuuacagacccugcuucaauagcagcccgaggguauauuaguacuaggguggggaugggagaagcugcggcuauuuuuaugacagcuacaccucccggcacagcagaugccuucccacagucaaaugcgccaauacaagaugaggagagagauauacccgaaagaagcuggaacagcgguaaugaauggaucacagauuuugcugguaagacagugugguucguaccuaguaucaaggcgggcaaugauauugcuaauugucuaaggaaaaacgggaagaaagucauacaacuaaguagaaagacauuugauaccgaauaucaaaagacuaaguugaaugauugggacuuugugguuacaacggacauuucagaaaugggcgcaaacuucaaagcagaucguguaauugauccuagacgaugucuaaagccaguaauacuuacagacgguccggagagagugauauuggcuggacccaugcccguaacugccgccagugcagcccagagaagaggaagaguaggaagaaacccacaaaaagagaaugaucaauauauuuuuacaggacagccacucaauaacgacgaagaucacgcgcacuggacugaagcaaaaaugcugcuagauaauauuaauaccccagaagguaucauacccgcuuuauucgagccggagagagaaaagagcgccgcuauagauggagaauauagauugaaaggagagaguagaaaaacauucguagaguugaugagacguggugauuuaccaguuugguuggcacauaaagucgcaucagagggaaucaaauacacagauaggaaauggugcuuugauggccagaggaauaaucagauucuugaagaaaacauggauguagagauauggacaaaggagggugagaagaagaaacuaagaccgcgauggcuugacgcaagaacauacucggauccacuagcuuugaaagaauuuaaagacuuugcggcaggcaggaaaaguaucgccuuagauuuggucacggagaucggaagaguaccuucacauuuggcccacagaacacgcaacgcacucgauaauuugguaaugcuacacacaagugaacacggaggcaaggcuuauaggcacgcuguagaagaacuccccgagacaauggaaacccuauuacuccucggguuaaugauucuacuuacugguggugcaauguuauucuugauaucaggaaaaggcauugggaaaacgucaauagggcuaauuugcguaauugcaucaucugggaugcuauggauggccgaaaucccauugcaguggauagcuagcgcuauaguucuagaguucuucaugaugguucuuuugauuccugaaccggagaagcagcggacaccacaggacaaccaacuagcguacgugguaauaggaauacucaccuuagcagcaauaauagcagcaaacgaaauggguuugcucgagacuaccaaacgagaucuugggaugagcaaagaaccggguguaguaaguccaacgagcuaccuugaugucgauuugcauccugcuucggcuuggacguuauaugcaguagcgacaacaguaauaacuccgaugcuucgacacaccauagaaaauucaacggcaaauguaucgcucgcggcaaucgccaaucaagcgguuguucuuaugggucucgacaagggauggccaauuucuaaaauggaccuagguguaccccuacuggcauuaggcugcuauucucaggugaauccccugacuuuaacggcagcagugcugcuacucauaacucacuaugcuauuaucgguccagggcuucaagcgaaagcaacuagagaagcacaaaagaggacagcagcaggaauaaugaaaaauccuacuguagacggaaucaugacuauagacuuggacccaguuauauaugauucaaaauuugaaaaacaauuaggucaaguaaugcuguuaguucuaugugccgugcaacuucuauuaaugcgaacuucuugggccuuaugugaggcuuuaacuuuagcgacaggaccaauaacuacucucugggaaggaagcccuggcaaguucuggaauacaacaauagcugucucgauggcuaacauuuuccgagguuccuaucuggccggagcuggccuggcuuuuucuauaaugaaaucaguuggcacuggaaagagagguacagguucacaaggagaaacauugggugaaaaauggaagaagaaacugaaccaauugucacgcaaagaauuugauuuauacaagaaaucaggaauaaccgaaguagaccgaacggaagcaaaagaggguuugaaacggggagaaauaacgcaccaugcgguuucacguggcucagccaaauugcagugguucgucgaaagaaauaugguuauaccagaaggcagagucaucgaccuaggauguggucgcggaggauggagcuacuauugcgcaggucuaaagaaaguaacagagguaagggguuauacgaagggagguccaggacaugaagaaccagucccuauguccacauauggauggaauauaguuaaguuaaugucuggcaaagauguuuucuauuuaccaccagagaaaugcgauacguuacuaugcgauauuggagaauccucaccaucaccgacaguagaagaguccagaacuauuagaguccugaaaaugguggagccauggcuaaagaauaaccaauucuguauaaaaguguuaaacccuuacaugcccaccguaauagagcaccuugaacgacuucaaaggaaacacggaggaauguugguaagaaacccacuaucucgcaacuccacacaugaaauguauuggauuucaaaugguacggguaacauugucgcuaguguaaacauggucaguagauuauuauuaaauagauuuacaaugacacauagacgaccaaccaucgaaaaagauguagaucugggugcaggaacacgucauguuaacgccgaaccagagacaccaaacauggauguaaucggggaaagaauaaaaagaauaaaagaagaacauaacucuacuuggcacuaugaugacgaaaauccauauaaaacaugggcauaucaugguucuuaugaaguaaaagcgacagguagcgccuccucaaugauaaauggaguuguaaaauuacugacgaagccaugggacguaguaccuaugguuacacagauggcgaugacagauacaacuccauuuggccagcaaagaguauuuaaagaaaaaguggauacgagaacgccucgcuccaugcccggaaccaggcguguuaugggaauuacagccgaaugguuauggagaacguugggaagaaauaagaaaccgcgacuaugcacucgcgaagaguucacgaagaaagugagaacaaacgccgcaaugggugcuguauuuacagaggagaaucagugggacucagcaaaagcagcaguagaagaugaagauuucuggaaguuagucgauagggagcgugaacuccauaaauuggggaaauguggaucuuguguauacaauaugaugggaaaaagagagaagaaauuaggugaauuuggcaaagcaaaagguagcagggcaauuugguacaugugguugggggccagauaucuagaguuugaagcccuaggguuucuuaaugaagaccauugguuuucaagggaaaacaguuauuccggaguggagggagaaggacuacauaaacucggauauauucuccgggacauaaguaaaauuccaggcggcgcgauguaugcagacgauaccgcgggaugggauacaagaaucacggaggaugaccugcacaaugaggagaaaauuacgcagcagauggauccugaacaccgccaacuagccaaugcgauuuuuaagcucacuuaucaaaacaaaguagucaaaguacaaagacccacaccgacugggacggugauggacauuaucucgcgaaaagaucaacguggaucuggacaaguagggaccuacgguuuaaacaccuucacuaacauggaagcucaauugauucgacagauggagggggaaggcguccucaguaaagcagacuuagaaaacccgcaucuuccugagaagaaaauuacucaaugguuggaaacaaaaggaguagaacgguuaaaaaggauggcaauaucaggagacgacugcguuguaaaaccuaucgaugacagauuugccaaugccuugcuugcguuaaaugauauggguaagguacguaaggauauaccacaauggcaacccaguaaagguuggcaugauuggcaacaagucccuuuuugcucgcaccauuuucaugaauuaguaaugaaagacggucgaaaauuaguaguaccauguaggccucaagacgaacucauaggccgagcuaggauaucacaaggagcugguuggucuuugcgugaaaccgccugccuaggcaaggcuuacgcgcaaauguggaguuuaauguauuuccaucguagagaccuucguuuagcgucaaaugcgauauguucggccguuccaguacauuggguaccgacuucacguacaacauggucgauccaugcacaccaccaauggaugacuacagaagauaugcuaacaguguggaauagaguauggauagaggacaacccguggauggaagauaaaacgccgguuacgacaugggagaaugucccauaucuaggaaagagagaggaucagugguguggaucguugauagggcuaacaucgcgggcgaccugggcucaaaauauuccaacagcuauacagcagguccgaucuuugauaggaaaugaagaguuccuugauuacaugccuaguaugaaacgcuucaggaaagaagaagagagugaaggagcuauaugguaa

SEQ ID NO: 23316 - RNA, 9873 nt, Artificial Sequence
  derived and/or modified CDS sequence (opt6) from DENV-3__EU726773__SS-prME
acgaguuuaugucuuaugaugauacucccagcugcacuggcauuucacuuaaccucaagggacggcgaaccacgcaugaucguaggcaagaacgaaagagguaaauccuuauuauucaaaacggcaucaggaaucaauauguguacgcuuauagcgauggaucucggugagaugugugaugauacaguuacauacaaauguccacacauaacggaagucgagccagaagauauagacugcugguguaaccugacgagcaccuggguaaccuaugggaccuguaaccaagcgggggaacauagacgagacaaaagaucuguugcacuugccccgcacgugggaaugggccuugauacaaggacccaaacauggaugucugccgaaggggcuuggcgacaagucgaaaaaguugaaaccugggccuuacgacacccaggauuuacgauacuggcauuguuuuuagcucauuauauugguacuucacucacucagaagguaguuaucuuuauucuacuaaugcucguaacuccgucaaugaccaugaggugcguaggcguuggaaacagagauuucgucgagggacuuuccggcgcuacuuggguugaugucguucuagaacacgggggcugugucacaacaauggcuaaaaauaaaccuacacuggauauagaguuacaaaagacugaggcaacacaguuagcaacgcuaagaaaauuauguauugaggguaagaucacaaauauuacuacagauucacguuguccuacucagggagaagcuguacuaccggaagagcaagaucaaaacuauguguguaaacauacguacguagauagagggugggggaauggauguggauuauucggaaaggggucguuaguuacgugugcaaaauuccaaugucuagaaccaauugaaggaaagguaguucaguacgaaaauuuaaaguauacagugaucauaaccguacauaccggugaccaacaccaaguaggaaaugaaacucagggaguaacagcagaaauaacaccacaggcuaguacuacggaagcaauccuuccagaauacgguacucuaggacuggaauguucuccucgaacaggcuuagacuuuaaugaaaugauacuuuuaacaaugaaaaauaaagcuuggaugguacauagacagugguuuuuugacuuaccgcuaccguggacaucuggugcuacaacugaaacuccaacguggaauaggaaagaauuacuuguuacauucaagaaugcgcacgcgaagaaacaggagguugugguacugggcucccaagagggugcaaugcauacugcacuaaccggggcaacugaaauucaaaauuccgguggaaccuccauauuugcagggcacuugaaguguaggcucaagauggacaaauuagaacucaagggaaugagcuacgcuauguguaccaauacauucguccuaaaaaaagagguuagugagacccagcacggcacaauauuaaucaaaguugaauacaaaggagaagauguuccaugcaaaauacccuuuaguacggaggauggccaaggaaaagcgcacaacgggagacugauuacggcgaauccugucguaaccaaaaaagaagaaccuguaaauauagaagcugaacccccguuuggagaaucuaauauugugauugggauaggggacaacgcucuaaagauaaauugguauaaaaaaggaagcucuaucggaaaaauguuugaagcuacagcucggggugccagaagaauggcaauauuaggugacacagcaugggacuuugguaguguuggugguguccuuaauucuuuagguaaaaugguacaucaaaucuuuggcagcgcauacacagcacuuuuuagugguguaucaugggugaugaaaaucgggauuggaguucuccugacauggaucggguuaaauucaaagaauacaucaauguccuucagcuguaucgucauuggaauaauaacucuauaucuaggagcuguuguucaagcagacaugggcugugucauuaauuggaagggaaaggaacuaaaauguggaagcggaauuuucguuaccaacgaaguccauacauggaccgagcaauauaaguuucaagcagacuccccuaagaggcuagccacagcaauugcaggagcuugggaaaaugggguuugcggaauuagauccacgacuagaauggaaaauuuauuauggaaacagauagcuaaugaauuaaacuacauauuaugggaaaacaauauaaaacuuacuguagucguaggugauauaauaggaguucuggaacagggaaaacguacacucacgccgcaaccuauggaacuaaaguacucauggaaaacuugggguaaggcaaaaauaguaacagcagaaacacaaaauuccucuuucauaauagauggcccgaacacgccggaguguccuagugcaagucgagcguggaaugucugggaaguugaagauuauggguuugggguuuuuaccaccaacaucuggcugaagcucagagagguauacacacaauuaugugaucacagacuaaugagcgccgcgguuaaagaugaaagagcgguccacgcugauauggguuacuggauagaaucgcaaaaaaauggaucuuggaaacuagaaaaggcgucacucauagaaguuaagacuugcacauggccuaaaucacacacauuguggucuaacggggugcucgagagcgauaugauaauuccuaaaucacucgcggguccaauaucacaacacaauuaccggccuggauaccacacgcagaccgcaggaccauggcaccucggcaaacuugagcucgauuucaauuauugcgaaggaacgacuguugucauuacggagaacugugggacaagagguccgagucuuagaaccacgaccguuagcggaaagcuaauccacgagugguguugcagaucuugcacuuuaccuccacugcgguacaugggagaagaugguuguugguacgguauggaaauuaggccgauaucagaaaaagaagaaaauaugguaaaaucauuaguuagcgcaggauccggcaaaguggauaauuuuacuaugggagucuuaugcuuagcaauuuuauucgaagaaguaaugagaggaaaguuuggaaaaaaacauaugaucgcugguguauuuuuuaccuuuguuuuauugcucaguggccaaauuacuuggagagacauggcucauacccuaauuaugauaggaagcaaugcaucugacaggaugggcauggguguaacuuauuuagcccuaauagcaacuuuuaaaauacaaccuuuuuuagcacucggguuuuuccuucgcaaacuaacaaguagggaaaaucugcuacuagggguagguuuagcaauggcaacuacgcuccaacucccugaggauauagaacaaauggcaaauggaauagcccuaggccuaauggcgcuaaaacuaauuacccaauuugaaacguaccagcucuggacagcgcuaaucagucugacuugcaguaacacgauauucacauuaacagucgcauggaggacagcaacauuaauccuggcaggaguuagccuucuaccgguaugucagucaucaucaaugagaaaaacugacuggcucccuaugacuguagcugcuaugggaguaccaccgcuuccacuauuuaucuuuucccugaaagacacuuuaaaaagacgaaguuggccccuuaaugaagggguaauggcuguagguuuaguuucaauacuagcuucuagccuccuacgaaaugacguaccaauggcaggaccccuaguagcggguggccucuuaauagcuugcuacguuaucaccggaacaucugcggaccucacuguagaaaaagcagcugaugucacaugggaggaagaagcggaacaaacaggagucagccauaaccuaaugauaacgguagaugacgauggcaccaugcguaucaaagacgaugagacggaaaauauucuaacuguguugcuuaaaacugcuuuauuaauaguuucgggaauauucccuuacucuauaccggcaacuuuacuaguauggcauacauggcaaaaacaaacucagagaucagggguuuuaugggaugucccauccccaccagaaacucaaaaagccgaacuggaagaaggugucuaccguauuaaacaacaaggaaucuuugguaaaacccaaguaggaguaggagugcaaaaagaagguguauuucauaccauguggcacguaacucgaggcgcaguccuuacauauaacgguaaaagguuagagccuaauugggcuucuguuaagaaagaucuaauaaguuaugguggcggguggagacuuucugcucaguggcaaaaaggagaggaaguacaaguuauagcaguggaaccggggaaaaacccaaaaaauuuucagacgaugccaggcacuuuucaaacaacuacgggggaaauaggggcaauagcucuugacuucaaaccaggaacaagugggucacccauuaucaaucgagaggguaaagugguaggccuuuaugguaaugguguuguuacuaagaauggaggguauguaucaggcauagcacaaacaaacgcugagcccgacgguccuacuccagaauuagaggaggaaauguucaaaaagagaaaccugacgauuauggaccuucacccaggaucagguaagacaagaaaauaucuucccgcaauagucagagaagcuaucaaaaggagauugaggacacuuauauuggcaccgaccagggucguggcagcggaaauggaagaagcauuaaaaggccuaccaauuagguaccagacaaccgcuacuaagucagagcacacuggaagagaaauaguggaucucaugugccaugcaaccuuuacuaugagauuauuaucuccugucagaguaccaaauuauaauuuaauaauaauggaugaagcucauuuuacagauccugcaucaauugcggcgagaggguauauuaguacuaggguuggaaugggcgaagcggcugcaauuuuuaugacugcaacgccuccugggacagcagacgcuuuuccucaaaguaaugcaccuauucaagaugaagagaaagauauuccugagaggucauggaacagcggaaaugaauggauaacggacuucgccggcaagacgguuugguucgugccaucaauaaaggcagguaaugauauugcuaauugccuacgaaaaaacgggaagaaagucauucaacuaucccgaaaaacuuuugauacagaauaucaaaagacuaaacucaaugacugggauuucgucguaacuacagauauaucagaaaugggagcaaacuuuaaagccgaucggguaauugauccacgccgaugcuuaaaaccaguaauuuuaacugacggaccggagagggugauuuuagcaggaccuaugccaguuacagcugcaagugccgcucaacgaagaggaagaguuggaagaaauccgcagaaagagaaugaccaauauaucuuuacgggacaaccuuuaaacaacgacgaagaucaugcucauuggacugaagcuaagaugcuauuagacaacaucaauaccccugaaggaauaauacccgccuuauucgagccugaaagagaaaaaagcgcagcuauagauggagaauauagacugaagggcgaaucaagaaaaacauuugucgaauugaugcgaagaggcgaucucccagucugguuggcucauaaagucgcaagcgagggaauaaaauauacagaucguaaaugguguuuugacggacaacguaacaaucaaauucuagaggaaaacauggauguagaaauauggacaaaagaaggcgaaaagaaaaaguuaaggccaagauggcuggaugcgagaacauacucagacccucuggcauuaaaagaauuuaaagacuuugcggcugggagaaaaucaauagcacuagaucuuguuacagaaaucggaaggguaccuucccaccucgcccaccgaaccagaaaugcauuggauaacuugguaaugcuccauaccucugaacacggagguaaagccuacagacacgcuguggaggaacuaccggaaaccauggaaaccuuauugcuguugggacuuaugauuuuguuaacaggaggagcuaugcuuuuucugauuuccggcaaaggaauugggaagacuagcauuggcuuaauaugugucauagccaguucagguaugcuuuggauggcagaaauaccccuucaauggauagcuucggccaucgugcuggaauucuucaugaugguauuacuuaucccugaacccgaaaaacaacguacaccacaggacaaucaguuagcuuauguagucauuggaauuuugaccuuagcugcaauaaucgcagcaaacgaaaugggacuuuuagagacuaccaagcgagaucuaggcaugucaaaggaaccgggagucguuagccccacuucauauuuagacgucgacuugcaucccgcuucagccuggacacuauaugcuguugcaacaacaguaauaacaccuauguugcgucauacaauagaaaauagcacggcgaauguaucacuggcagcgaucgcaaaucaagcgguaguguuaaugggauuggauaaaggauggccaauaucgaagauggaccuaggggugcccuuacuagcuuuaggcuguuauagucaggugaauccgcuaacccugaccgcagcaguauuacuuuuaauuacucauuaugccauaauugguccagggcuucaggccaaagcuacucgagaagcccaaaaaagaacugcagcagggauaaugaagaauccaacaguagacggcauuaugacgauagaccuagauccagucauuuacgacucaaaguuugaaaaacaacuaggucagguaauguuacucguacucugugcgguacaacuacucuuaaugcgcaccaguugggcgcuaugugaagccuuaacguuggcuacugguccaauuacaacguugugggaggggucaccuggaaaauucuggaauacuacaauugcuguauccauggcaaacauauuccguggaaguuauuuagcgggagcggggcuagcauuuaguauaaugaaaaguguaggaacaggcaagcguggaacugggucacaaggagaaaccuuaggcgaaaaguggaaaaaaaaguuaaaccagcucagccgaaaagaauuugaucucuacaagaagucaggaauaacagaaguagaucgaaccgaagcaaaagaagguuugaagagaggagaaauaacucaccaugcaguaaguagagguucggcaaagcuacaaugguuugucgaaagaaauaugguaauaccagaagguaggguaauagaccuuggcuguggaagaggagguuggucuuauuacugugccggacuaaagaaaguuaccgaagucagaggguacacaaaaggaggaccggggcacgaagaacccgucccgaugaguacauacggguggaacauaguaaaacuaaugagcggaaaagacguguucuacuugccgccugaaaaaugugacacauuacuuugugauauuggggaauccucucccucaccaacaguugaagaaagucgaaccauacgaguccuaaagauggucgagcccuggcuaaagaauaaucaauucugcaucaaaguuuugaacccguauaugcccacuguaauagagcauuuagaacggcuucagcguaaacauggaggaauguugguaagaaauccuuugucaagaaauuccacacacgaaauguacuggauaaguaaugggacuggaaauauaguggcguccguaaauaugguaaguaggcuuuuauuaaaucgguuuacgaugacgcaucguaggccuacgauagaaaaggacguggaucuuggagcagguacucgucauguuaacgcagaaccagagacuccaaauauggaugucauuggagaaagaauuaaaagaauuaaggaagaacauaacucuacauggcacuaugaugaugaaaaucccuauaaaacaugggccuaccaugguucauacgaagucaaggcaacaggcucugcaucaagcaugaucaauggaguagugaaauuauuaaccaagcccugggaugugguaccuaugguaacacaaauggcuaugacggauacgacaccguuuggucagcaacguguauuuaaagagaaaguagauacucgaacaccaaggaguaugccgggaacgagacgaguuaugggaauaacggcggaauggcuauggcgaacccuaggucgcaauaagaaacccagacuaugcaccagagaagaauuuacuaaaaaaguucguacaaaugcagccaugggggcuguuuuuacggaggaaaaucaaugggacucugcgaaggccgccguagaagacgaagacuucuggauuuuaguagacagagaaagggaacuccacaaacuuggaaaguguggauccugcguuuauaauaugaugggcaaacgggaaaaaaaacucggggaauucggcaaagccaaaggaagcagagcaauaugguauauguggcuaggagcaagguaccucgaauuugaagcacucggauucuuaaacgaagaccauugguuuagccgcgaaaauagcuacagcgguguagaaggcgagggauugcauaagcuaggguacauucuaagagacauuucaaaaauaccaggaggagcaauguacgcagacgacaccgcgggaugggauacucgcauaacagaggaugaucuucauaacgaagagaagauuacacaacaaauggacccagaacacagacagcuggccaacgccauuuucaaacuaaccuaccaaaauaagguaguaaaaguucaaagaccgacaccaaccgggacaguaauggacauaauaucacgaaaggaccaacguggcucuggucaaguuggaacguaugguuugaacaccuucacuaacauggaagcacaacuuauacgacaaauggaaggugaagguguacuaaguaaagcggaccuggaaaacccccacuuaccugagaaaaaaaucacacaaugguuagaaacaaagggaguagaaagacuaaaaagaauggcaauuagcggagaugauuguguaguaaaaccaauugacgaucgauuugccaaugcacuauuagccuuaaaugacauggguaaaguacgaaaggacauaccgcaauggcaaccgucuaagggauggcaugacuggcaacaagugccauucuguagccaccauuuccaugaacuaaucaugaaagacggccgaaaguuaguagucccauguaggccucaagaugaauuaauaggcagagcaagaauaagucaaggugcuggauggaguuuaagggaaacagccugccucggcaaggcguacgcacagauguggucacucauguacuuccauagacgugaucugagacuagcaagcaaugcuauaugcucagcaguuccaguucacuggguuccuacuucucgcaccaccuggucaauacacgcccaccaucaauggaugacuacagaagacauguuaacuguuuggaaccgugucuggauagaagauaauccuuggauggaagauaaaacaccaguaacaacgugggaaaacgugccauaccuaggaaagcgagaagaucaguggugcgguagucucaucggacuuacaucaagagccacaugggcacagaauauuccuaccgccauucagcaaguccguagcuuaauuggaaaugaagaauuucucgauuauaugcccaguaugaaacgauuccgcaaggaagaagaguccgaaggagcuauaugguag

SEQ ID NO: 23317 - RNA, 9873 nt, Artificial Sequence
  derived and/or modified CDS sequence (opt6) from DENV-3__EU726774__SS-prME
acgaguuuguguuuaaugaugauuuuaccagcagcacuagccuuucauuuaacuucacgagauggagaaccaagaaugauaguagggaaaaaugaaagagguaaauccuuguuauuuaaaacggccucugguauaaacauguguacucugaucgccauggauuuaggcgaaaugugugacgauaccgucacauauaaauguccucauauaaccgaagucgagccggaagacauagauugcuggugcaauuugacaaguacaugggucacauacgguaccuguaaccaagcaggcgaacauagacgugauaaaagaaguguggcacuagcaccacaugugggcaugggguuagacacgagaacacaaacuuggaugucagccgaaggugcauggcggcagguagaaaaaguagaaacuugggccuugagacacccuggauuuacaaucuuagccuuauuuuuagcgcauuauaucgguaccaguuuaacacaaaaaguuguuauuuuuauccuauuaaugcuugucacgccuucgaugacaaugagaugcguaggcgucggaaauagagauuucguugaaggauuaucuggagcuacuuggguagacgucguauuagaacauggagggugugugaccacaauggccaaaaacaaaccaacacuagacauugaauugcagaaaacagaggcuacacaauuagcuacacuuagaaaacuaugcauagaagguaaaauaacuaacauaacaacugacagucgguguccaacucagggagaagcggugcucccggaagaacaagaucaaaacuacgucuguaaacacacauacgucgaucguggauggggaaauggguguggucuauucgggaaagggagcuuagucacuugcgcaaaauuccaguguuuagaaccgauagaagggaaaguggugcaauaugaaaauuugaaauauacgguaauaauaacaguucauacaggugaccaacaucaaguggggaaugaaacacaaggagucacagcagagauuacaccucaagccucaacuacagaagcaauacuacccgaauaugguacucuaggguuagaaugcaguccuagaacaggucuggacuucaacgagaugauucuacuaacuaugaaaaacaaagcauggaugguccauagacagugguucuuugauuuaccauugccauggacuagcggggccacuacugaaacaccuacuuggaauaggaaagaacuauuaguuaccuucaaaaacgcucaugcuaagaaacaagaggucguaguauuaggcagucaggaaggggcgaugcacaccgccuugacuggugcaaccgaaauacaaaacuccgguggaacgucuaucuuugccggacacuuaaaaugucgucugaaaauggauaaacuugaauuaaaagguaugucauaugcaauguguacaaacacauuuguucuuaagaaagaaguaagugaaacucaacacggcacaauuuuaauaaaaguagaauauaaaggagaggaugugccaugcaagauacccuuuaguacagaagaugggcaagggaaagcucauaacggacgucuuauaacugcuaauccaguuguuacuaagaaggaagaaccgguuaauauagaggccgaaccacccuucggagagagcaacauugugauuggcauuggggauaaugccuuaaaaauaaauugguauaagaaaggaaguucgauuggcaaaauguucgaggccacagcuagaggagcacgcaggauggcuauccuuggagauacagccugggauuuuggcaguguuggaggaguacuaaauucacuaggcaagaugguucaccaaauauuuggaucggcauauacagcguuguuuucagguguuucauggguaaugaaaauagggauaggaguauugcuaacguggaucggacuaaauagcaaaaauaccucaaugucuuucaguuguauagcaauugggaucaucacacuuuaccuaggagcaguaguacaagcagacaugggguguguaauaaauuggaaagguaaagaauuaaaaugugguagcggaauuuucguaacaaacgaaguucauacauggacggagcaauacaaauuccaagcggacucaccaaaaagauuagcaacugccauagcuggggcaugggaaaaugguguauguggaauuagaucaacaacacggauggaaaaucuccuuuggaaacaaauagcaaaugagcuaaauuauaucuuaugggaaaacaauaucaaacucacuguaguaguuggagauacuauaggcguuuuagagcaagggaaaagaacauugacaccccagccaauggaacugaaguauagcuggaaaaccugggguaaagcgaaaaucgugacagcugaaacucaaaacucaaguuuuauaauagauggaccgaauaccccagaguguccuucagcaucgagagcauggaauguaugggagguagaagauuacggauucggaguauucacuacaaauauaugguuaaaguugagagaaguauauacucagcucugugaucaucggcuuaugucagcagcuguuaaagacgaacgggccguacaugcagauaugggcuauuggauugagagucagaaaaaugguaguuggaaauuagagaaagcaucauuaauugaagugaagacauguacauggccuaaaagucauacuuuauggagcaacggaguacuagaaagugauaugaucauucccaaaagccuagccggacccaucucacaacacaauuaucgaccugguuaucauacucaaacagcgggacccuggcaccugggaaaauuagaauuagacuucaauuacugugaaggcacuacuguaguaaucacggaaaacugcgggacacgggggccaucauuaagaacaacuacuguuagugguaaauuaauucacgaaugguguugcaggaguuguacccucccgccacuacgauauaugggcgaagauggaugcugguacgggauggagauuagaccaauuucggaaaaagaggaaaacauggugaaaaguuuggugucagccgggucuggaaagguagacaacuuuacgaugggaguacucugcuuagcaauucuauucgaagaagucaugagaggaaaauuuggcaaaaagcacaugauagccggaguauucuucacguucguguugcuauuaucuggucaaauuacauggagagauauggcgcacacacucauaauggucggcucaaacgccucagacaggauggguaugggaguaacuuaucuagccuuaauagcuacauuuaaaauacaaccauuucucgcauuaggauucuuucuaagaaaacugacaucgagagaaaaucuccuauuagggguuggacucgcaauggcaacuacacuacaacuaccagaagauaucgaacaaauggcaaaugggauagccuuaggucuaauggcuuuaaaacuuacaacacaauucgaaacuuaucaacuuuggaccgcuuuaauaucccucacaugcucgaauacaauauuuacauuaacaguagcuuggagaaccgcuacuuuaaucuuagccggugucucauuguuaccaguuugucaguccucaucaaugcguaaaaccgauugguuaccaaugacuguagcagcaaugggcgugcccccacuaccgcuauuuauauuuucauuaaaagacacauuaaaaagaaggucauggccucuaaacgaggguguaauggcaguuggucuuguaucuauacuugcaaguucccuccugaggaacgacgucccaauggcagguccucuuguggcggguggguuauugauagcauguuacguuaucacuggaacuucugcagaccucacaguagaaaaggcagcugacguuacaugggaagaggaagccgaacaaacggguguaagucacaaccuaaugauuacuguggacgacgaugggaccaugaggauuaaagacgacgagacugaaaauauucuuacuguucuguugaaaacggcuuugcuaauuguuaguggaaucuucccguauucgauacccgcuacucuauuaguguggcauacguggcaaaaacaaacgcaaaggaguggggugcucugggaugucccgaguccgccagagacccagaaggcagagcuagaagaagguguguaccggauuaagcaacaaggaaucuucggaaaaacacaggugggcguuggggugcaaaaggaagggguguuucauacuauguggcauguaacaagaggugccgugcuaacauacaacgggaagaggcuugagcccaacugggcaagcguuaaaaaggaucuaauauccuauggaggaggauggcgauuguccgcccaguggcaaaaaggugaagaaguucaaguaauugcgguugaaccgggcaaaaaucccaaaaauuuccagacuaugcccgguacauuccaaaccacuacaggggaaauaggagcuaucgcuuuagauuucaaaccggggacgucugguuccccaaucauuaacagagaaggaaaaguaguagguuuguauggcaauggaguggucacaaagaaugguggcuacguuucagggauagcacagacgaacgcugaaccggauggaccgacgccggaacuugaagaagagauguuuaagaaacgaaauuuaacaauaauggauuugcacccugggagcggaaaaacucgaaaguacuuaccagccauuguuagggaagcaauuaaaagaagauugcggacacucauauuagcaccgacgagggucguagcugcugagauggaagaagccuuaaaaggcuuaccaaucagauaucaaaccaccgcgacaaagucagaacauacuggcagagaaauaguagaccugaugugucaugcuacauucacaaugagacuccuaagcccaguaaggguuccaaauuacaaucuaauaauaauggacgaagcgcacuucacggacccggcaucuauagcugcccggggauacauaucaacacggguuggaaugggagaagcagccgccaucuuuaugacugcaaccccaccaggcacugcagaugcauuuccgcaaagcaacgcaccaauacaagaugaagaacgagauauaccggaaagaucguggaacaguggaaacgaauggauaacggacuuugcuggaaaaacuguuugguuuguuccaaguaucaaagcaggaaaugauaucgccaacugcuuaaggaaaaaugggaaaaaggucauacagcugucaagaaaaacauucgauacagaauaucaaaagacaaaacuuaaugauugggauuucgugguaacgacagauauaucugaaaugggcgcuaauuucaaagcagauagaguuauagauccgcgcagaugucuaaaaccuguuauacuaacagaugggccagaaagagucauuuuagcugggccaaugccuguuacagccgcgucagcugcucaacgacgaggucgaguuggacguaacccacaaaaagaaaacgaucaauacauauucacaggccaaccacuuaauaacgaugaagaccacgcacacuggacggaggcaaaaauguuacuggacaauaucaauacacccgaggggauuaucccagcgcuauuugaacccgaacgagaaaaauccgcugcaauugacggugaauauagacuuaaaggggaaagucgaaagacauuuguugaauuaaugaggcgaggcgacuuaccaguauggcuagcacacaaaguugcaucggaagguauaaaguauacugaucguaagugguguuucgaugggcagagaaauaaccagauacuugaggaaaauauggauguagaaaucuggacuaaagagggggaaaagaagaaacuuagaccacguuggcuagacgcacggaccuauagcgauccucuagcacuaaaagaauuuaaagauuuugcugcaggaagaaaauccauagcucuagauuuaguuacugaaaucggaagaguuccaucccaccucgcacauagaacgcguaacgcauuagacaauuuggucaugcuacacacaagcgagcauggagggaaagcauaucggcaugccguggaagaauuaccagaaacaauggagacauuacuauugcucgguuuaaugauacugcuuacugguggugcaaugcuauuucuaauaaguggaaaagggauugggaaaacaaguauagggcugauaugcguaauugcaucuucaggcaugcuuuggauggcugaaauaccccuccaauggauagcuucggcaauaguauuagaguuuuucaugaugguucuauugauaccagaaccagaaaaacagcguacaccucaagauaaucaguuagcuuaugucgucaucgggauauugacacuugccgcaauuaucgcugcuaaugaaaugggauuacuagagacaacaaagcgugacuuagggaugaguaaagagccaggaguuguuaguccaacguccuaucuggacguugacuuacauccugcaagugcguggacguuguacgcuguagcuacuaccgugauuacacccauguuacgucacacgauagaaaauucuaccgcaaaugucucguuagcggcgauugcgaaccaagcagugguacuaaugggauuagacaaaggauggccuaucucaaagauggaucuugggguccccuuauuggccuugggauguuauagucaaguuaaccccuugacccuuacagcagcagugcuuuuacuaauuacgcauuaugcaauuauagggccggguuugcaagcuaaggccacccgggaggcacagaaaaggaccgcggcaggaaucaugaaaaacccgacagucgacggcauaaugaccauugacuuggacccaguaaucuaugacagcaaauucgagaagcaauuaggacaaguuaugcuacugguacuaugugcugugcaguuauuacucaugaggacaucuugggcguuaugugaggcgcuaacucuagcaaccggccccauaacuacauuaugggaagggucaccggguaaauucuggaacacuacaauugcagugagcauggcaaacauauuccgaggaucuuaucuugccggggccggauuagcuuucaguaucaugaaaucaguuggaacagggaaaagaggaacgggcucucaaggcgaaacguugggagagaaauggaagaagaaauuaaaucaacuaagucgaaaagaauuugauuuauauaagaaaaguggcauaacugaaguggaccgcacugaggccaaggagggauugaagcgaggggaaauaacacaucacgcaguaucuaggggaucugcuaaacuacaaugguuuguagagagaaacauggugauaccagaagggagaguaauagauuuaggcugcggacguggaggguggucauauuauugugcgggucucaagaaagugacggaggucaggggcuacacaaaaggaggaccaggucacgaagaaccgguaccuaugucgacauauggcuggaacauuguaaaacuaaugaguggaaaagaugucuuuuacuuaccaccagaaaagugugauacuuuguuaugcgacauaggagaaaguucacccaguccuacaguugaagaaucaagaacaauaaggguacugaaaaugguugaaccuugguugaaaaacaaucaauuuugcauuaaaguacugaacccauauaugccaacagucauagaacaucuggaacgucuacaacggaaacauggugguauguuaguuagaaauccacuuucccgaaacaguacacacgaaauguauuggauaucuaauggaacaggcaacauaguagcuucgguuaauauggugucaagacuauuguuaaauagguuuacaaugacgcacaggcgacccacaauagaaaaggacguagaucucggcgccggaacacgccauguaaaugcugagccagagacaccuaauauggaugugauaggagaaagaauaaaaagaauaaaagaggagcauaacagcacguggcauuaugacgacgaaaacccauauaagacuugggccuaucauggaucuuacgaagugaaagcaaccggaucagcuaguagcaugauaaacgggguuguuaaacuucuaaccaagccaugggacgugguaccaauggucacacagauggccaugacggacacuacuccuuuuggccagcaaaggguguucaaagagaaaguagauaccagaacuccucgaaguaugccagggacuagaagagugaugggaauaacugcagaauggcuauggcgcacacuuggacgcaauaagaaaccaagguuauguaccagagaagaauuuacaaagaaaguucgcacuaaugcggccaugggggcaguguucacugaggaaaaccagugggauagcgcgaaggccgcuguagaagacgaagacuuuuggaaauuaguggaccgcgaacgagaacuacacaaauugggaaaauguggaaguuguguuuauaacaugauggggaaaagagagaagaaauuaggagaguuuggaaaagcaaaagggucaagagcgauaugguacauguggcuuggcgcaagauaucuggaguucgaagcucuuggauuccucaaugaagaccacugguuuucuagggaaaauucauauucagggguggaaggcgaaggccuucacaaauuaggauacauccucagagauaucaguaaaaucccagguggagccauguaugcagacgauaccgcagguugggauacacgaauaacagaagaugaccuacacaaugaagaaaagaucacacagcaaauggaucccgagcaucgacaacuagcgaaugcgauuuuuaaauuaaccuaccaaaauaaaguaguuaaaguacaacgaccaacaccgaccggaaccguaauggauauuauaagcaggaaggaucaacgaggaucaggucaaguugguacauacggccucaauacguuuacgaauauggaggcgcaauuaaucagacagauggaaggagagggaguacuaucgaaggcggaccuugaaaacccacaccuaccggaaaagaaaauaacucaauggcucgaaacuaaagguguggagcguuuaaaacguauggcgauaaguggagaugacuguguaguuaagccaaucgaugauagauucgcaaaugcauuacuggcauugaaugauaugggaaaaguaaggaaggauauaccccaguggcaacccucaaaaggguggcacgacuggcagcaagucccauuuugcagucaccacuuucacgaacuuauuaugaaggacggaagaaaauuaguaguuccauguaggccgcaagaugaauugaucgggagagcacggauuucacaaggugcuggauggucuuuaagggaaacagcaugucucggaaaagcauaugcacaaauguggagccuaauguauuuccauagaagggaccuaagacucgcaucuaacgccauuuguagcgcaguaccaguucacuggguaccaaccucuaggacaacuuggucaauacacgcucaucaucaguggaugaccacagaagacaugcucaccguauggaacagagucuggauagaggauaaccccuggauggaagauaaaaccccaguuacaacaugggagaauguaccuuacuuaggaaagagggaagaccaguggugcgguaguuuaauagguuuaacaagcagagcgacaugggcccagaauauacccacggcaauucaacaagugaggucacuaaucgggaacgaagaguuucuagauuauaugccaucuaugaaacgguucaggaaagaagaggaaucagaaggagcaauuugguaa

SEQ ID NO: 23318 - RNA, 9873 nt, Artificial Sequence
  derived and/or modified CDS sequence (opt6) from DENV-3__EU687219__SS-prME
accucacuauguuuaaugaugauucuaccagcagcucuggcguuucaccuaacaucgagagacggugaaccacgaaugauaguugggaaaaacgaacgggggaaaagccucuuauuuaaaacggcaagugggauaaauaugugcacguuaauagcgauggaccuaggugaaaugugcgaugauacgguaacauauaaauguccacauauagcagaaguagaaccagaagauauagacuguugguguaacuuaacgagcacaugggugacauauggaacguguaaucaagcgggugaacacagaagagauaaacguucuguagcacucgcaccgcacgugggaaugggauuagacacaaggacucaaacguggaugucagcagaaggagcguggagacagguggagaaaguggagacaugggcgcuaagacaccccggcuucacaaucuuagcguuguuucuagcucauuacauugggacgucauugacucaaaaaguaguaauauuuauuuuguuaauguugguaacaccaucaaugacaaugcgauguguaggagucgguaacagagacuuuguggaaggucuuaguggcgcuacguggguugaugugguauuagaacacggagggugcguaacuaccauggccaaaaauaaaccgacucucgauaucgaacuccagaaaacugaagcaacacaacuugcaaccuuacguaaacuauguauagagggcaaaauaacaaacauaaccacagacaguagaugcccuacacaaggggaagcaguacuuccagaggagcaagaccaaaauuacguauguaaacauacauauguugacagaggauggggaaauggguguggacuguucggaaaaggcucucugguuacgugugcaaaauuccaauguuuagaaccgauugagggaaaaguuguacaauacgaaaaucuaaaauauacagugaucaucacaguucauacaggcgaucaacaccaaguaggcaaugaaacacaaggcguaacggcagaaauuacaccacaagcaaguacaacugaagcuauccuuccagaauacgguacauuagguuuggaauguuccccuagaacaggauuagauuucaaugagaugauacugcucacuaugaaaaauaaggcuuggaugguucacagacaaugguucuuugaucuaccucucccauggacaucaggagcaacaaccgagacaccuacuuggaaccgaaaagagcuccucgucacauucaaaaaugcucacgccaagaaacaagaagucguuguacuagguucgcaagaaggcgcgaugcauaccgcucuaacuggcgcaacagaaauucaaaauucaggggguacaucaauauuugcugggcauuuaaaauguagauuaaaaauggacaaauuagaauuaaaaggcaugucuuacgcaauguguacuaauaccuucguauuaaagaaagaaguuucggaaacccaacauggcacuauacucauaaaaguagaguauaaaggggaagacgugcccuguaaaaucccauucagcacugaagaugggcaaggaaaagcacacaacggaagacuaauuacagccaauccgguaguaaccaagaaagaagaaccagucaauauugaagccgaaccucccuucggagagaguaauauaguuauuggaaucggagacaaugcuuuaaaaauuaacugguauaagaaaggaagcaguauagggaaaauguuugaagcuaccgcaagaggagcuaggcgaauggcgauuuuaggugacacagcaugggauuucgguucaguuggagguguacuuaacagcuuaggcaaaaugguacaccaaauauuuggaucggcguauacugcauuauucagcgggguuucuuggguaaugaaaauaggaauagggguacuccucacauggauagguuuaaauaguaaaaauacaucaauguccuuuuccugcauagcuauaggaaucauaaccuuauaccuaggugcugugguucaagcagauauggguugugugauuaauuggaaaggaaaagagcuaaaauguggcagcgguauuuuugucaccaacgagguucauacuuggacggagcaauauaaguuucaagcagacagcccgaagagacuggcaacagccauugcaggagcuugggaaaacgggguuugcggaauccguaguacuacacgaauggagaauuuacuguggaaacaaauagcuaacgaauuaaauuacauacuuugggagaacaacauaaaauugacaguagucgucggcgacaucauaggaguauuagaacaagguaaacguaccuuaaccccgcaaccaauggaacuaaaguauuccuggaaaacaugggguaaagccaaaauaguaacagcugaaacgcaaaauaguagcuucauaauagauggaccuaauaccccugaaugucccagugucagucgugcauggaacguuugggaagucgaggauuauggcuuuggcguauucacgacaaauaucugguugaaacuccgcgaaguuuacacccaacuuugugaccauagacuaaugucagcugcuguuaaagaugaaagagccguucacgcugacaugggguauuggauagaaucucagaaaaauggaaguuggaagcuagagaaggcuucauuaauagagguuaagacguguacauggccuaaaucucacacccuauggucgaauggaguauuagaaucugacaugaucaucccaaaauccuuagcaggacccaucucucaacauaauuauagaccagguuaccauacacaaaccgcugggcccuggcacuuagguaaauuagaacuugauuuuaauuauugugaagggacuacaguagugauuacagagaacuguggaacaagagggccuucacuucguacaacaacugucucagguaaauugauacacgaaugguguuguagaucuugcacacuaccuccguuacgcuauaugggugaagaugguuguugguacggcauggaaauucgcccgauuuccgagaaggaagaaaauauggucaaaucgcuuguuagcgccgguaguggcaaaguagauaacuuuacuauggguguacuguguuuagcaauucucuuugaagaagucaugagagguaaauuuggcaagaaacacaugauagcaggcguauucuuuacauuugucuuacuguuauccggucaaauaacguggagagacauggcccacaccuuaauaaugauagggucuaaugcaagugaccguaugggcaugggcguaacauaucuugcacuaaucgcaacuuuuaaaauucagccguuccuagcuuuaggauucuuuuuaagaaaauugacaucccgagagaaccuucucuuaggcguagggcuggcuauggcaacgacgcuacaauuaccagaagauauagaacaaauggccaacggaaucgcguuaggcuuaauggcuuuaaaacuuaucacgcaauucgagacuuaccaacuuuggacagcucuaauaagccuaacauguucuaauacaauuuuuacauugacaguagcauggagaacggcaacuuugaucuuagcgggaguaagucuacuaccagucugccaaagcagcucaaugcggaaaacugacugguuaccuaugacaguggccgcaaugggcguaccuccccucccacuuuuuauauuuucccugaaagacacucuaaaacgacggaguuggccccuaaaugaaggaguaauggcuguggguuugguauccauacucgcaucaucacuuuugcggaaugacgugccaauggcuggcccucugguugccggugguuuguugauagcauguuauguaauuacugguacaagugcagaccuaaccguggaaaaagcagcagacguaaccugggaagaagaagcugaacagacaggaguaucccauaaccucaugauaacaguagacgaugauggaaccaugcggauaaaagacgaugagacagaaaauauuuugaccgucuuacuuaagacagcacugcuaauagucucugggauauuccccuauucaauccccgcaacauuguuaguguggcauacuuggcaaaaacaaacccaaagaucagggguauuaugggauguaccgagcccuccagagacucaaaaggcagaauuggaggagggcguauaucgcauaaagcaacaagguaucuuuggaaagacacaaguuggcgucggagugcagaaagagggcgucuuucacacaauguggcauguaacacgcggagcagucuugacauauaauggcaagagacucgagccgaacugggcaaguguaaagaaagaucuaaucucauauggaggaggauggagauuaucugcucaauggcagaaaggagaagagguucaaguuauagccguggaaccgggcaaaaauccgaaaaauuuccagacaaugccgggcaccuuucaaacaacaacgggcgaaauaggggcaaucgcccuagacuuuaaaccuggcacgaguggaaguccgauaauuaaucgagaaggaaaaguagucggauuauacgggaauggaguaauuaccaaaaaugggggcuaugucucgggaauugcgcagacaaaugcagaaccagacgggccaaccccagaacucgaagaagaaauguuuaagaagcguaacuugaccauaauggaucuacauccuggaagcgggaagacacggaaguauuuacccgcaaucgucagggaagcaaucaaacggagacuacgcacccugauuuuagcaccaacacgcgucguagcagcugaaauggaagaggcacuaaaaggguugccaaucagauaccaaaccacagcaacaaagucggagcauacagguagagaaauaguggauuuaaugugucaugccacauuuacuaugcgauuauuaagcccaguaaggguacccaacuauaaucugauaauuauggaugaagcccacuuuacugacccggcaucgauugccgcgcgaggauacaucagcacaagggugggaaugggugaagcggcugcaauauucaugacugccacacccccugguacugcagacgcauuuccccaaucaaaugcaccuauacaagaugaagagagagauauuccagaaagguccuggaacucaggaaacgaauggauaacggacuucgcagguaaaacuguaugguuuguaccaagcauaaaagcagguaaugauauagccaauugucuucguaaaaauggaaagaaaguaauccaauuaaguaggaagacauucgacaccgaguaucaaaagacaaaauuaaaugacugggacuuuguaguuacaacugauaucagugagaugggagcaaacuuuaaagcagauagagugauagauccaaggcguugucucaaaccaguaauacuaacugacggaccggaaagaguaauccucgccgggcccaugcccguaacagcggcaagcgcugcccagagacgagggcgaguggggagaaauccacaaaaagaaaacgaucaauauauauuuacaggacaaccauuaaacaacgaugaagaccaugcccauuggaccgaagcaaaaauguuauuggauaauauuaauacaccagaagguaucauacccgcacuguucgaaccagagagagagaaaucggcggcaaucgacggagaauauagauuaaaaggcgagucaaggaagacuuuuguagaacugaugagaaggggagauuuaccgguguggcucgcgcacaaaguagcgucugagggaauaaaguauacugacagaaaauggugcuucgauggucaaagaaauaaucaaauauuagaggagaauauggaugucgaaauuuggacuaaggaaggagagaagaagaaauugaggccccguuggcuugaugcaagaacauacucagauccuuuagcucugaaagaguuuaaagauuuugcagcuggcaggaaaucaauugcgcuagacuuggucacugaaauaggacgagucccaucacaccuggcccauagaacuagaaaugcacuagacaauuuaguaaugcuccauacaagcgaacaugggggaaaagcauaucgucaugcuguagaagaacugccugaaacaauggaaacacuucugcuuuuaggacuuaugauuuuguugacaggaggagcuauguuguucuugauaucagggaaggggauagggaaaacgucaauuggcuuaaucuguguaauagcaucgucagggauguuauggauggcggaaauuccuuugcaauggauagccagugcgaucguacucgaauuuuucaugauggugcuauuaauuccagaacccgaaaaacaaagaacaccucaagauaaccaacuagccuacguuguaauaggcauccuuacguuggccgcuauaauagccgcaaacgaaaugggguuguuagaaacgaccaaacgagacuugggcaugucuaaagaaccuggaguuguuagcccgacauccuacuuagauguagaucuccacccagcaucugcuuggacguuguacgcggucgcaacaacaguaauuacaccuauguuacggcacacuauagaaaauucuacggcaaacgucucccucgcggcaauagcaaaucaggcaguuguauugaugggauuagacaaaggauggccaauaaguaagauggaccuagggguaccauuacuggcauuaggauguuacagucaagucaacccauuaaccuugacugccgcgguucuccuccuaauuacacacuacgcuauaauaggucccggccuucaagcuaaggccacacgagaagcucagaaacggacggcagcaggaauuaugaagaacccgacgguagauggaauuaugaccauagaccuagauccuguuaucuaugacucgaaguucgaaaagcaauuaggccaaguaaugcucuuaguuuuaugugccguacaacuccugcuuaugcguacaaguugggcuuuaugugaagcucucaccuuggccacaggaccgaucacaacguuaugggaagggaguccgggaaaguuuuggaacacaacaauugccguuagcauggcuaacauuuucagagggucuuaucuagccggcgccgguuuggcauuuagcaucaugaaaaguguugggacuggaaaaagaggcacagguucacaaggcgaaacauugggagaaaaauggaaaaagaaacuaaaccaauuaaguagaaaagaauuugaccuauacaagaaaucaggaaucaccgagguugaucggacggaggcuaaagaaggucucaaacgaggcgagauuacacaccacgccguuucucgagguucagcuaaacugcaaugguuuguagagcguaauaugguuauaccagaaggucgaguuauagauuuaggaugugggcgcgguggauggucuuacuauugugcaggacuuaagaaagucacugaaguaagaggauacacuaagggaggaccggggcaugaagaaccaguaccaaugagcacauacgguuggaacauuguaaaauuaauguccgguaaagacgucuucuacuuaccuccugaaaaaugugauacccuucuuugugauauaggagaaucaucaccgaguccaacuguggaggagaguaggacaauaagaguauuaaaaaugguagaaccaugguuaaagaacaaccaguuuugcauaaagguauuaaacccuuauaugccuacagucauagaacaucuagaacgauuacaaagaaaacauggaggaaugcuagugcgaaauccguugucaagaaauucgacacaugaaauguacuggauuucuaauggaacagggaacauuguugccucuguaaacauggugucgagauuacuacucaauagauuuacaaugacgcacagacguccaaccauagagaaagauguggaccucggagcggguacuagacaugucaaugcagaaccugaaacacccaacauggacgugauaggugagcgaauaaaaagaauaaaagaagaacacaauaguacguggcacuaugaugaugagaauccguauaaaacaugggcguaucacggcucuuaugaaguaaaagcaaccgggucagccuccucuaugauaaauggaguagucaaauuauugacaaaaccaugggauguagugcccaugguaacgcaaauggcaaugacugauacuacaccauuugggcagcaacguguguucaaggagaaggucgacacaagaacaccacggucgaugccaggaacucguaggguaaugggcauuacagcugaaugguuauggagaacgcugggaaggaauaagaagccuagauuaugcacaagagaagaauuuaccaagaaaguacgcacgaaugcugcgaugggcgcuguguucacggaagaaaaucaaugggacagugcgaaagcggcuguagaagaugaggauuuuuggaagcuaguugacagagaaagagaauugcauaaauugggaaaguguggauccuguguauauaauaugauggggaaacgcgagaagaaauuaggagaguucgguaaagcaaaaggauccagagccauaugguauaugugguuaggagcuagauaucucgaguuugaagcgcuagguuucuugaacgaggaccauugguuuagucgugaaaauucauauagcgguguggagggcgaaggauuacacaaacuuggguacaucuuaagagauauuagcaagauuccaggaggcgcaauguacgccgacgauacugccgggugggauacaagaauuacugaagaugaucuacauaaugaagagaaaaucacccaacagauggacccugagcauagacaacuggcaaaugcgauauuuaaacucaccuaccagaauaaaguaguaaagguacaaagaccaacaccaaccgguacaguaauggacauuauuaguagaaaagaucaacgaggaagcggccaaguagguacuuauggucuuaacacguuuaccaacauggaagcacaguuaauaaggcagauggagggagagggaguacuuucuaaagcugauuuggaaaauccacaucugccagagaaaaagauuacacaauggcuggaaacaaaagggguagaaagauuaaaaagaauggcaauaucuggagaugacugcguaguaaaaccaauugaugaccgguuugcuaaugcauuacuagcacucaaugacaugggaaaagucagaaaagauaucccacaauggcaaccuucuaaagguuggcaugauuggcaacaagucccuuuuugcagccaccacuuucaugagcuaauaaugaaagacggccgaaagcuaguagugcccuguaggccacaggacgaacuaauagggagggcaagaauaucucagggggccggguggaguuuacgggaaacugcauguuuaggaaaagcauaugcccaaauguggucauuaauguauuuccauaggcgagaucugagacuggcauccaaugcaauuugcucugcaguucccguccauuggguaccaacuagccguacaacauggucgauccacgcccaucaccaauggaugacuacagaggauauguuaacuguuuggaauagagucuggauagaagauaaucccuggauggaagauaagacgccggugacuaccugggaaaauguacccuacuuaggcaaacgagaagaccaauggugcgguagucuuauuggauuaacuucacgugcaacgugggcgcaaaauauuccuacagcuauucaacaaguccgaucgcucaucggaaacgaagaauuucuagauuacaugccaucgaugaagagauuccgaaaagaagaagaaagugagggugcaauaugguag

SEQ ID NO: 23319 - RNA, 9873 nt, Artificial Sequence
  derived and/or modified CDS sequence (opt6) from DENV-3__EU726768__SS-prME
acuucccuaugccuaaugaugauauuaccggcggcauuggcauuccaucuaacaucucgagacggagaacccagaaugauaguagggaaaaaugaaagagguaaauccuuacuauuuaaaacagcuuccgggauaaauauguguacacuaauugcgauggaccucggugaaaugugugacgauacgguaacauacaaaugcccacacauuacagaaguagaaccagaagauauagauuguuggugcaacuuaaccucgacuuggguuacguacggaacauguaaucaagccggugaacacagaagagauaaaagauccguagcacuggcuccucauguaggaaugggucuugauaccaggacacagacauggauguccgcugaaggugcuuggagacaaguagaaaaaguagaaacuugggcucuuaggcacccaggauucacgauauuagcacuguuccuugcccacuacauuggaacaucuuuaacacaaaaaguugugauauucaucuugcuaaugcuagucacaccuaguaugacuaugcguuguguugguguuggaaaucgagacuucguggaaggauugucuggggccacauggguagauguaguacuggaacauggaggaugcguaacuacgauggccaaaaauaaaccuacacuagauauugaacuacagaaaaccgaagcaacccaguuagcuacauuacgaaaacucugcaucgaaggaaaaauaacaaauauuaccacagauucccguugcccgacacagggggaagcgguuuuacccgaagaacaagaccaaaacuacgucugcaaacauacuuacguagaccguggauggggaaacgguugcggccuguuuggaaaaggaucauuggucacuugugcgaaauuucaaugucuugaaccaauagaaggaaaagugguucaguacgaaaauuugaaauacacggugauaauaacaguacacacuggagaccaacaucaaguaggaaaugaaacucagggggucacugccgagauuacuccacaggcaaguacaacagaagccaucuuaccagaauauggcacccuaggccuagaaugcaguccgagaacaggacuggacuucaacgaaaugauacuccuaacgaugaaaaacaaagcguggaugguacaucgucagugguucuucgaucuaccacucccuuggacgaguggagccaccacggaaacgccuacuuggaaccgaaaagaauugcuuguaacauuuaaaaaugcacacgcgaagaaacaagaagucgugguucugggcucacaagaaggcgcaaugcacacugcacuaacuggugcaaccgaaauacaaaauucuggcgguacaucuauauucgccggucaucuaaaaugucgauuaaaaauggauaaauuagaacuaaaagguaugaguuaugcaauguguaccaauacuuucguacuaaagaaagagguaucagagacacagcacgggacaauucuuauuaaaguagaauauaaaggggaggacguuccaugcaaaauuccuuucucaacagaagacggccaagguaaagcacauaacgggaggcuuauuacggcaaauccaguagucacgaagaaagaggaaccgguaaacauagaggcugaaccacccuuuggugaaaguaauaucguaauuggaauaggagacaaugcucugaaaauaaauugguacaagaaaggcucaucuauuggaaaaauguuugaggcuacagcucgcggugcacgacgaauggcuaucuugggagacacugcuugggauuuugguuccguuggcggagugcuuaauucauuaggcaaaauggugcaccagaucuuugggagugcauauaccgcuuuauuuucaggaguaucuuggguuaugaaaauuggcauugggguguuguuaaccuggauaggauuaaauucgaaaaacaccagcaugucauucucaugcaucguaauaggaaucauuacucuauaccuaggugcgguuguacaggcagauaugggguguguaauaaacuggaaaggcaaagaacuuaaaugcgguuccgguauauuugugacaaacgagguacauacauggacugaacaguacaaauuucaagccgauucuccaaaaaggcuugcaacggccaucgccggagcaugggagaaugggguuuguggaauccguucgaccacuagaauggaaaaucuucucuggaaacagauagcaaaugaauuaaauuauauucuuugggaaaauaacauaaaauuaacgguaguuguuggagauauaauaggaguuuuggaacaaggaaaaaggacacugacaccucaaccuauggaauuaaaauacucguggaagacauggggcaaagcaaaaaucguuacggcagaaacacagaauaguucauuuauuauugacgguccaaauacgccagaauguccuagcgcaagccgagcauggaauguaugggaaguugaagacuacggguuuggcguauuuaccacuaauauauggcuuaaacuacgggagguuuauacucagcuuugugaucacagacugaugucugcagcaguaaaagaugaacgggcgguccaugcugacaugggcuacuggauagaaucgcaaaagaaugguucauggaaauuggaaaaggcgucacuaauagagguaaaaacaugcacauggccaaaaagucacacucuauggucgaacggaguuuuagaauccgauaugauaauacccaaauccuuggccggcccuauaagucaacacaacuacagaccagguuaccauacucaaacagcggggccuuggcacuuaggaaaacuagaauuagauuuuaauuauugugagggcacuacaguagucauaacagaaaauugcgguacucgaggaccuucacucagaacaacaacuguuaguggaaaacucauccacgaaugguguugcagaaguuguacauugccaccccuccgguacaugggagaagacggcuguugguacggaauggaaauaagaccgauuucggaaaaagaagagaacauggugaaaucccugguaagcgccgguucagguaaaguugacaacuuuacaaugggcguacuaugucuagcgauacuauuugaagaagucaugcgugggaaguuugguaagaaacauaugauagcggggguauucuuuacauuuguuuuauuacuuaguggacaaauuaccuggagagauauggcgcacacucuaaucaugaucggaucuaaugcaagcgauagaauggguaugggaguaacguauuuagcguuaaucgcaacauuuaaaauacaaccuuuucucgcauuaggauuuuucuugcguaaauugacaucacgcgagaaucugcuacugggcguuggacucgcaauggcuacgacccuacaauuaccagaggauauugagcaaauggcgaacggaauagcacucggacuaauggcucuuaaauuaauaacacaauuugaaacguaccagcuauggacagcccucaucucacuaacauguucaaauaccauauucacccuaacuguagccuggagaacugcaaccuuaauacuugcggggguuuccuuauuaccagugugccaaucaucuuccaugcgcaaaacagauugguugcccaugacuguagcugcaauggggguuccaccguuacccuuauuuauauucucacuaaaggacacucuaaaacgaagaucauggcccuuaaaugagggggugauggccguagguuuaguuucaauacucgcaucaaguuuacuaaggaacgauguaccuauggcugggccauuaguagcuggaggucuccuuauugcauguuacguaauaacaggcacgucagcugauuuaacuguugagaaagccgcagaugugacuugggaagaagaagcagaacaaacgggagugucacacaaccucaugauaacaguagacgaugauggaaccaugcggauaaaggaugaugagacagaaaacaucuuaacagugcuacuaaaaacagcacuacuaauuguaucagguauuuuccccuacucgauccccgccacauuguuaguuuggcauaccuggcaaaaacaaacgcagaggucugguguucuuugggaugucccuucgccaccagaaacccaaaaagcugaguuagaggagggaguauaucgaauaaaacagcaaggaauuuucggcaaaacacaaguaggcguuggaguacaaaaagaaggugucuuucacaccauguggcauguaaccagaggagcaguacucacauacaauggaaagagauuagaaccaaacugggcuucaguaaagaaagaucuuauaagcuauggaggaggauggcgccuuucagcccaguggcaaaaaggagaagaaguucagguaauagcagucgaaccgggcaaaaacccuaagaauuuucaaacuaugccgggaacauuucaaacaacuacaggugaaaucggagcuauugcacuggauuuuaaaccgggaaccucuggcagucccauaaucaauagagaaggcaaaguuguaggacuuuaugguaaugguguuguaaccaaaaacggcggcuauguaucaggaauagcacaaacgaaugcugaaccagacgguccuacaccagagcuugaagaagaaauguuuaagaaaagaaauuuaacaaucauggaucuacacccagguucaggaaaaacaagaaaauacuuaccagcaaucguccgagaagcgauaaagagacgccuaagaacucuuauauuagcuccaaccagaguugucgcggcugaaauggaagaagcacuaaaaggguuacccauaagguaucaaacaacggcaacaaaaucagaacacaccggcagggagauaguagauuuaaugugucaugccacauuuaccaugcguuuauugucgccaguccguguuccaaacuacaaucuuauaaucauggaugaagcucacuucacagacccagcuucaauugcagcaaggggauacauuucuacgcgagucggcaugggggaagcggcugcaauauucaugacugcuacuccuccagggacagcggaugccuuuccucagucaaaugcuccaauucaagacgaagaaagagauaucccagagcgcaguuggaacucggguaacgaauggauuacugauuucgcagggaaaacaguaugguuuguuccuaguauaaaggcugguaaugacauagcuaacugucucaggaaaaauggcaagaaaguuauacaacucaguaggaagacuuuugauacagaauaccaaaagaccaaauuaaaugacugggacuuuguugugacuacggauauaagcgaaaugggugcuaauuucaaagcugaucgugucaucgacccuaggcguugcuuaaagccaguuauacuaacagacggaccugaacgcgucauauuagccggaccaaugccgguuacggcagcaucagcagcucaaagacgcggccgcgugggucgcaacccucagaaagaaaaugaccaauacauauucacuggucaaccacugaauaacgacgaagaucaugcacauuggacggaggcuaaaaugcuacuugauaacauuaacacccccgaaggcauaauuccugcguuguucgagccagagagagaaaaaucggccgcuauugauggagaauaucgacuaaaaggggaaagucguaagaccuuuguggaauuaaugcgaagaggcgaucuuccuguaugguuagcgcacaagguagccuccgaagguaucaaguauaccgauaggaaaugguguuuugacgggcaaaggaauaaucaaauacucgaggaaaacauggauguagagauauggacuaaagagggcgagaagaagaaacuaagacccagaugguuggaugcacgaaccuauucagacccauuagccuuaaaagaguucaaagacuuugccgcaggaagaaaaucuauugcacuagauuuaguuacggaaauaggucgaguaccuucgcaccuggcccacaggacaagaaaugcuuuagacaaccuagugauguuacacacaagugaacauggaggaaaggcguaccgucaugcaguugaagaauuaccggagaccauggagacauuacuacuuuuagggcucaugauacuacugaccggcggugcuauguuauuuuugaucucgggaaaagguaucggaaaaaccucaauaggacuuauaugugugauagcaagcucugguaugcuuuggauggcugagauaccccuucaauggauagcaagcgcaaucguuuuggaguucuuuaugaugguacuauugauaccagaaccggaaaagcagcgcaccccgcaagauaaucaacuagccuauguggugauagguauucugacucuggcagcuauuauagcggcaaacgaaaugggauuacuagaaacuacaaaaagagacuugggaaugaguaaagaaccaggaguagugucaccaacaucauaccuagacguagauuuacauccagccucagccuggacacuauacgcagucgccacgaccgugaucacacccauguuaagacacacuauagaaaauucgacggcaaacgugagccuggccgcaauagcuaaucaagcugucguuuuaauggguuuggacaaagguuggccuauuagcaaaauggaccuuggagucccuuugcuugcacuaggcuguuacagucagguaaauccauugacucuaacugcugcuguuuuguuauuaaucacacauuaugcaauuauagguccgggacuacaagcaaaagccacacgugaagcccaaaaacgcacugcagccggaauaaugaagaaccccacuguggacggaauaaugaccauagaccuagacccagucauauacgacucaaaauucgagaaacaauuggggcaaguuaugcucuugguacucugcgccguccagcuucuccuuaugaggaccucgugggcucucugugaggcguuaacucuugcaacaggcccaaucacaacguugugggaaggaucgccagggaaauuuuggaacaccacaauagcaguaaguauggcaaauaucuuccguggcaguuaucuggcuggcgcaggguuagcuuuuucaauaaugaaaagcguaggaacaggaaaaagaggaacuggaucgcagggcgaaacacuaggagaaaaauggaagaaaaaguuaaaccagcuaaguagaaaggaauuugacuuguacaaaaagagcggaauaacugaaguagaccgcacagaagcaaaagaaggauuaaaacguggggagauuacacaucaugcgguaaguagggggagugcgaaauuacagugguuuguagaacgaaauaugguuauaccagaaggacggguaauagaccuaggcugcggcagaggaggauggaguuauuacugugcaggauuaaagaaaguuacugagguuagggguuauacuaaaggagguccaggccaugaagaaccuguaccuaugucaaccuacgguuggaauauaguaaaacucaugaguggaaaagauguauuuuauuugccuccagaaaagugcgauacgcuauuaugcgauauaggagaaaguaguccaagucccaccguagaggagagcagaacuauacgaguccuaaaaaugguagaaccauggcucaaaaauaaucaauuuugcauaaaaguacuaaauccauacaugccgacagugauagaacacuuagaaagguuacaaagaaaacacggugguaugcuagugcgaaaccccuuaagcagaaacuccacucacgaaauguauuggauuucaaacggaacaggaaauauagucgccagcgugaacaugguuucgcgucuacuuuuaaauagauuuacgaugacucauagacgaccaacaauagaaaaagauguugauuuaggugcaggaaccaggcauguaaaugcagaacccgaaacaccaaauauggauguaauuggagaacguauuaaacgaauaaaagaagaacauaauuccacauggcauuaugacgaugaaaacccuuauaagacgugggcauaucauggaucuuacgagguaaaagcaacugggucugcuucaaguaugauaaacgguguaguuaaauuguuaacuaaaccuugggacguaguuccuauggugacacaaauggccaugacggacacaaccccauucgggcaacaaagaguuuuuaaagaaaaaguagacacccguacuccacgaucaaugcccggcacacguagaguaaugggcaucacugccgagugguuauggagaacuuuaggaagaaauaaaaagccccgacugugcacgcgagaggaauuuacuaaaaagguccgaacuaaugcagcuaugggagcugucuuuaccgaagaaaaucagugggacagugcgaaagcugcgguagaagaugaagauuucuggauccuaguugauagagaaagggaacuacauaaacuuggaaagugcgggucuuguguuuauaacaugauggggaaaagagaaaagaaacuuggggaauuugguaaggccaaaggcucacgggcaauaugguauauguggcuaggggccagauaccuagaguucgaagcucuggguuuccuaaaugaagaucacugguucucgagagaaaauucauacucuggaguugaaggagaaggucuccacaaauuaggguacauauugcgcgauauaagcaaaauuccaggaggugcaauguaugcagaugacacggcuggaugggauacccguauuacagaggacgaucuccauaaugaggagaaaauaacgcaacaaauggauccugagcacaggcaacuugccaaugccauauucaagcucacauaccaaaacaaagucguuaaggugcaaagacccacgccaacaggaacuguaauggauauaaucucuaggaaagaccaaagaggcucuggccaaguuggcacguacggacucaacacguuuacuaacauggaagcgcaauuaauacgacaaauggaaggagagggaguacuaucaaaagcagaucuagagaauccucauuuaccggaaaagaaaauaacgcaaugguuggagacaaaagggguugaaagacuaaaacggauggccauuucaggagaugacuguguaguuaaaccaauagaugaccguuuugcaaaugcauuauuagcacuaaaugacaugggcaagguaagaaaggauauaccucaauggcaaccuucgaaaggguggcacgacuggcaacagguaccauucuguucucaccauuuccacgaguuaauuaugaaggacggaagaaagcugguuguuccaugcagaccucaagaugaauuaauugggagagcacgcaucucacagggagcgggauggucguuaagggaaacagcuugcuuaggaaaagcauaugcacaaauguggucuuuaauguauuuucaccgccgcgaccuacguuuagcuucgaacgcuauaugcucagcgguuccuguucauuggguuccgaccagcaggacaacuuggucuauccaugcacaccaccaauggaugaccacugaagacaugcuaacuguauggaauagaguguggaucgaagauaacccauggauggaagacaaaaccccggugacgacaugggaaaaugucccauauuuagggaaaagggaagaucaaugguguggaucucucauaggccuaaccucgagagccacaugggcacaaaacauuccaacugcaauacagcaagugcgaucacuaauuggaaacgaggaauuuuuagauuacaugccuucgaugaaaagauuccguaaagaagaagaaagugaaggugcaauuugguag

SEQ ID NO: 23320 - RNA, 9873 nt, Artificial Sequence
  derived and/or modified CDS sequence (opt6) from DENV-3__EU687226__SS-prME
acaucucuuugucuaaugaugauuuuacccgcggcacuugcauuucaccuaacuucgcgagauggugaaccacgcaugauuguagguaaaaacgaaaggggaaaaucccuauuauuuaaaacggcaaguggaauaaacauguguacuuuaauugcuauggaucuaggugaaaugugugaugacaccguaaccuauaaauguccgcauauaacugaaguggaaccagaagauauagauugcuggugcaaccuuacuagcacaugggugacguaugguacaugcaaucaagcaggagaacacaggcgggauaaacguucgguagcucuagccccacacguaggaauggguuuagauacccgcacacaaacauggaugucagcugaaggugcauggaggcaaguugaaaaaguagaaaccugggcccuacgacaccccggauucacaauacucgcacucuuucuugcgcauuacaucgggaccagucugacucaaaaaguagugauauuuauccuauugauguuaguaacucccaguaugacaaugagauguguuggaguaggaaaucgagauuucgucgaaggacuaaguggggcaacauggguugauguagugcuagaacauggagguugcguaacuaccauggccaaaaacaaaccgacguuagauauagaauuacagaaaaccgaagcgacgcaauuggcuacgcuaagaaaauuauguaucgaaggcaaaauaacuaauauuacuaccgauaguagaugucccacgcaaggagaggcgguuuuaccugaggaacaagaucaaaauuacguuuguaaacauaccuacguagauagaggcuggggaaacggcugcggauuauucgguaaagggucccuaguaacaugugcaaaauuccaaugucuggagccuauagaagguaaaguagugcaguacgagaauuuaaaauauaccgucauaauaacgguucauacgggugaccaacaucagguaggaaaugaaacgcaggggguaacagcagagauaaccccacaagcuaguacaacagaagcgauuuuacccgaguauggcacucuaggucucgagugcucgccacggacaggacuagauuuuaacgaaaugauauuacuaacaaugaaaaauaaggcuuggauggugcauagacaaugguucuuugacuuaccucuaccguggacuucaggggcaaccacggaaacaccuacguggaacagaaaagaacuucuggugaccuuuaaaaaugcucacgcuaagaaacaggaagucguaguacuugggucacaagaaggagcuaugcacacagcacuuacaggcgcuacagaaauacaaaauucuggaggcaccagcauuuuugcaggccacuugaaaugcagacugaaaauggauaaacuagaacucaaagguaugucguaugcaauguguaccaacaccuucguuuuaaagaaagaggugucugagacucaacaugguacuauacuuauaaaaguggaauacaaaggagaagacguaccauguaaaauuccauuuaguacggaagauggacaaggaaaagcucauaaugggaggcuaauaacagcgaaucccguuguaacuaaaaaggaagaaccgguaaacaucgaagcggagccaccuuucggugaaucaaauauuguaauaggaauuggggacaacgcuuuaaagauuaacugguacaaaaaggguuccucaauugguaaaauguuugaggcuacggcucguggcgccagaagaauggcgauccugggagauacagccugggacuuugguucaguuggagguguauuaaacagccucggcaaaauggugcaucaaauauucgggagugcauacacagcgcuguuuucagguguaucguggguaaugaagauuggaauagguguucuguuaacauggauaggccugaacagcaaaaauacaucuaugucuuucuccugcauugcaauagggaucaucacucuauauuugggugcuguuguucaggccgacaugggaugcguaaucaauuggaaggguaaagaguuaaaaugcgggucaggaauauuuguaaccaaugaaguacauacauggacagaacaauauaaguuucaagcugacagcccaaaacggcuagcuacugcaauugcaggagcgugggaaaacgguguauguggaauaagaagcacaaccagaauggaaaaccuauuguggaagcagaucgcgaacgaauuaaacuauauacuaugggaaaauaauauuaaacuaacuguuguaguuggugauauuauugguguccucgagcagggaaaaagaacucuaacaccccagccuauggaacuaaaguauucuuggaaaacauggggcaaagcaaaaaucguuacagcugaaacgcaaaauucuaguuuuauuauugaugggccuaauacacccgagugcccuucagccucaagagcauggaaugucugggaaguugaggacuacggauuuggggucuuuacaacgaauauauggcuaaaacuaagagaagucuauacacaacuuugcgaccaccgacugaugucagcugccguaaaagacgaaagagcaguacaugcugacauggguuacuggauagaaagucagaaaaauggauccuggaaguuggaaaaagccucuuugauagaggugaaaacuuguacauggcccaaaagccauacccuaugguccaacggaguacuugagagcgauaugauuauacccaaaucccuagccggaccaaucucacaacauaauuacagaccaggauaccauacucaaaccgcugguccuuggcaccuuggaaagcucgaauuagauuuuaauuacugugaagguacgaccguaguaauaaccgaaaacugcgguacaagaggcccuuccuuacgaacuacaaccgugucaggaaaacuaauucaugagugguguugucguaguuguacgcuaccaccguuaagauauaugggcgaagaugguuguugguacgguauggaaauuagaccuguaagugaaaaggaggagaauaugguaaagagcuuaguaucagcuggaucugggaaaguugacaacuucacaaugggcguauugugccuugccauccuuuuugaagaaguaaugcggggaaaauuugguaagaaacacaugaucgccgguguauucuuuacauuuguacucuuauuaagcggacaaauaacuuggagggauauggcucauacacuuauaaugauuggaagcaaugcuuccgacaggaugggaaugggcguuaccuaucuggcacuaaucgcaacguucaaaauacaaccuuuucucgcucucggauucuuucuucguaaauuaacgagccgagaaaaucuacuacucggaguagggcuagcgauggcuacaacauugcaacuccccgaagauaucgaacaaauggcgaaugggauugcucuaggacugauggcacucaaacuuauaacacaauuugaaaccuaccaauuauggacagcucuuauaaguuuaacauguagcaauacuauauuuacccuaacuguagcauggagaacagcaacacuaauacucgcaggagugucgcuccuaccagugugucaaagcagcaguaugcgaaaaaccgauugguuaccaaugacugucgcagcaaugggaguaccuccucuaccacucuucauauuuucgcuaaaagauacacugaaacguagaucauggccacugaaugaaggaguaauggcuguagguuugguauccaucuuggccucuucacuucuaagaaaugaugugccaauggccggaccgcuaguugcagggggucuguuaauagccugcuaugucauaacagguacaucugcagauuugacaguagaaaaagcugcggacgugacaugggaggaagaagcugaacaaaccgggguuagucacaaccuaaugaucacuguagaugacgaugguacuaugcgcauaaaagacgaugagacagaaaacauucucaccguguuacugaagacagcuuugcuaauagucucagggaucuuuccuuacucuauuccugccacguuauuaguauggcacacauggcauaaacaaacacaacgaaguggcgucccgugggauguaccauccccgccagagacucagaaagcggaguuagaagagggcguguacaggauaaaacaacaaggaauauuuggaaaaacccaaguugguguaggaguucaaaaagagggggucuuucacucaauguggcauguaaccagaggggcaguauuaacauacaacgggaagagguuagagccuaacugggcaucagucaagaaagacuuaauaucguauggaggaggauggagauuaagugcacaguggcaaaaaggagaagaaguucaaguaauagccguagaacccggcaaaaacccgaaaaacuuucaaacaaugccagguacauuucaaacaacaacaggggaaauaggugcgaucgcucuagauuuuaaaccaggaacaagugggaguccgaucauaaauagagaggguaaagucguuggucuuuacgguaacggaguugucacuaagaacgguggauacguaucuggcaucgcacaaaccaacgccgaaccagauggaccgacuccggaacuggaggaagagauguuuaaaaagaggaacuuaaccauuauggauuuacaccccggaucuggaaaaaccaggaaauauuugccagcaauuguacgcgaagcaaucaaaaggcgccucaggacauuaauuuuagcuccgacccguguuguugcagccgagauggaggaagcauuaaaaggucuaccaauucgcuaccaaaccaccgcuacuaaaucugagcauaccgguagggaaauuguugacuugaugugucacgcaacauucacaaugagauuguuaucaccgguaaggguucccaacuacaaucuaauuauaauggacgaagcacauuuuacggauccggcuucaauugccgcucgugguuacaucuccacgcgagucgguaugggagaagccgcggccauauucaugaccgcuaccccgccggguacagcugaugcauuuccccaaucgaaugcacccauacaagacgaagaacgagauauccccgagagaucauggaauagugguaacgaguggauaacggacuuugcuggaaaaacugucugguucguaccaaguauuaaagcggguaaugacaucgcaaauugucuacggaaaaauggcaagaaaguaauucaacuaaguagaaagaccuucgauacugaauaucagaaaacgaaguuaaacgauugggauuucguaguuacgaccgacauuuccgaaaugggagccaacuuuaaggcagaccgcguaauagaucccagaagauguuuaaaaccagucauucuuacugaugggccagaacgagugauuuuagcugguccgaugccaguuacggcagcuucagccgcacaaagaagaggcagaguaggaagaaauccucaaaaagaaaacgaccaauauauuuucaccggacagccgcugaauaaugacgaagaucaugcucacuggacagaagcaaaaaugcuauuggacaacauaaauaccccagaagguauaauucccgcucuauuugagccagagcgagagaaaagugcggcaauagauggugaguauagauuaaaaggagaaucgcgaaagacguucguagaguuaaugagacgaggagaucuaccagucugguuagcacacaaaguggcuucugaagggaucaaauacacagaucggaaaugguguuuugacggacaaaggaauaaccaaauacuagaagaaaauauggauguggaaauauggacuaaagaaggugagaaaaagaaauuaagaccacgcuggcucgacgcuagaacauauucagacccacuagcgcucaaagaguucaaagauuuugcggcaggaagaaaauccauugcguuagauuuaguaacagaaauaggaagaguucccagccaucucgcccauaggacacgcaacgcucuggacaauuuaguuauguuacauaccucggaacacggcggaaaagcauacagacaugcaguugaagaacuaccggaaacgauggagacgcuucuauuacuagggcuaaugauccuucuaacugggggagccaugcuauuccucauaucuggaaaaggaaucggcaaaacgaguauuggccuaaucuguguuauagcaagcuccggcaugcuauggauggcggaaauaccccuacaauggauagcaucagcaauaguccuggaguucuucaugaugguucuucuaaucccggagcccgaaaaacaacgcacuccucaggacaaucaauuagccuauguggugaucggcauucuaacccuagcugcuauaauugcagcuaacgaaaugggauuacuagaaacaacaaagagagacuuagggaugagcaaagaaccagggguagucaguccaacaaguuauuuagaugucgaucuccauccggcuagcgcguggacauuauaugccguagcaacaacuguaauaacuccuauguugagacauaccauugaaaauucuacggcuaaugucucacuugcagccaucgcaaaucaggcggugguucucaugggcuuagauaagggguggccaauuucgaaaauggacuuaggaguuccauuacuggcucuaggcugcuauucacaaguaaauccguuaacacuuacggcagcgguauuguuauugauuacccacuaugcaauuauaggaccaggacuucaagcaaaagcgacuagagaggcacaaaagcgaacagcagcgggcaucaugaaaaauccaacgguagaugguaucaugacaauagacuuagauccagugauauaugacaguaaauuugagaaacaauuagggcaaguaaugcuccuaguccuaugugcaguccagcugcuguugaugcgaacgucuugggcguuaugugaagcacuaacguuagcaaccgggccuauaacaacauugugggaagggaguccaggcaaguuuuggaauacaacgauugcaguuaguauggccaacauauuucgagguaguuaccucgccggagcaggacuagcauuuucaaucaugaaaucagucggaaccgguaagcgcggaaccggaucacaaggcgaaacguuaggagaaaaauggaagaagaaauuaaaucaauugagucgaaaagaauuugacuuguauaagaaaucagguauaaccgaaguagauaggacagaggcuaaagaaggauuaaaaaggggcgagaucacucaccaugcuguuagucggggauccgcaaagcuccagugguucguagaaagaaauaugguaauaccagaagguaggguaauagaucuaggcuguggccgaggcggcuggagcuacuauugcgcugguuuaaagaaaguuaccgaaguaagaggauacaccaaagguggcccgggacaugaagaacccguuccaaugaguacuuauggcuggaacauugugaaacuaaugucuggaaaagacguauuuuaucuaccaccugaaaaaugcgacacauuacuaugugacaucggggaaaguucgccgucaccuacgguugaggagucuagaacgauacgaguccuaaaaaugguagaaccguggcucaagaauaaucaauucugcauaaaaguauugaauccauacaugccaacaguaaucgaacauuuagaacggcuucagcggaaacauggaggaauguuaguacgaaauccauuaagcaggaacaguacucaugaaauguacuggauaucuaauggaacaggaaauauuguugcuucaguaaauauggucagcaggcugcuccuuaauagauuuacuaugacucaucgucggccgaccaucgaaaaggacguggaucucggagcaggcacaagacaugucaacgcggaacccgaaacgccuaauauggauguuauaggugaacgaauaaaacggauuaaagaagaacacaauucaaccuggcacuacgaugaugaaaacccuuauaagaccugggcauaccacggcaguuaugaaguuaaagcuacuggaucggcauccaguaugauaaauggagucguuaaguuauuaacaaagccuugggauguugucccaaugguuacccaaauggcaaugacagauacuacuccguuuggacaacaacgugucuucaaagaaaaggucgacacaagaacucccaggaguaugccggguacaagacgugugaugggaauuacagcagaaugguuauggagaacacuugguagaaacaagaaaccaagguuauguacucgagaagaauuuacuaagaaagucagaaccaaugcagcuaugggggcgguauuuacggaagaaaaucagugggauuccgccaaggcagccguagaagaugaggacuucuggaaacucgucgacagagaacgugagcuacacaaguuagggaaaugcggaagcugcgucuauaauaugaugggcaagagagagaagaaacuaggcgaguucgguaaagcaaaaggaucaagagcaaucugguacaugugguugggagcuagauaucuugaauuugaagcccugggauuuuuaaaugaggaccacugguucaguagagaaaacucauauucuggcguggagggagaaggacuccacaaacuggguuauauacuaagagacaucaguaaaaucccggguggagcaauguacgcagacgacacagcaggaugggauaccagaauuacagaagaugauuuacacaaugaagagaaaaucacucaacagauggacccagaacauaggcaauuagcaaaugccauuuucaaguuaacuuaucaaaacaaaguagugaaaguccaaagaccaacaccuacaggcaccgugauggacauuaucagcagaaaagaccaacgcgguagcggacagguaggaacauacgguuuaaauacuuuuacaaauauggaggcacaauuaauacgacaaauggagggugagggagucuuguccaaagcagacuuagagaauccacaucuaccagagaagaaaauuacgcaguggcucgaaacuaaaggaguggaaagguuaaaacgcauggcuauaucaggggaugauugcguugugaaaccaauagaugauagauucgcaaacgccuuauuagcccuaaacgauauggguaaaguaagaaaagauauaccccaguggcagccgucaaaaggcuggcacgauuggcagcaaguuccauuuuguucgcaccauuuccaugaacuuaucaugaaagauggacguaagcuagugguaccaugcagaccucaagacgaacuaaucggccgagcaaggaucucacaaggagcaggguggucacuacgggagacagcaugucugggcaaagcauacgcccaaauguggucccugauguacuuucaucguagagaucuucgacuagccagcaaugcaaucuguucagcuguaccaguucauuggguaccaaccagucguaccaccuggucgauacaugcacaucaccaauggaugacuacugaagauauguuaacuguauggaaucgaguauggauagaagauaaccccuggauggaagacaaaacacccguuaccacaugggaaaaugucccuuaccuuggaaaaagagaggaccaauggugcgggucucuaauuggacucacaaguagagccacaugggcccagaacauaccaacugcuauacaacaaguuagaucacuaauugguaacgaagaguuuuuggacuauaugccaagcaugaagcguuuuagaaaagaagaggaaucagagggugcaaucugguaa

SEQ ID NO: 23321 - RNA, 9876 nt, Artificial Sequence
  derived and/or modified CDS sequence (opt6) from DENV-3__EU687233__SS-prME
acgagccugugccuaaugaugauucuaccagcggcacuggcauuucaucuuacuagcagagacggagaaccgagaaugauaguugggaaaaacgaacgcggaaaauccuuacuauucaaaacggcaucuggaaucaauauguguacacuaauagccauggaccuaggugaaaugugcgaugacaccguaaccuacaaaugcccucauauugcagaaguagaaccugaagacaucgacuguuggugcaacuuaacaaguaccuggguaacguaugggacguguaaccaagccggcgaacacagacgagacaaaagaucgguagcauuagccccucacguagggaugggauuagauacuaggacacaaacauggaugagcgcagaaggggcauggaggcaaguagaaaaaguagagaccugggcucuacgacacccaggauuuacuauacucgcacuuuuucuagcacacuacauaggaacgucuuuaacccagaaaguggugauauucauucugcuaaugcuaguuacacccagcaugaccaugcgcugugugggugucggaaauagagacuucguagaaggucuaaguggagcaacuuggguagauguaguucuagaacacggaggguguguuaccacaauggccaaaaacaaaccuacccuugacauagaauuacagaaaacagaggccacccaacucgcgacucuaaggaaacuaugcauagaagggaaaauaacaaacauaacaacggacaguagguguccuacacagggugaagcggucuugccagaggaacaggaucaaaauuauguaugcaaacacacauacguagaucgaggauggggaaauggaugcggauuauuugguaaaggaucauuagugacuugcgcuaaauuucaauguuuagaaccaauagaaggaaaagugguucaauacgagaaucuuaaauacacuguaauaauuaccguccauaccggagaucaacaucagguagguaaugaaacacagggagucaccgcagaaauaacuccucaagcaucaaccacagaagcuauucuuccagaauauggaaccuugggccuagaauguucgccaagaacgggauuagacuuuaacgaaaugauucucuuaaccaugaaaaauaaagccuggaugguacaucgacagugguucuuugauuuaccacuaccuuggacaagcggagcaacaacugaaacgccaacguggaaucggaaagaacucuuaguuacauucaaaaacgcucacgcaaagaaacaagaaguuguagugcuggguagccaggaaggcgcuaugcauaccgcacuaacaggcgcuacugagauacaaaacucaggaggaacaucuauauucgcagggcaucugaaaugccggcuuaaaauggauaaguuagaguuaaaggguaugucguaugccauguguacaaacaccuuuguucucaagaaagaagugucugaaacucaacaugguacuauuuuaauaaaaguagaauauaaaggagaggacguucccuguaagauaccauuuaguacggaagauggacaaggaaaagcucauaacggaagacucauaacugccaaccccguaguaacgaagaaagaagaacccguaaacauagaagcggaacccccauuuggugagaguaauauagugauaggaauaggagauaacgccuuaaaaaucaauugguacaaaaaggguucaucaauugguaaaauguuugaagcaacagcgcguggcgcacgucgaauggcuauacucggggauacagcgugggauuuuggauccgugggcgguguguuaaauucccuaggaaagaugguacaccagauuuuugggagugcguacacggcacuguuuucagguguauccugggucaugaaaaucgguauuggaguacuauuaaccuggauuggacucaauucaaagaacaccagcaugucauucucguguauagcuauugguauaauuacauuauaccuaggagcagugguacaagcggauaccggcugcguaauuaauuggaaaggcaaagaauugaagugugguucgggaaucuuuguaaccaacgaaguacauacauggacagagcaguacaaauuucaagccgacucaccaaaacgauuagcuacagcaauagcgggugccugggaaaacggcguaugcggaauaaggagcacgaccaggauggaaaacuuauuauggaagcagauugccaacgaauuaaacuacauucugugggaaaacaauauaaaacuuaccguaguuguaggugauauaaucgguguccuagaacagggcaaaaggaccuuaacuccucagccaauggaacuuaaguauaguuggaagacguggggaaaagcaaaaauuguuacggcggaaacacaaaauagcucauucauaauugauggaccuaauacgccagaaugcccaagcgcgucuagagcauggaaugucugggaaguagaagauuaugguuuuggaguguucacaaccaauauauggcuaaaauuacgagaagucuauacccaauuaugugaccacagacucaugagcgcagcagucaaagaugagagagcaguucaugcagauauggguuacuggauagaaucacagaagaauggaucuuggaagcucgaaaaagcaaguuuaauagagguuaaaacguguaccuggccuaaaucccacacauuauggagcaacggaguacuugaaagugauaugaucauaccuaagaguuuggcagggccaauaucacaacacaacuaccguccugguuaucauacacaaacagcgggaccuuggcaucucggaaaauuagaauuagauuucaacuauugugaagguaccacugucguuauaacagagaauuguggaacaagggggccgucauuacgaaccacaaccguaucgggaaaacuaauccacgaguggugcuguagaucguguacacuacccccauugcguuauaugggagaggacggaugcugguaugggauggaaauucgucccauaagcgaaaaagaagaaaacauggucaagucauuggugagugcggguaguggaaaagucgauaacuucaccaugggaguccuuuguuuagcuauauuauuugaagaaguaaugagaggaaaauucgguaaaaagcacaugauagccggaguguucuuuaccuuuguacuguuguugucuggccaaauaacuuggagggauauggcucacacccuaauaaugauagggucgaacgcuucugacaggaugggaaugggaguuacauaucuugccuuaauagcuacguucaaaauacagcccuuccucgcacuaggauucuucuuaagaaaauuaacauccagagaaaaccuauuauuggguguaggccuagcaauggcaaccacacuccaacuacccgaggauaucgagcagauggccaacggaauagcccuuggucuaauggcacuaaaacuuauuacacaauucgaaacauaccaacuguggaccgcgcuaaucagcuuaacauguaguaauacaauauuuacucuuacagucgcauggcgaacugcaacacuaauuuuggcuggcguuucguuacucccaguaugucaaucgucgucuaugagaaaaagugauuggcuaccuaugacggucgccgcgauggguguuccaccccugccacuguuuaucuucucucuaaaagacacccuaaagagacggaguuggccacucaaugaaggugucauggccgucggcuuaguaucaauacuagcaagcucacuacucaggaaugacguacccauggcaggacccuuaguugcgggaggauuacuuaucgcguguuauguaauuacggguacaucugcagacuugaccguagaaaaggcggcggauguaacgugggaagaagaagccgaacaaacagggguaucccacaauuuaaugauaacaguggaugaugaugggacgaugcgaauaaaagaugaugaaacugaaaacauccuaacagucuuacuaaagacagcguuacuaaucguaucaggaauauuuccauauucgauaccugcuacucuuuuaguauggcauaccuggcaaaaacaaacaagaaggaguggaguacuuugggaugugccuaguccgccagaaacccaaaaagcugaauuagaagaaggcguauauagaauaaaacaacagggaaucuucggaaaaacacaaguagguguaggugugcaaaaagaaggaguauuucacacaauguggcacguaacacgcggcgcaguccuaacguauaacggaaaaaggcuagaacccaacugggcaucuguuaagaaagaucuuauaucuuacggugguggguggagacugucugcacaguggcaaaaaggagaagaaguucaggucaucgcgguugaacccggcaaaaaccccaaaaacuuccaaacaaugccaggaacauuucaaaccacuacgggggagauuggcgcaaucgcauuagacuucaagccugguacuucagggucucccauaaucaaucgcgaaggaaaaguggucgguuuauauggcaacggugucguuaccaaaaacggaggauacguaagcggaauugcucaaacgaaugcugaaccagauggaccuacuccugaacuggaagaggaaauguuuaagaaaagaaauuugacgauaauggaucuacauccaggaucagguaaaacuaggaaauacuuaccagcgauagucagagaagcaaucaagagaagacuacgaacauuaauucuagcaccaacucgaguaguggcggccgaaauggaggaggcguuaaaaggacuaccuauuagauaucaaacaacagcaacaaaauccgaacauacuggacgcgagauuguagacuuaaugugucacgcgacuuucaccaugagauuauuaagcccagugagaguucccaacuacaauuugauaaucauggacgaggcacacuuuacagauccugcgucaauagcugcaagaggauauaucucgacaagagucggcaugggugaggcugcugcuaucuucaugacagcaacuccaccaggcaccgcagacgcauucccacaauccaaugcaccaauacaagacgaagaacgggauauaccagaaagaagcuggaauaguggcaaugaauggauaacugacuucgcaggaaaaaccguuugguuugugccuucaauaaaagcaggcaacgauauugcaaauugucuuagaaagaaugguaaaaagguuauucagcugaguagaaaaacauucgauacagaauaucaaaagacgaaacuaaacgacugggauuuuguaguaacuacugauauaucugaaaugggugcaaauuucaaagcagauagagucauugauccaagacgcugccuaaaaccggucauuuuaacagacggcccugaaaggguaauacuagcagggccaaugccuguaacugcugccucggcagcacaaagacguggaaggguaggacgcaauccacaaaaagagaacgaccaguauauuuuuacuggacaaccauuaaauaacgaugaagaccaugcacacuggacugaagcaaaaaugcuacuugauaauauaaacacucccgaaggaaucauaccagcccuauuugaacccgaaagagaaaaguccgcggcaauagauggagaauaucgacuuaaaggugaaagcagaaaaaccuuuguagaauuaaugcgaagaggugaucuucccguuugguuagcucacaaaguagcaagcgaaggcauaaaauacacugacagaaaguggugcuuugacggucagcgaaauaaucaaauacuggaagagaauauggacguagaaauuuggacgaaggagggagagaaaaagaaacuucguccaagauggcuugaugcuagaacguauucagacccacuggcacuaaaggaauuuaaagauuuugcugccggaaggaaaucaauugcauuagacuuggugacggaaauaggccgcgugccgagucaccuagcgcauagaacaaggaaugcauuagacaaucuugugauguuacauacgucagaacaugggggaaaagcauaucgacacgccguagaggaacuaccagagacaauggaaacccuuuugcuacuagguuuaaugaucuuacuaacagggggcgcaaugcucuuucucauaucaggaaaagguauagggaaaacgucuaucggcuugauauguguaauugcaucaucaggaaugcuauggauggcagaaauaccccuacaauggauagcuucagccaucguacuagaauuuuucaugauggucuuauuaauuccagaaccugaaaagcaacggacaccacaagauaaucaauuagcuuacguagugauaggcauucugacccuagccgcaauuaucgcggcaaaugaaaugggauugcuggaaacaaccaaaagagaccuaggaauguccaaagaaccaggcguaguaucaccuacauccuauuuagauguggaucugcacccagcuucugccuggacgcuguacgcgguagccacuacaguuauaacuccuauguuaagacauacaauugaaaacucaacggcaaacguguccuuagcagcgauagcaaaccaagcaguggucuugaugggucuagauaaaggauggccaauuagcaaaauggacuuagguguaccguuacuugcccucggguguuauucccaggucaauccacuuacacuaacagcagcuguccuccuauugauaacacauuacgccaucauaggacccggccuacaagcaaaggcuacacgugaagcgcagaagcguacggcagcugggauaaugaaaaauccgaccguagacggaauuaugaccauugaccuagacccagugaucuacgacaguaaguuugagaaacaguuaggccaaguuaugcuacucguucuaugugcaguccaguugcuguuaaugcguacaaguugggcgcuuugugaagccuuaacacuagccacaggcccaauuacuacccuaugggagggcucaccugguaaguuuuggaacacaaccauugccguuuccauggcuaacauauuuaggggguccuaccuugcgggcgcaggcuuggccuuuucuauuaugaaaagcguagguacaggaaaacguggaacuggaucucaaggagaaacgcucggugaaaaauggaagaagaaacuuaaccaguuaagccgaaaagaauuugaucuuuacaaaaagucaggcauaacugagguugacagaacugaagcuaaagaaggacuaaaacgaggugaaauaacgcaucacgcaguuaguagggggagugccaaguugcagugguucguugaacguaauaugguaauaccagaaggaaggguaauugaccuuggaugcgggagaggaggauggagcuauuauugugcuggacuaaagaaaguuacagaaguaagaggauauacaaaaggaggaccaggacaugaagaaccuguaccuaugaguacauauggauggaacauaguuaaacuuauguccgguaaagacguuuucuaccuuccaccggagaagugugauacacuucuaugugauauuggcgagucaagucccucuccaaccguggaggaaucacgaacaauaaggguuuuaaaaaugguugaaccuuggcuuaagaacaaccaauucuguauaaaaguccuuaauccguacaugccuacuguuaucgaacaccuagaacgucuacaacguaaacaugggggaaugcuuguacggaauccauuaucacgcaauuccacucacgaaauguacuggauauccaauggaacuggcaacauaguugccucagugaacaugguaucccgccuauugcuuaaucgcuucacaaugacacauagaagaccaacuauagagaaagauguagacuugggagccgguacucggcauguaaacgcagaaccagaaacgccaaauauggacguuauuggagaacgaaucaaaagaauaaaagaagaacacaauuccaccuggcacuacgaugacgaaaaucccuacaaaaccugggcuuaucaugggucauaugaagucaaagcgacuggcucugcaaguagcaugauaaauggaguaguuaaauuacucacuaagccaugggaugugguccccauggucacacagauggcaaugacugauacaacuccauucggacaacaaagaguauucaaagaaaagguagauacacgaacuccuagaaguaugccuggcacgcguaggguaaugggaauaacggcagaaugguuauggcgcacacuggggaggaauaagaaaccuagacucugcacucgugaggaauuuacuaagaaaguaagaacuaaugcggccaugggggccguuuucacagaggagaaucaaugggauucagcgaaagcagcugucgaagacgaagauuucuggaaguugguggacagggagcgagaacuucauaaacuugggaaaugcggaucauguguauauaauaugauggguaagcgcgagaagaaacuaggagaguucgguaaagcuaaaggaucacgugcuaucugguauauguggcugggagcaagauacuuagaguucgaggcacucgguuucuuaaacgaagaccauugguuuucgcgggaaaacagcuacagugggguagaaggagaaggguuacauaaacuaggguacauacuacgcgacauuucgaaaauuccagggggagcaauguacgcagacgauacggccggaugggauacaagaauaacagaagaugaccuccacaacgaggagaaaaucacccaacaaauggauccagaacacagacaguuagcuaacgcaauauucaaauuaaccuaucaaaauaaagugguuaaaguucaaagaccuacaccgacuggaaccguuauggauaucauuucccgaaaagaucaacgcggaagcggacaaguaggaacauauggucugaauacaugccauucuaacauggaggcgcaguuaauaagacaaauggagggugaaggggucuuaucaaaagccgacuuggagaacccucaucuaucugagaagaaaauaacgcaauggcuagaaacaaaagguguggaaagauuaaaacgaauggcgauaucuggggaugauugcguugugaaaccaaucgaugauagauuugccaacgcguugcuagcucucaacgauauggguaaaguaagaaaagauauaccacaauggcagccaaguaagggauggcaugacuggcaacaagucccauucuguagucaccacuuccaugagcugauuaugaaagaugggagaaaauuagucguaccuuguagaccacaagaugaguuaauagggcgcgcuagaauaucccagggcgcagguuggaguuuacgagaaaccgcgugcuuaggaaaagcguaugcgcagauguggucucuuauguauuuccauaggagagaucuaaggcucgcauccaacgccauaugcucugccguaccuguucauuggguccccacuucaagaaccacuuggaguauacacgcacaucaccaauggaugaccacagaagauaugcuaacaguuuggaaccgaguguggaucgaagauaauccauggauggaagacaaaacuccgguuacuaccugggagaauguaccuuaucugggcaagagagaagaucaauggugcgguaguuugaucggcuuaacgaguagagcgacgugggcacaaaauaucccaacagcuauacaacaaguuaggucccuuaucggaaaugaagaauuucuggacuacaugcccaguaugaaacgauuuagaaaggaagaggaaagugaaggggcgaucugguag

SEQ ID NO: 23322 - RNA, 9873 nt, Artificial Sequence
  derived and/or modified CDS sequence (opt6) from DENV-3__EU687234__SS-prME
acgagcuuaugccugaugaugauuuuaccagccgcacuugcauuucaucuaacuucgagggacggggaaccgcgaaugauaguagggaaaaaugaaaggggaaaaucucuacuguucaaaacugcuaguggaauuaauauguguacuuuaauagcaauggacuuaggugaaaugugcgaugauacaguuacauauaaaugcccacauaucacagagguugaaccagaggauauugacugcuggugcaaccuaacuucaacuuggguuacuuacggcacguguaaccaagcgggagagcacaggcgagauaaaagauccguugcucuagcuccucacguaggcauggggcuagacacgcgaacacaaacuuggaugucagcagaaggugcuuggcgucaaguagaaaaaguugaaacgugggccuuaagacacccaggcuuuacaauuuuagcacuauuucuugcucauuauaucggcaccucuuuaacucaaaaaguagucauuuucauucuucuuauguuaguaacuccaagcaugacaaugaggugugugggcguuggcaacagagauuuugucgaaggguugucaggggcaaccuggguggacguaguucuagagcaugggggaugcgucacgacaauggccaaaaacaaaccaaccuuagauauagaauuacagaaaacugaagcuacacaauuagcaaccuugcgaaaauuauguauagaagguaaaauuacaaauaucacaacggacagcagauguccgacacaaggagaagcaguauuaccggaagaacaagaccaaaauuaugucuguaaacauacguauguagaccgaggaugggguaacggcugcggcuuauucgguaaaggcucauuggugaccugugcaaaauuucaaugucuugagcccaucgaagggaaaguaguacaauacgagaaucuaaaauacaccgugauuauuacaguacacacgggagaucaacaucaagugggaaaugaaacacaaggcguaaccgcagaaauuacgccccaagcaucuacgacggaggccauacuaccagaauauggaacucuuggccuagaguguagcccaagaacuggccuagauuucaaugaaaugauauuauuaacaaugaaaaauaaagcauggaugguacaccggcaaugguucuucgauuuaccacuuccuuggacaucuggagcaacgacugaaacuccuacauggaacagaaaagaguugcuagugacuuucaaaaaugcacacgcgaagaaacaagaaguuguuguucuuggaucucaagaaggugcuaugcauacugcacucacgggugcuacugaaauucaaaauucaggcgguacuucaauuuuugcagggcacuuaaaaugcagacugaaaauggacaaauuggaacuaaaaggaaugagcuaugccauguguaccaacacauucguacucaagaaagaaguuagugagacccaacacgguacaauacugauaaaaguagaguauaaaggagaagauguaccuugcaaagugcccuuuuccacggaggauggacaaggaaaagcucauagugggcgguuaauaacagcaaaucccgucguuacgaaaaaggaagaaccugugaauauagaagcagaaccuccuuuuggagaauccaacauagugauuggaauaggagauaacgcgcuuaaaauaaauugguauaagaaaggcuccucgauaggcaaaauguuugaggcaacagcacgaggagccagacguauggccauucuaggcgauacagccugggauuucgguucaguuggcggcguauugaacagccuaggaaaaaugguacaucagauuuuuggaagugcuuacacggcucuuuucucugguguaucgugggugaugaagauaggaauaggaguccuuuuaacauggaucggccuuaauaguaagaauacaucaaugucauuuucuuguauuguuauaggaaucauaacuuuauacuuaggagcagucguucaagcugacauggggugcgugauaaauuggaaagguaaagaacuaaaguguggaagcggaauauucguaaccaaugagguucacacauggacagaacaguacaaauuucaggcagacucaccgaagcgauuggcaacugcuauagcaggagcaugggaaaacggcguuugugggauacggucgacaacaaggauggagaaucuccuguggaaacaaauagccaaugaauuaaacuacaucuuaugggaaaauaacauaaagcucacugugguggucggagauauuauagggguacucgaacagggaaaacguacuuugacaccccaaccuauggaacucaaauauaguuggaaaacaugggguaaagcuaaaauaguaacugcggaaacccaaaauucgagcuuuaucauagaugguccaaauacccccgaauguccuuccgcaucccgugcuuggaacguaugggaaguggaggauuauggguucgggguguuuacuacuaacauaugguuaaaacucagagagguauacacacaauugugugaucauagauuaaugagugcagcugugaaagaugagagagcugugcaugccgauaugggauacuggaucgaaucccagaaaaacggaaguuggaaacucgaaaaagccagucuuaucgaaguuaagacguguacguggccuaaaucacacacacuauggagcaaugguguucuagaaagugauaugauaauucccaagagucucgcuggaccaauaagucaacauaacuacagaccggguuaccacacacaaacagccgggccauggcacuuggggaaauuagagcuagacuuuaauuacugugaagggacaaccguuguaaucaccgagaacuguggcacacgagggccuaguuuaaggacgacuacaguaucugguaaauuaauacacgaauggugcugucgaagcuguacauuaccaccucuuagguauaugggagaagauggaugcugguacggaauggaaauacggccaauaagcgaaaaggaggaaaauauggucaaaucucuaguaagcgcaggcagugguaagguugacaacuucacgauggguguucuuuguuuagccauucuauuugaagaggugaugagaggaaaauucggcaaaaagcacaugauagcagggguauuuuucacauucguguugcuucucucaggacagauuacauggcgagacauggcacacacccucaucaugaucggcucgaaugcuucagaccguaugggcaugggaguaacauacuuagcacuaauugccacauucaagauucaaccauuucuugcauuaggcuuuuuccuccguaaacucacaucgcgugagaaucuacuccuaggaguuggacuagcaauggcgaccacacugcaacuuccagaagacauugaacaaauggcgaaugguauugcauuaggucuaauggcucuaaaguuaauuacccaauucgagacauaccaauuauggacagcacuuauaucauuaacauguagcaauacaauauucacccuaaccguugcauggcguacagcgacuuuaauacuagcuggaguaucuuugcucccagugugucagucaucaucaaugagaaaaaccgauugguuacccaugacuguggcagcuaugggagucccgccacuaccacuuuuuauuuuuagcuuaaaagacacucuaaaaagaagguccuggccacuaaaugaaggaguaauggcuguuggucugguuucuaucuuagcaucaucauuguuacgcaacgauguaccgauggcgggcccucuagucgcuggaggucuucugauagcuugcuaugugauaaccgggaccuccgccgaccuaacaguugaaaaagcugcggauguuacgugggaagaagaagcugagcagacaggaguaucucacaaucuuaugauaacaguggacgaugacggaacaaugcguaucaaagacgaugaaacagaaaauauacuaacaguccuucugaaaacugcacuauuaaucguuucaggaauauuuccauacaguauaccggcgacucuauugguauggcauacauggcaaaagcaaacccaacguagugguguguugugggauguaccuaguccaccagaaacucaaaaagcagaacuggaagaagggguauauagaauaaagcaacaaggaaucuucggaaaaacgcaagucggaguaggcguacagaaggagggugucuuucacaccauguggcauguuacacggggcgccguccucacuuauaacgggaaacggcuagaaccaaacugggcaucggucaagaaagaucucauaucuuacgguggcgguuggagguuaagugcucaauggcaaaagggugaggaaguacaaguuauagcaguggagccggggaaaaacccaaagaauuuccaaaccaugccgggaaccuuucagacaacgaccggagaaauaggugcgauugcacuugauuucaaaccugggacgagugguucacccauuauuaaucgagaagguaaaguuguagggcuauaugggaauggaguuguuacuaagaacggagguuacguuucaggaauagcacaaacaaacgcugaaccagacgguccaacaccugaauuggaagaggaaauguuuaagaaaaggaaucucacaauaauggaccuacauccaggaucuggcaaaacuaggaaauaucuaccggcgaucgugcgagaagcaauuaagcgccgacuacgaacucucaucuuagcaccaacacgagucguagccgcagaaauggaagaggcacuuaaagggcuaccaauaagauaccaaacaacggcgacuaaaucagaacacaccggacgagaaauaguugauuuaaugugccacgcaacuuucacaaugcgcuuguuaucgccaguacggguaccaaauuauaaucuaauuauaauggacgaggcgcauuucacagauccugcgucaauagcagcaagaggcuauauaucuacacgaguagguaugggcgaagcugcugcuauauucaugaccgcaacaccacccggaacagcugaugcuuuuccacaaucaaaugcuccaauucaagacgaagagagagacauaccugaaagaucauggaacagugguaaugaauggauaaccgauuuugcggggaagacaguaugguucguaccaucuauuaaggcaggaaacgauauugcaaauugcuuacguaaaaaugguaagaaagugauccagcuauccagaaaaacuuuugauacagaauaucagaaaacgaaacucaacgauugggacuucgucguaacuacagacauauccgagaugggagcuaauuucaaagcagacagaguaauugaccccagacguugccucaaacccguuauauuaacagauggaccagaaagaguaaucuuagcggggccaaugccugucacagcggcaucagcagcucagcgaagaggaagggucggacgaaauccgcaaaaggaaaacgaccaauauauauucacuggacaaccuuuaaacaacgaugaagaucacgcacauuggacggaagcuaaaauguuacuugauaacauaaauacuccugaggguauuauuccagcauuauuugaaccagaacgggaaaaaucagccgcgaucgauggggaauacagacucaaaggugagucgagaaagacauuuguugaauuaaugcgaagaggugaccuuccgguguggcuagcacacaagguagcaucagaaggaaucaaauauacagauagaaaauggugcuuugauggacagcggaacaaccaaauacuagaagaaaauauggauguagaaauauggacaaaagagggugagaaaaagaagcucagacccagaugguuggaugccagaacauauagcgacccacuagcacucaaagaauuuaaagauuucgcugcgggcagaaaauccauagcgcuugaucuggugacugaaauagguagaguuccaucccauuuggcacaucggacgagaaaugcucuagacaaccuaguaaugcuacacacaucagaacauggaggccgagccuacagacacgcuguagaagaacuaccagaaacaauggagacauuauuacuccuagggcuaaugauuuuauuaacaggaggggcaaugcuauucuuaauauccggaaaaggaauaggaaaaacuucaauaggauuaauuuguguuauagcaagcucagggauguuauggauggccgaaauaccacuccaauggauugcaagugcaauagucuuggaauuuuucaugauggucuuauugauuccagaaccagagaaacaaagaacaccucaagacaaucaauuagcauacgugguaauugggauauuaacucuugcugcaauaauugcagcaaacgaaaugggauuguuagaaaccaccaaaagagauuuaggaaugucgaaggaaccgggaguugucagcccaacuagcuaccuggauguugaccuacauccugcaucugcauggacguuauacgccguggccacgacgguuaucacuccaauguuaagacauaccauagaaaauaguacagccaacgucagcuuagcugcuauagcaaaucaagcgguaguccuaauggguuuggacaaaggauggccaauaucuaagauggaucuaggcgucccucuacucgcccuuggcugcuauucccaaguaaacccauuaacucuuacugcugcgguacuauuacuaauaacacauuaugcaauaaucggcccaggacuacaagcuaaagcgacucgagaagcccaaaaacgaacagcagcagggaucaugaaaaauccuaccguagaugguauuaugacaauugacuuggauccaguaauauacgauagcaaauucgaaaaacaacuaggacagguuauguugcuaguacuaugcgcaguacaauuacuuuugaugagaacgaguugggcccuaugcgaggcauuaacuuuagcaacagguccgaucacgacauugugggaggguucaccaggaaaauuuuggaacacuacaauagcgguuaguauggcgaacauuuuucgaggaucauauuuagcaggagcuggucuagcauuuagcauuaugaaaucaguagguacuggaaaacguggaacagggucccaaggagaaacuuugggugagaaauggaaaaagaaauuaaaucaguugucgagaaaagaguucgacuuauauaaaaagagugggauuacggaaguagacaggacugaggccaaagaaggacugaagcgaggggaaauaacgcaucaugcaguuagucgaggaucagccaaauuacaaugguuuguagaacgaaauauggugauaccugaaggaagaguaauagauuuagggugcggaagaggcgguuggucauauuacugugcuggacucaagaaaguaacagaaguaagaggauacacaaaaggcgggccagggcacgaagaacccguuccuaugagcacguauggguggaauaucguuaaacuuaugucuggaaaagauguauuuuaccugccuccggaaaaaugcgauacucuacucugcgacauaggagaaucuagcccuucgcccacaguagaggaaagcagaacgaucaggguacuuaagaugguagagccgugguugaaaaauaaucaauucugcauuaaaguacuuaacccauauaugccaacuguaauagaacaccuagagcgauuacaacguaagcauggagggaugcuaguucgaaaucccuugaguagaaauucuacacaugaaauguacuggauuucaaacggaacaggaaauauuguagcaaguguaaauaugguaucaagacucuuauuaaacagguuuacaaugacacauagaaggccuacaauagaaaaagauguugacuuaggugcaggaacucgacaugucaacgcugaaccagaaacacccaauauggacguuauaggagaaagaaucaagcgcauuaaagaagaacacaauaguacuuggcauuaugacgaugaaaacccuuauaaaacuugggcauaccacggaucguacgagguaaaagccacgggaucugccucuagcaugaucaauggaguagucaaacuucugaccaagccgugggauguugugccaaugguaacucaaauggcaaugaccgauacgacaccuuuugggcaacagagagucuucaaggagaaagucgauacucgcacgccuagaagcaugccagggaccaggcguguaauggggaucacugcggaaugguuguggaggacgcuagguagaaacaagaagccacgucuuuguacacgcgaagaguucaccaagaaagucaggacaaacgcggccaugggugcaguuuucacagaagaaaaccaaugggauuccgcuaaagcugcaguagaagaugaagauuuuuggauauuagucgauagagaacgggagcuccacaaacuggguaaaugcggaagcugcguguacaauaugauggguaagagagagaagaaacuaggagaguuugggaaagcuaagggcucaagggcaauaugguauauguggcuaggugcccgauaucuagaauuugaagccuuagguuuccuuaaugaagaucacugguucucgagagaaaacaguuacaguggaguugagggcgagggacugcauaaguuaggguacauauuacgagacaucucaaaaauaccugggggcgcgauguacgcagacgauacagcgggcugggacacaagaauaacggaagacgauuuacauaacgaggagaagaucacacaacagauggauccugaacaccggcaacuagcaagcgcaauuuucaagcuaacuuaccaaaauaaaguuguuaagguacaaaggcccacuccuacuggaacaguaauggacauaauaucacgaaaagaucaacgugggucaggucaaguagggacuuauggucuaaauacauuuacaaauauggaggcucaacuaauucgacaaauggagggagaaggcguacuaaguaaagcggaccuagagaacccucacuugccagagaagaaaaucacacaauggcuggagacaaaaggcgucgaacgucuaaaacgaauggcaauaucuggcgacgauuguguagucaaaccuauagacgaucgguucgccaaugcccugcuagcgcuaaacgauauggguaaaguaagaaaagauauuccgcaauggcagccuucaaaaggcuggcaugauuggcaacaaguaccuuucuguucccaucacuuccacgaauuaauuaugaaagauggaagaaagcuagugguuccuuguaggccgcaagacgaacuuaucgguagagcacgaauuucccaaggugcugguuggucauuacgagaaacagcguguuugggaaaagcauaugcacaaauguggucucuuauguacuuucaucgaagagaucuacgauuagcaucaaacgcuauauguucagcuguaccggugcacugggugccaaccucucggacaacauggucgauucaugcacaccaccaguggaugacuacagaggauauguuaacaguauggaacaggguauggauagaagauaauccuuggauggaggauaaaacuccuguaacaacuugggaaaauguaccuuaccuaggaaagagagaggaucaaugguguggcucgcugauaggcuuaacaaguagggcaacuugggcccaaaacauuccaacagcuauucagcaaguccgaucucuaauaggaaaugaggaguuccuugacuacaugccaucaaugaaacgauuucguaaagaggaagaaucagaaggcgccauuugguga

SEQ ID NO: 23323 - RNA, 9873 nt, Artificial Sequence
  derived and/or modified CDS sequence (opt6) from DENV-3__EU687196__SS-prME
acuuccuuaugcuugaugaugauauuaccugcugcacucgcauuucaccuaacuucaagggacggggaaccacgcaugauaguaggcaaaaaugaacggggaaaaagccugcucuuuaaaaccgcaucagguauaaacauguguacucuuaucgcgauggauuuaggugaaaugugugacgacacagucacauacaaaugcccgcauauaacggagguagaacccgaagacauagacugcuggugcaauuugaccaguacgugggucacuuacgguacuugcaaccaagcuggagaacauagaagggauaaaagaaguguagccuuagcuccucauguuggaaugggauuagacaccagaacacaaacauggauguccgccgagggagcuuggagacaaguagaaaaaguugaaacuugggccuuaagacacccgggauuuacaauccuagcucucuuuuuagcacauuacaucgggaccucccuaacacaaaaaguugucauauuuauccuucucauguugguaacuccaucaaugacaaugcgcugcgucggagugggcaacagggacuuugucgaaggauugaguggagcgacauggguagacgucgugcuagagcacggaggaugcguuacuacaauggcuaaaaauaaaccgacgcuagauauagaacuucagaaaaccgaagcuacgcaauuagcgacgcugagaaaacuuuguaucgaaggaaaaauaaccaacauuaccacugauaguagguguccuacacagggugaagccgucuuaccugaagaacaagaccaaaacuacguauguaaacacaccuauguugauagagguuggggaaauggcugcggauuauuugggaaaggaucucuagucacaugcgcaaaauuccaauguuuggaaccuauagaaggcaaaguaguccaauaugagaaucuaaaauacacaguaaucauuacggugcauacaggagaucaacaucaggugggaaaugaaacccaagguguaacagcagaaauaacaccucaggcuuccacaacagaggcuauccuaccggaauauggcacauuaggguuagaaugcucaccccgaaccggauuggacuuuaaugaaaugauacuacuuacuaugaaaaacaaagcauggauggugcaccgucagugguucuuugauuuaccuuuaccauggacaaguggugcaacuaccgaaacaccgacguggaaccgaaaagaacuucuaguaacauuuaaaaaugcccaugcgaagaaacaagaagugguaguacugggaucccaagaaggagcgaugcauacggcgcucaccggagcgacggaaauacaaaacucgggaggaacaagcauauucgccggacaccucaaauguagacuuaaaauggacaaauuagaauuaaaagggaugaguuaugcaauguguaccaacacuuucgugcuuaagaaagaaguaagugaaacacaacauggaacuauauuaaucaaaguggaauauaaaggagaggauguucccuguaaaauaccauucuccacugaagacggucaaggaaaagcucauaauggaagacuaauaacagcgaacccaguugugacuaagaaagaagaaccugucaauauagaagcugaaccaccauucggagaauccaauauaguaauagggauaggggacaaugcucugaaaauuaacugguacaagaaagguucaagcaucggaaaaauguuugaagcuacggcuagaggcgcaagaagaauggccauauuaggugacaccgcuugggauuuugggagcgucggcggaguacucaauucgcuagguaagauggugcaucaaauauuuggaagugcauacacggcccuguucagugguguaucguggguaaugaagaucgggauagguguccucuuaacuuggauuggccuaaauagcaagaacaccucgaugucauuuaguuguauagcuauagggauaauaacauuguaucuuggcgccguaguacaagcagacaugggguguguaauaaauuggaaaggaaaagaauuaaaaugugguucagggauuuuuguaacaaaugaaguacacacguggacggaacaauacaaauuccaagccgauucgccuaagcggcuggcuacugcgauagccggugcaugggagaacggcgugugugguaucaggucgacuacacgaauggaaaauuuauuguggaaacaaauugcaaacgaguugaacuauauacucugggaaaacaauauaaaauugacuguugugguuggagauacgauaggcgugcuggaacagggaaagcgaacucucacuccacaaccaauggaacugaaauauaguuggaaaacauggggaaaggccaaaauuguaacggcggagacacaaaauuccucuuuuauaaucgaugggcccaacacgccugaauguccaucggccaguagagcauggaaugucugggaaguagaagauuacggguuugguguauuuacuacaaacaucuggcuaaaacuaagagaggucuauacacaacuaugugaccacagacugauguccgccgcggucaaagaugaaagagcuguucaugcagauaugggcuauuggaucgaaucccaaaagaauggcucauggaaguuagagaaggcuucccuaaucgaagugaaaacuuguacauggccaaaaucccauacguuauggagcaacgguguauuggaaucugacaugauuaucccgaaaaguuuggcagggcccauuucgcagcauaacuaccgccccgguuaucauacucaaacagcaggaccguggcacuuaggaaaacuggaauuagauuucaauuauugcgaagguacaacgguaguuaucacugaaaacugugggacacgcggaccuucacuaagaacgacgacggucagcggcaaguugauccaugaaugguguugucgaaguuguacccuacccccacuucguuacaugggcgaggacgguuguugguacgguauggaaauuagaccaauaagugagaaagaagaaaauaugguuaaaucuuugguaagcgccggcaguggcaaagucgauaauuuuacuaugggagucuuaugccucgcaauucuauucgaagaaguaaugagaggcaaauuuggaaagaaacacaugaucgcuggaguuauuuucacauucgucuuguuacuaucgggucagauuacguggagagacguagcacauacacucaucaugauaggcuccaaugcaucagaucguaugggcaugggcguaacuuacuuagcacuaaucgcuacuuuuaaaauacaacccuuuuuagcccuaggcuucuuuuugagaaaacugaccaguagagaaaacuuacuacuagggguagguuuagcuauggcaaccacguuacagcuaccagaggauaucgaacaaauggcuaacgguauagcacuaggacuaauggcacuaaaacuaacgacucaauuugaaacuuaucaacuauggacagcauuaauaucuuuaacuugcucaaacaccaucuucacuuuaacgguugcauggcguacggcaacucuaauacucgcaggagucucuuuacuaccgguaugccaauccuccaguaugagaaaaacagacugguuaccaaugacagucgccgcuaugggagucccuccucucccucuauuuauauuuagucuaaaagauacucucaaaagacgaucguggccauugaaugagggcguaauggcggugggcuuaguuucuauauuagcaucuucauugcugaggaaugaugucccaauggcuggucccuuaguagcaggcgguuuacugauagcuuguuacgugauuacagggacaagugcagaucuuacaguagagaaagcugcugacguuacgugggaagaggaagcggagcagacuggcguaucacacaauuuaaugauaacaguagacgacgauggaacaaugcgcauuaaagaugaugagacagaaaauauacuaaccguucuauuaaaaacagcauuguuaauaguuucugggauauuuccauacucaauaccagcuacguuauuaguuuggcacacauggcagaaacaaacacaacguagcggcguccucugggacguaccaagcccuccagagacccaaaaagcagaauuagaagagggaguauaccguaucaaacagcaaggaauauucgguaaaacacaaguaggcguaggaguacaaaaagaagggguuuuucacacuauguggcacgugacuaggggugccgugcucacguauaacgguaaacgacuagagccaaacugggccucaguaaagaaagaccuaauuaguuacgggggugguuggcggcuaucagcucaguggcaaaaaggugaagaaguacaaguaauugcuguggaacccggcaagaauccuaaaaauuuucaaacuaugccaggaaucuuccaaaccacaacuggggaaaucggagcaauugcgcuagauuuuaaaccugggacaagugggagucccauuauaaacagagagggcaaagucgucggauuauaugguaauggaguugugacaaagaacggcggauacguaagcgggauugcacaaacaaaugcugagccagacgguccgacgcccgaauuggaagaagagauguuuaagaaacggaacuuaacaauaauggacuuacaucccggaagugguaaaacacguaaauauuuaccggcgauaguaagagaggcuauaaagcguagguugaggacccuaauccucgcaccaaccagaguugucgccgcugaaauggaggaagcccuaaaaggauuaccaaucagauaucaaacuaccgcaacaaaaagugaacacacagggagggaaauuguugauuuaaugugucacgcaacguucacgaugagacuuuuaucacccgugcgagucccaaauuauaaucuaauuaucauggaugaagcacacuuuaccgacccagcaaguauugcagcaagaggauauauauccacacgagucgggaugggggaagcagcagcuauauuuaugacugccacgccuccaggaacagcggaugccuuuccgcagagcaaugcacccauccaagaugaagaacgugacauaccagaaagguccuggaacucaggaaacgaguggauaacagauuucgcugggaaaacagucugguucguuccuucaaucaaggccgggaaugauauagcaaacugucuucguaagaacggcaagaaaguaauacaacucuccaggaaaacuuucgauacagaauaucagaaaacgaaauugaaugacugggauuucguaguuacuaccgauauaucggaaaugggggcaaauuucaaagcggauaggguaauagauccacggcgcugcuugaaaccuguuauccucacugauggaccagagaggguaauacuagcagggccaaugccugugacagcagcgagugcugcacagcgccguggcaggguaggucgaaacccucaaaaagaaaaugaccaauauaucuuuacuggccaaccacucaauaacgaugaagaccaugcgcauuggaccgaggcgaagaugcuccuagauaacaucaacacacccgaaggcauaauaccagcacuuuuugaacccgaacgugagaaaagcgcggcuauagacggugaguauagauuaaaaggcgagagucgaaaaaccuuuguggaacugaugagacgaggcgauuuaccuguaugguuagcacauaaaguagcuucagaggggauaaaauacacagacagaaaaugguguuuugauggacaaagaaacaaccagauucuugaggaaaacauggauguagaaauauggacaaaagagggagaaaagaagaaacuucgaccgagguggcucgacgcaagaaccuauagcgauccacuagcacucaaagaauuuaaagauuuugccgcaggacgcaaauccauagcauuagauuuagugacagaaauugguagggucccaucucaucucgcucacagaacgagaaaugcucuagacaacuuaguaaugcuucacaugagcgaacacggaggaaaggcuuaucggcacgcaguugaagaauuaccggaaacuauggaaacacuacugcucuuaggacugaugauacuuuuaacgggaggggcuaugcucuuuuuaauaagcggcaaagguauagggaagacaaguaucggucuuaucuguguuaucgcaucaucagggauguuauggauggcggaaauuccauuacaguggauugcuucggccaucguauuagaguucuuuaugaugguauuauugauacccgaaccagaaaaacagcgcacuccccaagacaaccaguuggccuaugucguuauugggauuuuaacuuuggcggcuauaaucgcagcaaaugaaaugggacugcuagagacaacaaaacgagacuuaggaaugucaaaagagcccggaguagugagcccuaccucauaccuagacguagacuugcacccagcaagugcguggacacucuacgcaguggcaacuaccguaaucaccccaaugcugagacauacuauagaaaacucaacagcaaauguaagccuagcugcaauagcuaaucaggccguaguacucauggguuuggacaaaggauggcccauaagcaagauggauuugggaguuccgcuauuagcauuaggaugcuacagucaagucaacccucucacacuuacugcagcgguacuauuacuaauaacucacuaugccauaauaggaccuggacuacaagcaaaagccaccagagaagcccagaaaaggacggcagcggguauaaugaaaaauccaacaguugauggaauaaugacaaucgaucuggauccgguaauauaugacucgaaauuugaaaaacaacuaggacagguuauguuacugguuuuaugcgcaguccaauugcugcugaugagaacaucuugggcauuaugcgaagcguuaacacuugcaaccggacccaucacuacauuaugggaaggauccccagguaaauuuuggaauacuacaauagccguuucuauggcaaacauauuuagaggaaguuacuuagccggugcuggcuuagcauuuucuauaaugaagucaguaggaacuggaaagagagggacuggaagucaaggagaaacacucggugagaaauggaaaaagaaacuuaaucaacuaagucguaaagaauuugaccucuauaagaaaagugggauaaccgaaguagacaggacagaagccaaagagggauuaaagagaggugaaauaacccaccaugccguaaguagagguagcgcaaaauuacagugguuuguagaaagaaauaugguuauaccugagggucgugugaucgauuugggaugcgguagaggcggauggucauauuacugcgcaggccuaaagaaaguaaccgaaguaagaggguacacaaaaggaggaccuggccaugaagaaccaguuccaaugagcacauauggcuggaacauuguuaaauuaauguccggcaaggacguguucuaucuaccaccagaaaaaugcgauaccuuauuaugugacauuggggaaucauccccguccccaacggucgaagagucuagaacaguucgcguuuuaaagauggucgaaccguggcugaaaaauaaucaguucugcauaaaaguucuaaauccuuacaugcccacagugaucgagcaucuagaaagauuacaaagaaaacauggaggaauguugguaagaaaucccuuaagcagaaauuccacacacgaaauguacuggauaaguaacgguacuggaaacauaguggccagcguaaacaugguaagcagauuauuauuaaauagguucacaaugacucauaggagaccuacaauugaaaaagauguagauuuaggcgcgggaacaagacacgucaacgcagagcccgagacuccaaacauggacgugauuggagagcgaauaaagagaauaaaagaagaacauauuagcacuuggcauuaugaugacgaaaacccguacaaaacuugggccuaucacgguaguuaugaggugaaagcuacagguagcgcgaguucaaugaucaaugggguggugaaacuauugacaaaaccaugggacguagugccuaugguuacacaaauggcuaugacugauacuaccccguuuggucaacaacguguauucaaagaaaaagucgauacgaggacuccacguaguaugccugguacaagaaggguaauggguauaacagcugaauggcuauggaggacacuagggagaaauaagaaaccacgccuguguacaagagaagaauuuaccaagaaaguuaggacaaacgccgcaaugggagcaguauucacagaagaaaaccagugggauucagccaaagccgcgguugaagaugaagacuuuuggaaauuaguggacagagaacgcgaacuacauaaacuuggaaagugcgggucgugcguauauaacaugaugggaaagcgagaaaagaaauuaggggaauuuggcaaggcaaaggggucuagagccauaugguacauguggcuaggugcccgauaucuugaauuugaagcacugggguuccuaaacgaggaucacugguuuucucgugagaacucguauucaggagucgaaggcgagggguuacauaaacuaggguauauauuaagggacauaucaaaaauaccuggaggggcaauguacgcagacgauacugcaggaugggauacucggaucacagaagaugaccuacauaacgaagagaaaauaacgcaacaaauggauccagagcaccgccaacucgcgaaugcaauauucaaauuaacguaccagaacaaagucgugaaaguucaaagaccuacaccaacaggaacaguaauggacauaauauccagaaaagaucaaaggggaucuggacaaguaggaacauauggacuaaacacauuuacaaauauggaggcgcaacuaauaagacaaauggagggagaggggguucuuaguaaggcugaccuugaaaacccacaucuuccugagaagaaaauaacccaaugguuagagacaaaaggaguggaacgguuaaaaaggauggcgauuagcggggacgauuguguaguaaaaccuauugaugaccgguucgcuaaugcacuacuggcuuuaaacgauauggggaagguucgcaaagacauuccucaguggcaaccaaguaaaggguggcacgauuggcaacaaguaccguuuugcagucaucauuuucacgaacugauuaugaaggacggaagaaagcuaguuguaccauguagaccucaagacgaauuaauugguagggcaaggauuucccaaggggcuggauggucuuuuagggaaacagcaugccuagguaaagccuacgcgcaaauguggucuuuaauguauuuccauagaagagacuuaagguuggcaucuaacgcgauuuguagugcggugccaguccauuggguuccgacaucuagaaccacaugguccauccaugcacaucaucaauggaugacgacagaagauaugcucacaguguggaacagaguauggauugaagacaaucccuggauggaagacaaaacuccgguaaccaccugggaaaaugugccauacuugggaaaacgcgaagaccaauggugugguagucugauaggacugacaucuagagcuaccugggcacaaaauaucccaacggcaauccaacaggucaggagcuuaauuggaaacgaagaguuuuuggacuacaugccaucaaugaaaagauuuagaaaggaggaagaaucagagggagcgauaugguga

SEQ ID NO: 23324 - RNA, 9873 nt, Artificial Sequence
  derived and/or modified CDS sequence (opt6) from DENV-3__EU854298__SS-prME
acaagccugugcuuaaugaugauucuaccugcagcauuagccuuccauuugacuucacgggauggugaaccaagaaugauaguagggaaaaacgaaagaggaaaauccuuacuuuucaaaacugcaagcggaaucaacaugugcacacugauugcuauggacuugggagaaaugugugacgacacuguuacguauaaauguccacauaucacugaaguagaacccgaagacaucgauuguuggugcaaccugacaucaacauggguuacguaugguacguguaaccaagccggugaacaucgcagagacaaacgaagcguagcauuggccccucacguaggaaugggauuagacacacgcacucaaacauggaugagcgccgaaggugcuuggcgacagguagaaaaagucgaaaccugggcacuaagacacccuggauuuacgauccuagcguuguuucuugcgcauuauaucggaacaucccuaacucaaaaaguuguuaucuucauccuacugauguuaguuacuccaagcaugaccaugagaugcguagguguaggcaaucgggacuuuguagaagguuuaagcggagcaacguggguagacgucguccucgaacauggcggaugugucacgacgauggccaaaaauaaaccaacccucgauaucgaacuccagaaaacagaagccacucaauuagccacuuuaaggaaacuuuguauagaagguaaaauaaccaauauaaccacugacagccgaugcccuacgcaaggugaagcagugcuuccggaagaacaagaucagaacuauguuuguaaacauacauauguagauaggggauggggaaauggaugcggccuuuuugggaaagggucauuaguaaccugugcaaaauuucaaugccuagaaccuauugaagggaaaguuguacaauaugaaaaccuaaaauauaccgucauuauaacaguacacacaggugaucaacaucaaguaggaaacgaaacacaagggguaaccgcggaaauaaccccacaagcuagcaccacggaagcuauccuaccggaauauggaacacugggauuggaauguuccccgagaacggggcuugauuuuaaugaaaugauauuauuaacaaugaagaauaaagcauggaugguucauaggcagugguuuuucgacuuaccacuacccuggacuagcggagcaacaacugagacgccuacauggaaucgcaaagaacuacuuguaacguuuaaaaaugcacaugcgaaaaagcaggaaguuguagugcuuggcucccaagagggugccaugcacacagcuuugacgggagcuacugagauacaaaacagcggcggaacaaguauuuuugcaggucauuugaaaugcagguuaaaaauggauaaacuagaacugaagggaaugaguuacgcaaugugcacaaauacguuuguacuaaagaaagaagucagugaaacacaacauggcacgaucuugauaaaagucgaauacaaaggagaagacgucccauguaaaauaccguuuucaacugaggauggccaggggaaggcucacaacgggagauugauuacugcuaauccaguugucacaaagaaagaggaaccugucaauauugaagccgaacccccuuuuggcgaaucaaacaucguaauaggaauaggugacaacgcacuaaaaauuaauugguacaagaaaggaucuucgauugguaaaauguuugaagcaacagcaagaggggcucguaggauggcaauccucggugauacagcgugggacuucggaaguguggguggaguauuaaauucauuggguaaaaugguccaucaaauuuuugguagugcauacacugcguuauucagugguguaucaugggucaugaaaauaggcauugggguucucuuaacuuggauuggucuaaauagcaaaaauacuucaaugagcuucuccuguauugccauaggcauaauaacuuuauauuuaggagcugucguacaggcagacaugggcuguguaauuaauuggaaagggaaagagcuaaaauguggaaguggaauauuugucacaaaugaaguucacacuuggacagaacaauacaaauuccaagcagacaguccuaagagauuagcuacugcaauugccggagcgugggaaaaugguguauguggaauaaggaguacuacgagaauggaaaauuuauuauggaaacagauugccaaugagcugaauuacauucugugggaaaacaacauaaaauugacuguuguuguaggugauauaauuggcguacuugagcaaggaaaaagaacguuaacaccgcaaccuauggagcucaaauacucuuggaagacauggggcaaagcuaaaauugugacugccgaaacucaaaauucaucauuuaucauugaugguccaaacacuccugaauguccuaaugcuucacgugccuggaaugugugggagguggaggacuacgguuucggaguauuuaccacgaauauaugguuaaaauuaagagaaguacauacucaacuaugcgaccauagauugaugagugcugccguaaaagaugaaagagccguacacgccgauaugggcuacuggauagagagucagaagaaugguucauggaaauuggaaaaggcuucguuaauugaaguuaaaacuuguacauggcccaaaucacacacucuuuggagcaauggaguucucgaaucggauaugauuauaccuaagagcuuggccgguccgaucucacagcacaacuauaggccuggauaucacacgcagacagcgggaccauggcauuuaggcaaguuagaacucgauuuuaacuacugugaagguacaacaguuguuauaacagaaaacuguggcacuagagggccaaguuuacgcacaaccacaguaagugggaaacuaauacacgaguggugcugcaggucauguacgcuaccaccuuuaagauacaugggugaagauggcugcugguauggaauggaaauaagaccuauaucagaaaaagaagagaacauggucaaaucacucgugagcgcaggaucgggaaaaguugauaauuuuacgaugggaguauuaugccuggccauucuuuucgaggaaguaaugcgcggaaaauucgguaagaaacacaugauagcaggaguuuucuuuaccuucguucuacuacuuaguggucaaauaacauggagagauauggcacauacauuaauaaugauugggagcaacgcuucggacagaaugggaaugggugucacauaucuagcacugaucgcgacguuuaaaauucaaccguuuuuagcgcucggauuuuuccugcgaaaacuaaccagucgcgaaaauuuauuacuaggaguaggauuggcaauggcgacaaccuuacaacuaccagaagauauagagcagauggcaaaugguauagcucugggucugauggcgcuuaaacuaauaacacaauucgagaccuaucaacucuggacugcgcuaauuucauuaacguguagcaauaccauauuuacccuaacugucgcguggcguacagcuacacucauccuggcuggagugucccuuuuaccgguaugccaaaguaguagcaugcgaaaaacagacugguuaccgaugacgguagcagcuaugggggucccaccacuaccgcuuuucaucuuuagccugaaagacacgcuuaagcgaaggucauggccacuaaacgaaggaguuauggcaguaggcuuaguauccauauuagccucaucucuucucaggaacgauguuccgauggcaggaccgcuaguggcagggggccucuuaaucgcgugcuacguaauaaccggcacaucggcggaucuaaccgucgaaaaagccgcagaugucacgugggaagaagaagcggagcagacaggcguaagucauaacuugaugauaacaguggaugacgaugguacaaugagaauaaaagaugaugaaacagaaaauauauuaaccgugcucuugaaaacagcacuucucauagucucagggauauuuccuuauucuauacccgccacacuauuaguauggcauacguggcaaaaacaaacucaaaggucugggguauuaugggacguaccaagucccccagagacacaaaaagcagaauuggaagaagggguguaccgaauaaaacaacaagguauauuugguaaaacacaagucggaguugguguccaaaaggaagggguguuucacacgauguggcauguuacacgaggggccguauuagcuuacaaugguaaaagacuagaacccaacugggcgucugucaagaaagaccuaauuucguacgguggaggcuggcguuugucagcacaauggcaaaaaggugaagagguacaagucauagcgguggaaccaggcaaaaacccuaagaauuuucaaacaaucccagguacuuuucagacaacuacuggagagauuggagcuauagcucuggauuucaaaccugguacaucagguucaccaaucauaaacagagaaggaaaaguuguaggauuauacggaaacggagucguaacuaaaaacggggguuauguaucaggcauugcucaaacuaaugccgaaccugauggcccuacaccugaacuagaagaggaaauguuuaagaaacgaaacuuaacgauaauggacuuacauccuggaucuggaaagacacgaaaguacuuaccggcaauagugagagaagcaauaaagcgucgauugaggacacugauauuggcaccgacucgugucguagcagcggagauggaagaagcgcuuaaaggacuaccuauaagguaucagaccacagcaaccaaaagugagcauaccggaagggaaauaguggaucuaaugugccaugcuaccuucacaaugagacuauugaguccaguuaggguuccgaauuauaauuuaaucauaauggacgaagcccacuuuacugauccagcaucaauagcagcacgaggauacaucaguacacggguaggaaugggugaagcagccgcgauauucaugacagcgacaccuccagguacagcugacgccuuuccacaaaguaacgcaccaauccaagacgaagaacgugacauuccagaacgaaguuggaacucagggaaugaguggauaacggacuucgcaggcaaaacgguuugguucguaccgaguauaaaagcugguaacgacauagcgaacuguuugaggaaaaacgguaagaaagugauacaacugucaagaaagacauucgauaccgaauaccagaaaacaaaacuaaacgauugggauuucgucgucaccacagacauaucagaaaugggugcaaacuuuaaagccgauaggguaauugauccgagacgguguuugaaaccaguaauuuuaacagauggcccagaacgagucauacuugcugggccgaugccuguuacagcagcgucugcugcucaacgacgaggacgaguuggccguaacccccaaaaagagaacgaucaauacauauuuacaggucagccgcuaaauaaugaugaagaucacgcucauuggaccgaagcaaaaauguuacuugauaacauuaauaccccagaaggaauaaucccugcauuauucgaaccagaaagagaaaagucagcagccauagauggagaauacagacuaaaaggcgaaagucgcaagacauucguagaacucaugaggagaggagaucuacccguauggcucgcccauaaagucgcaucugaaggaauuaaauacacugaccgaaaauggugcuuugacggacaacggaauaaccagauuuuggaagagaacauggacguagaaauauggaccaaagagggugaacgaaagaaacugagaccacguuggcuagacgcuagaacauauucagacccauuagcuuuaaaagaguucaaagauuucgcggcugguaggaaaaguaucgcuuuagaucuaguaacagaaauaggcagaguuccaagucauuuagcacauagaacacgaaaugcacucgacaauuuaguaauguuacauacaucggaacauggaggaaaggcuuauaggcacgcaguagaagaacuuccagaaacaauggaaacccuacuauugcuagguuugaugauacuauuaacagguggcgcaauguuauuucuaauuaguggcaaagguauuggcaaaacgaguauuggccucaucugugucaucgcaagcuccggcauguuauggauggcugaaaucccgcuacaauggaucgcaucagcuauuguucucgaguucuuuaugauggugcuauuaauaccagaaccugaaaaacaacggacaccucaagauaaccaauuagcguacgugguaauuggaaucuuaacccuugccgcuauaauugcugccaacgaaaugggucuucucgaaacuacgaagagagacuuggguaugucaaaggagcccgggguagugagcccaacuagcuaucuugauguugaucuacauccugcuucagcauggacguuauacgccguugcuacuacagucaucacuccgaugcucagacacacuauagagaacucaacagccaauguaucacuagcagcuauugccaaucaagccguaguauuaaugggucucgacaaggguuggccuauuucaaaaauggaucuuggagucccucucuuagcacuaggcuguuacucacagguaaauccgcuaacccuaacugcagcgguauuacuguuaaucacccauuaugccauuauuggaccaggacuccaggcaaaggccacaagggaagcucaaaagaggacagcagcaggcaucaugaaaaauccuacugucgaugguauaaugacuauugaucuggacccagugaucuaugauucaaaauuugagaaacaacucgggcagguuaugcuucuuguuuuaugugcggugcaacuacuccuaaugcguacauccugggccuuaugugaagcacuaacccuagcaacaggaccaaucacaacauugugggaaggcucuccagguaaauuuuggaacacuacgauagcugugucuauggcuaacauauucaggggcagcuacuuagcgggagcuggauuagcguuuaguaucaugaagucggucggcacaggaaaaagaggaacaggaucgcagggugaaaccuugggagaaaaguggaagaagaaauuaaaucaacuaagccgaaaagaauuugaccuauacaagaaaucaggaauaacggaaguagauagaaccgaagcaaaagagggacuaaaaaggggugaaauaacgcaccacgccguaagccguggaagugcaaaauuacaaugguuuguagaacgcaacaugguuauacccgaggguaggguuauugacuuagggugugguagaggcggauggucauauuacugugcuggacuuaagaaaguaacagagguuagaggguacacaaaaggugggccuggacacgaagaacccgugcccaugucuaccuauggguggaacauugucaaacucauguccggcaaagaugucuuuuaucuuccaccggaaaaaugugauacauuacuaugugauauaggugaaaguagcccuuccccaacagucgaagaaucucguacgauuagggucuuaaaaaugguggagccauggcucaaaaauaaucaauucuguauaaaaguacuaaauccauacaugccuaccguaauugagcacuuggaacgacugcaacggaaacauggugguauguugguucgaaauccccugucccggaacaguacgcacgagauguacuggauuaguaaugguaccggaaacaucguggcgaguguuaauaugguuucgagauuguuauuaaauagauuuaccaugacacaucgcagaccuaccaucgaaaaagacguagaccuuggagcuggaacucggcacguaaacgcggaacccgaaacaccuaauauggaugucauaggggagcguauaaaacguauaaaagaagaacauaacuccacauggcacuaugacgaugaaaauccuuacaaaaccugggcuuaucaugguucuuaugaaguaaaagcgaccgggagugcauccaguaugauuaauggaguuguuaagcugcugacgaaaccuugggacguaguuccuaugguaacccaaauggcaaugacugauacgaccccauuuggacagcaaagaguauucaaagagaagguugacaccagaacgccacguaguaugccaggaacgagaaggguaaugggaauaacggcagaaugguuguggagaacucuugggaggaacaagaagccgaggcuuugcacgagggaagaauuuacuaagaaaguaagaacaaacgcagcaaugggagcggucuucacagaggaaaaucagugggacucagcaaaagcagcaguagaggacgaagauuuuuggaaacuuguagaucgagagcgugaacuccauaaauuaggcaagugcggaaguugugucuacaauaugauggggaagagagaaaagaaauugggcgaauuugguaaagcaaaggguaguagggccauuugguauauguggcugggugccagauauuuagaguucgaagcguuggguuuucucaaugaagaucauugguuuaguagagaaaacucuuacuccgguguugaaggugaaggccuucacaaguuaggauauauacuaagggacauaucuaaaauuccgggaggagcaauguacgcagaugauacggcagggugggacacgcgcaucacagaggacgacuuacacaaugaggagaaaauaacucaacagauggauccugaacacagacaguuagcgaacgcuaucuucaaauugacuuaucaaaauaaaguuguuaaaguacaaaggccuaccccgaccggaacagucauggauauuauaaguaggaaagaucaaagagguagugggcaagucggcacauauggucuuaauacuuuuacaaauauggaaguacaguugaucagacaaauggaaggagaagguguucuaucuaaggcagauuuagaaaauccucaucugccugagaagaaaauaacacaaugguuagaaacuaaaggugucgaaagauugaaaaggauggcuaucucuggagacgauuguguaguaaaaccuauagacgauagauucgcgaacgcucucuuagcauuaaacgauaugggaaaaguacgcaaggauaucccucaauggcagccaucgaaaggauggcacgauuggcaacagguaccguuuuguucccaucacuuucaugaauugaucaugaaagauggucgcaaacuugucgucccuuguagaccccaagacgaauuaauugguagagcacgcauaucacaaggcgcuggauggucuuugagggagacagccuguuuaggaaaggcuuacgcccaaauguggagucugauguauuuucaccgccgagaccuacgacuugcaucaaacgcaauauguagugcuguaccaguacauuggguaccaacgucaagaacuacauggagcauucaugcgcaucaucaauggaugacaacagaagauauguuaacuguauggaaucgaguguggauugaagauaacccauggauggaggauaaaacaccagucaccacaugggaaaauguucccuacuuaggaaaacgcgaggaucaauggugugggucuuugauaggauuaacaucgcgugcaacaugggcacaaaacauaccaacagcaauccaucagguacgaucacugaucgggaaugaagaguuucuagauuauaugccaucaaugaaaagguucagaaaagaggaagaacuggagggugcuauaugguga

SEQ ID NO: 23325 - RNA, 9873 nt, Artificial Sequence
  derived and/or modified CDS sequence (opt6) from DENV-3__FJ373306__SS-prME
acaucauugugucucaugaugauuuugccugcagcccucgcguuucacuuaaccucccgugauggagaaccucgaaugauaguaggcaaaaacgaaagagggaaaucauuacuuuucaaaacggcuucuggaauuaauauguguacccucauagcaauggacuugggagaaaugugugaugacacagugacguauaaauguccacacauuacagaaguggaaccugaagauauagauugcugguguaacuuaacgucaacgugggucacauaugguaccuguaaucaagcgggagaacauagacgagauaaaagaucgguagcucuggcgccgcacguuggaaugggauuagacacuagaacacaaacguggaugucagcugaaggggcuuggagacaagucgaaaaaguagaaacaugggcacugcggcaccccgguuuuacaaucuuagcccuguuccucgcucacuacguagguacuagccucacacaaaaaguaguuauauucauuuuauuaauguuggugacaccaaguaugaccaugcgguguguaggaguugguaacagagacuuuguggaagggcucuccggagcaaccuggguagauguagugcuagaacacggcggauguguaaccacuauggccaaaaauaaaccaacccuagauaucgaauuacagaaaacugaagccacucaauuagcaacacuacgaaaauuauguaucgaagguaaaaucacaaacauuaccacugacaguagaugucccacacaaggagaagcuguauuaccagaagaacaagaucaaaauuauguaugcaaacauacauauguugacagggguugggguaauggaugcggucuauucggaaaaggaaguuuggugacaugugcgaaauuccaaugcuuggaaccaaucgaaggaaaaguuguccaauaugaaaauuuaaaauacaccguuauuauuacaguccauacaggagaccaacaucaaguagguaacgaaacgcaaggaguaacagcagaaaucaccccacaagcaucaaccacggaagcaauuuugccugaauacgguaccuuagguuuagaaugcagcccaaggacagguuuggauuucaacgagaugauauuauuaacaaugaaaaacaaggcuuggaugguucaccgucaaugguucuuugauuugccauuaccuuggacaucgggagcgacgaccgaaacacccacauggaauaggaaagaauuauuaguaacguuuaaaaaugcacaugcaaagaaacaagaagugguuguacugggaucacaagaaggagcaaugcacacagcccuaacaggggcaacagaaauccaaaacuccggagggacaucaaucuucgcaggucaucuaaaauguagauugaaaauggauaaacuggaauuaaaagguaugagcuaugcuauguguacuaauacguucguacucaaaaaggaaguuuccgaaacgcaacacgggaccauucugaucaaaguggaauauaaaggagaggaugugccuugcaaaguuccuuuuagcaccgaagacggucaagguaaagcccauaaugggaggcuaauuacugcgaauccaguaguuacaaagaaagaagaacccgucaauauugaagcggaacccccauuuggcgaaucgaauauaguaauuggaaucggcgauaacgcauuaaagauaaauugguacaagaaaggcagcuccaucggaaaaauguucgaggcaaccgcacguggcgcccggagaauggcaauccuuggugauacagcaugggacuucgguucuguuggcggcguuuuaaacucacuugguaaaauggugcaccaaauauucggcagugcauacacagcauuauuuagugggguuaguuggguaaugaaaauagguauugguguacuacuaacguggauaggguuaaacagcaaaaacacuucaauguccuucucuuguaucgucauugguaucauuacauuauaucucggcgcaguaguucaagccgacaugggaugcgugaucaauuggaagggaaaagaacuuaaaugcgguagcggcauuuuuguuacaaacgaaguacauacauggaccgaacaauacaaauuccaggcggacucuccaaaaaggcucgcuacggcaauugcgggagccugggaaaauggaguauguggaauaagaagcaccacgcggauggaaaaccuuuuauggaaacaaauagccaaugagcuaaacuauauccugugggagaacaacauuaaauugacgguagucguuggugacaucauagguguucuagaacaagguaagagaacucugacuccacagccuauggaacuuaaauauuccuggaaaacuugggggaaagcuaaaaucgugaccgccgagacccagaauaguaguuucauaauagaugguccgaauacaccggaguguccuuccgcaagucgagccuggaauguuugggaggucgaggauuacggauucgggguuuucaguacaaacaucuggcuuaaauuacgggaaguauauacccagcucugcgaucauagauugaugagugcagcaguaaaagacgagagagcugugcacgcggacaugggauauuggauagaaagucaaaagaacggaaguuggaaacuugaaaaagcgucacuaauagaaguaaaaacaugcacuuggccuaagucccacacauuauggaguaacgggguacuagaaucagacaugauaaucccaaaaagccuagcgggacccauaucgcaacauaacuaccgaccaggauaucacacacaaaccgcagggccauggcaucuuggaaagcuagagcucgauuuuaacuauugugaaggaacuacuguugucauaacagaaaauugugguacucgaggucccucuuuacgaacgacuacaguuucagguaaauuaauacacgaaugguguuguagaucaugcacacuuccaccacuuagauauaugggcgaagauggguguugguauggaauggaaaucaggcccauaucagagaaagaagaaaacaugguaaagucgcuaguaucagcgggcuccggcaaggucgauaauuucacuauggguguucuuuguuuagcaaucuuauucgaagaaguaaugcgagguaaauucggaaagaaacacaugauagcaggcguauuuuucacuuuuguauuacuacuuucagggcaaaucaccuggcgagauauggcacacacuuuaauuaugauagggaguaacgcaagugaucguauggggauggggguaacuuaucuugcgcuaauagccaccuucaaaauacaaccauuucucgccuuaggauucuuucuaaggaaauuaacgagucgagaaaaucuccuacuaggagugggauuagcuauggcaacuacgcuacaacuaccugaggauauagagcaaauggcaaaugguauagccuuaggacuuauggcguuaaaacuaaucacccaauuugaaacauaucaacuuuggacagcacuuauuucacuaaccugcuccaauacaauauuuacucuaacagucgcauggagaacagcgacgcuuauacuugcaggggucucgcuacucccggucugucaaucaaguucaaugcguaaaaccgauugguuacccaugacgguggcagcaaugggcguaccaccccucccauuauucaucuuuucacucaaagauacguuaaagaggcguaguuggccucucaaugaaggcguaauggcagugggauuaguuucaauuuuggccucuaguuugcucagaaaugacguuccuauggccgggccgcugguagcaggagggcuguuaauugcuugcuacguuauaaccgggacaagugcagaucuaacaguagaaaaggcagccgauguaacaugggaagaagaagcugaacaaacugguguuucucauaacuuaaugauuacgguagaugaugauggcaccaugagaauaaaggaugaugaaacagaaaauauucuaacaguccuacuaaaaacagcauuacuuaucguaaguggaauauucccauauagcauaccagcaacucuuuuaguguggcacacauggcaaaaacaaacacaacgaagcggcguacucugggauguaccuuccccuccagaaacccaaaaagccgaauuggaagagggggucuaucgaaucaaacagcaaggaauauucggcaaaacacaagugggaguugggguucagaaggagggaguauuucacacuauguggcacgucacgcggggugccguauuaacauacaauggaaaacgccuagaaccuaacugggcuagcguaaagaaagaucugauuuccuacggaggaggauggagacuaagugcacaguggcaaaaaggagaggaaguacaagugauugcuguagaaccagguaagaauccuaaaaauuuucaaacaaugccugguacguuccaaacgacaacaggcgaaauaggagccauagcccuggacuuuaaaccuggaacgucagguucuccaauaauuaacagggaaggcaaaguaguugggcuuuauggaaauggaguaguaacgaaaaacggggguuaugugucagguaucgcacagacaaacgcugaaccagauggaccaacgccagagcuggaggaggagauguucaagaaaagaaacuuaaccauaauggaccuucauccuggcagugguaaaaccagaaaauaccuuccagcaauaguaagagaagcgauaaaacgucgacuucgaacuuuaauuuuagcgccaacucgcgucguagcagcagaaauggaggaagcauuaaaaggccuaccuauuagauaccaaacuacggcaacgaaaagugaacauacuggacgcgaaauaguagaccucaugugucaugcuaccuuuacuaugcgacuacuaucgccaguucgaguuccaaacuacaaucugaucauaauggaugaggcgcacuuuaccgauccugccagcauagcggcaagagguuauauaaguacacgcguagguaugggagaagcggccgcuauuuucaugacagcaacuccucccggcacagcggaugcguuuccgcagagcaacgcaccaauacaagacgaagaaagagacauaccugaacgaucuuggaacucggguaaugaauggauaacagauuuugcagggaaaacaguaugguucguacccucgauaaaagcgggaaaugacauagccaauugcuuaaggaaaaauggcaagaaaguaauacaguuaaguagaaaaacauuugauacagaguaucagaaaacgaaacuaaaugacugggacuucguaguaacaacagauauaagcgagaugggagcaaauuuuaaagcagacagaguuaucgauccucgacgcugccuaaagccagucauuuuaacagauggaccagaacguguaauucucgcaggaccuaugccgguaaccgcggcaagcgcagcucagcgucgagggagaguaggccgaaauccacaaaaggaaaaugaucaguauauuuucaccggccaaccccuaaauaaugaugaggaccaugcacauuggacagaagcaaaaaugcuauuagauaauauuaacaccccggaagggauaauaccagcuuuauucgaaccggaaagggagaaaucugcagcaauugacggagaauauagacuaaaaggagaaucacgaaaaaccuuuguagagcuaaugaggcgcggggaccuuccaguauggcuagcucauaagguagcaucagagggaauuaaauauacugaucggaaauggugcuucgacggucagaggaacaaucaaauuuuagaagagaauauggacguagagauuuggacuaaagaaggagagaaaaagaaacuaagaccccgaugguuagaugcuaggacguauagcgauccauuagcauuaaaggaguuuaaggacuuugcugcgggaaggaaaucaauugcccuggauuuaguuacugaaauaggaagaguaccuucucauuuagcccaucgcaccaggaaugcucuggacaacuuagucaugcuucauacgucugaacauggcggcaaagcauaucgacaugccguugaagaauugccagaaacgauggagacgcuguuacucuugggucuuaugauuuuacuaaccggcggagcaaugcuauucuuaauuucaggaaaggguauuggcaaaacaagcauaggacuuauuugcguuauagcuaguuccgggauguuauggauggcugaaauaccauugcaguggaucgcaucagcaauagucuuggaauuuuucaugaugguccuguuaauacccgaaccagaaaagcaaagaaccccgcaagauaaccaauuagcauaugugguaaucgggauauugacauuagcagcaauaauagcagccaaugaaaugggucuauuagaaacuacaaaaagagaccucgggaugaguaaagaaccaggaguaguuucuccaaccaguuaccucgacguagauuuacauccugcaagcgcauggaccuuguaugcaguagcuacaacggugaucacuccgauguugaggcacacaaucgaaaauucaaccgcaaacguaucucuagcggccauagcgaaucaggcuguaguacucaugggauuagauaaaggcuggcccaucucgaaaauggaccuuggcguaccguuauuagcucuaggauguuacagucaaguuaauccucuaacuuuaacagcagcaguacuccuuuuaauaacccauuacgcuauaauaggaccaggucuacaagcaaaagcuacaagagaagcucaaaaacgaacugcagcaggcauuaugaaaaauccaacaguggauggaauaaugacaauugauuuagaucccgucaucuacgauucaaaauuugaaaaacaauuagggcaaguuaugcuucugguucuaugugccgugcaauuacuacugaugcgaacaagcugggcucucugugaagcgcuaacgcuugccacagguccaauaacuacauugugggaaggcucuccaggaaaauuuuggaacacaacaauagcgguuucaauggcuaacauuuucagaggcucauauuuagcaggcgcugguuuggcauuuaguaucaugaaaagcgucggaacugguaaaagggguaccggaagccaaggggaaacauuaggagaaaaauggaaaaagaaacuaaaucaacuguccagaaaagaguucgauuuauauaagaaaucggguauaacagaagucgaucgaacagaagcgaaagaaggacucaaaaggggagaaauaacccaucacgcaguaaguagaggaucggcgaagcugcagugguucguugaacgaaauauggugauacccgaaggacgagucauagacuuaggaugcgguagggguggguggucauacuauugugcgggacuaaagaaagugacagagguaaggggauauacaaagggagggccaggacacgaggaacccguaccgaugucuacuuacggauggaauauaguuaaacuuaugagugguaaagauguuuucuaucuuccuccagaaaagugugauacacuguuaugugauaucggcgaaucuucgcccuccccaacaguugaagaaucuaggacaauucgaguccugaagauggucgaaccaugguuaaagaacaaucaguucuguaucaaagucuugaauccguacaugccaacugugauugaacauuuagagagauuacaaaggaaacaugggggcauguugguaagaaauccauuaucacguaauuccacacaugaaauguauuggaucaguaaugguacgggaaacauaguggcaucaguaaacauggucucaaggcucuuauuaaauagauucacuaugacgcaucgccguccgacgauagaaaaagacguagaucucggagccggaacccgucacguuaaugcagagccugaaacuccuaauauggacgucauaggagagagaauuaaacgcauaaaggaagaacacaauucuacauggcacuacgacgacgaaaacccuuauaagacgugggcauaccauggaucuuaugaaguuaaagcuacaggaucggccucuagcaugauaaauggugugguaaaguuauuaaccaaaccaugggacguaguucccaugguuacccaaauggcaaugaccgauacaacucccuucggccaacaacgcguauucaaagagaaaguagauacuagaacgccccgcaguaugcccggaacacgccguguaaugggcauuaccgcugaauggcuuuggcggacacucgguagaaacaagaaacccaggcuauguacacgagaggaguucacgaaaaagguaagaacaaaugcugccaugggugcaguauuuacagaagagaaccaaugggauucugcgaaggcugcgguagaggaugaagauuuuuggauacuuguggacagggaaagagaacuccauaaauuaggaaaaugcggaucaugugucuauaacaugauggguaaacgcgagaaaaaguugggugaguucgggaaagcuaaaggaagcagagccauaugguauaugugguuaggggcgagauaucuggaguucgaagcucuuggcuuccucaaugaagaucauugguuuucacgagaaaacagcuauuccggaguggagggagagggacugcauaaacucggauauauacuaagagauaucaguaaaauacccgguggggccauguacgcggaugauacagcagguugggauacucgaaucacagaggaugauuugcauaacgaagagaaaauaacccaacaaauggauccagaacacagacaacuagcuaaugccauuuuuaaacuuacauaucagaacaaaguaguaaaagugcaacggccgacaccgacaggcacaguaauggacauaauaagcagaaaagaucaacgagguagugggcaagugggcacauauggauuaaauaccuuuacaaacauggaggcucaauuaauaagacaaauggaaggugaaggagugcucuccaaagcagaucuggagaacccucauuuacccgagaagaaaauuacccaaugguuggaaacaaaaggagucgaaagauuaaaaagaauggcgauaaguggagaugacuguguaguaaagcccauugaugaucgauuugcaaaugcauuacucgcacuaaacgauaugggaaagguaagaaaagacauuccucaauggcaaccuucuaaaggcuggcaugacuggcaacagguuccuuuuuguagccaucacuuccaugaauuaauuaugaaggacggccgcaaacuugucguacccugccgaccucaagaugaauugauuggacgagccaggaucucacaaggagccggguggucguuacgggaaacugcaugccuaggcaaagccuacgcacaaauguggucucuaauguauuuucaccguagggaccuucgguuagccucgaaugccauuugcagcgcagugccaguccauuggguaccgacaagccgaacaacauggaguauacacgcacaucaccaguggaugacaacggaagacaugcuaacgguauggaauagaguauggauugaagacaauccuuggauggaagauaagacucccguuacuacgugggaaaauguacccuacuuaggaaaacgagaagaucaauggugugguagucuuauaggccuuaccaguagagcuacgugggcacaaaacauccccacugcaauacagcaaguacgaucccuuaucggaaaugaagaguucuuggauuauaugccaaguaugaaaagauuucgaaaagaggaagaaucugaaggagcaauaugguaa

SEQ ID NO: 23326 - RNA, 9873 nt, Artificial Sequence
  derived and/or modified CDS sequence (opt6) from DENV-3__EU687197__SS-prME
acgagucuaugccuaaugaugauauuaccagcugcucuggcauuucaccuuacaucgagagacggugaaccucgaaugauaguuggcaaaaacgagagaggaaaaucucuacuuuuuaaaacggcgucuggaauaaauauguguacgcugaucgcaauggauuugggagaaaugugugacgacacaguuacauacaaaugcccucacaucacugaaguugaaccggaagacauagacugcugguguaaccuaacuuccacuuggguaaccuacgguacuugcaaucaagcaggagaacacagacgugauaaacgaagcguagcuuuagcaccacacguagggauggguuuagacacaagaacacaaacuuggaugucugcagaaggugcuuggagacaaguagaaaaaguagaaacaugggcccuacgucacccgggauuuacaauauuagcguuauuccucgcgcacuauauaggaacgaguuuaacacaaaaaguaguuauuuuuauacuacuuauguugguuacgccuucaaugacaaugagaugcguaggagucggaaaucgagauuucguagaagguuugucuggugcaacuugggucgauguuguguuagagcacgggggauguguaacaaccauggcuaaaaauaaacccaccuuagacauugaacuacagaaaacagaggcgacgcaacuggcaacucuaagaaaacugugcaucgagggaaaaaucaccaacauuaccacagauucaagguguccaacccaaggagaggcuguauuacccgaagaacaggaccagaauuacguauguaaacauacguauguagacagaggauggggaaaugguugcggacuuuucggaaaagguaguuuaguaacaugugccaaauuucaauguuuagaaccgaucgaagguaaaguaguucaauacgagaauuuaaaauauaccguaauaauuacagugcacacgggugaucaacaccaaguugguaaugaaacccaaggaguaaccgccgaaauaacuccacaagcgucaacaacggaagccauauuaccggaauauggaacauuaggucucgaaugcaguccgcggacuggacucgacuucaaugagaugauucuguuaacuaugaaaaauaaggcuuggaugguacacagacaaugguucuuugaucuuccacuacccuggaccucuggugcuaccacagaaaccccaacauggaacagaaaagaguuguuaguuaccuucaaaaaugcacaugccaagaaacaagaagucguaguauuaggaagucaggaaggagcaaugcacacugcauuaacuggcgcaaccgaaauacaaaacucaggagguacaaguaucuucgcuggccaccuaaaaugccgacugaaaauggacaaauuagaauugaaaggcaugagcuaugcaauguguacaaauacguucguccucaagaaagagguaucggagacgcagcauggcacuaucuuaaucaaaguggaauauaaaggugaagauguaccguguaaaauaccauucucgacugaagauggacagggaaaagcacauaacggccgacuuauaacugcaaacccaguaguaacgaagaaagaagaaccagucaacauagaggcagaaccaccuuucggcgaaagcaauauuguaauaggaauuggagauaacgcgcuuaaaauaaauugguauaagaaaggcaguaguauugguaaaauguuugaggcaacugcgagaggagcuagaagaauggcuauauuaggagauacagcaugggauuuuggcucuguugguggagugcuaaauucauugggaaaaauggugcaucagauauuugguucagccuauacggcauuauuuucagggguuucgugggucaugaaaauaggaauaggaguccugcuaacauggauuggauuaaauaguaaaaauaccucuaugaguuuuaguuguauagcaauaggaauaauuacacuauauuugggagcaguuguacaggcagauaugggcuguguaguaaauuggaaaggaaaagaauuaaaauguggaucaggaauauuugugacuaaugaagugcauacauggacagaacaauacaaauuucaagcggauaguccuaaaagauuagcgacggcuauagccggugcaugggaaaacggaguuugcggaauccgaaguaccacccguauggaaaauuuacuauggaaacaaauagcuaacgaacucaacuauauacuaugggagaacaauauaaaacuaacuguaguaguuggagacauuaucggagugcucgaacagggaaaaagaacgcuaacuccccaaccaauggaacugaaauacaguuggaaaacauggggaaaagcuaaaauaguuaccgcggaaacgcaaaauucaucauucaucauagacgguccuaacaccccagaaugccccaacgccaguagggcauggaauguaugggaagucgaggacuauggauuuggaguuuuuaccacuaauauaugguuaaaacuacgggagguauauacucaacugugcgaucaucgucuaauguccgcagccgugaaagaugagagagccgugcaugcugauaugggcuauuggauagaaagucagaaaaacggcucuuggaagcuagaaaaagcgagucuaauagaagucaaaacgugcacguggccuaagagucauacucuaugguccaacggaguucuagagucggauaugauuauaccaaagagucuagcaggaccuaucagccagcauaauuauagaccgggauaucacacccaaaccgccgggccuuggcaucuggguaaacuagaacucgauuuuaauuacugugaaggaacgacaguuguuaucacagaaaacugcggaacaagagguccgucauuacgaacuacuacaguaucuggcaaauugauacacgaaugguguugcagaucguguacccugcccccacuucguuacaugggugaagacggcugcugguacggaauggaaauaagaccaauuucugaaaaagaagagaauauggugaaaucuuugguaucugcugggucgggcaaggucgacaauuucacaaugggaguucuaugccuugcaauccuauucgaggaagucaugaggggcaaauucggcaagaaacauaugaucgcgggaguauucuuuacauucguuuuacuacugaguggucaaauaacauggcgugauauggcccacacauuaauaaugauaggauccaacgcgagugauagaauggguaugggaguaacauaucuagcacugauugccacauuuaaaauccagccuuuucuugcucuuggcuucuuucugagaaaauuaacaucacgugaaaaucuauuauugggaguaggcuuagcaauggcaacaacccugcaauuaccagaagacauugagcaaauggcaaauggcauagcguuaggccuaauggcucucaaacucauuacccaauuugaaacguaucaauuauggacugcucuaauuucgcugaccuguagcaacacaauuuucacacucacaguagccuggagaacugccacccuaauucuggcagggguaagucuccugccuguaugucaaucaucaagcaugagaaaaaccgauugguuaccgaugacaguagcggcaaugggcguuccgccccuaccacuguuuauuuuuagucuaaaagacacuuuaaaaagacgcucauggccccuuaaugaggggguuauggcaguggggcucguaagcauauuagcuuccucuuuacuucgcaaugauguuccaauggcaggaccucuagucgccggaggguugcucauugcauguuacguuaucacugggacauccgcagauuuaaccguugagaaagcggcagaugugacuugggaagaagaggccgaacaaaccggagugagucacaaucuaaugaucacgguagacgaugauggaacaaugcguaucaaagacgaugaaacugaaaauauucuuacaguccuccucaaaacagcacucuuaauuguaucaggcauuuucccuuauaguauuccagcaacccuuuugguauggcauacguggcaaaaacaaacucaacgaagugguguucuuugggaugucccaucuccuccagagacucaaaaagccgagcuagaggaagguguauauagaauaaaacaacaagggauuuuuggcaaaacacaaguugguguggggguccagaaagagggaguguuucauacuauguggcacgucacucgcggagcugucuuggccuacaaugguaaacgccucgagccuaauugggcaucugugaagaaagauuugauaagcuacgggggcgguuggagacuaagcgcucaauggcagaaaggugaagaaguucagguaauagcuguagaaccggggaaaaaccccaaaaacuuccagacgaugccuggaacguuccaaacuacaaccggggaaauaggggcuauagcucuggauuuuaagccagggacgagcggcucucccauuauaaauagagaaggaaagguagucggauuauacgggaacggaguaguaacuaaaaacggaggauacguaaguggaauagcgcagaccaaugccgagcccgaugguccaaccccugaacuagaggaagagauguuuaagaaacgcaauuuaacaauaauggauuuacacccaggaagcggcaaaacuagaaaauaccuacccgcuauaguacgagaggcuauuaaaagaagacucagaaccuuaauacucgcaccgacuagggugguagcagccgagauggaggaagcacuuaaaggauuaccaauaagauaucaaacgacagcuacaaaaucggaacacacagguagggaaaucgucgaccuaaugugccacgccaccuucacaaugagacuauugucaccuguccgaguaccaaauuauaauuuaauuauuauggaugaagcacacuuuacggauccagcaucaauagcugccagaggcuauaucaguacaagagugggaaugggugaggccgcugccauauuuaugaccgcuacaccaccugggacugcagacgcuuuuccacagucuaaugccccaauucaagaugaagaaagggacauuccggagaggucauggaauagcggcaaugaauggaucacugauuuugcgggaagaacuguaugguuuguuccuucuauaaaagcagguaacgacauagcuaauugccucaggaagaauggaaagaaaguaauccaauuaagccgaaaaacguucgauacagaguaccagaaaacuaaauuaaaugacugggauuucguagugacgacagauaucuccgagaugggagcuaacuuuaaggcugauagaguaauagauccucgucgauguuuaaaaccggugauauuaacugacggaccggaaaggguuauacuagccgggccuaugcccguuacggccgcguccgcagcacaacgacguggacgggucgguagaaacccccaaaaagagaaugaucaauauauauucaccggacagccacuaaacaacgacgaagaccacgcacauuggacugaagcuaagaugcuucuagauaacauuaauacgccugagggaauuaucccagcgcuauucgaacccgaaagagaaaagucagccgcgaucgacggcgaguauaggcuuaagggggaaaguagaaagacguuuguugaacucaugagacgcggagauuuacccguguggcuggcacacaagguagcuagugaagguauaaaguauacagauagaaagugguguuucgauggccaaagaaauaaccagauucuugaggagaauauggacguugaaauauggacuaaagagggggaaaggaagaaauuacguccgagauggcuugaugcucgaaccuacucugauccacuugcucuuaaggaauuuaaagauuuugcugcuggccguaaaucgauagcucuugaccuaguuacagaaauugguagggucccuagucauuuagcacacagaacccggaaugcucuggacaaucuaguaaugcugcacaccagcgaacauggcgguaaagcauacaggcaugcuguagaagaacuaccggaaacaauggaaacacuauuauuacucggccuuaugauuuugcuaacagguggagcgauguuauuuuuaauuuccggaaagggaauaggaaaaacaucuauaggacuaauaugcgucauugcuucuucagggaugcuuuggauggcagaaauaccguuacaauggauagcgagugcaauaguacuggaauuuuucaugaugguacuauuaauccccgaaccagaaaaacaacguacgccccaagauaaucagcuagccuacguuguuauagggauacuaacuuuagcggccauuauugccgcaaaugagaugggcuuguuagaaacuacuaaaagggacuugggaaugagcaaagaaccggguguugugagucccacaaguuaccucgauguagaucuacauccggcaagcgcguggacucuauaugccgucgcaacuacuguuaucacgccaauguuacgacacacaauagaaaacagcaccgcgaacgucucucuagcggcaauagcaaaccaggcgguugugcuaaugggauuagauaaaggauggccgauaagcaaaauggaccuuggugugccacuccucgcucuugguuguuauucacaaguaaauccacucacacuuacagcggcuguguuacuauuaauaacucauuaugcaauaauagguccuggacuccaagcaaaagccaccagagaagcucagaaacgaacagcagcaggaauaaugaaaaauccaacuguagacgguauaaugacaauugaucuugauccuguaauuuacgacucaaaguuugaaaagcaacuaggacaaguuaugcucuuaguacuaugugcgguucaauuacuguuaaugagaaccucuugggcucuaugcgaagcucucacauuagcuacgggucccauuacaacguuaugggaaggaaguccuggcaaauuuuggaauacgaccauagcaguauccauggcgaauauauuucgaggaucauaccuggcaggagcuggucuugcauuuaguauaaugaaaucuguaggaacaggaaaaaggggaacugguucccaaggugaaacauugggugaaaaguggaagaagaaauuaaaucaguugucacgaaaagaguuugacuuauacaagaaaagcggaauaacggagguugacagaacagaagcgaaagagggcuuaaaacggggagaaauuacacaccacgcugucucucgcgggagugcuaaauugcaaugguuugucgaacggaacaugguaauacccgaaggcagaguaauugaucuaggauguggacgugguggguggagcuacuacugcgccggauuaaagaaaguuacugaaguucggggcuauacaaaaggcggaccaggacacgaggaaccgguuccaaugucuacguacgguuggaauaucguaaaacugaugagcggcaaagauguauuuuaccuuccaccugagaaaugugauacauuacuaugugauaucggugaaagcucaccaucaccgaccguagaggaaucaagaacaauuaggguccuuaagaugguggaaccuuggcugaagaauaaccaauucuguauaaaaguauuaaaucccuacaugcccaccgucauagaacaccuggaacgccuccaacguaagcacggagggaugcuaguucgcaauccauuaagucgaaauucuacgcaugaaauguauuggauuucaaaugguacggguaauaucguagcgucagucaacaugguaagccgucuacucuuaaacagguucacgaugacacaccguagaccaaccauagaaaaagauguggacuuaggcgcggguacucgucaugucaaugcugagccagaaacuccgaauauggaugugauuggagaaagaauuaagagaaucaaagaagaacauaacaguacuuggcauuaugaugaugaaaaccccuauaagacaugggcguaucaugguucauacgaggucaaagcuaccgguucggcgagcucaaugauuaauggcguaguaaaacuucuaacuaagccuugggauguuguaccaaugguaacgcaaauggcaaugacagacaccaccccuuuugggcagcaacgaguguuuaaagagaaggucgauacaagaaccccuagaagcaugccuggaacaagaaggguuaugggaauaacagcggagugguuauggagaacgcuaggacgcaauaaaaagccccgacuauguacuagagaagaauuuaccaagaaaguuagaacgaaugcagcgaugggcgccgucuuuacggaagagaaucaaugggacuccgcgaaagcagccguagaagacgaagacuuuuggaaacuuguagaucgagagagagaacuccacaaacuagguaaaugcggcucuuguguguacaauaugaugggaaaacgugaaaagaaauuaggagaauuuggaaaagcaaaggguucacgggcaauuugguauauguggcuaggagcuagauaccuagaauuugaagcccuugguuuccucaaugaggaccauugguuuucgcgcgaaaauucauacagcggaguagagggcgaagguuugcauaaauuaggguauauuuuaagagauauaucaaaaauaccgggcggugcgauguacgcagacgacacagccggaugggacacgagaauaacggaagaugauuuacauaaugaagaaaagauuacccaacaaauggaucccgaacaucgacaauuagccaaugccaucuuuaaacuaacauaucagaauaaagucguaaaagugcaaaggccuacaccuacugguacagucauggauauaauauccagaaaggaucaaaggggcaguggacaaguagggaccuauggucuaaauacuuucacaaacauggaagugcaauuaauuagacagauggaaggggaaggaguucuuucgaaagcugaucuggaaaacccucacuuaccugagaagaaaaucacucagugguuagaaacaaaaggcguagaaagacuaaaacgcauggccauaagcggggacgacugcguaguaaagccaaucgaugaccguuuugcaaacgcauuauuggcauuaaaugacauggguaaaguaagaaaagauauuccacaauggcagccaucuaagggcuggcacgacuggcaacaaguaccauucuguucacaucacuuccaugagcuuauaaugaaagacggacgaaagcuaguaguacccuguaggccgcaggacgaauuaaucggucgagccagaauaucucaaggugccggauggaguuuaagggaaacugcaugcuuaggaaaagcauaugcacaaauguggagucuuauguauuuucauaggagagauuuaagacuagcaucuaaugccauuuguucagccguaccaguacacugggugccaaccaguagaaccacauggaguauccaugcacaccaccaguggaugacaacggaagauaugcuuacaguauggaauagaguauggaucgaagauaaucccuggauggaagauaaaaccccuguaacaacuugggaaaacguaccuuaucuagggaaaagagaagaucaguggugugggucacuuauaggacuuacaucuagagcgacuugggcucaaaacauuccuaccgcaauucaucaaguuagaagccuaauagguaaugaagaauuuuuggacuauaugccuagcaugaaaagguucagaaaagaggaagaacuagagggggccauuugguaa

SEQ ID NO: 23327 - RNA, 9873 nt, Artificial Sequence
  derived and/or modified CDS sequence (opt6) from DENV-3__EU687198__SS-prME
acuagcuugugcuuaaugaugauauuaccugcagcucuugcuuuccaucugacuucacgagacggggaaccccguaugauaguagggaaaaaugaacgaggaaaaucuuuauuauucaaaacugcaucaggaauaaacauguguacgcuuaucgcuauggaucuuggagaaaugugugaugacacaguuaccuauaaauguccgcauaucgcagaaguugaaccugaagauauagacuguugguguaacuuaacaaguacauggguuacauauggaaccuguaaccaagccggugaacaucgucgggacaaaagaucaguggcacuugccccucacguaggaauggguuuagauacccgaacgcaaacguggaugagugcagaaggagcauggcgacaaguagaaaaaguagaaacaugggcguuaagacacccagguuucacuauacuagcauuauuucuugcccauuauauugguacuucuuuaacucaaaaaguaguaaucuucauucuccuuauguuaguaacuccaaguaugaccaugcgcugcguugguguagggaacagagauuuuguagaaggucucaguggggcuacauggguagauguggugcuagaacacggaggguguguuacaacaauggccaaaaauaaaccaacacuagacauagaguuacagaaaacggaagccacacaacuagcaacauugagaaaauuaugcauagaggguaaaauaacgaauauaacuacagacagucguuguccuacgcaaggagaggcaguccuuccagaagaacaagaucaaaacuauguuuguaaacauacuuaugucgacaggggaugggguaacgguuguggucuuuuuggaaaaggaucguuaguaacuugugcuaaauuccaaugucuggagccgauagaagguaaaguggugcaguaugaaaaccugaaauauacaguuauuauaacagugcacacaggagaucaacaccaaguagguaacgaaacacaaggagucacugccgaaauuacuccacaagccucaacaacggaggcaaucuugcccgaauauggaacucuuggguuggaaugcagcccuaggacuggccuagauuuuaaugaaaugauauuguuaacaaugaaaaacaaagccuggauggugcacaggcaaugguucuucgaucugccucugcccuggacaaguggagcuacuacugagacaccuaccuggaauagaaaagagcuauuagugacauucaaaaacgcgcaugccaagaaacaagaaguaguaguacugggaagccaagaaggugcuaugcacacggcacuaacuggugccacugaaauucaaaacagcgguggaacaaguauauuugccggacacuuaaaaugcagacucaaaauggauaaacuugaacuuaaaggaaugucuuaugcgauguguacaaauacauucguacuaaagaaagaagugucagagacacaacacggaacgauucucauaaaaguugaguauaaaggggaagacguacccugcaagauaccauuuucgacagaagauggucaaggcaaagcucauaauggaagauugauaacugcaaacccuguaguaacuaagaaagaagaaccggucaacaucgaggcggaacccccauuuggagagaguaauauaguuaucggcguuggugacaaugcucucaagaucaacugguauaagaaaggcucaucuaucgggaagauguucgaagcuacagcuagaggcgcgagaagaauggcaauucucggagauaccgcuugggacuuugguagcguagguggaguauuaaauucucucgguaaaaugguccaucagauuuucggaagcgcauacacagcuuuauuuucagguguuucuuggguuaugaaaauaggaauugguguacuucucacguggauuggcuugaauaguaaaaacacuagcaugagcuucagcugcauugcaauaggaauaauaacuuuauaccuaggagcggucguucaagcagauaccgguuguguuaucaauuggaagggaaaggaacuaaaaugcggguccggaaucuuuguaacuaaugaaguccacacauggacagaacaauacaaauuucaagcugacucuccuaaacgauuagccacugcaauagcuggugcaugggagaacggaguaugugguauacgcucgacaacuagaauggaaaaucuccuauggaagcaaaucgcgaaugaauuaaacuauauacuuugggaaaauaauaucaaacuuacuguaguggucggggacauuauaggaguccuagaacagggcaaaagaacccuaacuccacaaccaauggagcuuaaauauuccuggaaaaccuggggaaaagcgaaaauuguaacagcggagacacaaaacucaaguuuuauuauagaugguccaaacacgcccgaaugucccucugcaucucgagcuuggaaugugugggaaguagaagacuacggauuuggaguuuuuaccacgaacauuuggcucaagcucagagaaguguauacgcaacucugcgaccacagauuaaugucugcagcaguuaaagacgaaagagcaguacaugcagauaugggcuauuggaucgaaagccagaagaacggaagcuggaaacuugaaaaagcgucucuaauagagguuaagacguguaccuggccaaaaucgcacacauuguggucuaacgguguccuugaaucagauaugaucaucccuaaaagucuagcuggcccaaucucacaacacaacuaucgaccaggguaucauacacagaccgccggaccuuggcaccuagguaaacucgaacuagauuuuaauuauugugaggggacaacaguagugauaacagaaaauugcggcacucgaggaccgagucuaagaaccaccaccgucucaggaaaauuaauucacgaaugguguugccgaaguugcacauuaccacccuuacgauacaugggggaagaugggugcugguacgggauggaaauccguccaauaucagaaaaagaagagaacaugguuaaauccuugguuagcgcggggucgggaaaaguagacaacuuuacaaugggggugcuaugcuuggcaauacucuucgaggaaguaaugagaggcaaauuuggcaagaaacacaugauugcggguguauucuuuaccuucguucuacucuuaucaggacaaaucacguggcgugacauggcucacacgcuuauuaugauaggauccaacgccucagaucgaauggguaugggugucacuuacuuagcgcugauugcaacguucaaaauccaaccguuccuagcacuaggauucuuucugagaaaauuaacaaguagggaaaauuuguuauuaggaguaggguuagcaauggcaaccacucuacaacuaccagaggauauagaacagauggccaacggcauagcacuuggauuaauggcuuuaaaacugauaacacaguuugaaacauaccaauuauggacggcacuaauaucgcuuacaugcaguaauacaaucuuuacccucacaguagccuggcgaacagccacccuaauucuugccggugucagucuccucccaguaugucagagcucaaguaugcgcaaaucugauugguugcccaugacggucgcagcaaugggagucccaccccuaccuuuguuuauauuuucuuugaaagauacccuaaagcgacgaucauggccucuuaaugaggguguaauggcgguuggacuugugucuauucuagcaucgagcuuacugcgaaacgauguccccauggccgggccauuaguagcagggggauugcucaucgccuguuacguuauaacaggcacauccgcggauuuaacggucgaaaaagcugcugauguuacuugggaagaagaggccgaacaaacugggguuagucauaacuugaugauaaccguagaugaugauggcacaaugaggauaaaagaugaugagacugagaauauuuuaacuguucugcuuaaaacugcgcuauugauaguaagcggaauuuucccguacucaauaccugccacacuauugguguggcauacauggcaaaaacagacucgucgaagcggaguccuuugggauguuccaucgccgccagaaacgcaaaaagccgaacuagaagagggugucuaucgaaucaaacaacaagguauuuuugguaaaacacaaguagguguugguguccaaaaagaaggaguauuucauacgauguggcauguuaccagaggggccguccuaacuuacaaugggaagagacuugaaccuaauugggcaucagucaagaaagaucuuauuucauauggcggaggauggagacugagugcccaauggcaaaaaggagaagagguucaagugauagcaguagagccaggcaaaaacccuaagaacuuucaaacaaugccagggacguuucaaacuacgacuggagagauuggggcgauagcauuagacuuuaaaccaggaacuucgggcagcccuauaauaaauagggaaggcaaaguaguuggguuauacggaaacggcguagucacuaaaaauggaggauacguaaguggaauagcgcaaacaaaugcugaaccggacggaccaacucccgaauuggaggaagagauguucaagaaacgaaacuugacuauuauggauuuacauccuggcagcgguaaaacacgaaaauaccugcccgcgauaguucgcgaagcuauuaagcgacgccucagaacacuuauuuuagcaccaacccggguaguagcggcagagauggaagaagcccugaagggacuuccuauuagauaucaaacaacggcaacuaaaucugaacacacagguagagagauaguugaucuaaugugccaugcuaccuuuacgaugagacuauuauccccuguaagaguuccuaauuauaauuuaauaauaauggaugaagcccauuuuacagacccggccaguauugcagcucgugguuauauuaguacucgaguuggcaugggcgaggcugcagcaaucuucaugacagcaacuccucccggaacagcagaugcauucccacagucaaacgcaccaauccaagaugaggagcgugacauaccugaacgcucauggaacuccgggaaugaauggauaacagacuucgcgggaaagaccguaugguuuguaccaucaauaaaagcuggaaaugacauagcaaacuguuuaagaaagaacggcaagaaagucauccaguugaguaggaaaacuuucgauacagaguaccagaaaacccgguuaaacgauugggacuuuguuguaacaacagauaucucagaaaugggggcuaauuuuaaagccgauagagugaucgauccgagacgaugccuaaaaccuguaauacuaacggacggaccagaaagaguuauauuagcggguccgaugccagucacugcggcaucggcugcacaaagaagaggaagaguugguaggaauccacagaaggagaacgaccaauauaucuucaccgggcaaccuuugaauaacgaugaagaucaugcacauuggacagaagcaaaaauguuacucgacaauauaaauacaccugaaggaaucauacccgcguuauuugaaccagaaagagagaaaagugccgccauugauggugaauacagacuuaaaggggaaagccgaaagacauuuguagagcuuaugcgcagaggagauuuaccagucuggcuggcacauaaaguagcaucugagggaauaaaguauacugaucgaaaauggugcuuugauggucaacgcaauaaucaaauucuugaggagaacauggacguugaaauuuggacuaaggaaggagagaagaagaaacugcggccgagauggcuugaugcucguaccuacucagauccgcuugcauugaaagaauuuaaagacuuugcggcuggaagaaagucaaucgcccuggaucucgucaccgaaauuggaagaguaccuucacauuuagcacauaggaccaggaaugcgcuggacaaccuuguaauguuacacacguccgaacacggaggcaaggcuuauaggcaugcugucgaggaauuaccagaaacaauggagacucuacuauuauuaggauugaugauuuuacuaacaggaggggcaaugcuguuccugauaagugguaaaggaaucggaaaaacaagcauugggcuaauuugcguuauagcgaguagcgggaugcuauggauggccgagauaccacuucaauggauugcgagugcaauaguacuagaguucuuuaugauggugcuacucauuccugaaccagagaagcaaaggacaccacaagacaaucaauuagcguaugucguaauugguauuuuaacacuagcagcaaucaucgcugcuaacgagaugggcuuacuugaaaccacuaaacgagauuuagguaugucaaaagaaccaggcguaguguccccaacgagcuacuuagauguugaccuccauccagcaucagccuggacuuuguaugcaguagcaacuacaguaauaacaccaauguuaaggcauaccauagaaaauucaaccgcuaaugucucuuuagcggcaauagccaaccaagcaguaguacuaaugggguuggauaaaggauggcccaucuccaaaauggacuuaggggugccgcuacucgcauuaggauguuauucacaagugaauccuuuaacuuugacugccgccgugcuauuacuuauuacucauuaugcuauaaucggcccuggacuucaagcuaaagccacccgagaagcucagaaaaggacggcugccgggauuaugaaaaacccgacaguugaugguauaaugacgauagaucucgaucccguaauauaugauucaaaauucgaaaaacaacuaggccaaguaaugcuauuaguuuuaugcgcuguacagcuccuauuaaugagaacaagcugggcacuaugugaagcacuuacauuagcaacggggccuauaacaacauuaugggaggguucuccaggaaaauucuggaauacgacaauugcuguuucaauggcuaauauuuuucguggcucauaucuugcaggagcaggacuagccuucucaauaaugaaaaguguuggaacgggaaaaagagggaccgggucacaaggcgaaacuuuaggagaaaaauggaagaagaaacucaaucaauugucacgaaaagaauuugaucucuacaaaaaguccgggauuacugaaguagacagaacugaagcaaaagagggguugaaaagaggagaaaucacccaccacgccguaagccgggguagcgcgaagcuacaaugguuuguugaaagaaauaugguaaucccggagggaagaguaauagaucugggaugcgguagaggagguuggucuuacuacugcgccggucuaaagaaagucacggaagucagagguuauacaaaaggagggccgggucaugaagaaccaguaccgaugaguacuuaugguuggaacauaguuaaacuuaugagcgggaaagauguuuucuaccugccgcccgaaaagugugauacuuuauuaugcgauaucggugagucaucacccucaccuacagucgaggaaagcagaacaauccguguacuaaagaugguagaacccuggcuuaaaaauaaucaauuuuguauaaaaguauuaaauccguauaugccuacagucauugaacauuuagaaagacuacagagaaaacauggcggcaugcuuguuagaaacccucucucaaggaacuccacgcaugaaauguauuggaucucuaacggaaccgguaauaucgucgcaucaguaaacauggugagccgccuuuugcuuaauagauuuacaaugacacauagaagaccaacuauagaaaaagauguugaccuaggggcagguacgaggcauguaaaugcggaacccgaaacuccaaacauggauguuauuggggagaggaucaaaaggauaaaagaagaacauaacaguacuuggcacuaugaugaugaaaauccauauaaaacaugggcauaucacggaucauacgaaguaaaagcgaccgguagugcuucaucaaugauaaaugguguaguaaaacuuuuaacaaaaccuugggacguuguaccaauggugacucaaauggcaaugacagauacgaccccuuucggacaacaacggguauucaaagaaaagguagauacuagaaccccucguucaaugccaggaacaaggcgcguaaugggaauaacugcagaaugguuauggcggacgcucggacggaauaagaaaccuagacuauguacgcgagaagaauuuacgaagaaaguacguacuaacgcagcgaugggagcuguguuuaccgaagaaaaucaaugggauucggcaaaagcagcuguagaagaugaggauuuuuggaaacuuguugacagagaacgugaguuacauaaguuaggaaaaugugggucaugugucuauaauaugaugggaaagcgagagaagaaacucggagaauuuggcaaggcaaaggguagcagggcaauuugguacauguggcuaggugcaagauaucuagaauuugaagcucugggauucuugaaugaggaucacugguuuucgcgagaaaauucauacucaggaguagaaggagaaggauuacacaaauuaggcuacauacuaagggacauaucuaaaauaccagggggugcaauguacgcagaugauacugcuggcugggacaccagaauuacagaagaugauuuacauaacgaagaaaagauaacacaacaaauggaccccgaacauaggcaauuggcaaaugcaauauuuaaauuaacguaucaaaauaagguaguuaagguacaacggccgaccccuacugguacaguaauggacauaauuucgagaaaagaccaaagggggagcggucaaguuggaacauauggacuaaacacuuucacaaacauggaagcccaacuaauccgucagauggagggggaaggaguauuaaguaaagcagauuuagaaaacccccacuugucagaaaagaaaauaacccaaugguuagaaacgaaagggguagagagacuaaaaaggauggcaauaucgggugacgauugcgugguaaagccaauugaugaucguuuugcuaaugcguugcuagcccucaaugacaugggaaaaguacggaaggauauaccgcaauggcaaccaucuaaggguuggcacgacuggcagcaaguuccuuuuugcucccaccauuuucaugaacugauaaugaaagaugguaggaagcuagucguaccuugcagaccucaagaugaauuaauugguagggcacggaucucccagggagccggauggucucuucgagaaacugcaugucugggcaaggccuaugcccaaauguggagucugauguacuuucauagacgcgaccuuagguuagcaucuaaugcuauauguucugcuguaccuguccauuggguaccuacaagucguacaacguggaguauccacgcgcaucaucaguggaugacuacugaggacaugcugacagucuggaauagaguauggaucgaggacaauccguggauggaagauaagacgccgguaacaacgugggagaauguuccuuaccuaggaaagagagaagaucaguggugcggaucgcuaauuggacuaacaucgcgcgcuaccugggcacaaaacaucccaacugcgauucaacagguucggaguuuaauugggaacgaggaauuuuuagauuacaugccaucgaugaaaagauuccgcaaagaagaagagucagaaggagcaaucugguag

SEQ ID NO: 23328 - RNA, 9873 nt, Artificial Sequence
  derived and/or modified CDS sequence (opt6) from DENV-3__EU726769__SS-prME
acaagccuaugccuaaugaugauucuaccagcagcucuagccuuccauuuaaccucacgggacggagaaccacggaugauuguuggcaaaaacgagcgggguaaaucucuucuguucaaaacagcaagcggcaucaauauguguacucuaauagcuauggacuuaggagaaaugugcgaugacacuguaacauauaaaugcccucauauuaccgaaguagagccugaagacauugacugcugguguaaucucacaucaacauggguuacauacggaacauguaaccaagcgggcgaacacagacgagauaaacgaagcgucgcacuagcaccccacguugguaugggucuagacacacguacacaaacguggaugucugcugaaggugccuggcgacaaguagaaaaaguugaaacaugggcuuuaagacacccgggguucacuauauuagcuuuguuuuuagcacauuauauaggaacuucauugacacaaaaaguagugaucuucauacugcuaaugcuuguaaccccuaguaugacgaugcguuguguaggagugggaaacagagauuuuguagagggguuaucaggcgcuacauggguagauguuguacuugagcauggcggcuguguuacaacuauggccaaaaauaaaccaacguuagauauagaacugcagaaaacugaagcaacacaauuagcaacauuaaggaaacuauguauagaagguaaaauaacaaacauaacuacagauucccguuguccgacacagggagaagcaguacuaccagaagaacaagaccaaaauuacguuuguaaacacaccuacguggauagaggauggggcaauggaugcggccucuuugguaaaggcagucugguuacuugcgcuaaauuucagugcuuagaaccaauugaggguaaaguaguacaauacgaaaacuuaaaauacacuguaaucauaacaguacauacuggagaucagcaccaaguagguaaugaaacacaaggagucacugcugaaauuacaccacaggcaucuacaacagaagcgauauugcccgaguacgguacauugggucucgaauguagcccucgaacuggccuagauuucaaugaaaugauucuauugacaaugaaaaacaaagcauggauggugcaccgacaaugguucuuugaccuaccauugccguggaccucaggggcuacgacagaaacaccaacauggaaucgcaaagagcuucuuguaaccuucaaaaacgcacaugcaaagaaacaggagguuguaguuuuagggagucaggaaggggccaugcacacagcauuaacaggcgcaaccgagauccaaaauucuggagggacgagcauauuugcgggccaccucaaauguagacuaaaaauggauaaauuagaauuaaaaggcaugucguacgccauguguacaaacacuuucguauuaaagaaagaaguuuccgaaacacagcauggaacuauauugauuaagguugaauauaaaggagaagacguuccuugcaaaauuccauuuucuacagaggacgggcaaggaaaagcucauaauggccgauuaauaacagcuaauccagucgucacgaaaaaggaggaaccuguaaacauagaagcggaaccaccauuuggagaguccaauauugucauuggaauaggcgauaacgcacuuaaaauuaacugguauaaaaagggguccagcauuggaaagauguuugaggcgacagcacgaggagcucgcagaauggcaauuuuaggagacacagcgugggauuuugggagcgucggaggaguuuuaaacuccuuagguaagaugguacaucagauauuuggaucagccuauacugcucuuuucaguggaguaucaugggugaugaaaaucggcaucggagucuuguuaacguggauaggucucaauucuaaaaacacuagcaugucauuuucuuguauaguaauaggaauaauaacgcuauaccuaggcgccguuguacaagccgauaugggauguguaauaaacuggaagggaaaagaauuaaagugcgggucaggaauauucguaacuaacgagguucacacuuggacggaacaauacaaauuucaagcugauucgccaaaaagauuggcaacagcgauagcaggcgcaugggaaaacggugugugugggauacguuccacgacucgaauggaaaaucuccucuggaaacagauagcaaacgaguuaaauuacauacuaugggaaaauaacauaaaauuaacagugguaguaggggacauaauuggaguguuggaacaagggaaaaggacacugacgccccaaccuauggaauugaaguauaguuggaaaacuuggggcaaagcuaaaauagugacugcugagacgcaaaacagcucuuuuauuaucgaugguccaaauacuccagaaugcccgucugcgagcagagccuggaacguaugggaaguugaggauuaugguuuuggcguauucacuacuaauauaugguuaaaacucagagaaguguacacacaauuaugugaccacagauuaaugagugcagcagugaaagaugaacgggcuguucacgccgacaugggauacuggauagaaucucagaaaaaugguaguuggaaauuagaaaaggcuucacuuauugaaguuaaaaccuguacguggcccaaaucccauacacuauggaguaacgguguuuuagaaagugauaugauaauuccuaaaucguuagcagggccaauaucacaacauaauuaucguccaggauaucauacccaaaccgcaggucccuggcaccuagggaaauuggaauuagacuuuaacuacugcgaaggcaccacagucguaaucacagaaaacugcgggacaagagguccuucacuucgaacaaccacagucucuggaaaacucauacaugaguggugcugucgcucuugcacgcuaccuccauuaagauacaugggggaagauggaugcugguacgguauggagauacgacccauuucagaaaaagaagaaaauaugguaaaaagccuaguaagcgcaggaagcggaaaaguagacaauuucacaaugggaguucugugccuagcuauuuuguucgaagaagucaugagagggaaauucgggaagaaacauaugguugcaggaguauucuuuaccuuuguacuauuacuuagcggucaaauaacguggagggauauggcgcauacauuaauuauggucggaucaaaugcuuccgauagaaugggaaugggggucacguacuuagcgcuaauugcgacuuuuaaaauacaaccauuccuugcacucggguucuuuuugcgcaaauuaaccucgagagaaaaucuacuuuuaggugugggauuagcuauggcaaccacucuccaacuaccugaagacauugaacaaauggcuaacggaauagcacuuggacuaauggcccuaaaguuaauaacacaguucgaaacauaucagcuuuggacugcacuuaucagucuaacguguucuaacacaauuuucacauugacaguugcguggcguaccgcaacauuaauacuggcaggagugagcuuacuaccagucugucaaucaucgaguaugcgaaaaacagacuggcugccaaugaccguugccgcaauggguguaccuccacuaccucuauucauauuuucauugaaagacacucucaaaaggagaucguggccauuaaacgaaggaguaauggcaguagggcuggucucuauacuugcauccucgcuuuuacgcaaugacguaccuauggccgggccccuaguugcaggcggauuacuuauagcauguuauguaauaacaggaacgucugcugacuuaaccguagaaaaggcagcugauguaaccugggaggaggaagcggaacaaacugggguuucccacaacuugaugauuacggucgaugacgauggaacgaugcguauaaaagacgaugaaacagaaaacauuuuaacuguauuauugaaaacugcucucuuaauugugucugguaucuuuccuuacaguauuccagcgacuuuauugguauggcacacguggcaaaagcaaacgcaacguucaggaguucuuugggauguaccauccccaccugagacucagaaagcggaauuggaagaggggguauauagaauuaaacagcaaggaauauucggaaaaacccaagucgguguaggaguucagaaggaaggaguuuuccacaccauguggcacguuacucgaggcgcgguauuaacauauaaugguaaacgguuggaacccaacugggcuagugucaagaaagaucugauaucauauggagggggauggagacuaucagcucaauggcagaaaggagaagaaguccaagucauugccguggaaccggguaagaauccuaaaaacuuucagacaaugccaggaacauuccaaacgacgacuggagaaauaggugcgaucgcacuggauuucaaaccaggaacgucagguagucccaucauaaaucgagaagguaaggucguuggacuuuaugguaauggcgugguaacuaaaaauggcggcuauguaucuggcauugcacaaaccaaugcugaaccugauggcccaaccccggagcuugaggaagagauguuuaaaaagagaaacuuaacuaucauggaccuacacccgggcuccgguaaaacccgcaaauauuuaccugcuauugucagagaagcaauaaagagaagauugagaacgcuaauauuagcuccgacgaggguuguugccgcagagauggaagaagcauuaaagggauuaccuauacgcuaucaaacaacagcaacaaaaucagaacauacaggacgugaaauagucgaucugaugugccaugcaaccuucacaaugagacuguuaagcccuguuagagugccuaauuauaaucuuaucauaauggaugaggcucauuucaccgacccugcuucuauagcggcaagaggauauauaucaacgcgaguagguaugggagaggcagcagcaauauuuaugacugcuacaccgccagguacugcugacgcauuuccucaaucgaacgcgcccauacaagaugaagaaagagacauaccagagcgguccuggaacucaggcaacgaauggauaacagauuucgccggaaaaacuguaugguuuguucccaguauaaaagccggaaacgauauugcuaacuguuuaaggaaaaacggaaagaaagucauucaacuaucgagaaagacuuuugauacggaauaucagaaaaccaagcuaaaugauugggauuuuguuguuacaaccgacaucucggaaaugggagcgaacuucaaggccgacagggucaucgauccacguagauguuugaaaccuguaauauuaacagauggcccagaaagaguaauauuagcagguccaaugccaguuacugccgcaucggcagcucaaagacgugguagagucggucgaaauccucaaaaggagaaugaucaauauauauucacaggucaaccucuuaacaaugaugaagaucacgcgcacuggacagaggcaaaaaugcuauuagacaacauaaauacuccagagggaauaauucccgcgcuauuugaaccagaaagagagaaaagugcagcaauagauggugaauauagacuaaagggcgaaucacgaaagacauuuguagagcugaugagacgaggcgauuuaccgguuuggcuagcucauaaaguugcaagugaagggauuaaauacaccgacaggaagugguguuuugauggccaacgaaauaaccaaauuuuagaagaaaacauggauguagagauuuggacaaaggaaggggagaagaagaaacuccgaccuagauggcuagacgcuagaacauauagugauccccuagcguugaaagaguuuaaagacuuugccgcagggcggaaaucaaucgcucuagaucuugugaccgagaucggaagagucccaagucacuuagcccaucggacacgcaaugcguuagacaaucucguaaugcuccauacgagcgaacacggugguaaagcguacagacaugcaguugaggaauuaccagagacaauggagacauuacuucuacuaggauuaaugauccuacuuacuggaggugcuaugcuuuuucuaauaaguggaaaggguaucggcaagacaucaaucggacuuauuugugucauugcuaguuccggcaugcuauggauagcagagaucccguugcaauggauugccucugcuauuguacucgaauuuuucaugaugguuuuauuaauaccagaaccugagaagcaaagaacaccccaggauaaucaacuagccuacguugucauaggaauuuuaacucuagcggcuauaauagcagccaacgagaugggcuuacuggagacaacaaaacgcgaucugggcaugaguaaagaaccagggguaguaucuccaacaaguuacuuagauguggacuuacauccagccuccgcauggacacuuuaugcuguugcuacaacagucauuaccccaauguuacgucauaccauagaaaauagcaccgcaaauguaucgcuggcagcgaucgcaaaucaagcaguaguuuuaaugggacuagacaaaggauggccuauaucaaaaauggaucucgguguuccuuuacuugcuuugggcugcuauagccaaguaaauccacuaacacugacagcggcagucuuacuauuaauaacucacuacgcuauuauaggcccaggacuucaggcaaaagcgacaagagaagcgcagaaaagaacggccgcggguauaaugaaaaauccaacggucgauggcaucaugacaauagaccucgacccugucauauaugacaguaaauucgaaaaacaacuaggacaaguaaugcuauuaguccuaugcgcaguucaauuacuccuaaugagaacaagcugggcacuaugugaagcccucaccuuggccacagguccaauuacaacauuaugggagggaaguccgggaaaguuuuggaauaccacuauagccguuagcauggcaaacauauuucgcgguaguuaucuagcaggggcgggucuagcuuuuucgaucaugaaaagcguaggaacugguaaacgagguacagguucgcaaggcgaaacacuaggugagaaauggaagaagaaacuaaaucagcucucaagaaaagaauuugacuuauauaaaaagucggggauuacggaaguagaccguacggaagccaaagaaggguugaaaagaggagaaauuacacaucaugcagucagucgagggucagcaaaacuacaaugguuugucgagagaaacauggucaucccggaaggaagaguaaucgauuugggcuguggaagaggagguuggucauauuacugugcuggcuugaagaaagugaccgaagucaggggcuauaccaaaggaggaccaggacacgaagaaccuguaccgaugucuacauauggcuggaauaucguaaagcucaugucuggcaaggauguauuuuacuugccacccgagaaaugcgacacguuacuaugcgacauuggugagaguucuccgucaccaacaguagaagaaucaagaaccauaagaguucuaaaaaugguagagccaugguuaaagaauaaucaguucuguauaaaaguccuuaauccauauaugccuacuguaaucgaacaucuagaacgacuacaaagaaaacauggaggaaugcuaguacguaacccucuaagucguaacaguacccaugaaauguauuggauaucgaacggcaccgggaauaucguagcauccgugaauaugguaagucgucuucuauuaaaccgauuuacuaugacuuacagacgucccacaauagaaaaagacguagaccugggggcaggcacccgccaugugaacgcggaacccgaaacgccaaacauggacguaauaggcgaaagaauaaaacguauaaaggaagaacacaauaguacuuggcauuacgacgaugagaauccguauaagacaugggcuuaucauggaaguuaugagguaaaggccacagguagcgccagcucuaugauaaauggaguaguuaaacuacugacgaaaccuugggacguuguacccaugguaacgcaaauggcaaugacagauacaaccccauuugggcagcaacguguauuuaaagaaaagguugacacaaggacacccagaagcaugccuggaacccgaaggguaauggguauaacagcugaauggcuauggcguacccuaggucgcaauaagaaaccaagauuauguacgagagaagaauuuaccaagaaagugagaacaaacgcagcaaugggagcuguguuuacggaagaaaaccaaugggauucagccaaagcggcaguagaagacgaagacuuuuggauuuuaguagacagagaacgagagcuucauaaaguagggaaaugcggaaguugcguguacaacaugauggguaaacgagagaaaaaguuaggcgaauuuggaaaagcuaaggggucaagggcuaucugguauaugugguugggugcacgcuaucucgaauuugaggcacucgguuuucuaaacgaagaucauugguuuaguagagaaaacuccuauucagggguggaaggugaaggucuccacaaacuaggguauauauuacgagacaucaguaaaauaccugggggcgcuauguaugcugacgauacagccggaugggacaccagaaucacagaagacgacuuacauaacgaagagaaaauuacgcaacaaauggaucccgaacaucgacaacucgcaaaugcaauauuuaagcugacuuaccaaaauaagguaguuaaggugcagcguccuaccccaacgggaacagugauggauauaauaagucgaaaggaccagagggggucuggacaggugggaacguauggacuuaauacauuuacuaauauggaagcgcaacugaucaggcaaauggagggcgaaggagugcuuagcaaagcagauuuagaaaacccgcaccucccagagaagaaaaucacccagugguuagaaacaaaaggggucgaacgacugaaaaggauggcaauuucaggggaugauugcguagucaagccaauugaugauagauuugcuaaugccuuauuggcccuuaaugauauggguaagguaagaaaggacauaccacaguggcaaccuucaaaaggcuggcacgauuggcagcaagucccuuuuugcucgcaucauuuccacgagcuuauuaugaaagacggacguaaauuagugguaccuuguagaccucaagaugaguuaauaggacgagcaaggauaucccaaggagcuggauggucauuacgggaaacagcuugcuuggggaaagcguaugcccaaauguggagucucauguauuuucaucgaagagacuugcgauuggcuuccaaugccauaugcucugccgucccuguacacuggguaccgaccaguagaacuacuuggucuauucaugcacaccaucaauggaugacaacagaagauaugcuuaccguuuggaauagaguguggauugaagacaacccauggauggaagacaaaacgccggugacaaccugggaaaauguaccguauuuaggcaaacgugaagaucaauggugugggucuuugauuggccuaacuucaagagcaacgugggcgcaaaacauucccacagcuauccaacaagucagaagucuaauaggaaaugaagaauuuuuggauuacaugccaaguaugaaacguuuccgaaaagaagaggaaucagaaggugcaauuugguaa

SEQ ID NO: 23329 - RNA, 9873 nt, Artificial Sequence
  derived and/or modified CDS sequence (opt6) from DENV-3__EU687239__SS-prME
acuucccucuguuuaaugaugauauugccagccgcauuagcuuuucaccuaacgagucgcgauggugagccgcgaaugauaguuggcaaaaacgaaagagggaaaucuuugcuuuuuaaaaccgccaguggaaucaacauguguaccuuaauagcaauggaucuuggugaaaugugcgacgacacugugacauauaaauguccacauaucgcagaggucgaaccagaggacauugauuguugguguaaucuaacaucgacgugggugacauacggaacguguaaccaagcuggagaacaucgaagagauaaaagaucuguugcacuagcaccacauguugguaugggacuagauacuagaacucaaacuuggaugagugcagaaggagcguggagacaaguugaaaaagucgagacaugggcucuaagacauccaggauuuacaaucuuagcccuauuuuuagcacacuacauagguacuucacuaacacaaaaaguaguaauuuucauacuucuaaugcuugugacuccuucuaugacuaugcgaugcguaggugucgguaacagagacuucguagaaggacucuccggagcuacguggguagauguaguguuagaacacggcggaugcgucacuacgauggccaaaaacaaaccaacccuagauaucgaauuacagaaaacggaggcaacacaauuagcaacauugcggaaacugugcauugaagggaaaauaacuaauauaacuacggauaguagauguccaacccaaggagaagcaguccuuccagaagaacaagaucaaaacuaugucuguaaacauacauauguagaucguggaugggguaaugguugugggcuuuuuggaaaagguucccuuguaacaugugcaaaauuucaaugccuagaaccaaucgagggcaaaguuguucaguaugaaaaucuuaaauacacuguaauaauuacaguacauacuggugaccaacaccaaguuggaaacgaaacucaggguguaacugcugaaauaacaccucaagccucaacuacggaggccauacuuccagaauauggaacacuaggucucgaaugcagcccgagaacuggccuagauuuuaaugaaaugauacuccuuacaaugaaaaacaaagccuggaugguucaucgccagugguucuuugauuuaccccuaccauggacaucuggugcaacaacggagacuccgacuuggaauagaaaagaacuauuaguaacuuuuaaaaaugcucaugccaagaaacaagagguaguuguauugggaagucaagaaggagcgaugcauacagcucuuacgggcgcuacagaaauacaaaauucaggaggaaccaguauauucgcaggucacuugaaauguagauugaaaauggacaaacuugaacugaaagguaugucuuaugcuaugugcacuaacacauucguacuaaagaaagaaguuucggaaacacaacacggaacgauacucauuaaaguugaauacaagggggaagauguuccaugcaaaauaccauucucaaccgaggauggccaaggcaaggcacauaacggacgacuaaucacugcaaaucccguagugacaaagaaagaggaaccugucaauauugaagcugaaccaccguucggcgaaaguaauauugucaucggaguaggagauaaugcuuuaaaaauaaacugguacaagaaagguaguucaauaggcaagauguucgaagcuacagcuaggggagcaaggagaauggcaauauugggagacacugccugggacuuugguucuguaggagguguccuuaacucacuaggaaaaaugguacaccagaucuuugguucagccuacacugcacuuuucucgggaguaucuugggucaugaaaauugggauaggaguucugcuuacguggauaggcuugaauaguaaaaacacaaguaugagcuucagcuguauugcaauagggaucauaacucuguaccuaggggcuguaguccaggcugacacggggugcguaauaaauuggaaaggaaaggaacuuaaaugugggucaggaauauuuguaacuaacgaaguacauacauggacugagcaauacaaauuccaagcagauucaccuaagcgcuuagcuacagcaauagcaggggccugggaaaaugggguuugugguauaaggucuacgacaagaauggaaaaccuauuguggaaacagauugcaaaugaacucaauuauauacuuugggaaaauaacaucaaauuaacaguaguugugggagauauaauuggaguauuagaacaaggaaaaagaacacuaacgccgcaacccauggaauuaaaauauucauggaaaacgugggggaaagcaaaaauaguaacugcggaaacgcaaaauucauccuuuauaauugacgguccuaacacuccugaaugcccuucagccaguagagcauggaauguuugggaagucgaagauuacggauucgggguauuuacgacuaauauaugguuaaaguuacgcgaaguauacacccaacuuugugaucaccguuugaugucagcagcaguuaaagacgaaagagcaguacaugcggauaugggauacuggauagaaagucaaaagaauggcucuuggaaacuagaaaaagcaucuuuaauagaaguuaaaacaugcacauggccaaaaagccauacguuguggucgaacggugugcuugagucugauaugauaauaccuaaaucucuugccgggccaauaagucaacacaauuauagacccggauaccacacacaaacagcaggaccguggcaucuaggcaaacucgaauuagacuuuaauuauugugaaggaaccaccguuguuauuacagaaaauuguggaacacgggggcccuccuugagaacaacgacaguaucaggaaaacuaauacaugaauggugcugccguucuugcacgcugccgccgcuacgguacaugggggaagacgggugcugguauggaauggaaauccgcccaauaucugaaaaagaggaaaauaugguaaaaucauuaguuucagcaggauccgguaaagucgacaacuuuacaauggguguguugugucucgcgauauuauucgaggaagucaugagggggaaauuuggcaagaaacauaugaucgcuggugucuucuuuacauucguucuacuucuaagcggacagauaacuuggagagauauggcccauacacugauuaugauagguucaaaugcaagugauagaaugggaaugggagugaccuacuuagcauugaucgcaacuuucaaaauacagccguuucuugcauuaggguucuuucucaggaaguuaacgucucgagaaaacuuauuauuagguguugguuuagcuauggcaaccacucuucaacuccccgaagauaucgaacaaauggcuaaugguaucgcacucggacuuauggcucugaaauuaauaacgcaguuugaaaccuaucaacuuuggacagcauuaaucucccucacgugcagcaacacuaucuuuacguugacuguagcuuggagaacugcuaccuugauauuggccgguguaucguugcuuccuguuugucagucgagcuccaugagaaaaagugacuggcuucccaugaccguagcggcaaugggcguuccgccuuugcccuuguuuaucuucucacugaaagacacauuaaaaagacguucauggccgcuaaaugaggggguaauggcaguaggccuaguaaguauuuuggcaucgucccuacuuaggaaugacguaccaauggcuggaccguuaguugcugguggauuauugauagcuuguuauguaauaaccgguacaagcgcagauuuaaccguggaaaaagccgcugauguaacaugggaggaagaagcugagcaaaccggggucagucacaacuuaaugauuacagucgaugaugauggaaccaugaggaucaaagaugacgaaacugaaaacauauugacaguuuuacuaaaaacagcuuuacuuaucguaucuggaauuuuuccauacagcauuccagcuacccuacuuguauggcauacguggcaaaagcagacgcguagaagcggcgugcugugggauguaccaucuccaccugagacgcaaaaagcagaacuagaagagggaguguauagaauaaagcaacaaggcauuuuuggaaaaacacaagucggugugggaguucagaaagaaggcgucuuucacacaauguggcauguaacuagaggugcaguguuaacguauaacggaaaacgacuagaaccuaacugggcauccguuaagaaagaucuuauaucauaugguggcggauggcggcugagugcccaauggcaaaaaggugaagagguccaaguaauugcuguggagccagguaaaaacccuaaaaacuuccagacaaugccagggacauuccagacaaccacgggagaaaucggggccguagcacuagauuuuaaaccuggcacgagcggcaguccaauaauuaaccgugaaggaaagguuguaggguuguauggcaaugguguaguuacuaaaaauggaggauacguaucaggaauagcacaaacaaaugcggagccggauggaccuacaccagagcuagaggaagaaauguuuaagaaaagaaaccuaacaauuauggacuuacauccagggucuggaaagacgagaaaguaucucccagccauaguccgagaagccauaaaaagacgacuucggacauuaauacuggcuccuacucguguaguggccgcugaaauggaggaagcgcuaaaaggccuaccuauaagguaucaaaccaccgcaacuaaaagugaacauacaggacgggaaauagucgacuugaugugucaugccacauucacaaugagguuauuaagcccuguacgaguaccuaacuauaaucucauaauuauggacgaagcacauuuuacggauccagcaucuauagcggcgcguggcuacauauccacucgugugggcaugggcgaagcugcagcaauauuuaugacggcaacucccccugguacagcagaugccuuuccccagagcaaugcaccaauacaggaugaagaaagggauaucccugaacguaguuggaacucugguaaugaauggauuacugauuuugccgggaagacggucugguucgucccuucgauaaaagcuggaaaugacaucgcgaauugcuuaaggaaaaacggcaaaaagguuauacaauuguccagaaaaacguucgauacagaauaccaaaagacgaaacuaaacgacugggacuuuguuguuacaacggacaucagugagaugggcgcaaacuuuaaggcugauagaguaaucgauccacgccgcugccuaaagccuguuauacuuaccgacgguccagaaaggguaauauuagccggaccaaugccugucacugccgcuucugcagcgcaaagacguggacgagucggacgcaauccucaaaaagagaacgaucaauacauauuuacugggcaaccucugaacaacgacgaggaucacgcacauuggacagaagcaaaaaugcuucuugacaauauuaauaccccugaagggauaauuccagccuuauuugagccugaaagggagaaaagcgcagcgaucgauggagaguaucgauugaaaggcgaaucgagaaaaaccuuuguagaauuaaugagacguggggauuuaccaguauggcuugcucacaaaguagcuucggaggguauaaaauacacagaccgaaagugguguuuugauggacaaaggaacaaccagauauuagaggagaacauggauguagagaucuggacaaaagaaggagagaagaagaaacuacguccacggugguuagaugcaagaacuuacucagacccacuugcccucaaagaguuuaaagacuuugcagcaggaagaaaaucaauagcacucgaccuagucacugagauuggaagaguaccuucucaccucgcacaucguacuagaaaugcccucgauaaucuaguuaugcuacacacguccgagcauggagggaaagccuaucgucacgccguggaagaacucccugaaaccauggaaacacuacuauuguuaggccuaaugauccuccuaacagguggagccaugcucuuuuuaaucucggggaaagguauuggaaaaacaaguauuggucuaaucugcgugaucgcaaguucugggauguuguggauggcagagaucccucuacaguggauagcgagugcuauaguauuggaauuuuucaugaugguacuucuaaucccagagccagaaaaacaacguaccccacaggauaaucaacucgcuuauguggugauuggaauauuaacccuggccgcaauaauagcagcaaacgaaaugggacuccuagaaacaacuaaacgcgaucucggaaugucgaaagagccgggcguaguuucuccaacgaguuauuuggacguagaccuccauccagcuuccgccuggacacuuuacgcuguagcuacuacaguuauuacaccaauguuacgccauacuaucgaaaauucaacggcaaauguaagucuagcagcuauugcuaaucaagcagucguucugaugggauuggauaaaggauggccuaucuccaaaauggaucuaggagucccacuacuagcucuagguugcuauagucaaguaaauccuuuaacauuaacggcagccguuuuauuauuaauaacacauuacgcaauaauuggccccggacuucaagcuaaagcuacccgagaggcacagaaaagaaccgcagcagguauuaugaaaaauccaacaguggauggcauaaugacuauugacuuagauccagucauauaugacucaaaauuugaaaaacaacuuggacaaguaaugcugcuaguacuuugcgcgguucaacuuuuauuaaugcgaacaaguugggcuuugugugaggcauugacacuggcuacuggaccaauaacaacacuaugggaagguaguccggguaaauuuuggaauacuacaauugccgugaguauggcaaauauauucagaggcaguuaccucgcaggcgcagggcucgcuuuuaguaucaugaagagugucggaacuggaaaaaggggaacaggcucgcaaggugaaacauugggggaaaaauggaagaagaaacuaaaucaauuguccagaaaagaguuugaccuuuacaagaaaagcggaauaacugaaguagaucgcacggaggcaaaagaaggguuaaaaagaggugaaauuacccaccaugcaguuucaagaggaucugcaaaacuacaaugguuuguagaacggaacaugguaauaccggaaggaagaguaauagaucuaggaugcgguagaggcggcuggaguuauuacugcgcaggccugaagaaaguuacugagguaagaggauacacaaaaggaggaccgggacacgaagaaccaguaccaaugucuacuuauggauggaacauaguuaaacuaauguccggcaaagacguauuuuaucuaccuccagagaaaugcgauacuuuauugugcgacauaggugaaaguucucccaguccuacaguugaagaaucacgaacaauccgcguccuuaaaauggucgaaccaugguugaaaaacaaucaauuuuguauuaaaguacuaaacccauauaugccaacagugauagaacaccuagaaagacuacaaaggaaacaugguggaauguuaguuagaaacccuuuaucccgaaauuccacucacgaaauguauuggauauccaacggaacaggaaauauagucgccuccgugaacaugguaaguagacuucuauuaaaucgauucacgaugacacacagacgaccaacaauagaaaaagacguagacuugggagcuggaacuagacauguaaaugcagaaccagagacaccuaauauggacgucauaggagagaggaucaaacgaaucaaagaagaacacaacucgacauggcacuacgaugaugagaacccauacaaaaccugggcuuaccaugguagcuaugaaguaaaagcaacgggaagugccagcuccaugauaaaugguguggucaaacuacucacaaaaccaugggauguagugccuaugguaacucaaauggcaaugacagacacaacuccauucggucaacaacgagucuucaaagagaaaguggauacucgaaccccucgcucuaugccaggaacaagaagaguaaugggaauaacugcagaguggcuauggcggaccuugggcagaaacaagaaaccucgacuuuguacacgcgaagaguucacuaagaaagugagaacaaacgcugcaaugggagcuguauuuacggaggaaaaccaaugggauagcgcaaaagcugcuguggaggaugaggacuuuuggaaacucguagauagagagcgggagcuucauaaacuagggaaauguggaucgugcguguauaauaugaugggaaaaagagagaagaaauuaggagaauuuggaaaggcaaagggaucacgugccauaugguauaugugguuaggcgcacgguaccucgaauuugaggcucuaggcuuuuugaacgaggaucauugguucucgagagaaaauaguuauucaggaguugaaggagaagguuuacauaaacuaggcuauauuuugagggauauuucaaaaauaccugggggcgcaauguaugccgaugauacagcuggcugggacacaagaaucacggaagaugauuugcauaaugaggaaaagauaacacaacaaauggacccagaacacagacaauuggcaaacgcuaucuuuaaacuuaccuaccaaaauaagguaguuaaagugcaacgaccaacuccaaccggcacagugauggacauuauuucacguaaagaucagagagguucaggccaagugggcacauaugguuugaacacuuuuacgaauauggaagcccaauuaauuagacagauggaaggugagggcguacuuucaaaagcugacuuggaaaauccccaucuaucggagaaaaagauaacccaauggcuugagacaaaaggggucgaaagauuaaaacgaauggcuauuaguggcgaugauuguguaguuaaaccgaucgaugaucgauuugcgaaugcccucuuagcuuuaaacgauauggguaaagugagaaaagauaucccacaauggcaaccaaguaaaggauggcaugauuggcaacagguuccuuuuuguucacaccauuuucaugagcuuaucaugaaagacggucggaaauuggucguuccuugucguccacaagacgaacugauugguagagcaagaauuucgcaaggcgcaggguggucucucagagaaacugcuugcuuggggaaagcguacgcacaaauguggucguuaauguacuuccauagacgugaucugcgccucgcaagcaacgccauuugcucagcagugccaguacacuggguaccaacuucacguacuacauggaguauccaugcacaccaucaauggaugacgaccgaagauaugcuaaccgucuggaauagaguguggauagaggauaacccauggauggaagacaaaacgccggucacuacaugggaaaacgucccauauuuaggaaaacgcgaggaucaauggugugguagccuaauuggguuaacaucccgugcaacaugggcacaaaacauuccaaccgccauccaacaagugcguucacucauagguaaugaagaauuucuugauuauaugccuaguaugaaacgcuuccguaaagaagaggaaagcgaaggagucauuugguaa

SEQ ID NO: 23330 - RNA, 9873 nt, Artificial Sequence
  derived and/or modified CDS sequence (opt6) from DENV-3__FJ182004__SS-prME
acgagcuuaugucucaugaugauauuacccgcagcuuuggcuuuccaucuaacaucuagagauggugaaccucggaugauuguaggcaaaaacgaaagagguaaaucccuauuauuuaaaacggcuaguggcauaaauauguguacacucauugcaauggaucuuggcgaaaugugugacgacaccguaacuuauaaauguccucacauugcugaaguagaacccgaagacauagauugcuggugcaaucuuacaagcacauggguuacauacgggacuuguaaucaagcaggggaacauagaagagacaaacgauccguggcauuagcuccccauguggguaugggcuuggauacgcgcacgcaaacauggaugagcgcagaaggagcauggagacaaguagaaaaaguagaaacaugggcauugcgacacccuggauucacuauucuagcgcuguuccuagcacauuacauuggaaccucauuaacucaaaaaguaguaauauucauuuuauuaauguuagugacaccuuccaugacgaugcgauguguugguguaggaaauagagauuuuguugaaggauuaaguggagcgacguggguugacguaguucuggaacaugguggaugcguaacaacaauggcuaaaaauaaacccacacucgacauagaacuacagaaaaccgaagcuacgcaacuggcgacauuaaggaaacuuuguauagaaggaaaaauaacaaauauaacuacugauagucgauguccgacacaaggagaggcaguguuaccagaagaacaagaccaaaauuauguuuguaaacauacguacguagacagaggauggggaaauggauguggacuuuucggaaaagguucuuuagucacaugugcuaaauuucaauguuuggaaccaauugaaggaaaaguuguccaauaugaaaauuugaaauauacaguuauaaucacaguacauaccggagaccaacaucaaguaggcaaugagacccaagguguuacagcagagauaaccccucaagcaucaacuacugaagcuauacuacccgaguacggcacccugggguuagagugcucuccgaggacaggacuggauuuuaacgagaugauauuguuaacgaugaaaaauaaagcauggauggugcaucgccaaugguuuuucgaucuuccucuaccuuggacuucaggugcuacaacagaaaccccaaccuggaacaggaaagaauugcuugugacauuuaaaaaugcccacgcaaagaaacaggaagucguaguuuugggcagccaagaaggggcgaugcacacagcccuaacaggugcaacagaaauacaaaauuccggaggaaccucaauuuucgcaggacaucucaaauguagacugaagauggacaaacuugaacuaaaaggcaugaguuacgcuauguguaccaacacauucguccuaaagaaggaaguaagugaaacacaacauggaacuauacuaauaaaaguugaguacaaaggcgaggaugcuccauguaagauuccuuucaguaccgaagacggacaagguaaagcucauaacgggcguuugauaacagcaaauccaguaguuacuaagaaagaggaaccuguuaauauagaagcugaaccacccuuuggugagucaaacauagucaucggaauuggagauaaugcauuaaaaauaaacugguauaaaaagggcucaagcauuggcaaaauguuugaggcgacagcgagaggugcucggagaauggcaauauuaggcgauacagcuugggacuuuggcaguguaggaggagucuuaaacucauuagguaaaaugguccaccaaauuuucggcagcgccuauacagcauuguuuucgggcguauccuggguaaugaaaauaggaaucgguguauuacuuacauggaucggauuaaacaguaaaaauacgucaaugagcuuuagcuguauugccauugguauaaucacacuguaucuaggagcaguagugcaagcagacacgggauguguaauaaauuggaaaggaaaagaauugaagugcgguaguggaauuuucgucacaaaugaaguacacacauggacagagcaguacaaauuucaagcagauaguccaaaacguuuggccacagccaucgcuggagcaugggaaaauggaguaugugguauuagauccacaaccaggauggaaaacuuacuuuggaagcaaguggcaaaugaacucaauuauauucuaugggaaaauaacauaaaauuaacugucguaguaggagacauaaucgguguucucgaacagggcaaacgaacucuaacaccucagcccauggaacuaaaauacucauggaaaacauggggaaaggcuaagauuguuacugcagaaacucagaacuccagcuucauuauagacggaccuaacacaccagagugcccuuccgcgucccgcgcauggaacguaugggaaguggaggauuauggauucgguguauucacaacaaacauuuggcuuaaguugagagaagucuacacucaauugugugaucacagauuaaugucggcagcgguaaaagacgagcgggcagugcacgccgacaugggauacuggauagaaucucagaaaaauggauccuggaaguuagaaaaggcauccuuaaucgaaguaaagacguguacguggccgaaaagucauacacuauggucaaacgguguauuagaaucagauaugaucauaccaaagucuuuagcuggaccuauuucucagcauaacuauaggccaggauaucauacucaaacggcaggaccguggcaccuuggaaaguuagaauuagauuuuaauuacugugaaggaacaacaguaguaaucacagaaaauugcgggacccgagggcccucacuuagaacaacaacgguuucuggaaaacuaauccaugaguggugcugcagaaguuguacuuuaccgccauuaagauauaugggcgaggacggcuguugguauggaauggagauucgacccaucagugaaaaggaagaaaacauggucaaaucauuaguuuccgcgggaucaggaaaagucgauaauuuuaccauggggguuuugugcuuggccauucuguucgaggaaguaaugagaggaaaauucgguaagaaacacaugauagcggguguuuucuuuacguucguucuacuguugaguggacaaauuaccuggagggauauggcucauacuuugauuaugauaggaucuaacgcuucugaccgcaugggaaugggcgucacauaucucgcgcuuauugcaaccuuuaagauucaaccauuccuagcacugggguucuuccuucgaaaacuuacaucgagggaaaauuugcuguugggagucggacuagcaauggcaacgacucuccaauuaccagaagauaucgaacaaauggcgaauggaauagcacuaggucuaauggcguugaaacuuauaacacaauucgaaaccuaucaguuauggacagcacugauaagccuaacaugcucuaauaccaucuuuacguuaaccgucgcauggcguaccgcgacgcucauccuagcaggaguaucauuacugccaguuugucaaagcagcagcaugcgaaaaagcgauuggcuaccaaugacaguagcagcgaugggcguaccacccuuaccauuauuuauauuuagucugaaagauacucucaagaggagauccuggccguugaacgaaggcguuauggcuguuggccuaguauccauacucgcgaguucuuuguuacgcaaugauguaccaauggcggguccucucgucgcagggggcuuguuaauagcaugcuauguuauaaccggaacaagugcagauuuaacaguggaaaaggcugcagacguuacgugggaagaagaagccgaacaaacgggaguaagccauaacuuaaugauaacaguagaugacgacggcacuaugagaauaaaagacgaugaaacugaaaauauauuaacgguccuuuugaaaacagcucuacugaucgugagcgguauauuccccuacucaaucccagccacucuguuagucuggcacacauggcaaaaacaaacaagacguucaggaguucuuugggaugucccgucaccaccugaaacucagaaagcugaguuagaggaggguguauaccgaauaaaacaacagggaaucuuuggaaagacucaagucggaguuggcguacagaaagaaggaguauuucauacuauguggcacguaaccagaggagcuguucugacauacaaugggaagaggcuagaaccuaauugggcgagcguuaagaaagacuuaaucucuuauggcgguggguggagauuaucugcucaauggcagaaaggcgaagagguucaaguuauugccguggaaccgggcaaaaacccuaaaaacuuucagacuaugccugggacauuucaaacuaccacuggugagaucggagccaucgcacuugauuucaaaccaggaaccaguggaucaccuauaaucaaucgagaaggaaaaguaguaggauuauauggaaacgguguugucacuaagaauggcgguuauguaucggguauugcacaaacaaaugcugagccggacggaccaaccccagaacuugaagaagagauguuuaagaaaagaaacuuaacaauaauggacuuacauccaggcucgggaaaaacaaggaaauauuuaccugcaauuguaagagaggccaucaagcguaggcuaaggacauugauacuugcacccacgcgcguagucgccgcagaaauggaggaagcucuaaagggcuugccaauucguuaccagacaacugccaccaagucagagcauaccgggagggaaaucguagauuugaugugccacgcgacguucaccaugagauuguugucacccguuagaguuccuaacuauaaccucauuauuauggacgaagcgcacuuuacugacccagcaucaauagcggcaagaggguauauaucaacuagaguugggaugggagaagccgcagcuauauucaugacagcgacuccuccaggaacugcagacgccuucccccaaucaaaugccccaauccaagaugaagaacgggacauaccggaaagaaguuggaacagugguaacgaauggauaacugauuuugcaggaaaaaccgucugguuuguccccucaaucaaagcaggaaacgacauugcgaacugccuuaggaaaaacggcaagaaagucauucaauugagucguaaaacguucgauaccgaauaccagaagacaaaauuaaaugauugggauuucguuguuacaacagauauaucugaaaugggagccaacuucaaagcagacagaguaauagauccaagaagaugucucaagccggucaucuuaacagaugguccugaaagaguaauauuagcuggaccaaugccugucacagcagccucugcugcucaacgccguggccguguagguagaaauccccagaaggaaaacgaucaauacauauucacaggacaaccucuuaauaacgacgaggaucacgcacauuggacagaggcgaaaaugcuauuagauaauauuaacacuccggaaggcaucauaccggcacuuuuugaaccagagcgagagaaaucagcagcaauugacggagaauaccguuugaaaggagaaagucgcaaaacauuuguugaauuaaugcguaggggagaucuaccgguauggcucgcgcauaaagucgcuucagagggaauaaaauauacagaccgaaagugguguuuugacggacaacgaaacaaucaaaucuuggaagaaaacauggacguggaaaucuggacuaaagagggagagaagaagaaacuuagaccuagaugguuagaugcacgaacuuacagcgauccacuagcgcuaaaagaguuuaaagacuuugccgcugggagaaaaucaaucgcuuuagacuugguuacagaaaucggccgagucccaucucauuuagcacauagaacacgaaacgcuuuagacaauuugguaauguuacauaccucugaacacgguggcaaggcuuauagacacgcuguagaagaguuaccggaaacuauggagacauuguuguuacuggggcuaaugauucuccuaacuggcggggccaugcuauuccuaauaagcgguaaagguauagggaaaacgaguaucggacucauauguguaauagcgucaagcggaaugcuuuggauggcugagauaccguugcaguggauagcauccgcgauuguguuagaguucuuuaugaugguauugcugauacccgaacccgaaaagcaacguacuccacaagacaaucaauuagcauaugugguaauuggcauacuuacgcuagcagccaucauagcagcaaacgaaaugggauuguuagaaacaacaaagagggaccuaggcaugucaaaagaacccggaguaguaucaccaacaaguuacuuggauguagacuuacacccggcuucagcauggacacuauaugcuguagccacaacgguaaucacuccuaugcucaggcacacgauagagaacagcaccgcaaacgucucacucgcugcaauagcaaaucaagcaguaguguuaaugggccuagacaaagguuggccuauaucaaaaauggauuuaggcgucccacugcuugcccuuggaugcuacucgcaagucaauccucuuacucuaacggcugccguauugcuacuuauaacacauuacgccauuauaggaccaggauugcaagcuaaagcuacucgagaggcacagaaaagaacggcggcgggaauaaugaagaaccccacgguggauggaauaaugacaauagacuuggauccagucauuuaugacaguaaauucgaaaaacaguugggacagguaauguuacugguucugugugccguucaguuauuauuaaugaggaccaguugggcccuaugugaagcguuaacacuugccacggggcccauaacgacccucugggaggggagcccaggaaaguucuggaauacgacuauagcaguauccauggcaaacauauuucgggguucguaccuugccggugcuggucuugcuuucucuauaaugaagaguguaggaacaggaaagagaggaacgggaucacaaggagaaacucuuggcgagaaauggaagaagaaacuuaaccagcuaucacguaaagaauuugacuuauacaaaaagaguggcauaacagaggucgaucgcacagaagccaaggaaggauuaaaaagaggagaaauaacacaucacgcuguaucucgagggucggcaaaacuccaaugguuuguugagagaaauaugguuauucccgaaggacgcguaauugaccucgggugcggcagagguggcuggaguuauuacugcgcaggucuuaagaaagucacggaaguuagaggcuauacuaaaggagggccuggacaugaagaaccuguaccgaugaguaccuacgguuggaauauugugaagcucaugaguggaaaagacguauuuuacuugccgccggaaaaaugcgauacucuauuaugugauauaggggaaucaucaccaucuccuacaguugaagagucaagaacuauccgcguuuuaaaaaugguagagccuugguugaaaaauaaccaauucuguauaaagguuuuaaauccauauaugccaacgguaauagaacauuuggaacgucugcaaaggaaacauggagggaugcuaguucgaaacccauuaagccguaauucgacccaugaaauguacuggauaaguaacggaaccggaaacauaguagcuagugucaacaugguaaguagacuauuauuaaauagauuuacaaugacccauagacgcccaacuauugaaaaagacguagaccuaggggcuggaaccagacacgucaacgccgaacccgagacuccaaauauggauguaauuggagaacguauuaaaagaauaaaggaagaacauaauagcacauggcauuacgacgaugaaaacccauauaagaccugggcauaucaugguaguuacgaagugaaagcaacuggcagugcauccucgaugauuaauggcguuguaaaacuauuaaccaaaccaugggacgucgucccaaugguaacacaaauggcuaugaccgacaccacucccuucggacaacaacgcguuuuuaaggaaaaaguagacacucgaacuccgcguucuaugccggguacccgucgaguuauggguaucaccgcagaaugguuauggagaacucuaggacgaaauaaaaagccacgccuauguacucgagaagaauuuaccaagaaagucagaacuaacgccgcaaugggcgcaguuuuuacagaagaaaaucagugggauucugcgaaagcggcaguugaggacgaagauuuuuggaaguuagucgaccgcgaacgugagcugcauaaauuaggaaaaugcgggucuuguguuuauaacaugauggggaaaagggagaagaaauuaggagaguucggcaaagcgaaagguuccagagcgauaugguacauguggcuaggagccagauaucuugaguucgaagcacugggguuucugaacgaagaccacugguuuucaagagagaacaguuauaguggagucgaaggugaaggccuacacaaauuaggauacauuuugcgagacauaaguaaaaucccggguggagcuauguaugcugaugacacagcaggcugggauacaagaauuacagaagaugacuuacauaaugaagagaaaaucacacaacaaauggacccagaacauagacaacuagcuaaugcgauauucaaauugacauaccaaaauaaggucguuaaaguacaacgacccacuccaacugguacaguaauggacauuauaucucgcaaggaucagcgaggaucaggucaaguagguacauacggccuuaacacauucacuaacauggaggcgcaauugauaagacaaauggagggagaaggaguauuaaccaaagcugaccuagaaaauccgcauuuaagugaaaagaaaauuacgcagugguuggagacuaaaggaguggaaagguuaaaacguauggcaauaucuggggacgauugcguuguaaaaccuauugacgacagauucgcgaacgcauuacucgccuugaaugauauggguaaaguaaggaaggacaucccacaauggcaaccgaguaaaggauggcaugacuggcaacaagugccguucuguagucaucacuuucaugaauuaauaaugaaagauggaagaaagcugguuguaccguguagaccacaagaugagcuaauagguagagcgagaauuagucagggugcgggcuggucuuugagagaaacagccugucuaggcaaagcguacgcucagauguggucccucauguacuuccauagacgugacuuaagauuagcuucuaacgcaauauguucagcuguaccgguucacuggguuccuacaaguagaacuacuuggucaauacacgcgcaucaccaguggaugaccacggaagacaugcuuacaguguggaauaggguguggauagaagauaauccguggauggaggacaaaacaccaguuacuacuugggaaaaugugccauaucucggcaaaagagaagaccaauggugcggaagccuuauaggauuaacaagucgggcaaccugggcccaaaauaucccuaccgcgauacaacaaguaaggucucuuauugggaacgaagaguuccuagacuauaugccuagcaugaaaagauuccgcaaagaggaggaaucagagggagcuauuugguaa

SEQ ID NO: 23331 - RNA, 9873 nt, Artificial Sequence
  derived and/or modified CDS sequence (opt6) from DENV-3__FJ024465__SS-prME
acaucacuaugucucaugaugauauuaccggcagcguuagcguuucauuugacgaguagggacggagaaccacgaaugauuguugguaaaaaugagagagguaagagccuuuuauuuaagacagccucagguauaaacauguguacauuaauagcuauggaccucggcgagaugugcgacgacacaguuacguacaaauguccacacauagcggaaguagaaccagaagauauugauugcugguguaacuuaacuuccacauggguaacguacggaacuuguaaucaagccggagaacaccgaagagauaaacggucaguagccuuagcuccacacguugguauggggcuugauacucgaacccagacguggaugucagcagagggcgcauggcgacaaguugagaagguugaaacaugggcacuuaggcacccuggauucacaauacuugcccuauuuuuagcacacuacauugguacgagccuuacacaaaaaguagucauuuucauucuacucaugcuaguaacuccaaguaugacaaugcgaugcguuggaguuggaaauagagacuuuguggaaggguuauccggugcaacauggguugaugugguucucgaacacgguggauguguaaccaccauggcaaaaaacaaaccaacucuugauauagaauuacagaaaacagaagcgacgcaauuggccacuuugcgaaagcucuguaucgagggaaaaaucacaaacauaacgacagacagcagguguccgacacagggcgaggcgguauuacccgaggaacaagaucaaaacuacguuugcaaacauacuuaugucgaccgaggaugggggaacggauguggguuauuuggcaaaggcucauugguaaccugugcuaaauuccaauguuuagaaccaaucgaaggaaaaguuguccaauacgaaaacuuaaaauauacagugauuauuaccguacacacaggcgaucaacaucaaguugggaaugaaacccaaggaguaacugcggaaauaacaccacaagcuagcaccacggaagcaauauugccggaauaugggacguuagguuuagaauguuccccgcggacaggacuagauuuuaaugagaugaucuuauuaacaaugaaaaauaaagcuuggaugguucacagacaaugguuuuuugacuugccacuaccguggacgucaggagcuacaacagaaacuccaacuuggaacagaaaagagcuacuaguaacauucaaaaaugcccaugcgaagaagcaagaagucgucgucuuaggcucgcaggagggugcgaugcauacugcauuaaccggagcaacagaaauucagaacaguggagggacuucuauauucgcaggacaccuuaaaugccgccucaaaauggauaaauuagaacucaaaggaaugucauacgccaugugcacaaacacuuucgucuuaaaaaaggagguuagugaaacccaacauggaacaauauuaauuaaaguagaguacaagggagaagaugucccuugcaaaauacccuuuucaacggaggauggucaaggaaaggcacacaacggaagacuaauuacggccaauccgguaguaacaaaaaaagaagaacccguaaacauagaggcugaaccaccguuuggagagaguaacaucguuauagguauaggagacaaugcguuaaagauuaacugguauaagaaaggcaguucaauugggaaaauguucgaagcuacagcgcgaggagcacgccguauggcuauccuaggugacaccgcaugggauuuuggcagugucggugggguauuaaacucguuagggaagauggugcaccagauauucgguucagcguauacugcuuuguuuagugguguauccugggugaugaaaauagggauuggaguacuauuaacauggaucggccuaaauuccaaaaauacaucaaugagcuuuucauguauugcaauuggaauuauaacacuauacuuaggugcagucgugcaagcggacacagggugcguuauuaacuggaaggguaaagaauuaaaauguggauccggcauauucguaaccaaugagguccauacauggacagaacaguacaaauuucaagcagacagcccgaaacggcuagccacagccauagcaggcgcuugggaaaauggggucugcgggauacggucuaccacuagaauggaaaaccuucuuuggaaacaaauagcaaacgagcuaaacuauauacuuugggagaauaacauaaaacugacggugguaguaggagauaucaucggaguuuuagagcagggcaaaagaacauugacaccacaaccgauggaguuaaaauauucuuggaagacaugggggaaagcuaaaauagucacagcagagacucagaacagcucuuucauuauagauggaccaaauacuccugaaugcccuagugcaaguagagcauggaaugugugggaaguagaagauuaugguuuuggagucuucacaaccaacaucugguugaaacugcgagaaguauacacccaacuaugcgaccaccguuuaaugagugcggcaguaaaagacgaacgagccguacacgcggauaugggauacuggauugaaagccaaaaaaacggaucguggaaacuagaaaaagcaucgcuaauugaagugaagaccugcaccuggccaaaaucucauacauuauggaguaacggaguacuagaaagugacaugaucauaccaaagagucucgcuggucccauaucacaacacaauuauagaccuggauaucauacacagacugccggaccauggcaccuuggcaaauuagaauuagacuucaacuauugugaaggaacgacagucguuauuacugaaaauuguggaacgcgcgguccuucacuaaggacgacuacugugucggggaaacugauacacgaaugguguugucgguccuguacacuuccaccacuacguuauaugggagaagacggaugcugguacggaauggaaauaaggccaauuucugagaaagaagaaaauauggucaaaagucugguaucugccgguagcgguaaaguugauaauuuuaccaugggcguuuugugcuuggcgauauuauuugaagaaguuaugcgagggaaauuuggaaagaagcacaugauugccgggguauuuuuuacauuuguucuuuuauuaaguggccagauaacuuggagggauauggcacauacucugauuaugaucggcaguaaugcgagugacagaaugggaaugggugucacuuauuuagcacuaauagcaaccuuuaagauccaaccauuccucgcacugggguucuuccuaagaaaacuaacaagucgagagaauuuauuacugggugucgguuuagcuauggcaacaacguuacaauuaccagaggauauugaacaaauggcuaauggaaucgcacuagguuuaauggcauugaaauuaauaacccaauucgaaacuuaccaacucuggacggcauugauaucacugacuuguaguaacacaauuuuuacauuaacaguagcguggcgaacggcaacuuuaauucuagcagguguuuccuuguuaccaguaugucagaguucaagcaugcggaaaucugauugguuaccaaugacgguagcagcaauggggguaccaccauugccacuauuuauuuucagucucaaggacacauuaaagcggagaucauggccauugaaugaaggcguuauggcgguaggucugguuucaauauuagcaagcaguuugcuaagaaacgacgucccuauggccggaccccugguggccggaggacuacuaauugcaugcuauguaauaacaggcacuagugcugaucuugcaguagaaaaagcggcugacgugacgugggaagaggaagcagaacaaaccggcgucucucacaauuugaugaucacagucgaugacgaugggacuaugaggauuaaagaugacgaaacagaaaauauacugacgguuuuacuaaagaccgcauuauuaauugucucuggcauauuuccauauucaauaccagcaacuuuauugguuuggcauacauggcaaaaacaaacucaaagauccggaguauuaugggaugugccaucaccacccgaaacucaaaaagcagagcucgaagaaggaguguaucgaauuaaacaacaggguauuuuuggaaaaacacagguuggcguggggguucaaaaagaaggugucuuccacacgauguggcacguuacacgaggcgcgguguuaacauacaauggaaaaaggcuagagccaaauugggccucagugaaaaaagaccuaaucagcuacggagguggguggagauuaucagcacaauggcaaaaaggcgaagaggugcaggugauugcaguagagcccggaaagaacccaaaaaauuuccaaacaaugccgggcacguuccaaacaacaacaggagaaauaggagcuauagcguuagauuuuaaaccaggaacaucgggaaguccaaucauaaauagggaaggcaaaguaguaggucuauacgguaaugguguaguaacgaagaauggagguuaugugucaggaauagcacaaaccaacgcugagccggacggaccgacgccugaacuagaagaagaaauguuuaaaaaacgaaaccucaccauaauggauuuacauccugggucagguaaaacaaggaaauauuugcccgccauuguuagagaagcgauaaaacgucgucucagaaccuugauucuggcgccaacuagaguugucgccgcugaaauggaggaggcauugaagggucugccgauucgcuaccaaaccacugcuacgaaaagugaacauacaggcagggaaauaguagauuugaugugucaugcaacuuuuacgaugcgacuccuuuccccuguccggguuccuaacuauaaccuaauaauaauggaugaagcacauuucacagauccggcuucaauagccgcgagaggauacaucucaacccguguugggaugggcgaagccgcagcgaucuucaugacagcgacuccgccuggaacugcugaugcauuuccucaaagcaaugccccaauucaagacgaagaacgugauaucccagaaagaucguggaacucagggaacgaguggauaacggacuucgccggaaaaaccgucugguuuguaccguccauaaaagccgguaacgacauagcaaacuguuuacgaaaaaauggaaaaaaagugauacaguugucaagaaagaccuuugacacugaauaucaaaaaacuaaacuaaaugauugggacuuugucguuacgacugauaucucggaaaugggcgcgaauuuuaaagcugacagagucauagauccucgaagaugccucaaaccuguaauacuuacagauggucccgaaaggguaauuuuagcgggaccuaugccgguaacggcggcaagcgcagcgcaaagaagaggucgaguugguagaaauccacagaaagaaaaugaucaauauaucuucaccggucaaccauuaaauaacgacgaagaucaugcucauuggacagaagcuaaaaugcuacuagauaauauuaauacacccgaagggauuaucccugcccucuuugaaccggaaagggaaaagagugcugcaauugacggggaauaccggcucaaaggugaaucaagaaaaacguuuguagaauuaaugcgaagaggcgaccuuccaguaugguuagcacauaaaguugcgucugaaggaauuaaauauacagauagaaaauggugcuuugauggucaacgcaauaaccagaucuuagaagagaauauggacguagagauauggacaaaggagggagaaaaaaaaaaauuaagaccaagauggcuggaugcccgaacauauucagacccauuggcacuaaaagaguuuaaagacuuugcagccgguagaaaaucaauagcauuagaucugguuacggaaaucggaagaguaccgucacauuuagcucauagaaccagaaaugcauuagacaaucucgucauguugcauacaagugaacaugguggaaaggcauauagacaugcaguagaagagcugccagagacaauggagacguuauuacuuuuaggccuaaugauauuauuaacagguggagcuauguuauucuugauaucagggaaaggcauugggaaaacaucgauagggcuaauuuguguaaucgcuucgucuggaaugcucuggauggcagaaaucccucuccaauggauagcuucugcaauuguuuuggaguuuuuuaugaugguacucuugauucccgaaccagaaaaacaaaggacaccucaagacaaucagcucgcauaugugguuauugguauacuaacacuagccgcgauaauagcggcaaaugagaugggguuacuugagacaacaaaacgcgaucuaggaaugaguaaggaaccuggaguaguaaguccuacaagcuauuuagacguagaucuacacccugcguccgcauggacucuuuaugcuguggcaacaacgguaauuacaccgauguugcgacacaccauugaaaauaguacagccaacguuucacuagcagcgaucgcuaaucaggcaguaguacuuaugggacuagauaaggguuggcccauaucaaaaauggaccuaggagugccacuacuugcacucggauguuauucccaggucaauccacuuacacuaacagcagcuguauugcuauuaaucacacauuacgcaauaaucgggccgggcuuacaagcuaaagcuacgcgcgaagcucaaaaaagaaccgcagcggggauuaugaaaaacccuacaguugaugguauaaugacaauagauuuagacccgguuauauacgauucaaaauuugaaaaacaacuuggacagguaaugcuccuuguacucugugcuguacaacuacuauugaugagaacaucaugggcccucugugaagcucucacuuuagcaacuggcccuauaacaacucuaugggaagguagcccgggaaaauucuggaauacaacuauagcaguaaguauggcaaacaucuuucgcgguagcuaccuagcaggugcuggguuagcuuuuuccauuaugaaaucggucggaacgggaaaaaggggaacaggaagccaaggugagacucugggcgaaaaguggaaaaagaaacucaaucaacuaaguaggaaagaguucgaucuguauaaaaaaucagggauuacggaaguagacagaacagaagcuaaggaaggacuuaagagaggugaaauuacacaucaugcuguaucacgaggaucagcuaaacuccagugguuuguggaaagaaauaugguuauccccgagggccgaguaauagauuuaggauguggacgaggcggguggaguuauuacugcgcagguuugaaaaaaguaaccgagguucgcggguacacuaaaggagggccugggcacgaagaaccaguuccaaugaguacguauggauggaauauaguaaaguugaugucuggcaaggauguguuuuaccuaccuccagaaaaaugugauacgcuauuaugcgauauuggagagucuucaccgucuccuacuguugaagaaucacgcacuauucgaguacuuaaaaugguggaacccugguuaaagaacaaccaauucugcauaaaaguguugaauccauauaugccaaccgucauagagcaucucgaacgcuugcagcgaaaacacggugggauguuaguuaggaacccucuaucucgaaauucaacacaugaaauguauuggauaucaaaugguacggggaacauaguggcgucuguaaacaugguuagucgguuauuacuuaaccguuuuacaaugacacaccgaagaccuaccauugagaaggauguggacuuaggcgcgggaacccgucaugugaaugccgaaccggagaccccaaauauggacguaaucggugagagaauaaagagaauuaaagaagaacacaacaguacguggcacuaugacgaugaaaacccguauaaaaccugggcguaccaugguaguuacgaaguaaaggcuacgggauccgccucauccaugauaaacggugugguaaagcugcucaccaagccaugggauguagucccaacaguaacucagauggcaaugacagauacaaccccuuuuggacaacagagaguauuuaaggaaaaaguagauacaagaacaccaagguccaugccggguacaagaagaguaaugggaauaacggcggaaugguuauggcgcacauugggucguaacaaaaagccucgauuaugcaccagggaagaguucacaaaaaagguaagaacuaacgcagcgaugggggcuguauuuacagaagagaaucaaugggauagugcaaaagcugcuguugaggaugaggacuucuggaaacugguugacagggaacgagaacuacauaaacuugguaaaugcgguaguugcgucuauaacaugaugggcaaaagggaaaaaaagcucggagaauuuggaaaagcuaaagggaguagagcaaucugguacauguggcuaggggcccgguauuuggaauuugaggcuuuaggcuuucuaaaugaggaccauugguuuuccagggaaaauucauauucagguguugagggggaaggauuacacaaauugggauauauacuaagggauauaagcaaaauaccagguggagcuauguaugcagacgauacugcuggcugggauaccaggauaacggaagaugacuuacacaaugaagaaaaaaucacacaacagauggaucccgaacaucgucaacuagcgaacgcuauauucaaauuaaccuaucagaauaaagucguaaaaguccaacgaccaacccccacaggaacuguaauggauaucauaucaaggaaagaucaaaggggaaguggacaaguagggacuuauggguugaacaccuuuacaaacauggaagcacagcuuauacggcaaauggaaggggaagggguacugucgaaggcagacuuagaaaacagucaucuaucagaaaaaaaaauuacgcaaugguuagaaaccaaaggcguagaaagguuaaagaggauggcuauuucaggagacgauugcguagucaaaccuauagaugauagauuugccaacgccuuacuagcgcuuaacgacaugggaaagguacgcaaagauauaccgcaauggcaaccuucuaagggauggcacgauuggcaacagguuccuuuuugcucgcaccauuuccaugaacuaauuaugaaggacggaagaaaauugguaguuccguguagaccccaggacgaacuaaucgggagagcuagaauaucacagggggcaggcuggucucuucgugaaacagcauguuuaggaaaggcauacgcucaaauguggucucuaauguauuuccauaggagagacuugcgucucgcuuccaacgcuauaugcuccgcugugccagugcauuggguucccacuagccgaaccaccuggucaauucacgcccaccaucaguggaugaccaccgaagauauguuaacaguauggaacagaguguggauugaagauaacccuuggauggaagauaagacaccaguaaccacuugggaaaacgugccauaucugggaaagagagaggaccaaugguguggauccuuaauaggauuaacuucacgagcaacuugggcgcaaaacauaccaacagcaauacaacaagugagaucgcuuaucggaaaugaagaauuucuugauuacaugccaagcaugaagagauuuagaaaggaagaagagucggaaggugccauaugguga

SEQ ID NO: 23332 - RNA, 9873 nt, Artificial Sequence
  derived and/or modified CDS sequence (opt6) from DENV-3__FJ024466__SS-prME
acaucucucugcuugaugaugauauuaccggcagcacuagcauuucaucuuacaagucgugauggagaaccgagaaugauaguuggcaaaaaugaacgugguaaaucccuacuauucaaaacagcgucugguauuaauaugugcacguugauugcaauggaccuaggagaaaugugugacgacacuguuacuuauaaaugcccacacauagcugaaguugaaccagaagauauagacuguugguguaauuuaacaucaacauggguaacauauggaacgugcaaccaagcaggagaacaucggcgagacaaaagaucgguagcgcuagcuccgcauguagggaugggauuagauacuagaacccaaacguggaugucagcugaaggagcauggagacaagucgaaaaaguagaaacaugggcauuacgacauccgggauucacaauauuagcacuauuucucgcacauuauauuggcaccucacuaacucaaaaagucguaaucuucauccucuuaaugcuagucacaccuuccaugacaaugcgcugugucggaguaggaaauagagacuuuguggaaggauuaucuggagccacaugggucgauguaguauuggaacacggaggauguguaacaacaauggcuaaaaacaaaccaaccuuagauauagaacuacagaaaacagaagcgacgcaauuagcgacccuacggaaauuaugcauagaaggcaaaauaacgaacaucacgacggauagucgaugcccaacacaaggugaagcugugcuccccgaagaacaagaucaaaacuauguguguaaacacacauauguugaccgaggauggggaaacggaugcggguuauucggcaaagguucacuggucacaugcgcgaaauuccaaugucuagaaccaaucgaagguaaaguaguacaguacgaaaauuuaaaauauaccguaaucaucacuguccauacaggcgaucaacaucaaguagggaaugaaacacagggcguuaccgcggaaauaacuccacaggcauccacaacugaagcaauucuacccgaauaugguacacuaggacuugaauguagcccacgcaccgguuuggauuuuaaugagaugaucuuacuaaccaugaaaaacaaagcauggaugguacaucgacaaugguucuuugaucugccauugccuuggacuucaggcgcaacuacagaaaccccaacguggaaucggaaagagcuacuugugacuuucaaaaaugcacaugccaagaaacaagaggucguaguucuuggcagucaagagggagcaaugcauacggcucuaacuggugcgacagaaauucaaaauucaggggguacaaguauauuugcaggccaccuaaaaugccgauuaaaaauggauaaacucgaguugaaagggaugucauaugcaauguguacaaacacuuuuguauugaagaaagaaguaucugagacucaacacgguacuauauuaaucaaaguagaguacaaaggugaggacgcgccguguaaaauaccauuuucuaccgaggauggacaaggcaaagcacacaaugguagacuuauaacggcaaacccaguugugacaaagaaggaggaaccaguuaacauugaagcugaaccacccuucggugaaaguaauauaguaauaggaauuggggauaaugcauugaaaauuaauugguacaagaaaggaaguucaauagguaagauguuugaggccacagcccggggagcacgaagaauggcaauauuaggggauaccgcaugggauuuugguucagucggaggaguauuaaacucacuaggaaaaaugguccaucagauauuuggaagcgcauacacugcauuauuuaguggagugagcugggucaugaaaauagguaucggaguacuauugaccuggauugguuuaaacaguaaaaauacgucaaugagcuuuuccuguaucgcaaucggcauuauuacgcuauaucuuggcgcugucguacaagccgauacaggaugugugauaaauuggaaaggaaaggaacuaaaguguggaagcggaauauuugugaccaaugaaguucacacauggacagaacaauacagauuccaagccgacucaccgaagagacucgcaacugcuauugcaggagcuugggaaaauggagucugcggcauacguucaacuacuagaauggaaaauuuguuauggaaacaaauugcaaaugaacuaaauuacauacuuugggagaacaauauaaaacuaacuguaguaguaggcgauauaauaggaguacuggagcagggaaaacggacauugaccccgcagcccauggaauuaaaauacucauggaagaccugggguaaagccaagauuguaacagcagaaacacaaaauuccaguuuuauuauugacggccccaauaccccagaaugcccgagcgcaagcagagcuuggaacguaugggaaguugaggauuauggauuuggggucuuuacaacaaauauuugguuaaaacuaagagagguauacacacaacuuugugaccaccgacucauguccgccgccguaaaggacgaaagggccguacaugcagacaugggauacuggauugagagucagaaaaacgggucuuggaaauuagaaaaggcuucauuaauugaaguaaagacguguacauggcccaaaagucacacacuuugguccaacggaguacuagaaagcgacaugauaauaccuaaaucucuagcgggcccaauaucccaacacaauuauagaccaggauaucauacacagacagcgggaccuuggcaccugggaaaauuagaacuagacuucaauuauugugaagggacaacaguuguuaucacagauaacugcggcacucgcgguccuagccuucgaacuacuacgguaucaggaaaacugauccacgaaugguguugcaggagcuguacacuuccgccgcugcgcuauaugggagaagauggaugcugguaugguauggaaauacgcccaauaucugaaaaggaagaaaauaugguaaaaucauugguaagcgcaggaaguggaaaaguugauaauuucacuauggguguucuuuguuuagcaauauuguucgaagaagucaugaggggaaaguuugguaagaaacacaugauagccggaguauucuuuacguuuguacuacuuuuaucaggccaaauaacuuggcgagacauggcgcacacauuaauuaugauagguagcaacgcaagugaucgaauggguaugggcguuacuuaucuagcauugauagcuacuuuuaaaauucagccuuuucuggccuuaggguuuuuccuaaggaaacuaacaucacgugaaaauuuacuuuuaggcgucgggcuugcgauggcuacaacccuacagcuuccugaagauauagaacaaauggcgaacggaauagcucucggauugauggcccucaaacugaucacacaauucgaaacauaccaacuauggaccgcauuaauuucucuaacguguucaaacacuaucuuuacgcuaacuguugcauggagaaccgcaacacuuauucucgcuggagucucuuuauuaccaguuugccaaucaucgucuaugagaaaaagcgauuggcucccgaugacaguagcggcaauggguguuccgccucugccccuguucaucuuuucccucaaagacacacugaagagaagaucauggccccuaaaugagggaguuauggcaguaggcuuaguaaguauccuggcgagcagucuacuccguaaugacgugccaauggcuggcccucucguggcuggcggauuauugauagcauguuacgucauaacugggacaagugcagauuuaacuguugaaaaggcagccgaugugacgugggaagaagaggcugagcaaacaggaguaagccacaaccuuaugauaaccguugaugacgacgguacgaugagaaucaaagaugaugaaacggaaaauauacuuacuguacuauuaaagacagcuuuauuaauaguuaguggaauuuucccauacaguaucccugcgacgcuacucgucuggcauaccuggcaaaaacaaacuaggagguccggcguacuaugggaugucccuucgccaccugagacgcagaaagcagaacuagaagaaggaguguauagaaucaaacaacaggggauauuugguaaaacgcaaguaggugucggcguucaaaaagaaggagucuuucauacaauguggcacgucacaaggggagcuguacucacauacaacgggaagagacuugagccaaacugggcgaguguuaagaaagaucugaucucuuauggcggcggauggaggcuaagcgcacaguggcaaaaaggggaagaaguacaaguuaucgcugucgaacccggcaagaauccgaagaauuuccaaaccaugccagggacauuucaaacuacaaccggagaaauaggagcaauagcguuggauuuuaaaccagguacuagcggaaguccaauaauuaaucgcgagggaaaaguggucggauuauauggcaauggaguagucacgaagaacggaggauauguaagcggaauugcgcaaacgaaugcggagcccgacgggccgacgccagaacuagaagaggaaauguuuaagaagcguaaucucacuauuauggaucuccaucccggauccggcaaaacccgaaaauaucuaccagcaauagugcgagaagccauuaaacgcagguuaaggaccuuaauauuggcaccgacucguguaguagcugcagaaauggaagaagcacuaaaaggacugccuauucguuaccaaacaaccgcuacaaaaagugaacacacuggaagagaaauuguugauuuaaugugucaugccacauuuaccaugcgauuacugucaccuguuagagucccaaauuacaacuuaaucauuauggacgaagcacauuuuacggacccagcaucgauagcagcaagaggauauauaucaacaagaguuggaaugggagaagcagcggcaauuuucaugacagcuacaccaccuggaacggcggacgcauuuccgcaaucaaaugcuccaauacaggacgaagagagggauauccccgaacguucauggaauagugggaaugaauggauaacugacuuugccggaaaaacuguaugguucguuccauccaucaaagcaggaaaugacauagcuaauugucuaagaaagaacgguaagaaaguaauucaguugucgagaaaaacauuugauacugaauaccagaaaacgaaauuaaaugacugggauuuuguggugacaacugacauuucugaaaugggugcaaauuuuaaagcagaucgaguaauagacccacgaagaugucuaaaacccguaauucuuacagacgguccugaaagaguaauucuagcaggacccaugcccguaacagcagcaucugcugcucagcgccguggacguguggguagaaacccucaaaaagaaaaugaucaauacauauuuacugggcaaccgcugaauaaugaugaagaucacgcacauuggacagaagcaaaaaugcuacuugauaauaucaacacuccagaaggaauaauaccugcuuuguucgagccagaacgagagaaaucggcagcaauagacggcgaguacagacuuaagggagagaguagaaaaacguuuguagaacucaugaggagaggcgacuuaccaguuugguuggcucacaagguggccucggaggggaucaaauauacagaccgcaaaugguguuuugaugggcaaaggaauaaccaaaucuuggaggaaaauauggacgucgaaauauggacgaaagaaggagagaagaagaaacuaagaccuagguggcucgaugcgaggacauacagcgacccacuugcacuaaaagaguuuaaagauuuugcagccgggcggaaaucaauagcauuagaccugguuacagaaauaggacgggugcccucccaucuagcgcaucggacaagaaaugcucuagacaauuuaguuauguuacauacuagcgaacacggagggaaagcguauagacacgcgguagaggaacucccagaaacgauggaaacguuauuauuguuaggguuaaugauauuacuuacaggaggagcgaugcucuuucucaucaguggaaaagggauugguaaaacaucuauagguuugauaugugucaucgccucuucgggaauguuauggauggcagaaaucccacuacaauggaucgccagugcaauaguccucgaguucuuuaugaugguacucuuaaucccugaacccgaaaaacagaggacuccucaagauaaucaacuagcauacgucguaaucggaauuuuaacucuagcugcaaucauagcggcaaacgaaaugggccuccuagaaacaacuaaacgcgaccuuggaaugaguaaagaaccugguguaguuucacccacgucuuaucuggacguagacuuacacccagcaucagcguggacuuuauacgcgguggccacaaccguaauaacgccaauguuaagacacacgauagaaaauucgacggcaaacguuucauuggcugcaauagcaaaccaggccgucguccuuaugggcuuagacaaaggguggccuauuagcaagauggaucuuggcgugccacuacuagcauuaggauguuacagucaaguuaaucccuuaacacucacugcggccguauuauugcuaaucacccacuaugcaauaauaggccccgguuugcaggcgaaagcaacaagggaggcucaaaaacggacagcagcuggaaucaugaaaaauccaacagucgauggaaucaugacgauagaucuggauccugucauuuaugacaguaaauuugagaaacaguuaggacaaguaauguuacugguacuaugugcaguacaauuguuauugaugcggacaaguugggcuuugugugaagcccuaacacuagcaacuggacccauaaccacgcuaugggaaggaucuccugguaaauucuggaacacaacgauagccguuucaauggcaaauauuuucagagggucauaccuagcgggugcaggacuagcauuuucaauaaugaaaucagugggcacuggcaagcgagguacggguucucagggagagacuuugggagaaaaauggaagaagaaacuaaaucagcugagucguaaagaguuugaccucuauaaaaagucuggaauuacugagguagacagaacagaagcaaaagagggucuaaagagaggcgagauuacacaucacgcggucucacggggcucugccaaacuacaaugguucguagaacggaauaugguuauuccggaggggagaguaauagauuuaggguguggaagagguggguggucauacuacugugcgggacuuaagaaaguaacagaaguacgaggauauacuaaagggggaccagggcaugaagaaccagugccaaugucaacauauggguggaauauaguuaaauuaaugagugguaaggaugucuucuauuugccucccgaaaaaugcgauacuuuauuaugcgacauaggagagucaaguccguccccgacuguagaagagucgcgaacuauacgcguccuuaaaaugguugagccauggcuuaaaaauaaucaguuuuguauaaaaguguuaaauccauauaugccuacuguaauagaacauuuagagaggcuucagaggaaacauggugguauguugguuagaaauccccuaucacgaaauuccacacaugagauguauuggaucucaaauggaaccggaaacauugucgcaucgguuaacaugguuaguaggcucuuauugaauagauucacgaugacccauagaagaccuacaauugaaaaagacgucgauuuaggggccgguacacgacauguaaacgcagaaccggaaacaccaaacauggauguaauaggugaacggauuaaaagaauaaaggaggagcauaauagcacguggcauuacgaugaugagaacccauacaaaacgugggcuuaucacgggaguuacgaaguaaaggccaccggcucugcuaguaguaugaucaacgguguagucaaauuacugacaaaaccuugggauguuguaccuaugguuacucaaauggcuaugacagacaccacuccuuucgggcagcaacgaguauucaaagaaaaaguggacacccggacaccaaggagcaugccaggaacucgaagaguaauggguaucacagcggaaugguuauggcgaacucuaggacguaacaagaaaccuagauuguguacgagagaagaauuuacuaagaaaguuaggacaaacgccgcuaugggugcaguauucacagaggaaaaccaaugggacucugccaaagcagccguagaagacgaagacuuuuggaaauugguagaccgagaaagagaacuacacaaauuagggaagugugggagcuguguauacaacaugaugggcaaacgugagaagaaacuaggugaauuugguaaagcuaaggggucaagagccauuugguacaugugguuaggagcaagauauuuagaauuugaagcucucggcuucuugaaugaggaucauugguucaguagagaaaacucuuauucuggcguugaaggggaaggguuacauaaguuaggauauaucuugagggacaucagcaaaaucccgggcggcgcgauguaugcagaugacacagcaggaugggauacacguauaacugaagaugaccuccauaaugaagagaaaaucacacaccaaauggaccccgaacauagacaacuagcuaacgcuauauucaaacuuacauaucagaauaaagugguuaaaguacaaagaccaacuccaacggggacugucauggauauaaucuccaggaaggaccaacggggaaguggccaaguaggaacauauggguuaaauacauucacgaauauggaagcacagcugauaagacaaauggaaggagaaggcguguuaaguaaagcagauuuggaaaacccucaccugagugagaagaaaaucacacaaugguuagaaaccaaagguguagagagacuaaaacgaauggcaauaaguggagacgacugugucguaaaaccuauagaugauagauucgccaaugcacuacuagcacuaaaugauaugggcaaagucaggaaggacauaccccaauggcaaccuucaaaaggguggcaugacuggcaacaggucccuuuuuguagucaucauuuccaugaauugauaaugaaagauggucguaagcuaguagugccguguaggccacaggacgagcuuauagguagggcacgaauuagccaaggcgcaggguggucguuaagggagacagcaugccuagggaaggcuuaugcucagauguggagucuuauguauuuccauagacgugauuugcguuuggcaagcaaugcaauauguucugcggucccuguacacuggguaccgacaucucguacuaccugguccauacacgcucaccaucaauggaugacgacugaagacaugcuaacuguauggaaucgggucuggauagaggacaauccuuggauggaggauaagacuccuguuacaacaugggagaacgugccauaccuagguaaaagggaagaucaauggugcgggucccucauuggguugacuucaagggcaacgugggcacaaaauauacccacagcaauucaacaggucaggucacugauaggaaaugaggaauuuuuagacuauaugccaucuaugaaacgguucagaaaagaggaagagucagaaggagcuauuugguaa

SEQ ID NO: 23333 - RNA, 9873 nt, Artificial Sequence
  derived and/or modified CDS sequence (opt6) from DENV-3__FJ024467__SS-prME
acgagccuuuguuugaugauggugcuaccugcagcacuggcauuucauuugacaucaagagauggagaaccaagaaugauaguagguaaaaacgaaagaggaaaauccuuauuauucaaaacagcuagcggaauuaacauguguacguuaauugcgauggacuuaggugaaaugugugaugauacagugacuuacaaaugcccacacauaacggaagucgaaccugaagauauugauugcuggugcaaucuaacuucgacuuggguuacauauggaacauguaaucaagcuggugaacauaggcgagauaaaagaucuguagcacuagccccucacguugguauggggcuagauacaagaacucaaacguggaugucagcugaaggggcuuggagacaaguagaaaaaguagaaacgugggcucuacggcauccuggauuuacaauauuagcuuuauuucuggcacacuauauagguaccucacuaacucaaaaaguuguaauauuuauacuacuaaugcuaguaacucccucgaugaccaugcgcugcguaggagucggaaaucgagauuucgucgaaggauugucgggugcuacaugggucgauguaguucuggaacaugggggaugcguuacaacgauggcuaaaaacaaaccuacauuagauauagaacuucagaaaacagaagcuacucaacuagcuacacuucgaaaacuaugcauagaaggaaaaauaacuaauauaacaacugauagucgcuguccgacucaaggagaagccguccuuccagaggaacaagaucaaaauuacguguguaaacauacuuacguugauagagguuggggcaauggaugcggguuauuuggaaaaggaaguuugguaaccugcgcaaaauuccaauguuuggaaccaauugaagguaaaguaguacaauacgaaaacuuaaaauacacaguaauaaucacaguccacaccggugaucaacaucaaguuggaaacgaaacccagggaguuacugcggaaauaacgccccaagccucgacaacagaagcaauucugccugaguacggcacucuaggacuagagugcucaccacguacagggcuggauuuuaacgaaaugauucuacucacaaugaaaaacaaagcguggaugguucacagacaaugguucuuugaucuaccacucccauggacgucuggagcuacaacggaaaccccgacuuggaacagaaaagagcuucugguaacauuuaaaaaugcgcaugcgaagaaacaggaaguaguagucuuaggaucacaagagggggcgaugcauacagcguuaacaggagcaacagagauacaaaacaguggagggacgaguaucuucgccgggcaccugaaauguagacuaaaaauggauaaacuagaacuuaaaggcaugaguuaugcaauguguacuaacacauuuguacuaaagaaagaggucagugagacgcaacaugggacuauauuaauaaagguugaauauaaaggagaagaugccccuuguaaaaucccauucagcaccgaagauggacaaggcaaagcccacaauggacgacuaauaacagcaaacccuguggugacaaagaaggaagaaccgguaaacaucgaagcggaacccccguuuggagaaucaaauauaguaauagguauuggagauaaugcuuugaaaauaaauugguauaagaaagguaguagcauaggaaaaauguucgaggcaaccgcacguggugcacguagaauggcaauacugggugauaccgcaugggauuuugguucaguaggagguguucucaacucacuaggaaagaugguacaucagauauucggaagcgcauacaccgcacuguuuagcggcguaucauggguaaugaagauaggaaucggaguacuauuaacauggauagguuuaaauagcaaaaauacaucaaugucauucaguuguauagcaauagguguaaucaccuuauacuugggugcgguuguccaagccgauaugggcuguguuauuaacuggaaagggaaggaacuaaaaugcgggaguggaaucuuugugacuaacgagguacacacauggacagaacaauauaaauuucaagccgacucuccuaaacgauuggcgacagcaauugcgggagcgugggaaaacggugucugugggauaagaucaacgacgagaauggaaaaccuacuauggaaacaaaucgcgaaugaacucaauuacauauugugggaaaauaauauaaaauuaacaguugucguaggcgacaucauaggaguacuugaacaaggaaaaagaacguuaacaccccaaccgauggaacuaaaauauuccuggaaaacauggggaaaagcaaaaauuguaacagcugaaacccaaaacaguagcuucauuauagauggaccgaacacuccggaauguccaagcgcuucaagggcauggaacguaugggaagucgaagauuauggguuuggaguuuuuacaacaaacauuugguugaaauuaagagaagucuacacacagcuaugugaccauagauuaaugagugccgcagugaaggaugaaagagcgguacaugcugacaugggguacuggaucgaaucacaaaagaaugggaguuggaaauuagaaaaggcuucacugauugaagugaagacauguacuuggccuaagagccauacgcuguggaguaacgguguuuuagagagugacaugauaaucccaaaaucacuagcuggcccuauuucacagcacaaucauaggccgggauaucaaacacaaacagcuggacccuggcaucuugggaaauuagaguuggauuuuaacuacugcgaaggaacaacaguaguuauaacugaaaauugugggacaagaggaccauccuuaagaacuacuaccgucucaggaaaguugauucacgaaugguguugcagauccuguacauuaccaccacuaagguacaugggugaagauggauguugguacggcauggaaaucagaccgaucagcgaaaaagaggaaaauauggugaaaucgcucguaucggcaggaucuggaaaagucgauaauuuuaccaugggaguccuuugccuagcaauacuguuugaagaaaugaugaggggaaaauuugggaaaaagcacaugauagccgguguauucuuuacuuucgugcuccuccucaguggucaaauuacauggagagacauggcucacacauuaauuaugauaggcaguaacgcaagcgauagaauggguaugggaguaacauaucuggcauuaauagccgcguuuaaaauacaaccguuuuuagcguugggguucuuuuuaagaaaguuaaccaguagagaaaaucuacucuuaggaguuggguuagcaauggcgaccacacuucaacuccccgaagauauagaacagauggccaaugggauugcguuaggacuuauggcauuaaaauuaauuacacaauucgaaacauaucaacuuuggacagcacuuauaagccuaacaugcuccaacacuauguucacccuaacuguugcuuggcguacagcaacgcuaauauuggccggaguuucauugcuaccagucugucagaguuccuccaugcgcaaaaccgacugguuacccauggcaguagcagcaauggguguacccccuuuaccauuauucauuuucagcuuaaaagacacucucaaacgucgaucauggccacuuaaugaagguguuauggcaguaggauuaguaucaauauuagcgucgucauugcugcgaaaugaugugccuauggccgguccccuugucgcaggaggacuacuuauugcaugcuacguaauuacugguacaucagcagacuugacaguagaaaaagcugcggauauaacaugggaggaagaagcagagcaaacagggguaagccacaauuuaaugauaacugucgaugaugauggcacuaugcgcauuaaagacgaugagacagagaacauauuaacaguuuuguuaaaaacugcacuuuuaaucguuagcggggucuucccuuauaguauaccugcuacucucuuaguguggcauacauggcagaaacaaacccaaagaucagggguauuaugggaugucccaucaccgccagaaacacagaaggcugaacuagaagaagguguguaccgcauuaagcaacagggaauauucgggaaaacucagguuggugucggaguucagaaagaaggaguauuccauacaauguggcaugucacaagaggagcaguucuaacauauaaugggaaaagauuagagccgaauugggcgagcguuaagaaagaucuaauauccuaugguggcgguuggagacuuucggcacaauggcagaaaggggaagaaguucaaguaauugcaguagaaccgggcaaaaaccccaaaaauuuucaaacgaugcccggaacauuucagacgaccacuggagaaauuggagcgaucgcucucgauuucaaacccggcacaucuggaucacccaucauaaaucgagaagguaaagucgucggucuuuauggaaaugggguggucaccaaaaauggggguuauguuucaggaauagcccagaccaaugcagaaccugauggaccaacucccgaacuggaagaagaaauguuuaaaaagcgcaacuuaacaaucauggacuugcauccagguagcggaaagacacggaaauaucuccccgcaauuguacgagaagcaauaaaaagacgacuaagaacauuaauauuagcgccuacuagaguaguugcagcagaaauggaggaagcgcuaaagggauuaccuauucgauaucagaccacugcuacaaaaagugagcauacuggccgggaaauugucgaccuuaugugucaugcgacuuuuaccaugagauuacuaucuccagugagaguaccaaacuauaauuugauuauaauggacgaggcgcacuuuacugacccugcgagcauagcugcacguggauauauaucaacucggguugggaugggugaggcugcggcaauauuuaugaccgcuacgccaccaggcacagcagacgcauuuccgcaaucaaaugcuccgauacaggacgaagaaaaagauauaccagagcgaagcuggaacucagggaacgaguggauaacugauuuugcagggaaaacuguaugguucgugccaagcauaaaggcaggaaaugacaucgccaauugucucaggaaaaacggcaagaaaguuauucaacucucccgaaagacauucgauacugaauaccagaaaaccaagcuaaacgauugggauuucguugugacaacagauaucagcgaaaugggagcuaauuuuaaagcagaucgaguuauagacccgcggagaugucuuaaaccgguaauuuugacggauggcccagaaagaguaaucuuggccggaccaaugccagucacugcagcgucggcugcacaaaggcgaggacgaguuggcagaaauccucagaaagaaaaugaucaguauauuuuuacgggccaaccacuuaauaacgacgaagaucaugcucacuggacggaagcaaaaauguuauuagacaauauaaacacaccagaaggaauaauuccugcucuuuuugaaccagaaagagagaaaagcgcggcgaucgauggagaauaccgucuaaaaggagagucuagaaagacguuuguagaacuuaugagacgaggagaucugccgguguggcuugcgcauaagguugccagcgaagguaucaaauacaccgacaggaaaugguguuucgauggacaaagaaauaaucaaauacuagaagaaaauauggauguggagauauggacuaaggaaggagaaaagaaaaaguugcgaccccgauggcuagaugccagaacauacagugauccuuuagcacucaaggaguuuaaggacuuugcugcuggaagaaagagcaucgcccuagaccuuguuacagaaauaggacgagucccgucucaucucgcccauagaacgagaaacgcauuagauaaucucguuauguuacacacaagcgaacauggcggacgagcauauagacaugccguggaagaauuacccgaaaccauggaaacgcuacuauuauugggauugaugauccuacuuaccggcggggccaugcucuuuuuaauaagcgggaaaggaauuggaaaaacauccaucgguuuaauuuguguuauagcaucaagcggaaugcuauggauggcggaaauuccucugcaauggauagcaucagcaauaguauuagaauuuuucaugaugguguuauugauaccggaaccagagaaacaacguacaccccaagacaaccaauuagcauacguaguaauugggauccucacacucgccgcaaucauagcugcuaacgaaaugggacuauuagagaccacaaagcgagaucucgguaugaguaaagaaccuggaguagugucccccacaucuuauuuggacguagauuuacacccugcuagugcuuggacccuauacgcaguugcaacaacagugauuacccccaugcuacgccacacuauagagaacucuacagcaaacguuucacuagcagcaaucgcaaaucaagcuguaguacuaaugggauuggauaaaggauggccuauaucgaaaauggacuuagggguaccccuacuugcgcuuggauguuauagccaaguaaauccucuuacguugacugcagcuguauuacuguuaauaacacauuaugcgauaaucggucccgggcuacaagcaaaagcuacucgcgaagcccaaaaacguacugcugcgggaaucaugaaaaauccaacuguagaugguauaaugacaauugacuuagauccaguaauauacgauucaaaguuugaaaaacaguuaggacaagucaugcuccuaguuuuaugugcagugcaauuauuacuuaugcguaccucuugggcucuaugugaagcucuaacucuagcuacugggccuauaacaacucuaugggaagggucuccaggaaaauuuuggaacacuaccauagcuguuucgauggccaauauuuuuagggggucuuauuuagcaggggcaggacuugcauucaguauaaugaaaagcguagguacaggaaaacgaggcacagguagccaaggggaaacgcucggcgaaaaauggaagaagaaauuaaaccaacuaagccggaaagaguuugacuuauauaagaaaucugguauaaccgaaguagauaggaccgaagcuaaagaaggccugaaacgcggagagaccacucaccacgcgguaucacgagguacagccaaacuucaaugguucguagagagaaacaugguaaucccugaagggagaguaauagacuuaggauguggaagaggaggguggaguuauuauugugccggccucaagaaaguuacggaaguaagaggauacaccaaaggcggacccggacacgaggaacccguaccaaugaguacuuauggauggaacaucgucaagcucauguccggaaaagauguauuuuauuugccuccagaaaagugugauacucuacuaugugauauuggagaaagcucacccagccccaccguggaggaaagucgcacaauucgaguuuuaaaaaugguugaaccuugguugaaaaacaaucaguuuuguauuaaaguuuugaauccauauaugcccacaguaauugaacaucuagaacgccuucaaaggaaacacgguggaaugcuuguacgcaauccauugagcaggaacagcacucacgagauguacuggauaucuaacgguaccgggaauauaguggccucaguuaauaugguaagucgacuacuucuaaacagauuuacaaugacucauagacggccaacaauagaaaaagacgucgauuugggcgcagguacgagacaugugaaugcggaaccggaaacaccuaacauggauguaaucggagagagaauaaaacgaauaaaagaagaacacaauuccacauggcauuacgaugaugaaaacccauacaaaaccugggcauaccauggaagcuacgaagucaaagccacgggaagcgcuagcucaaugaucaauggcguaguuaaacuucuaaccaaaccuugggauguaguaccaaugguuacucaaauggcgaugacugacacuacucccuuuggacagcaaagaguauuuaaagaaaagguagauacucggacgccacgcaguaugccaggaacucgaagggcuaugggaaucacugcagaaugguuguggaggacacugggucgaaacaagaaaccacggcuguguacgagggaagaguucacaaagaaagucagaacaaaugccgcuaugggugcuguauuuacugaggagaaucaaugggacagugcuaaggccgcggucgaagaugagaacuucuggaaacuuguggacagggaaagagaacugcacaaacuugguaaauguggaucaugcguauauaauaugauggguaaaagggagaagaaauuaggggaauuuggaaaagccaaaggaaguagggcgauaugguauauguggcuaggugcgcgauauuuagaauuugaggcgcucggauuucuaaacgaagaccauugguuuucaagagagaacucuuauucgggcguagagggagagggucuacacaaacuaggauacauucuucgagauaucuccaagauuccagguggagccauguacgccgacgauacggcagguugggacacacgaaucacugaggacgauuuacacaaugaagaaaagauuacucaacaaauggaucccgaacacagacaauuagcaaacgcaauuuuuaaacuaacguaucaaaauaaaguagucaaaguucaacguccuacuccgacugguacuguuauggauaucauaaguagaaaggaucaaagaggcucgggacagguaggaacauaugguuuaaacacuuuuaccaauauggaagcucaacuaauacgccagauggaaggggaggggguucuaagcaaagcagauuuagaaaacccacacuuaccagagaagaaaauuacccaauggcuagaaacaaaagggguagaaaggcugcgaagaauggcaauuagcggagacgauugcgucguaaaaccaauagacgauagguucgcgaaugcgcuuuuagcuuuaaaugauauggggaaaguucguaaggauaucccccaauggcaaccaaguaaaggauggcaugacuggcagcaaguacccuuuugcagccaucauuuccacgaauuaauaaugaaagacggaagaaagcuaguagucccuugccggccucaggacgagcuaauaggucgggcccggaucucacagggugcuggguggagucucagggaaacagcaugcuuggggaaagcauaugcacagauguggucacuaauguauuuccauagacgcgaccuucgauuagccagcaacgcaauuuguucugcgguucccguucacuggguaccgacaucaagaacuacauggagcauucaugcucaccaucaauggaugacgaccgaagacauguuaacagucuggaauagaguauggauagaagauaauccauggauggaggauaagaccccugucacuacuugggaaaacguuccguaucugggcaagagagaagaucaauggugugguagcuuaaucggauugacgaguagagcaacgugggcucaaaacauuccaaccgcaauucaacaaguaagaucauugauuggcaacgaggaguuccuagauuauaugcccucaaugaaacguuuuagaaaagaagaagaaucggaaggagcaaucugguaa

SEQ ID NO: 23334 - RNA, 9873 nt, Artificial Sequence
  derived and/or modified CDS sequence (opt6) from DENV-3__FJ024468__SS-prME
acuucccuuuguuuaaugaugauacuuccggcugcauuagcuuuccauuuaacuucccgagauggagagccacgaaugauuguuggcaaaaaugaaagagggaaaucauuauuauuuaaaacggcuucugggaucaauaugugcacguuaauagcuauggaucucggagaaaugugugaugauacaguaacauauaaauguccucauaucacagagguagaacccgaagauauugacuguuggugcaaucuuacaaguacuuggguaaccuacgguacuuguaaucaagcgggagagcaucgcagagauaaacguucaguugcauuagcuccucacguugguaugggauuagauacaagaacccaaacauggaugagugcagagggagcauggagacaaguagaaaaaguagaaacgugggcacuucgacacccaggauucacgaucuuagcuuuauuucucgcacauuauauuggaacgucauuaacccaaaaaguagucaucuucaucuuauugaugcuuguuacgccuucgaugacaaugagaugugucgguguggggaaucgagauuuuguugaaggauuaucuggugcgacaugggucgauguaguucuagaacauggaggauguguuacaacgauggcuaaaaauaaaccuacacuagacaucgagcuucagaaaacagaggcaacgcaauuagcaacccuucgaaaacuuuguauugaagggaaaaucaccaacauuacuacagauucacgauguccuacacaaggggaagccguauuacccgaagaacaagaucaaaauuacguaugcaaacauacuuacguggauaggggaugggguaauggaugugggcuuuuugguaaagguucacucguuacaugugccaaauuucaaugccuugagccuauagagggaaaaguuguacaguacgagaaucucaaauauacaguaauaauuacuguacauaccggggaucagcaucaaguagguaacgaaacacagggugugaccgcagagauaacuccccaggcaucaacgacagaagccauauugccagaauacgguacguuaggacuugaauguucaccaagaacgggccuagacuucaaugaaaugauauuacuaacaaugaaaaauaaagcauggaugguucauagacaaugguucuuugacuuaccuuugcccuggacuucuggagcgacaacggagaccccuacauggaacagaaaagaacuucuaguaacauuuaagaaugcacaugcuaaaaagcaggaaguugucguauuaggaucucaagaaggcgcaaugcauacugcauugacgggagcuacagaaauucaaaacagcggggguacguccauauuugcaggccauuugaaauguagguuaaaaauggauaaauuagaauuaaaggguaugucauacgcuauguguacaaacacuuuuguucuaaagaaagaaguaagcgaaacccaacacgggacgauccuaauaaaaguagaauauaaaggagaagacgcuccguguaaaaucccuuuuaguacggaagauggacaaggcaaagcucauaauggcagacucauaacggcgaacccaguagugacgaagaaagaagaaccugugaauauugaagcagaacccccauucggagaaagcaacaucguuauaggaauaggcgacaacgcguuaaaaauaaacugguauaagaaaggaucgaguauaggaaaaauguuugaagcgaccgcuagaggagcacggcgcauggcuauuuuaggagauacugcuugggauuuugguucugugggcggagucuuaaacucacuugggaaaaugguucaucagaucuuugguuccgcuuauacagcauuauucucggguguuucauggguuaugaaaaucggaauaggaguucuguuaacauggauuggucuuaauagcaaaaauacaaguaugagcuucucauguauagcaauugggguaauaacauuauaccuaggcgccgugguucaagccgauaugggcugcguuauuaauuggaaaggcaaagaacuuaaaugugggagugguauauucguaacaaaugaaguucacaccuggacugaacaauacaaauuucaagcagacaguccaaagagauuagcaacugcaauagccggugcaugggaaaaugggguguguggaauuagaagcacaacacgaauggaaaauuuauuauggaaacaaauugcaaaugaacuaaauuauauccuaugggaaaacaauaucaaacuaaccguaguaguaggagauauaauuggggucuuagaacaggguaaaagaacccuaacaccgcaaccuauggaguugaaauauucuuggaaaacuuggggcaaagcuaagauugucacugcagaaacccaaaacucuucauuuauaaucgauggacccaauacuccagaauguccaucugcuuccagggcguggaauguuugggaaguugaagacuauggguucgggguauuuacaacaaacauauggcuuaaauuacgagagguauacacacaguuaugcgaucacaggcuaaugucugcagcagucaaagacgaacgagcuguacaugcagacaugggauauuggauugaaagucagaaaaaugguaguuggaaauuagaaaaggcauccuuaauagaagugaaaacauguacauggccuaaaucucauacacucuggagcaaugguguucuagaaucagacaugauuaucccaaagucacuugccggaccaauaucccaacauaauuaucgaccaggcuaucauacccagacugcgggcccguggcacuugggcaaacucgaauuggacuuuaauuacugcgaagguacuacgguaguaauuacugaaaauuguggaaccagagguccgucacuacggaccacgacaguaucuggaaaacuaauacacgaauggugcugucgauccugcacuuugccuccgcucagauacaugggugaagacggcuguugguauggcauggaaaucagacccauuucagagaaagaggagaauaugguaaaauccuugguaagcgcaggaucagguaaaguugacaacuucaccaugggaguuuuauguuuagcaauauuauuugaagaaguaaugagagggaaauucggaaagaaacacaugauagcuggagucuuuuucacauuuguccuauuauugucaggccaaaucacuuggagggauauggcccacacauugauuaugaucgguucuaaugcaagugacaaaaugggcaugggugugacuuacuuggccuuaauagcuacauucaaaauacaacccuuucuagcgcuaggauucuuucucaggaaauuaacaagucgagaaaaccuauuguuaggaguaggacuggcuauggcaacaacauuacaguuaccugaggauaucgaacaaauggcuaacgggauugcccuuggcuuaauggccuuaaaguuaauaacacaauucgaaacuuaucaacuuuggacagcccuuauuucgcuuacaugcagcaauaccauguucacucuuacuguggcauggagaacugccacgcuaauauuagcaggaguaaguuuauuaccugucugccaaucuucuaguaugagaaaaacggauugguuaccaauggcgguagcagcaaugggcguaccaccauugccgcucuuuauuuuuagccuaaaagauacucucaaacguaggucauggccguuaaacgagggcguaauggcaguaggcuuaguguccauauuagccuccagccuauuacguaaugauguaccgauggcggguccccuuguagcaggagguuugcuuauagcguguuauguaauaacagguacgagugcugauuugacaguagagaaagcugcggacauuacgugggaagaagaagcggaacagacggggguaucacauaacuuaaugauaaccguggaugacgacggcacaaugcgaauaaaagacgacgagacagaaaacauauuaaccguacuauuaaaaacggcucuauugauagugucagguguguuuccguauucaauaccagcaacacuauuaguguggcauacauggcaaaaacaaacccaacgaagcggaguauugugggaugugccaucgccucccgaaacccaaaaagcagaguuggaggagggcguauauagaauaaaacaacaagggauauucgguaaaacucaaguaggaguaggcgugcaaaaagaagguguauuucauacuauguggcacgugacacgaggagcaguacuuacuuauaacggaaagcgucuagaaccgaauugggcuucuguuaagaaagaccuaauuucauaugguggugguuggcguuuaucagcucaauggcagaagggugaagaaguacaagucauagccgucgagccagggaagaaucccaaaaauuuccagacgaugccggguaccuuucaaacaaccacaggagaaauuggugcuaucgcccuugacuuuaagccaggaacgaguggcucaccaauaauaaaucgagaaggaaaagucguuggccuuuauggcaacggcguuguaacuaaaaauggcggauauguuuccggcaucgcacaaacaaaugcagagcccgaugggccuacccccgaacucgaggaggaaauguucaaaaagagaaaccuaaccauuauggaucuccauccagguagcggaaagacgcgaaaauauuugccggcuaucguuagggaagcaauuaaacguagacugcgaacgcugauucuggcgccgacaagagucguugcggcagaaauggaagaggcacugaagggauuaccaauuagauaucaaacuacugcaacaaagucagaacacacgggucgagaaauaguagauuuaaugugucacgccacauuuacgaugagauuauuaucuccaguaagggugccaaauuauaaucucaucaucauggacgaagcucauuucacagauccggccucaaucgcggcccggggauauauauccacaagagucgguaugggcgaagccgcagcaauauucaugacagccaccccgccugggacagcagaugcguuuccccaaucuaaugcucccauucaagaugaagaaagagauaucccagagagaaguuggaacucaggaaaugaauggauaacggauuuugcugguaaaacaguuugguuuguuccgaguauuaaagcaggcaaugauaucgcaaauugccuacgaaagaacgguaagaaaguaauucaguuaucaaggaaaacauucgauaccgaauaucagaaaacaaaacuuaaugauugggacuuuguaguuacgacagauauaucggagaugggagcaaacuucaaagccgaccgaguaaucgauccuagacggugccuaaaacccguaauccuuacggacggacccgaacgaguaauacuggcaggaccaaugcccguaacagcugcaucugcggcacaacgucgcggacgagucggucgaaauccccagaaagaaaaugaucaauauaucuucacuggucaaccacuuaauaaugaugaagaucaugcacauuggacugaagcaaaaauguuacuagacaauauaaacaccccugagggcauaauaccagcgcuguuugagccggagagggaaaagucagcugcgauugauggagaauacaggcuaaagggagagucgcgaaaaaccuucguagaauuaaugaggagaggagaucuaccuguaugguuagcacauaaagucgcuagcgagggaauaaaauauacggauaggaaaugguguuuugauggucaaagaaacaaucagauauuggaagaaaauauggacguagaaauuuggacgaaggaaggagagaaaaagaaacuacgaccacgaugguuagacgcgaggacauauagugacccguuagcguuaaaagaauuuaaagauuuugcagcgggacgcaaaucaauagcguuagaccuuguuacagagauaggacgagugccaucacacuuagcacacaggacacgaaaugcucuugacaaucuuguaaugcuucacacgagugagcacggaggacgugcguaucggcaugcuguagaagaacuaccugaaacgauggagacuuuauuacuuuuaggucuaaugauccugcugacgggaggagcaaugcuauuucuaauaucggggaaaggaauaggcaagacgaguauuggccuaauauguguuaucgcuucaucgggaauguuauggauggcagaaauacccuuacaauggauugcaucugcaauaguccucgaguucuuuaugaugguucuucuuauaccagaacccgaaaagcaaagaacuccacaagauaaucaguuagcuuauguuguaauagggauucucacacuugccgccauuauugcagcaaaugaaaugggacugcuggaaacuaccaaacgugacuugggaaugucgaaagaaccaggggugguuucgccaacaucuuaucuagauguugacuuacauccagcaagugcuuggacguuauaugcugucgcgacuacaguaauaacaccuauguuaagacauacaauagagaacucuacggcgaacguuucucucgcugccauugcaaaucaagcgguuguacucauggguuuagacaagggauggcccauaucaaaaauggaucucgguguuccguugcuugcucucgguuguuauucgcaaguaaaucccuuaacuuuaacagcugcaguccuauuauugauaacacacuaugcaauaaucgguccaggauuacaagcaaaggcaacgagggaagcccaaaagaggaccgcggcagguauuaugaaaaacccaacugucgaugguaucaugaccauagauuuggauccaguaauauaugauagcaaguuugaaaaacagcuaggccagguaaugcuuuuggucuugugugcgguacagcugcuacucaugagaaccucaugggcacuuugugaagcgcuuacucuugccacggggccaauaaccacauuaugggagggaucacccggaaaauuuuggaacacaaccauugcagucagcauggcgaacauuuucagaggaaguuaucuagcaggagcaggacuugccuucucuaucaugaagucaguggggacagggaaacgagggacuggaucacagggcgaaacauugggagaaaaauggaagaaaaaguugaaucaauuaagccgcaaagaguuugacuuguacaagaaaagcggaauaacggaaguugauagaacagaagccaaagagggauuaaaaagaggagaaacgacccaucaugcaguuaguaggggaacagcaaaguuacaaugguuuguagaaagaaauauggucauacccgaaggaagaguuauagaucuuggcuguggacgcggagguuggagcuauuauugugcgggccuuaagaaaguaaccgaaguacgagguuauacgaaggguggaccaggccaugaagaaccuguaccuaugucgacguacggguggaauauaguaaaacuaaugaguggaaaggacguguucuauuuaccgcccgagaaaugugacacacuacuuugugacauuggugaaucuaguccaucucccacuguugaagaaagccgaaccauucguguguugaaaaugguggaaccauggcugaagaauaaucaauucuguaucaaaguuuuaaauccuuauaugcccacagugauagagcauuuagaaagauuacagagaaaacacggaggcaugcuggugagaaacccucugucaagaaacucgacacaugaaauguauuggauuucaaacgguacaggcaacauuguugcaagugugaacauggugucacgccuauuguuaaacagauuuacaaugacacaccguaggccuacgauugaaaaggauguagacuugggugccggaaccaggcacguaaaugcugaacccgaaacaccaaacauggauguaauaggggagaggaucaaacgcauuaaagaagaacauaauucaacguggcauuacgacgaugaaaauccuuacaagacaugggcuuaucauggaucuuaugaaguaaaagcuacugguucagcuagcucuaugauaaacgggguaguuaaacuacuuaccaaaccgugggaugucgugccgaugguaacgcaaauggccaugacugauacaacucccuuuggucagcaaagaguuuuuaaagaaaaaguugauacgaggaccccaagguccaugccuggaacgaggagaguaaugggcauuacugcugaauggcuauggagaaccuuaggucgcaacaagaaaccucgacuuugcacaagagaagaauuuaccaagaaaguucguacuaaugccgcuaugggcgcagucuuuacugaagagaaccaaugggauucugcuaaagcagccguggaagaugaagauuucuggaaguuaguagaucgagaacgcgaacuucauaagcuaggaaaguguggaucaugcguauacaauaugauggggaaaagagaaaagaaauuaggagaauuuggcaaggcuaaaggauccagggcuauaugguacauguggcuuggagcucgauaucucgaguuugaggcuuuggguuuucugaacgaagaucauugguuuagccgugaaaauucuuauaguggcguagaaggugaaggauugcauaaacuaggauacauacucagagauaucaguaaaauaccagguggagcuauguaugcagaugauacagcggguugggauaccagaauaacggaggacgaucuucacaaugaggagaaaauuacucagcaaauggauccagaacauagacagcuggcgaacgcuauauuuaaacuuacguaccagaauaagguggucaaaguacaacgcccgacgccaacaggaacaguaauggauauaauaucuaggaaggaccaacgcggaucaggccagguugguacguauggucugaacacuuucacuaauauggaggcucaacuaauacgucagauggaaggcgagggugugcuguccaaagcugaucuagaaaauccccacuugccugagaagaaaaucacucagugguuagaaacgaaaggagucgaaaggcuacgcagaauggcaauuagcggggacgauugugucgugaaaccuaucgacgaccgguucgcuaacgcacuauuagcuuuaaaugauaugggcaaagucaggaaagacauaccacaauggcaaccgucuaaaggauggcacgauuggcaacaagugccguucuguucccaccauuuccacgaauugauuaugaaagaugggcguaagcuaguaguaccgugcaggccacaggacgagcugauaggccgggcaagaauaagucaaggggcgggauggaguuuacgagaaaccgcuuguuugggaaaagcguaugcacaaauguggagccuaauguacuuccacagaagagaucuucgauuagcaaguaaugcuauauguuccgcagugccaguacauuggguaccaacgagcagaacaaccuggucaauucaugcacaccaccaauggaugacgacagaagacauguuaacgguauggaauagaguuuggauugaagauaacccauggauggaagacaaaacgcccgugacgacuugggaaaacgucccauaucuagggaaacgugaagaucagugguguggaaguuuaauaggauugacuagccgcgcuacaugggcacagaacauuccaacugcuauucaacaagugaggucguuaauuggaaaugaggaguuccuugacuauaugccaagcaugaaaagauuucggaaagaagaagaaucugaaggcgccauaugguag

SEQ ID NO: 23335 - RNA, 9873 nt, Artificial Sequence
  derived and/or modified CDS sequence (opt6) from DENV-3__FJ024470__SS-prME
acaucucuaugcuugaugaugauauugccggcagcguuagcguuccaccuuacuucaagagacggggaaccuagaaugauagucggcaaaaaugaacgcgggaaaucacuucuuuuuaaaacggccagcgggauaaauauguguacucuaauagcaauggaucuaggggaaaugugcgaugauacuguuacuuacaaauguccucauauaacagaaguugaaccugaagacauagacuguugguguaaucuuacgaguaccuggguuacuuaugguacgugcaaccaagcuggagaacaccgaagagacaaaagauccguagccuuagcgccucaugugggcaugggauuagacacaagaacgcaaacuuggaugucggcagaaggggcauggcggcaagucgaaaaaguagaaaccugggcacuacgucauccaggauucacaauccuagcccuguuucuagcgcauuauauagggacaucacuaacacaaaaagucgucauauucauuuuacuaauguuaguaacuccaaguaugacaaugcgauguguggguguagggaacagggacuuuguagaaggacuaucgggagcaacuuggguggacguuguacuagaacaugguggcuguguuacuaccauggcuaaaaauaaacccacucuggauauagaauuacaaaagacggaagccacacaauuagcaacauuacgaaaacuauguauagaaggcaaaauaacuaauauuacaacugauucgagauguccaacccaaggagaagcagcgcuaccagaagaacaggaucaaaacuacguuuguaaacauacauacguagacaggggaugggguaauggaugugggcuauucgguaaaggaucucuuguaacuugugcaaaauuucagugucuagaaccgauugaggguaaaguuguacaauaugaaaaucuaaaauauacugugauaauuacaguacacacuggugaucaacaucaaguuggcaacgaaacgcaaggugugacagcagaaauaacaccucaggcgucaacaacagaggcuauacuuccugaauacggaacacugggacuugaaugcucccccagaacaggacuugacuucaacgagaugaucuuauuaacaaugaaaaauaaagcguggaugguucauaggcaaugguucuucgaucuaccguuaccauggaccuccggugccacaacagaaacuccgacauggaaucggaaagaacuguuaguaacguucaaaaaugcacaugccaagaaacaagaaguugugguuuuaggcucacaggagggagcaaugcacacagcccuaacaggagcaacagaaauucagaauaguggugguaccucaauuuuugcuggccauuuaaaaugccggcuuaaaauggacaaacuggaauuaaaaggaaugucauacgcaauguguacgaauacauucguccuuaaaaaggagguauccgaaacucaacacgggaccauacuaauuaagguagaauauaaaggugaggacguuccauguaagauaccuuuuucaacggaagauggucaagguaaagcucacaacggcagguuaauaacggcaaauccaguggucacaaagaaagaggaacccguaaauauagaagcagaaccuccguuuggagagucaaauauaguaaucgguauaggggauaacgcguuaaaaauaaacugguacaagaaagguuccucaauagguaagauguucgaagcaacagccaggggagcuaggcgaauggcgauccuaggugacacagcuugggauuucggcucagugggcggaguuuuaaauucgcuaggcaaaaugguacaccaaauauucggaagcgccuacacggcucuauucucgggcguuucuuggguaaugaaaauaggaauuggaguuuuacuuacuuggaucggacuaaacaguaaaaacacgaguaugaguuuuagcugcauugcgauagguauaaucacacuauauuuaggcgcuguaguacaagcugauauggguugcguuauuaacuggaagggcaaagaauuaaaaugcggcuccgguauauuuguaacaaaugaagugcauacguggacggagcaauacaaguuccaggccgacagcccuaagcgauuggcaacagcuauagcaggagccugggaaaacggggugugugggauaagaucaacaacaagaauggaaaaucugcuauggaaacaaauagcuaaugaauuaaauuacauacuaugggaaaacaauauuaaauuaacgguaguuguuggugauauaauagggguacuugaacaaggaaaacgaacacuaacaccacaaccuauggagcuaaaauacaguuggaaaaccugggguaaggcuaaaauuguaaccgcagaaacucagaacaguucauuuaucaucgaugguccaaacacuccagaaugcccuucugcaagucgcgcguggaaugugugggaagucgaggacuacggguuugggguauuuacgacuaauaucuggcugaaguuacgugagguuuacacgcaauuaugcgaucacagguugaugucagcagccguaaaggaugaacgggccguccacgcagauaugggauauuggauugaaagucaaaagaacgguucauggaaauuagaaaaagcaucucuuauugaaguaaaaacuuguacauggccuaaaucgcacacccuguggagcaaugguguacuagaaucugauaugaucauaccaaagagucuagcaggaccaaucagucaacauaaucauaggccaggauaucauacacaaacagcugggccauggcacuuggggaaacuugaacuggauuucaacuacugugagggaacuaccguaguuauaacagaaaauugcgguacacgugguccgucacuaaggacgacuacgguuaguggaaaguugauacacgaauggugcugucgaucuugcacgcuuccgccacuuagguacaugggggaagauggaugcugguacgggauggaaauaagacccaucagugaaaaagaagagaacaugguuaagaguuuaguuucagccgguagugggaaaguugacaauuuuacaauggguguucuauguuuagcaauccuauuugaagaagugaugcgaggcaaauuuggcaagaaacauaugauagccgguguuuucuuuacauuuguauuauuacucucaggucagauaacguggagagacauggcucauacccuaauuaugauuggcagcaaugcuagcgaucgaauggguaugggaguaacguaccuggcccuuauagcaaccuucaaaauacaaccauuuuuagcucuaggguucuuucuccgcaaguuaacgucccgagaaaaucuacuuuuaggagugggucuugcuauggcaacuacuuuacaacuaccggaagauaucgaacaaauggcuaauggaauugcguuaggacuaauggcacugaaacuaauaacccaauuugaaacauaucaacuguggacugcucugaucagucucacaugcucuaacaccauuuuuacgcuaacaguagcguggcgcaccgcaacauuaauacuagccggugucagcuuacucccgguaugucaauccaguucuaugagaaaaacagauugguugccaauggcagucgcagcgaugggaguaccaccguuaccgcuuuucauuuucagucucaaggacacccuuaagcgacguaguuggccucuuaacgaagggguuauggcggucggccucguaaguauauuagcuucuagcuugcuacgcaaugacguacccauggcaggaccucuaguagccggcgggcuacugauugccugcuacgugauaacagggacuucagccgaucucacuguugaaaaagcagccgauauaacgugggaagaggaggcagaacagacuggaguuucucacaacuugaugauuaccguugaugaugauggaacaaugaggauuaaagaugaugaaaccgagaauauauuaacaguacuucugaagacagcauuauugauuguuucaggcauauuuccauacaguaucccugcgacgcuccuagucuggcauacuuggcaaaaacaaacacaacgaagugguguccuuugggacguuccuucuccacccgagacacaaaaagcagagcuugaagaaggcguauaucguauuaaacaacaaggcauuuuugguaaaacucaagucggcguaggaguacaaaaagaaggaguauuucauacaauguggcacgucacaaggggcgcuguacuaacauauaacggaaaacgauuagaaccaaauugggcaagcgugaagaaagaucuaauaucauauggagggggauggagacugagcgcgcaauggcaaaaaggcgaggagguacaaguaauugcuguugagcccggaaagaaucccaaaaacuuucaaaccaugccaggaacauuccaaacaacaacaggugaaauuggcgcaauugcuuuagacuuuaaaccuggaacuagcgguagcccuauuaucaaucgagaagggaagguaguuggauuauaugguaacggcgucgugaccaaaaauggaggauaugucuccggcauagcacaaacaaacgcugagccagauggcccuacacccgaacuagaagaagaaauguuuaaaaagcguaaucuaacuauaauggaucuccauccgggaucagguaaaacuaggaaauaucugccugcaauaguacgugaagcuauaaagagacgacuccgaacacugauauuagcuccuacuagaguaguagccgcugaaauggaagaagcucuuaaaggccucccaauaagauaucaaacuacugcgacuaaauccgagcauacuggaagagaaauaguggaucugaugugucaugccacuuucacaaugaggcuacuaagcccaguacgugucccaaacuauaaccugauuauaauggacgaagcacacuuuacagaucccgcgucgauagcagcgagaggauauaucaguacgcgaguaggaaugggugaagcagcugcgauuuuuaugacugcaaccccgccgggaacagccgaugccuucccucaaaguaaugcacccauucaagaugaagagagggacauuccggaacggucauggaauagcgggaacgaauggauaacugauuucgcuggaaaaacgguaugguuugucccaucuauaaaggcagggaacgauauagcuaacugucuuaggaaaaaugggaagaaaguuauucaacuaagucgaaaaacauucgauacagaguaucagaaaacaaaauugaaugauugggacuucguaguaacuaccgauauuucggaaaugggagcgaacuuuaaagccgaucgaguaauagacccacgucguugucucaaacccguaauauuaacugauggacccgaacgggugauucuggcuggaccaaugccgguaacugccgcaagcgcagcccaacgaagaggcagagugggucggaauccgcagaaagagaacgaccaauacaucuuuacgggacaaccauuaaauaacgacgaggaucacgcacacuggacugaagcaaaaaugcugcuugauaauauaaauaccccagagggaauaauaccggcauuauuugaaccagagcgagaaaaaucagcagcaauagacggagaauaccgccuaaagggagaaagcagaaagacuuuuguagaauugaugcgccgcggugaccugccagucugguuagcgcacaaaguagcuagugaaggaaucaaguauacugacaggaaauggugcuucgacggacaacggaacaaccaaauauuagaagaaaacauggacguugaaauauggacaaaagaaggagagaagaagaaacugagaccacgaugguuagacgcccguacauauagugauccucuugcacuaaaagaauuuaaagacuuugcagcggggaggaaaucaauagcgcuagaucuuguaacugagauaggcagagucccaucucaucuagcucauaggacgagaaacgcgcuagauaauuuggucaugcuacauacaucagagcauggagggagagccuaucgacaugcaguggaagaauuaccagaaacaauggaaacucucuuacuacuuggacucaugauauugcugacggguggcgcaaugcuuuuucugaucuccggcaaaggaaucggcaaaaccuccaucggccuaaucuguguuauagcaaguucggguaugcuuuggauggcagagauaccguuacaauggauagccucggcgauaguccuagaguucuucaugaugguauuauuaauaccagaacccgagaaacagcguacaccgcaagauaaucaauuagcuuacguggugaucgguauuuuaaccuuggcagcaauuauagcagcaaacgaaauggggcugcuugaaaccacaaaaagggauuuagggaugucaaaagagccugggguuguuucaccaaccuccuacuuagaugucgacuuacauccugcgagugcuuggacacuuuaugccguagcuaccacuguuauaacaccaaugcuuaggcauacuauugaaaauucuacggcaaauguaucucucgcagcuauugcuaaccaggcuguagugcuuaugggauuagauaaaggauggccaauaaguaaaauggauuuaggcguaccucuuuuagcauugggaugcuacagucaggucaaucccuuaacucuaaccgcugcaguuuuauugcuaauaacacauuacgcaauaauaggaccugggcuacaggccaaagcgacgcgagaagcucagaaaagaaccgcagcgggcauaaugaagaauccaaccguugacggcauuaugacuauagauuuggauccgguuaucuaugauaguaaauuugaaaaacaacuuggacaaguaaugcuuuuagucuuaugugcaguacaacuacuuuugaugcgcacgaguugggcauuaugugaagcauuaacuuuagcaacaggcccuauuacuacguugugggaaggaaguccagggaaauuuuggaacaccaccauagccgucucuauggcuaauauuuuccgaggguccuauuuagccggugcaggucuagcauuuucuauaaugaaaagcguaggaacaggcaaacgugguacgggcucgcagggggaaacucuaggugagaaauggaagaagaaauuaaaccaacuaucaaggaaagaguucgacuuauauaaaaagucagggauaaccgaaguagaccguacggaagcuaaggaagguuuaaaacgaggagaaauaacucaucaugcagucagccgcggcucagcaaagcugcagugguucgucgagagaaauauggugauaccagaagggagaguaauagacuuaggauguggucgcgguggaugguccuauuacugcgcggggcucaagaaaguaacggagguaagaggcuauacaaaaggaggaccuggccaugaagaaccaguuccuaugucaacauacggcuggaauauaguuaaacucaugagcgguaaggacguauucuacuugcccccagaaaagugugauacccuauugugugauauaggugaaucuucaccgucgccuacaguugaggaaucacgcacuauacguguacugaagaugguagaaccuuggcucaaaaacaaucaguucugcaucaaaguuuuaaaccccuacaugccgaccgucaucgaacaucuugaaagguugcaaagaaaacauggagggaugcugguaagaaauccccuuucaagaaacagcacacacgagauguauuggaucaguaacgguacagguaauauaguagccucaguaaacaugguaucuaggcuauuacugaacagguuuacaaugacccauagaagacccacaauagaaaaagacguugacuuaggcgcuggcacacgacauguaaaugcugaaccugaaacaccaaauauggauguaauaggagaacgaauaaagcggaucaaagaagaacacaauaguacuuggcauuaugacgaugaaaacccuuauaaaacuugggcuuaucaugguucuuacgaagucaaagcaacuggaucggcaucaagcaugaucaauggagucguaaaauuguuaacuaaaccaugggacguaguaccuauggucacucagauggcaaugacugauacaaccccuuuuggacaacagagagucuucaaggagaaaguagauacgagaacuccgaggucaaugccaggcacaagacggguaauggguauaacggcagagugguuauggagaacgcuaggaaggaacaaaaagccuaggcuauguacacgugaagaguuuaccaaaaagguaagaacaaaugcugcaaugggugcuguauucacugaagaaaaucagugggacagugcaaaagcagccguagaggacgaagauuuuuggaaguuaguagaucgcgaaagagaacuacacaaauuggggaaauguggaucuuguguauacaauaugauggggaaacgugagaagaaacuuggagaauuugggaaagcuaaaggcagcagagcaaucugguacaugugguugggugcgcgauauuuagaguuugaagcguuaggcuuuuuaaaugaagaccacugguucagucgugaaaauucauacagcggagucgaaggagagggcuugcauaaauuaggcuauaucuuacgugauauauccaaaaucccagguggagcuauguaugcugacgauacagcuggcugggauaccagaauuacagaagacgauuugcauaacgaagagaaaauuacccaacaaauggacccagaacauaggcaacuugcaaacgcaauuuucaaacuuacuuaucaaaacaagguaguuaaaguacagagaccuacaccgacuggaacaguaauggauauaauaucgcgaaaagaucaacgcgggucaggccaaguuggcacauauggccuaaauacuuuuacuaauauggaagcccaauuaaucaggcaaauggaaggggagggaguucuaaguaaagccgaucuagaaagccaucaccucccggagaagaaaauaacacaaugguuagaaacaaaaggaguagaacgucuaaagagaauggcaauauccggggacgauuguguaguaaaaccgaucgaugacagguuugcaaacgcauuacuugcgcuuaacgauauggguaagguuagaaaagauauaccgcaauggcaaccgucaaaaggcuggcaugauuggcagcaagucccuuuuuguagucaucauuuucaugagcuuauaaugaaagaugguagaaaauugguugugccaugccggccccaagacgaauuaauaggucgagcgagaaucucacaaggcgcuggauggucauugagagagacagccugccuaggaaaagcauaugcucagauguggucucuuauguacuuucaucggagagauuugagauuagcuuccaacgccauauguucugcaguaccuguucauuggguacccacaucaagaacuacuugguccauucacgcgcaccaucaguggaugacaacugaagauaugcugacuguauggaaccgagucuggaucgaggacaauccauggauggaggacaaaacacccguaacgacuugggaaaacgugccuuacuuaggaaaacgugaagaucaauggugcggguccuugauaggacugaccaguagagcaacaugggcacaaaauauuccgacugcaauccaacaagucagaucacuaaucggaaaugaggaguucuuagauuauaugccaucuaugaagagauuuagaaaggaggaggaaagugagggugcuauaugguaa

SEQ ID NO: 23336 - RNA, 9873 nt, Artificial Sequence
  derived and/or modified CDS sequence (opt6) from DENV-3__FJ024471__SS-prME
acgucauuaugucuaaugaugauucuacccgcggcacuagcguuucauuuaacgucaagggacggagaaccuagaaugauugucggcaaaaaugaacgggguaaaucacuacucuuuaaaacugcuucuggaauuaacauguguacgcuuauagcuauggacuuaggugaaaugugugacgacacaguuaccuauaaauguccgcauauuacugaaguagaaccugaagauauugauuguugguguaaucuaacauccaccuggguaaccuaugggacguguaaccaagccggugaacacagaagagacaaaagguccguagcauuagcuccacacgucgguaugggauuggauacaagaacccaaaccuggaugagcgcggaaggugcauggagacaagucgaaaaaguggagacaugggcguugagacacccaggauuuaccauccuggcauuauuucuggcacauuacauagguaccucacucacacaaaaaguugugauauuuauucuacuuauguugguaacaccgucaaugaccaugcggugcguugguguggggaaucgggacuuuguugaagguuuauccggagcaacauggguagauguuguccuggaacauggaggcugugugacuacaauggcuaaaaauaaaccaacccuagacauagagcuacagaaaacugaggcaacgcaacuggcaacauugcggaaauugugcauagagggaaaaaucacaaacauaaccacagauagucgauguccuacucaaggugaggcagcacuuccagaagaacaagaccaaaauuauguauguaaacacacauauguagaccgagguugggguaauggcuguggauuauuuggaaaagggaguuuaguaacaugcgccaaauuucaaugcuuagagccaaucgaaggaaaaguaguacaauacgaaaacuugaaauacaccguaauaauuacgguacacacaggagaucaacaucaaguuggaaaugaaacccaaggaguuacggccgaaaucacaccccaggcuucaacaacugaggcgauauuaccggaguaugggacacucggacucgaaugcagcccccggacuggguuagacuuuaaugagaugauuuuauuaaccaugaagaacaaagccuggauggugcaucgacaaugguucuuugaucuaccuuuaccauggacaucgggagcuacuacagaaaccccaacuuggaaucgaaaagagcucuuggucacauucaaaaacgcucaugcgaaaaagcaagagguaguaguauuggguucccaagaaggagcgaugcacacagcauuaacaggagcuacugaaauacaaaauagcgggggaacaucgauauuugcuggacauuugaaaugcagacucaaaauggauaaacuugaauuaaagggcaugaguuaugcaauguguacaaacacuuucguacuuaagaaagaaguaagugaaacucaacacgguacaauacuuaucaaaguagaauauaagggcgaagacguaccaugcaagauaccauuuucgacagaagauggacaaggaaaagcucauaauggacguuuaauaaccgcuaaucccguugucacaaagaaagaagaaccgguaaacauugaggccgaaccaccauuuggagaauccaacaucguaauaggaaucggugauaaugcacuuaaaauaaauugguacaagaaagggucaucaauaggaaaaauguucgaggccacggcucgaggagcuaggagaauggcgauucuaggagauacagcaugggauuuuggaucuguaggaggcguacuaaauucucuaggaaaaauggugcaccaaauauuuggauccgcauacacugcauuauucagcgguguauccugggucaugaaaauagggauagguguguugcuaaccuggauaggauugaacucgaaaaauacaagcaugucuuucucauguaucgcuauagggaucauaacgcuauacuuaggggcagugguacaagccgacaugggcugugugaucaacuggaaagguaaagaguugaaaugcgggucugguauauucguaacaaacgaaguacauaccuggacugagcaauacaaauuucaagcagauucaccaaaaagauuggcaacugcaauagcaggcgcaugggaaaauggaguuugcgggauaaggagcacaacaagaauggagaacuuacuuuggaaacaaauugcaaaugaauuaaacuauauucuaugggaaaacaacauuaaguugaccguaguagucggugauauaauuggaguacucgagcaaggaaaacggacguuaacuccccaacccauggaguuaaaauacucauggaaaacuuggggaaaggcgaagauaguuacagcggaaacacagaacaguaguuuuauuauagauggaccaaauacaccggaaugcccaucagcuucuagagcuuggaauguaugggaaguagaagauuauggauuuggagucuucacaacaaacauaugguuaaaauuacgcgaggucuacacucaauuaugcgaucacagacuaaugucagccgcuguaaaagacgaacgugcaguucacgcagauauggguuacuggauagaaucacagaaaaaugguucauggaaauuagaaaaagcuaguuugaucgagguaaaaacuuguacauggcccaaaucacacacccuauggucgaacggaguacuagagucagacaugauaauucccaagucauuagcugguccuauaucucaacacaaucaucgaccuggguaucauacccagaccgcgggaccauggcacuuaggaaaauuggaguuagacuuuaacuauugugaagggacaacgguggugauaacagaaaauuguggaacucguggaccaucuuuacgaacaacuacgguaucaggaaaauugauccaugaaugguguuguaggucuuguacucucccaccucuuagauauaugggagaggauggaugcugguauggaauggaaauaagaccaaucagcgagaaggaagaaaauauggugaaaucauuaguaagcgcuggcagcgguaaaguagauaauuucacaaugggcguucucugcuuggcaaucuuauucgaagaagugaugagaggcaaauucggcaagaaacauaugauugcaggaguauucuuuaccuuugugcuucuccuuagcgggcaaauaacauggagagauauggcgcacacauuaauaaugauuggcuccaaugcuagugaucgcaugggaaugggggugacuuaucuggcauuaaucgcuacauucaagauucaaccauuuuuggcucuaggauuuuuccuaagaaagcuaacaaguagagaaaauuuacuacuagguguuggucuagccauggcaacaacuuuacagcuuccugaagacauagaacagauggcaaauggaaucgcauuggguuuaauggccuugaaacugauaacacaauuugaaacguaccaacuauggaccgcauuaauuucucuuacguguagcaauacaauauuuacccucacgguggcauggagaacugccacacuuauauuagcuggcguuucacuccuaccaguuugccaauccaguagcaugaggaaaacugacugguugccuauggcuguugcggcaauggguguaccuccacuaccguuguuuauauucucgcuaaaagacacuuuaaagagaagaaguuggccccuuaacgaagguguaauggcugucggucuaguaaguauacuugcuucuucacuacuucgaaaugacguuccaauggcugguccucuaguagccgguggacuccuuauagcauguuacguaauuacuggaacaagugcggauuuaacaguagaaaaagcugcagauauaacaugggaggaagaagcagaacaaacggggguaucacacaauuuaaugauuacuguugaugaugacggcacuaugcgcaucaaagaugacgaaacagaaaauauuuuaacagucuuacuuaaaacagcauuauuaauaguuagcggaauauuuccauauagcauaccagcuacguuacugguuuggcacacauggcagaagcaaacgcaacguucuggcguucugugggaugucccuagcccacccgaaacucaaaaagccgaacuagaagagggaguauauagaaucaaacaacaaggaauuuuugggaaaacacaagucggaguuggcguacaaaaggagggagucuuucauacaauguggcauguaacgagaggggcgguuuugacuuauaauggcaaacgccuagaaccuaacugggcuagugucaagaaagaccuaaucucuuauggaggugguuggcggcuaucagcacaauggcaaaaaggagaagagguccaaguuauugcaguagagccugggaagaaucccaaaaacuuucaaacaaugccaggaaccuuucagacuacuacuggggaaauaggagcgauagccuuagauuuuaaaccgggcacaagcggaagucccauaauaaaccgagaagguaaaguaguuggacuauaugguaauggggugguaacgaaaaauggagguuaugugucugggauagcucaaacuaaugcggaaccagaugggccgaccccugaauuggaagaagaaauguuuaagaaaagaaaccuaacaauuauggaucuccacccuggaucagggaaaacacggaaguaccuuccagccauaguacgcgaagcgauaaaaagacggcuacguacguuaauauuagcccccacuagagugguugcugcggagauggaagaagccuugaagggauugccgauacgguaccaaacaacagcaaccaaaagugaacacacaggccgugagauuguagauuugaugugucaugcaacuuucacaaugcgcuuacuaagucccgugcgaguacccaacuauaacuuaaucauaauggacgaggcacacuucaccgauccugcaaguauagcugcaagggguuauauaaguacacguguaggaaugggagaagcggcagcuaucuuuaugaccgcuacuccaccgggaacagcugacgcauuuccgcaaaguaaugcgccuauacaagacgaagaacgggacaucccagaaagaagcuggaauagcggcaacgaguggauaacagauuuugcaggcaaaacagucugguuugucccgucgaucaaggccgguaaugauaucgcaaacugccuaaggaaaaauggcaagaaggucauccagcucucucggaaaacauuuaauacagaauaccagaaaacuaaacuaaaugauugggauuuuguggucacaacagauaucagcgaaaugggggcaaauuucaaagcagaccgagucauagauccgcggagguguuuaaaaccggucauucucacagacgggccagaacgcgugauucuggcuggaccgaugccggugacugcagcuagugcugcgcaacggcgaggacgaguagguagaaacccacaaaaagaaaaugaccaauacauuuuuaccggacaacccuuaaauaacgaugaggaccaugcacauuggacugaagcuaaaaugcuuuuagacaauauuaacacaccagaagggauaauuccagcucucuucgaaccagagcgagaaaaaucagcugcaauugacggagaguauagacuuaagggggaaucccggaaaacuuuuguagaacuuaugcgacguggcgauuuacccguuuggcuagcccacaaaguugcaagcgaggguauuaaauauacagacaggaaauggugcuuugacggacagagaaacaaucagaucuuggaggaaaacauggacguggaaaucuggacaaaagagggggagaaaaagaaauuacguccucgcuggcuagacgccagaacauauucagaucccuuggcacuuaaagaauuuaaagacuucgccgcaggaaggaaaaguauagcacucgauuuaguaacagaaauaggucguguccccucgcaccuagcgcacagaacgagaaacgcguuagacaauuugguaauguuacauacaagugagcauggcggcagagcauaccgucaugcaguagaagaauuaccagaaacgauggagacuuuacucuuauuagguuuaaugauacuauuaacagguggagcgauguuguuucugauuucggggaaggguauagguaaaacuuccauuggucuaauuugcgugauagccagcuccggaauguuauggauggcugaaauaccauugcaauggauagcgagcgcaauuguacuugaguuuuucaugauggucuuacucauaccagagccugaaaaacaaagaaccccucaagauaaucaguuagcuuacgucguuauuggcauucugacuuuagcagcuauaauugcagcaaaugaaaugggauuacuagaaaccacgaaacgggacuuaggaaugucuaaggaaccugggguagucaguccuacaaguuaucuugauguugaccugcauccagcuucagcauggacucucuacgcgguggcaacaaccgugaucacuccaaugcuucgacauacaaucgaaaauucaacggcuaauguaucccuugccgcaauugcgaaccaagcagugguacugauggguuuggacaagggguggccgauaucgaaaauggauuuggguguucccuuauuggccuuaggauguuauucccaagucaauccacuaacuuugacagccgcaguacuuuuguuaauaacucauuacgcaauaauuggaccaggacuacaagcaaaagcaacgcgcgaagcccaaaaacgaacggcggcaggaauuaugaaaaauccuacuguggaugguauaaugacaauagacuuagacccagucauauacgauucaaaguuugagaaacagcuuggccaaguuaugcuauuaguguuaugcgccguacaauuacuauuaaugaggaccucuugggcacuaugugaagcacuaacucucgcuaccggaccuaucacgacacuuugggaagggagcccuggaaaauuuuggaacacaaccauagcugugucuauggcaaacauuuuuagagguaguuacuuagccggugcagguuuggcauucucaauaaugaaaucgguagggacggguaaacgaggaacagggucacagggugagacauugggagaaaaauggaagaagaaauuaaaucagcucaguagaaaagaguucgauuuauauaagaaaucgggaauaacugaaguagaucgaacugaagccaaagaggguuugaagagaggagagauaacccaucaugcaguuucacgugguagcgcaaaacuccagugguuuguggaaagaaauauggucauaccagagggaagagucauagaucuugguugcggucgaggaggauggucuuacuauugugcgggacuaaagaaaguuaccgaaguucgcggauacacgaaaggaggucccggucacgaagaaccaguuccaauguccacuuacggguggaacauagucaaacuaaugaguggaaaagauguauucuauuugccaccagagaaaugcgacacucugcuaugcgacauaggagaauccucacccucccccacaguagaagaaucucgcacuauaagaguuuugaagaugguagaacccuggcucaaaaauaaucaauuuuguauuaaagucuuaaauccauacaugccaacaguuauagagcaucuugaaagauugcagaggaaacacgguggaaugcucguaagaaacccucuaagcagaaacagcacccacgaaauguauuggaucaguaauggaacaggaaacaucguugccagugugaacaugguaucacgacuccuacuaaaucgauuuacgaugacccaccggcguccuacaauagaaaaagacguugaccuuggagcaggaacucgccaugugaaugcugagcccgaaacgcccaacauggacguuauaggugaaagaauuaaaagaauuaaagaggagcacaacagcaccuggcacuaugacgacgagaauccauacaagacaugggcauaucauggaucguaugaagucaaggcaacaggcucugcuucuucaaugauuaacgguguaguuaaauuacuuaccaaaccuugggacguaguaccaauggucacccaaauggcuaugaccgauacgacacccuuuggccaacaacguguuuucaaggaaaagguggauacucguaccccucgcucuaugccuggaacgcgccgaguuauggggauaacagcugaauggcuauggaggacauuaggacgcaauaagaaaccaagauuguguacacgugaggaauuuacuaagaaagucaggaccaaugcugcaaugggcgcuguauucaccgaagaaaaucaaugggauagcgccaaagcagccguggaggaugaggauuucuggaaacugguagacagggaacgugaauuacacaaauugggaaagugcggaagcuguguuuauaauaugaugggaaaaagagaaaagaaacuaggagaguucggaaaagcgaaaggaucuagagcuauaugguacaugugguugggugcgcgauaucucgaauuugaggcuuuaggguuuuuaaaugaagaucauugguuuaguagagaaaauagcuacucaggaguugaaggagaaggacuacacaagcuaggguauauauuaagagauauuaguaagauucccggaggugcaauguaugcagaugacacagcgggaugggauacccgaauuaccgaagacgacuuacauaaugaggagaaaauaacucaacaaauggacccagaacaccgacaguuagcgaacgcaauauuuaaacuaaccuaccagaacaaagucgucaaggugcaacgacccaccccaacgggaacgguaauggacauuauaagucgcaaagaucaaagaggaucaggccaaguaggaacguauggacuaaauacauucacaaauauggaggcccaacugauuaggcagauggagggagagggaguacucaguaaggcagacuuagaaagucaccaucugagcgaaaagaaaauaacucagugguuagaaacaaagggcguagaacgcuuaaagagaauggcuauuagcggagaugauuguguaguaaaaccaauugaugauagauuugcaaaugcccucuuggcguugaaugauaugggcaagguccgaaaagacauaccucaguggcaaccgagcaaaggguggcacgauuggcaacagguaccauuuuguagucaccauuuccaugaacuaauaaugaaggacggucgaaaguugguuguaccaugccgaccacaagacgaacuaauaggcagagcaagaauuucacaaggcgccggcuggagccuccgagaaacugccugucucggaaaagcguaugcucaaauguggucacugauguacuuucauaggagagaucuaagauuagccucaaacgcuauaugcuccgcaguaccaguccauugggucccuacuucucguacaacauggaguauacaugcgcaucaucaauggaugacuacugaagacaugcuaacgguuuggaaucgaguguggauagaagacaauccauggauggaagauaaaacaccaguuacaacaugggaaaauguaccauaccugggcaaaagggaagaccaaugguguggaagccugauuggucugacuagcagggcgacuugggcgcaaaauauaccaaccgcaauucaacaaguacgaagccuuauuggcaacgaagaguucuuggauuauaugcccagcaugaaaagauuccgcaaagaagaggaaucugaaggugcaauaugguaa

SEQ ID NO: 23337 - RNA, 9873 nt, Artificial Sequence
  derived and/or modified CDS sequence (opt6) from DENV-3__FJ182005__SS-prME
acgucucuaugucugaugaugauccuaccagcagcgcuugcauuucaccucacuucgagagauggagaaccccguaugauaguuggcaaaaaugaaaggggaaaauccuuacuauucaaaacagcuucaggaaucaacaugugcacauuaaucgcaauggauuuaggagaaaugugugaugacacagugacauauaaaugcccucauauaacugaaguagaaccagaagacauagacugcuggugcaaucuuacaagcacgugggucacauauggcacauguaaucaagcaggggagcauagaagagauaaacgaucugucgcauuggcgccucacguaggaauggggcuagacacacgcacucaaaccuggaugucggcugaaggagcuuggcgccaagucgaaaaagucgaaacuugggcauuaaggcauccaggauucacaauucuagcacuuuuccuugcucacuauaucggaacaaguuuaacgcaaaaaguggucauuuuuauucuguuaaugcugguaacaccaucuaugacuaugcguugugugggagugggaaaccgagauuucguggaaggucuaucaggugccacauggguggauguaguuuuagaacacggagguugcgucacgacuauggccaaaaauaaaccaacgcucgacauagaauugcagaaaacagaagcaacccaacuugcuacucuuaggaaauuguguaucgaggguaaaauuaccaauauaacgaccgacucaagguguccaacgcaaggagaagcagucuuaccagaagaacaagaucaaaacuauguguguaaacauaccuacguugaucgggguugggguaacggaugcggacuauucggaaaagguucauuaguuacaugcgccaaauuccaauguuuagaaccgaucgaagguaaaguuguccaauaugaaaaccuuaaauauacugugauuauuacggugcauacaggugaccaacaucaaguagguaaugaaacccaaggaguaacugcggaaauaacaccacaggcuucaaccacagaggcaaucuuacccgaauauggaacgcuuggauuggaauguucgccaagaacaggauuagacuuuaacgagaugauuuuacucacaaugaaaaauaaagcguggauggugcacaggcagugguucuuugaucucccuuuaccguggacaagcggcgcuacaacugagacgccaacuuggaaccgaaaagagcuauugguaacauuuaaaaacgcacaugccaagaaacaagaaguaguaguccuugguucccaagaaggagccaugcacaccgcgcugacaggcgcaacugaaauacaaaauucaggaggcacgucaauuuuugccgggcacuugaaauguagacuaaaaauggacaaacucgaauuaaaagguauguccuaugcgauguguaccaauaccuucguuuugaagaaagaagucucugaaacucaacaugguacaauuuuaaucaaaguagaguacaaaggcgaggacguuccauguaaagucccguucucgacagaagauggacaagggaaagcacauucaggcagacucauaacagcgaauccaguagugacuaagaaagaagaaccaguuaauauugaagcggagccucccuuuggugaaucgaacauaguuauaggaauuggagauaaugcuuuaaaaauaaacugguacaagaaagguaguaguauagggaaaauguuugaggccacggcgaggggagcaaggagaauggcgauauuaggagacacagcaugggauuucggcuccguaggcggaguauugaacagucuagggaaaaugguacaccaaauuuucggguccgcauacacagcauuauucucaggcguaucauggguuaugaaaauaggcauaggaauauuauugacuuggauaggauuaaacagcaaaaacacaucaaugaguuuuaguuguaucgucauugguauaauaacacuauaccugggagcggucguccaggcggauaugggaugcguaauaaauuggaaaggcaaagaacugaaauguggauccgguauuuuugugacaaacgaaguacauacuuggaccgaacaauauaaauuccaagcagauucuccaaaaagacuagcuaccgcaaucgcaggagcaugggaaaacggagugugugggauaagaagcacuacaagaauggaaaauuuacucuggaaacaaauagcuaaugaguugaacuauauucuaugggaaaauaacauuaaacucaccgucguaguuggagauauuaucggcguauuagaacaaggaaaaagaacacucacuccucaaccaauggaauuaaaauacaguuggaaagcauggggcaaagcaaaaauaguaacagcagagacccaaaacaguagcuucauaauagauggaccuaacacacccgaguguccaagugccucaagagcauggaauguaugggagguagaagauuauggguucgggguauuuaccaccaauauauggcucaaacucagagaagucuauacacaauugugugaucaucgcuuaaugagugcggcaguuaaagacgagcgagcggugcaugcagauauggguuacuggauagaaagccagaaaaaugguaguuggaaacucgagaaagcgucacuaauagaagugaaaacuuguacauggccgaaaagccauaccuuauggucaaacgguguacuugaaucugauaugauuauuccuaaaucacuagccggacccaucucgcaacauaacuaccggccgggguaucauacacaaacugcaggaccuuggcaucugggaaaacucgaacuagauuuuaauuacugugagggaacuacaguaguaauaacugaaaauugugggacgcgaggacccagcuuacgaacgacaacgguuagcgguaaacuuauucaugaguggugcugucguagcuguacccuuccaccauugagguauaugggagaggauggguguugguauggaauggagauacguccuauuucugaaaaagaagaaaauauggucaaaucguuaguaucggccgggucagguaaagucgacaauuucacaauggguguuuuaugcuuagcaauacuauucgaggaagucaugcgggggaaauucggcaagaaacacaugauagcagggguuuucuuuacauucguauugcuauuaaguggccaaauaacauggcgagauauggcucauacauuaaucaugauagguucaaaugcaagugaccggauggguaugggaguuacauacuuggcacuuauagcaacguuuaagauacaacccuucuuggcacuaggauuuuucuuaagaaaauugacgucaagggaaaaucucuugcuagguguaggauuagcaauggcaacaaccuuacaauuaccggaagacauagaacagauggcaaacgguauagccuugggauugauggcucuaaaacuaauaacgcaauuugaaacguaucaauuguggacugcguuaauaagucuuacaugcucuaacacaaucuuuacacuaacaguugccuggagaacagccacguuaauucuugcaggggugagccucuuaccaguaugccagucguccagcaugagaaaaacugauuggcuaccaaugaccguggcagcuaugggaguuccaccucuuccucuauucauauuuagcuuaaaagacacccuaaaacgaaggucauggccacugaacgaaggcguaauggcagugggcuuaguaaguauauuagcgaguaguuugcuaagaaacgacguaccaauggcagggccauuagucgccgguggacuucuaauagcaugcuaugucauaacugguaccucagcugacuugacggucgagaaagcggccgauguuacgugggaagaggaagcugaacaaacaggaguaagccacaauuuaaugauuacgguagaugaugauggaaccaugaggauaaaagaugacgaaacugaaaacauauuaacaguucuacuuaagacggcacuacuaauuguaucgggcauuuucccauacucaauaccugcuacacuccuuguauggcauacauggcaaaagcaaacacagcgaucaggagugcugugggaugucccauccccuccggaaacucaaaaagcugaguuagaagaaggcguauauaggaucaaacaacaggggauuuuuggaaaaacacaagugggggugggaguacagaaggaaggaguguuccauacuauguggcaugucaccaggggagcuguuuuaaccuauaacggcaaacgacucgaaccaaauugggcuagcgugaagaaagaccuaauaucauauggagggggauggcgcuugagcgcucaauggcaaaaaggagaagaaguccaagugauagcuguggagcccgguaagaauccuaaaaauuuucaaacaaugcccggaacauuucagacaacgacgggcgaaauuggugcaauagcguuagacuuuaaaccagguacaaguggcagcccaauuauaaacagagaagggaaaguaguaggguuauacgggaacggcguaguuaccaaaaauggaggauacguuucaggcauugcccagacaaacgcggagccagaugguccuacaccagagcuggaagaagaaauguucaagaaaagaaauuuaaccauuauggaccuccauccugggaguggaaagaccagaaaguauuugcccgcaauagugagggaagccauuaaaagaagacuacgaacucuaauucucgcaccgacacgcguaguggcugcagagauggaagaagcccuaaaaggguugcccauaagauaucagacaacggcaacgaaaagcgaacauacaggucgagagaucgucgacuuaaugugccaugcgacauucaccaugcguuuauuauccccugugcgcguaccuaacuauaacuuaauaaucauggacgaagcgcacuuuacggauccugcaucaauugccgcucgcgguuacauaagcacaagagucgguaugggagaggcggcugcuaucuuuaugacugcaacaccgccagguacagcagaugcuuucccucagucuaacgcucccauacaggacgaagagagggacauuccagaacgaucauggaacucagguaacgaauggaucacugacuuugccgggaaaacagugugguucgucccuagcauuaaagcaggcaaugacauagcaaauugccuaaggaaaaacggcaagaaaguuauucagcuauccagaaagacauucgauaccgaauaucagaaaacgaaacuuaaugauugggauuucguaguuacuacugacauauccgaaaugggggcaaauuucaaagcagauagagucauugaucccaggcguugccuuaagccggugauuuugacggacggaccagaaagaguaauucuugcugggccaaugccaguaacagcugcuuccgcugcgcaaaggagaggaaggguagggcgaaacccacaaaaagaaaaugaucaauauauauucacuggacaaccucuaaauaacgacgaagaucacgcucacuggacagaagcuaaaaugcuccuugacaacauuaauacuccagaaggaauaauaccagcucuuuuugagccugaaagagaaaaaucagccgccauagacggggaauacagacuuaaaggugaaaguagaaaaacauuuguggaacuaaugagacguggagaucuuccaguauggcuggcucauaaagucgcaagcgaaggaaucaaauacacggacagaaaauggugcuuugauggucagcgcaauaaucaaauauuggaggaaaacauggaugucgaaaucuggacaaaagagggagagaagaagaaacuacgcccaagauggcuggacgcacgaacuuauagcgauccacuagcacuaaaagaauuuaaagacuuugccgcaggcaggaaauccauagcacuagaucuaguaacagagauagggcguguacccucacacuuagcucacagaacaagaaaugcuuuggauaaccuaguuauguugcauaccucugaacaugguggacgggcauacaggcaugcaguagaagaacuaccugaaacuauggaaacacucuugcucuuagggcuaaugauuuuacuuaccgguggcgcuaugcuauuucuaaucucuggaaaaggaauuggaaaaacgucuauugguuuaauauguguaauugcauccuccgguaugcuauggauggcagaaauuccacuucaauggauagcaucagcaauagugcucgaguucuuuaugaugguacuuuugauuccugaacccgagaaacaaaggacaccucaggauaaccaacuagccuauguagucauaggcauacuaacacuagccgccaucauugcugcaaaugaaaugggguuacucgaaacuacuaagcgagauuuaggcaugucuaaagaaccaggaguaguaucaccuacgagcuaucuugauguagaccuacauccggcuucggcuuggacccuauacgcgguugccaccacaguaauaacuccaaugcuaagacauacgauagaaaacuccacagccaauguaucauuagcggcaauagcaaaucaagcuguuguacuaaugggauuggacaaaggcuggccgauaucaaagauggaccuagguguaccauuacuagccuuggguugcuacucacaagucaauccauugacguuaacggcagcuguucuucugcucauuacccauuaugcuauaaucggaccuggacugcaagcaaaggcaaccagagaagcucagaaaagaaccgcagcgggaauuaugaaaaauccuacaguugaugguauaaugacaauagacuuagauccaguuauauaugacucaaaguucgaaaaacagcuaggacaaguaauguugcucguucugugcgcuguccaacucuuacuaaugcggacuagcugggcauuaugugaggcacugaccuuggcuacagguccgauaacaacguuaugggaaggaucaccgggaaaauucuggaacacgacuauagcagucagcauggcaaauauauuucgaggcucguaccucgcuggcgccggacuugcauuuucaauuaugaaaagcguaggcacaggaaagaggggcacugguucacagggcgaaacacugggagaaaaauggaagaagaaacuaaaucaacuaagccgaaaagaguucgaccuauacaagaaaucaggcaucacagaaguugacaggacagaagcuaaggagggacuuaagagaggagagauaacacaucaugcgguuagucgaggaucugcuaaacuucaaugguuuguggagagaaauaugguaauaccagagggucgcguaauugauuugggaugugggcgaggaggauggucauacuauugcgccggauugaagaaagugacagaagugagaggauacacaaaagguggaccuggacaugaagaaccgguaccaaugagcaccuauggauggaacauuguaaaauugaugucaggaaaagaugucuucuaucuaccuccagaaaagugcgacacauuacucugcgacauaggagagucaucgccuagcccaaccguagaagaaucaagaacaauuagagucuuaaaaaugguagaacccugguugaaaaauaaccaguuuugcaucaaaguuuuaaacccuuauaugccuacuguaaucgagcaucuagaacgcuuacagagaaaacacgguggaauguuaguuaggaacccauuaaguagaaauagcacucacgaaauguacuggauaagcaauggcacgggaaauauaguagcaagcgugaauauggucucaagauuacugcugaacagguucacaaugacacacaggcgaccaacuauagagaaagauguugauuuaggcgccggaacucgacaugugaacgccgaaccagaaacuccuaauauggacguaauuggagagaggauaaaacgaauaaaagaagaacauaauuccacauggcauuacgaugacgaaaauccuuacaaaacaugggcauaucauggaucuuacgaaguaaaggcuacagggagcgcgaguagcaugauaaaugguguuguaaaauuauuaaccaaacccugggacguuguccccauggucacucaaauggccaugacggauacaacaccguucggacaacagcggguauucaaagaaaaagucgauacucgaacgccaaggaguaugcccgggacgcggagaguuauggguauaaccgcagaauggcuuuggcguaccuuagggcggaauaaaaagcccaggcucuguacacgugaagaguuuacaaagaaaguaagaaccaaugcagccaugggcgccguuuuuaccgaagagaaccagugggauagcgccaaagcugccgucgaagacgaggauuuuuggauauuaguagauagggagagagaauuacacaaguuagguaaaugugggagcuguguauacaacaugauggguaaacgagagaagaaacuuggagaauuuggaaaagcgaaaggaucaagagcuauaugguauauguggcuuggagcacgauaucuggaauuugaggcucugggcuuucuuaacgaggaucauugguucucacgagaaaacuccuauucuggaguagaaggugaggguuuacauaaacugggauacauauuacgagacauaagcaagauaccaggaggggcaauguaugccgacgacacugcaggaugggacacaaggaucacagaagacgacuugcauaaugaagaaaagaucacucaacaaauggaccccgaacaucgucagcuggcuagugcaauuuuuaaacuuacauaucagaacaaaguuguuaaaguucaaagaccgacgccuacagggacugucauggacauaauuucaagaaaggaucaaagaggaucaggucaaguuggaacuuauggacuaaauacguucacaaacauggaggcgcaauuaauuaggcaaauggaaggcgagggaguauuaaguaaagcggacuuggaaaauccacaucugccagagaagaaaauaacacagugguuagaaacaaaaggaguugagagacuaaaacggauggcuaucaguggagaugauugcguaguaaaaccuauagaugacagguuugcgaaugcuuuauuagcgcugaaugacauggguaaaguacgcaaggacauuccacaguggcaaccuucaaaaggauggcaugacuggcaacaagucccauuuuguagucaucauuuucacgaguugaucaugaaagauggacguaagcuaguuguaccgugucguccacaggacgaguuaauaggucgggcuaggauuagucagggcgccggguggucuuuaagggaaacggcgugucuagguaaagcguaugcacagauguggaguuuaauguauuuccaucgccgugacuugcgacuagcuuccaacgcaauauguagcgcugucccaguacauugggucccaacgucuagaacuacguggaguauccaugcacaccaccaauggaugacuacugaagacaugcugacaguauggaacagaguauggauagaagauaaucccuggauggaggacaagacgccaguuacgacaugggaaaacguaccuuacuuagggaaaagggaagaucagugguguggcucucuaauuggccuaaccucgcgcgcaacgugggcacaaaauauacccacugcuauacagcagguucggucgcucauagguaacgaggaauuucucgacuauaugccgaguaugaaaagauuuagaaaagaagaagaaagugaaggagcuauuugguaa

SEQ ID NO: 23338 - RNA, 9873 nt, Artificial Sequence
  derived and/or modified CDS sequence (opt6) from DENV-3__FJ373302__SS-prME
acguccuuaugcuuaaugaugauauugccugcugcgcuagcauuucacuuaacuucccgagauggggaaccaagaaugaucguaggcaaaaaugaaaggggaaaaucgcuacuauuuaaaacugcaucaggaauaaacaugugcacacuuauugcaauggaccuaggagaaaugugcgaugacacugucacuuauaaaugcccucauauagcagaaguagaaccggaagacauagacuguugguguaacuugacaagcacauggguuacguaugggacuugcaaucaagcuggugaacauagaagagacaaacguagcgucgcuuuagcuccacauguugggaugggacuugauacaagaacgcaaaccuggaugagcgccgaaggagcauggcgucagguugaaaaaguggagaccugggcauuacgucauccugguuucacuauucucgcucuuuuucuugcacauuacaucggaacaagccuaacacaaaaagucgugauauucauauuacuaaugcuaguaacuccuaguaugacaaugagauguguuggggucggcaaccgagacuuuguggagggacuaucaggagcaacauggguagacguuguacuagaacauggugguuguguuaccacgauggccaaaaauaaaccaacacuugauauagagcuucagaaaacagaagcgacucaacuagcuacacuccgaaaacucuguauagaaggaaaaauuacuaacauuaccacagauagccgcugcccaacccaaggcgaagcaguguugccugaagaacaagaucaaaauuacguuugcaaacacacauauguagaucgcggcuggggaaauggauguggauuauuuggaaaagguagucucgucacgugcgcaaaauuccaaugccuugagccgauagaaggaaaaguaguacaauacgaaaauuuaaaauacacuguaauaauaacaguacacacuggagaucaacaucaaguuggcaacgaaacgcaagguguaacugcagaaaucacaccccaagcaucaacaacagaggcaauauuacccgaauacggcacccuuggcuuggaauguaguccaaggaccggauuagauuucaacgaaaugauacuacuaaccaugaagaauaaggcauggaugguacaucggcaaugguucuuugauuuaccauugccauggacaucaggcgcaacaacugaaaccccgacuuggaaucgaaaagaacugcuaguuaccuucaaaaaugcacacgccaagaaacaggaaguaguuguacugggaucacaagaaggugccaugcacacugcauuaacaggagcaaccgagauucaaaauucugggggaacaucaauauucgcaggccaccucaagugucguuuaaaaauggacaaacuugaguuaaaagguaugucauacgcuaugugcaccaacacuuuuguauuaaagaaagaagugucugaaacgcaacaugguacaauauuaauuaaaguugaauacaagggugaagaugcgccuuguaaaaucccuuucaguacagaagacggacaaggaaaagcacacaacggacguuugaucacagccaaccccgucgucacuaagaaagaggagccgguaaacauugaagcagagccuccuuucggcgaaucaaauauuguaaucgguauaggcgauaaugcauugaaaaucaacugguacaagaaggguucuagcauugguaagauguuugaagcuacagcaaggggagcacgcagaauggcuauacuaggggauacggccugggacuuuggaaguguagguggaguauuaaacucccuugguaaaaugguacaucagaucuucggcagugcauauacugccuuauuuucaggagucagcuggguaaugaagauaggcauaggagugcuacucacuuggauagggcugaauaguaaaaacacguccaugaguuuuucuugcauugcuauugguauaauaacguuauacuuaggagcugucguucaggcggacaccggaugugucauaaacuggaaaggcaaagagcuaaaauguggauccggaauauucguuacaaaugaaguucauacuuggacugaacaauauaaguuccaagcggacucaccuaaacgccucgcaacagcgauugccggagcaugggaaaaugguguaugugguauuaggucaacgacacgaauggaaaaccugcuauggaaacaaauugccaacgaauuaaacuacauucuuugggagaacaauauaaaauuaaccguuguggugggugauaucauaggcguacuagaacaagguaaaagaacuuuaaccccacagccuauggaacuuaaauauucguggaaaacauggggaaaagcuaaaauuguuacggcagaaacucagaacagcucauuuaucauagauggaccuaauacuccagaguguccgucagcaucacgagccuggaacgucugggaaguugaagauuauggauucggcguguuuaccacuaauaucugguugaagcuaagagaggcuuacacgcagcuuugugaccacagauuaaugucugcugcugugaaggacgaacgcgcaguucaugcggauauggguuacuggauugaaucacagaagaaaggcucauggaaauuagaaaaggcuagcuuaaucgagguaaaaacguguacauggccgaaaagccacacuuuguggucuaaugguguacuugaguccgauaugauuauacccaagagcuuagccggccccauaucacagcauaauuaucgccccggauaucauacacaaacugcugguccuuggcaccuuggcaaauuggaauuagauuucaauuauugugaggggacaacaguagugaucacagaaaacugcggaacucguggacccagucuacggacuacaacaguuucugggaaacuaauucaugaauggugcuguagaucauguacauuaccaccuuuacgauauaugggagaagauggcugcugguacggcauggaaauacgcccuaucucagaaaaagaagagaacaugguaaagagcuuggugagugcgggauccgguaaagucgacaacuuuacaaugggugugcuuugucuagcgauucuuuucgaagaagucaugagaggaaaauuuggcaagaaacauaugauagcagggguauucuuuacauuuguauuauuacuaaguggacaaauaaccuggcgagacauggcacauacguuaauuaugauaggcaguaaugcaucugaucguauggguaugggcguuacguacuuggcuuuaaucgcuacauucaaaauucaaccauuucucgcauuaggcuucuuucugcgaaaauugaccagcagagaaaaccuuuuauuggggguaggacuagcuauggccacuacauuacaacuuccagaagacauagagcaaauggcgaaugguauagcauuaggucucauggccuuaaagcuaauaacgcaauucgaaacauaucaguuguggacugcauuaauaagccuaacaugcucaaacacuauauuuacuuuaaccguagcuuggagaacugcgacacuuauucuagcgggaguuagucuccuuccugugugucagaguucuaguaugaggaagucggacuggcuaccuaugacuguugccgccaugggcguuccuccauuaccguuauucauauuuucacuuaaagauacuuuaaaaagacgaaguuggccgcuaaacgaaggagucauggcaguaggauugguuuccauauuggcaucaucguugcuaagaaacgacguaccgauggccggcccucugguugcaggaggcuuauugauagcauguuauguaauuaccgggacuucagccgaucuuacaguugaaaaagcugcugauguaacgugggaagaagaagccgaacaaacagguguaagccacaaccucaugauaacuguagacgaugacgguaccaugcgcauaaaagacgaugaaacugagaauauauuaacagugcuauuaaaaacagcacuucuaauuguaucagggauuuuucccuauucaauucccgcaacguuacucguauggcauacauggcaaaagcaaacacgucgaucagggguacuaugggacguuccuucaccaccagagacccaaaaagcggaacuugaggagggaguguaucguauaaaacaacaagguaucuuuggaaaaacgcaaguagggguuggaguccaaaaagagggaguuuuccacacaauguggcaugucacaagaggagcaguccuaacauacaaugguaagagacuagaaccaaacugggcaagugugaaaaaggaccugauaucauauggagguggcuggcgccucagcgcgcaauggcaaaaaggagaagaaguacaaguaauagcaguagaaccagguaaaaacccgaaaaauuuucaaacaaugccuggaacguuccaaacuacgacgggugaaauaggagccauugcgcuagauuuuaaaccgggaacaagugguaguccgauuauaaaccgagaaggaaaaguggucggucuguacgguaauggaguugugacuaaaaauggagguuacguaagcgguauagcgcaaacuaacgcggagccagaugguccuacuccagaacuugaggaggaaauguuuaagaaaagaaaucuaaccauaauggaucugcacccaggaucugggaaaacccgaaaguaccuaccggcaauaguaagagaagcaauuaaacguagacuaaggacauuaauacuugcaccaacaagaguaguggccgcugaaauggaggaagcccuaaagggguuaccaaucagauaccagacuacggccacaaagucugaacacacaggacgagaaauuguagaucuuaugugccaugcaacauuuacaaugagacuacucucuccuguuaggguaccaaacuauaaccuuauuauaauggacgaagcacauuuuaccgauccagcguccauagcagcccgaggcuauaucagcacaagaguagguaugggagaagcggcagcgauauucaugacugcuacuccgccaggaacggcggaugcguucccccaaucaaaugcaccaauccaggacgaagaacgggauauuccagaacgaucauggaacucgggaaaugaauggaucacagacuucgcgggaaaaacuguaugguuuguuccuucuauaaaagccggaaacgacaucgcaaauugucuaagaaagaaugguaaaaaggugauacaacuuagcagaaaaacuuuugacacugaauaccaaaagacuaaauuaaaugacugggauuuugucguaacuacugauaucuccgaaaugggggccaauuucaaagcugaccguguaauagauccgaggagaugccucaaacccguaaucuugacagauggaccagaacgaguaauacuagcgggaccuaugccggugacggcugccucggcagcucaaaggcgaggacgaguaggccguaacccccaaaaagaaaacgaccaauacauauuuacuggucaaccgcucaacaaugaugaagaccacgcacauuggaccgaagcgaaaauguuauuggauaauauuaauacaccagaaggaauaaucccugcucuauuugaaccugagagagagaaaagcgcugccauagauggggaauauagacugaagggagaaucucguaaaacuuucguagaauuaaugagacggggagacuuacccguuuggcucgcacauaaagucgcuucagaaggcauaaaauauacugauagaaagugguguuuugacggccaaagaaacaaccaaauauuagaagaaaauauggauguugaaaucuggaccaaggagggagagaaaaagaaacucagaccaagauggcuugaugcccgaacuuauagugacccauuagcacuaaaagaauuuaaagacuuugcugccggacgaaaaucaaucgcacuugaccuuguaacugaaaucggcagaguaccaucacaucuagcgcaccgcaccagaaaugcacucgauaaucuaguuaugcuacacacguccgaacauggaggaaaagcauaucgucaugccguugaagaacuaccagaaacgauggagacacucuuacucuuaggccucaugaucuugcuuacaggaggcgccauguuauuuuuaauaucaggcaaaggaauaggaaaaacgaguauugguuuaaucugugucauagcuucgucgggcaugcuauggauggccgagaucccacuccaauggaucgcaucagccauaguauuagaguucuuuaugauggugcuacuaauaccggaaccggaaaaacaacguaccccgcaagauaaucaacuggcuuauguuguuaucggcauccucacgcuugcugcaauaaucgcugcaaaugaaaugggacuccucgaaaccacuaaaagagauuuaggcauguccaaagaaccaggggucguaagucccacaaguuacuuagacguagaccugcauccagcaagugcuuggacucuguaugcggucgcuacaacaguaauaacaccaaugcuaagacauacaauagaaaacucaacugcgaauguaagccuagcggccauagcuaaccaagccgugguuuuaaugggucuugauaaaggauggccaauaaguaaaauggaucugggcguuccucuguuagcccuuggaugcuacagucaaguuaacccccucacacuaacugcugcagugcuacucuugauuacccauuaugcaaucauugguccgggacuccaagcaaaagcuacaagagaagcacagaaaaggacagcagcugggauaaugaaaaauccuacgguagauggaauuaugaccauagauuuagaccccguaauauaugauagcaaguuugaaaaacaauuaggacaggucaugcuauuaguucuuugugcuguacaauuacuuuuaaugagaacaaguugggcuuugugcgaagccuugacuuuagcuacaggucccaucacgacauuaugggaaggaaguccaggaaaauucuggaauacaacaaucgccguguccauggcuaauauauuuaggggauccuauuuggcuggcgccgguuuagcauuuaguaucaugaagaguguagggacaggaaagaggggcaccgguucuaaaggggagacacuaggugaaaaguggaaaaagaaauuaaaucaauugucgaggaaagaauuugaucuuuacaagaaaucaggaauuacagaaguagauagaacagaagccaaagaaggacuaaaaagaggugaaauaacgcaccacgccguaaguagaggcucagcgaaacuucaaugguuuguugaaagaaacaugguuauaccggaagggcgugugaucgaucuaggcuguggucgugggggaugguccuacuacugcgcggggcucaagaaagugacugaaguacgaggauauacaaaaggaggcccgggacacgaagaaccagucccaaugucuaccuacgguuggaauaucgugaaguuaaugucaggaaaagaugucuucuauuugcccccugaaaagugcgauacauuacuaugugacaucggugaaaguucaccuagcccuacaguagaagagucucgaaccauacgaguuuuaaaaauggucgaaccuuggcugaaaaauaaccaauuuuguauuaaaguacuaaaucccuacaugccaacgguuauagaacauuuagagcgucuucaacguaaacauggagggauguuaguuagaaacccguugucuagaaauucgacccaugagauguauuggauuucuaauggcaccgggaacauaguagcuucuguaaauauggugucaagauuguuacuuaauagguucacaaugacccauagacgaccaacuauugaaaaagaugucgacuuaggagccggaacacgacaugucaaugcagagcccgaaacaccuaacauggauguuauaggcgagcgcaucaaacguauaaaagaagaacauaauucuaccuggcacuaugacgaugaaaauccuuauaaaacaugggcauaucacggcagcuaugaggugaaggcuacagguagcgcuaguaguaugaucaauggcguaguaaaauuacuaacaaagccaugggauguugugccgauggugacucaaauggcaaugacagauacaacucccuucggccaacagcgcguauucaaagaaaaaguagacacacgaacuccucgcucaaugccagguacccgccgagucaugggaaucacagcggaauggcuauggcggacuuugggaaggaauaagaaaccgagauuauguacaagagaagaguuuacuaagaaagugagaacuaaugcugcaaugggagcuguauuuacagaagaaaaccaaugggauagcgcaaaggcugccguagaagaugaagacuuuuggaaauugguugauagggaacgugaauuacauaaguuagguaaauguggaagcuguguuuauaacaugaugggaaaaagagagaagaaauugggagaauuuggaaaagcgaaaggcaguagagcaaucugguauaugugguuaggagcuagguaucuagaauuugaagcauuaggcuuccuuaaugaggaucauugguucucacgagaaaauucauacagcgggguagaaggugaggguuuacacaaacuuggauauauucuaagggacauaagcaaaauuccagggggagcaauguacgcagaugacacagcagggugggauacgcggauaacggaagacgauuuacacaaugaggagaaaauuacacaacagauggaucccgaacaccgccaauuagcuaaugccaucuuuaaauugaccuaccaaaacaaggucgugaaaguccaacggccgacaccuacagggaccgucauggacauaauuucgcgaaaggaucagagaggaagugggcaagucggcacauauggauuaaauaccuuuacaaauauggaagcacaauuaauucgucaaauggaaggagaaggaguacugucuaaagcagaucuggaaaauccccaucuaucugagaagaaaaucacgcaaugguuagaaaccaaaggaguagagcgccucaaacgaauggcgauaucgggggaugacugugugguuaaaccaauagaugauagauuugcaaaugcacuucuagcauugaacgauauggggaaaguacguaaagauauaccccaguggcaaccuucaaaaggguggcacgacuggcagcaaguaccguucugcagccaucacuuccaugaacucauuaugaaagacgggaggaaauuagugguuccgugcagaccucaggaugaacuuauagguagagcucggauaucucaaggagccggauggucguuaagagagacugccuguuuaggaaaagcguaugcccaaauguggucacuaauguacuuccauagacgggaccucagguuggcaaguaaugcuauuuguagcgccguaccaguacauuggguaccaacuucccgaacaacuuggucuauacaugcgcaucaucaauggaugaccaccgaagauauguuaacgguuuggaaccggguguggauagaagacaacccuuggauggaggacaaaaccccaguaacaaccugggaaaaugugcccuaccugggaaaacgagaggaucaauggugugguagccucauuggguuaacauccagagccacaugggcccaaaauaucccaaccgccauacaacaaguccguucauugaucgggaacgaagaauuuuuggacuauaugccuagcaugaaaagauucagaaaagaagaggagagugaaggcgcuauaugguaa

SEQ ID NO: 23339 - RNA, 9873 nt, Artificial Sequence
  derived and/or modified CDS sequence (opt6) from DENV-3__FJ182007__SS-prME
acgaguuugugccuaaugaugaucuuaccagcagcuuuggccuuccaucuaacuucaagagauggggaacccagaaugauaguuggcaaaaacgaacgagguaaaagccuacucuuuaaaacugccucugguauuaauaugugcacacuaaucgcuauggaucuaggagaaaugugugaugauaccguaacuuacaaaugcccacauauugcggaaguagaacccgaagauauagauugcugguguaauuugacaaguaccugggugacauauggaacguguaaucaagcuggagaacaccgacgagacaaaagaucuguagcccuagcgccacauguaggaauggggcuggacacuagaacccaaaccuggaugagcgcugaaggugcauggaggcaaguugaaaaagucgaaacuugggcuuugcgucauccaggguucacaauacuugcuuuauuuuuagcacauuacauagggacaaguuuaacacaaaaagucguaauuuuuauauuguuaauguuagucacaccaucaaugacgaugcgcugcgugggugucggcaacagggauuuuguagaaggucugucuggagcaacuuggguagauguuguacucgaacacggggguugcguaacaacaauggccaaaaacaaaccgacauuagauauagaauuacagaaaaccgaagcaacacaauuagccacacuaagaaaacuauguauugaagguaaaauuacaaauauaacaacagacagucgaugcccaacacagggcgaagcuguauuaccagaagaacaagaucaaaacuacguuugcaaacauacauauguagauagagguuggggcaauggaugugguuuguuuggcaaaggaagccuagucaccugugccaaauuucaaugccuagaaccuauagaggguaaaguaguccaauacgagaauuuaaaauacacagugauuauuacaguucauacaggggaccaacaucaagugggaaacgagacucaaggcgugaccgcagaaauaacgccacaggcuucaacgacggaagcgauucuaccagaauacggaacccugggacuggaauguucccccaggacuggguuagacuucaaugaaaugauccuauuaacaaugaaaaauaaagcauggaugguucaucgacaaugguucuuugauuuaccacuucccuggacuucuggggcuacaacugagaccccuacauggaaucgaaaagaauuauuagugacguucaaaaaugcccacgcuaagaaacaagaaguuguuguccuaggaagucaagaaggugcuaugcauacugcucuaacaggugcgacggaaauacaaaauucuggcgguacauccauuuuugccgggcaccuaaaaugcagguuaaaaauggauaaauuagaacucaaaggaaugucuuacgcuauguguacaaacaccuuugugcuaaagaaagaagucucagaaacucagcaugguacuaucuugaucaaaguggaauacaaaggugaagaugcuccaugcaaaauaccuuucaguacugaagaugggcaaggaaaggcccauaacggacgcuugauaacugccaauccaguagucacaaagaaagaagaaccagugaacauugaagccgagccuccuuucggcgaaucuaacauaguaauaggaacgggugauaaugcacuaaaaauuaauugguauaagaaagggucgagcaucgguaaaauguucgaagcaaccgcccgaggggccagaagaauggccauacucggugauaccgcgugggacuucggcaguguaggcgguguauuaaacucauugggaaaaaugguacaccagauauucgguagcgcuuacacugcguuauucaguggcgugaguuggguaaugaagauugggauuggaguacuauuaacuuggauuggucugaacuccaaaaacaccucaaugagcuucucaugcaucgcaauugggauuaucacucucuaccuuggcgccgugguacaagccgauacuggauguguaauaaacuggaaagggaaagaacucaaaugcggauccggcauuuucgucacgaacgaaguucauacuuggacugagcaauauaaguuucaagcagauucaccgaagcggcuagccaccgccauagcgggagcgugggagaacgguguaugugguauacguagcacgaccagaauggagaacuuguuguggaaacaaauagcaaaugaacuuaauuacauccucugggagaacaauauaaagcuaacaguuguaguaggggacauaauaggcguuuuagaacaaggaaaaaggacacuuaccccucagccaauggaacuuaaauauagcuggaaaacaugggggaaagcgaaaaucguuacggccgaaacgcaaaacaguucguucauaauugacgggccuaauacaccugaaugucccucagcaucgagagcauggaacgugugggagguagaagauuacggauuuggcguguucacaacaaauauuuggcuaaaauuacgugaaguauauacacaauugugugaucaucgauugaugucagcugcagucaaagaugaacgagcaguucaugcagauaugggauauuggaucgaaucgcagaaaaacggaucauggaaacuagaaaaggcuucguugauagaaguaaagacuuguacguggccgaaaucgcacacauuguggucaaacggcguacuugaaucagauaugaucauaccaaaaucauuggcaggaccgauuagucagcauaauuacagacccggcuaucacacucagaccgcaggaccguggcacuugggcaaguuagaauuagacuuuaacuauugcgaagguacaacagucgugaucacggaagauugcggaacaagagguccuucucugagaacaacuacuguaucaggaaaacuuauucacgaguggugcugucgauccugcacauuacccccucugagauauaugggagaggacgguugcugguauggaauggagauacgacccauaagugagaaggaagaaaacauggucaaaucacugguaagugcuggaucuggaaagguagauaacuucaccaugggaguccuaugccucgcuauacuauuugaagagguuaugcgaggaaaauuuggcaagaaacauaugauugcaggcguauucuuuaccuuuguacuucuauugaguggacaaaucacguggagggauauggcgcauacgcuuauaaugauagggagcaaugcuagcgacagaaugggaaugggagugacuuauuuagcauuaauugcuaccuuuaaaauucaaccguuucuggcuuugggguuuuuccucagaaaguuaacaucacgcgaaaauuuacuccucggagucggacuagccauggcgacuaccuuacaguuaccagaagauauagaacaaauggcuaacggcauugcacuuggauugauggcuuuaaaguugaucacccaauucgaaacuuaucaguuauggaccgccuugauaagucuaacauguucaaacacaauuuuuacgcucacgguagcuuggagaacagccacauugauauuagccgguguaagccuucuaccugugugucaaaguaguucaaugcguaagucugauuggcuucccaugaccguagcagcaaugggugucccgccccucccucuauuuaucuuuagucucaaagacacucuaaagcggaggucguggccuuugaaugaaggaguaauggcaguuggacucguaucaauccucgcaaguagccuccuaaggaacgauguuccaauggcaggaccgcuuguagcaggaggucucuuaauugcaugcuacguaaucacaggaaccagcgcagaucucacaguagagaaagcagcagaugucacuugggaagaagaagcugaacaaaccggugucucucauaauuugaugaucacugucgacgacgaugguaccaugaggaucaaagacgaugaaacagaaaauauccuuacaguucugcucaaaacagcguuacugauaguaagugguauauuccccuacaguauuccagcaacauuauugguguggcauacauggcaaaagcagacgcgcagguccggaguauuaugggaugucccuagcccgcccgagacacagaaagcggaauuggaggagggcguguauaggaucaaacaacaagguaucuucggcaaaacccagguuggaguugggguacaaaaggaaggaguuuuucauacgauguggcauguaacacgaggugccguuuuaacauacaauggaaagcgauuagagccaaacugggcaucggucaagaaagauuugauaucuuauggagggggauggaggcuaucagcacaguggcagaaaggagaagaaguacaagugauugcgguagaaccagggaaaaauccuaaaaauuuccaaacuaugccagggaccuuucaaacaacaacgggagagauaggggcaauugcacuggauuuuaaaccgggaacaucaggcucaccaauaauuaauagagagggcaagguugugggacucuauggaaacgguguuguaaccaaaaauggcggguacguaucagguauagcucagaccaaugcagagccagaugguccuaccccggaacuagaagaagaaauguucaagaaacguaauuuaaccauaauggauuuacaucccgggagugguaaaacucguaaauaccuaccugcaauaguaagagaagcuaucaaaagaagauuacgaacgcucauuuuggcacccacaaggguuguggcagcagaaauggaagaggcuuuaaagggauuaccaaucagauaucagacaaccgcuacaaaaucugaacauacgggcagagagaucguagauuuaaugugccaugccacguuuacuaugcguuuacuuucaccaguacgcgugcccaauuacaaccugauuauuauggaugaagcgcacuuuacugauccagcuucgauagcagcacgagguuauauaaguacuagggucgguaugggggaagcugcagcgauuuuuaugacagcaacacccccagguacagccgacgcauuuccucaauccaacgcaccgauacaggaugaagaacgugauauaccagaaagaucuuggaauaguggaaaugaauggauaaccgauuuugcagguaaaacuguaugguucguuccaucuauuaaagccggaaaugauauagcaaauugcuugagaaagaacggaaagaagguaauucagcugagccgaaaaacuuuugacacggaauaccagaaaacuaaacuaaaugacugggacuucguggucacaacggacauuucagaaaugggugcaaacuuuaaggccgacagaguaauagacccacgaagguguuuaaaacccgucauucuaacugacgggccagaaagaguaauacuagcuggacccaugccagugacagcagccucggcugcacagaggagagggagaguaggaagaaacccacagaaagaaaaugaccaauacauauuuacuggacaaccucuaaauaaugaugaagaucacgcccauuggacggaagcaaaaaugcuauuggacaacauaaauacaccagaaggcauuauaccugcacuauucgagcccgaaagagaaaaaucagcggcaauagauggagaauaucggcucaaaggcgagucccguaaaacauuuguugaacuaaugaggcgaggagauuugccaguaugguuagcccacaaaguugccagcgaaggcauaaaauauaccgaucgcaaaugguguuuugacggccaacggaauaaccaaauacuugaggagaauauggauguugaaaucuggacuaaagaaggugagaagaagaaacuacgaccaagguggcuagacgcacggacuuauucagauccuuuagccuugaaagaauuuaaagauuucgcugcuggcagaaaauccauagcgcuagaucuggucacggaaaucggaaggguaccaagccacuuggcacaucguacaaggaacgccuuggauaauuuagugauguuacauacaagugaacaugguggaaaggccuaucgacacgccguugaagaacuaccugaaacaauggaaacgcuuuugcuccuugguuuaaugauacuucuaacaggaggcgcaauguuauuucuaauuaguggcaaagggauagggaaaacaucaauaggucuaauaugcguuauugcaucaucgggcauguuguggauagcagagauaccacuucaauggauagcaagugcaaucguucuagaguucuuuaugaugguacuucuaaucccggagccggaaaaacaacguacgccccaagauaaucaauuagccuaugugguaaucgguauauuaacauuagcugcuaucauagcggcuaaugagaugggacuacuggaaacuacaaagagagauuuagguaugucgaaagaaccaggugucguuucgccuacaucguaucuagauguugaucuucauccggccagcgcauggacuuuguaugcaguagcaaccacagugauaacuccaaugcuuagacacacgaucgaaaauucaacagcgaaugucaguuuagcugcgauugcuaaucaagcugucguccucauggguuuagauaaaggauggccuauaagcaagauggauuuaggagugccacuacuagccuugggaugcuauagucaagucaaucccuuaacacuaaccgccgccgugcugcuauugauaacacauuaugcaauaauugguccaggacuacaagcuaaagcuacgagagaagcccagaaacggacagcugcuggcauuaugaaaaauccaacaguagauggaauuaugaccauugaucuggauccaguuauauaugauucgaaguuugagaaacaacuuggacaggugauguuacuuguccuuugugcgguucagcuauugcucaugaggaccagcugggcgcucugcgaagcguuaacuuuggcgacaggaccaauaacaacacuaugggaaggaaguccggguaaauuuuggaauacuacaauugcugucaguauggcgaauauauuucgugguaguuaucuugccggagcuggucuugcauucaguauaaugaaaagcguugguacaggaaaaagaggaacuggaucucagggugaaacuuuaggcgagaaauggaagcguaaacucaaucaauugagcagaaaagaauuugaccuauacaaaaagagcggcaucacugaaguagaucguaccgaagcgaaagaaggucucaaacgaggggagauuacacaucaugcagugucccgagggucagcaaagcugcaaugguucguugaaagaaacauggugauaccugagggucgagucaucgacuuaggcugcggaagaggaggguggagcuacuauugcgcgggucuaaagaagguaaccgagguaagagguuacacgaaaggaggaccgggccacgaggaaccagugccuaugagcacauauggauggaauauuguaaaacuaauguccgggaaagacguuuucuaccuuccgccugaaaaaugcgauacacuauugugugacauuggugagucuagcccaagcccuacaguagaagaaaguagaacaauaaggguauuaaagaugguagaaccuuggcuuaaaaauaaccaauuuuguauuaaaguacuaaacccauauaugccaacaguuauugaacaucuagaacgacuccaaagaaaacauggugggauguuaguccguaauccccugucacgcaacucaacacaugaaauguauuggauuucgaauggaacuggaaacauaguugcuucaguuaauauggugucaagauuacuacucaaccguuuuaccaugacccaucguagaccaacaaucgaaaaagaugucgaucugggcgcaggaacgcgacacguuaacgccgaaccggagacaccaaacauggacguaauuggagagaggauaaaacguauaaaagaagaacacaauucuacguggcauuaugaugaugagaacccauauaaaacuugggcuuaucauggcucauaugaagucaaggcaaccggcucugcgucauccaugauuaauggagugguaaaauuauuaacaaaaccgugggacguuguuccuaugguaacucaaauggccaugaccgauaccacgccguuuggacagcagcgcguauuuaaagagaagguugacacgagaacuccuagaucuaugcccggcacuagaagaguaaugggaauuacagcggaaugguuguggcgaacucuaggcagaaauaagaaaccgcgauuaugcacaagagaggaguuuaccaaaaagguucguacaaaugcggcgaugggggcaguguucacugaagaaaaccaaugggauuccgcaaaggcugcaguugaagaugaggauuuuuggaaguugguagauagagaaagagaacuccacaaauugggcaagugugguucguguguuuauaacaugaugggaaaaagagagaagaaacuuggugaguuugguaaagcaaaaggaucaagagcuauaugguacauguggcugggggcaagauaucuagaauuugaagcauugggauuccuaaaugaagaucacugguuuucgagagaaaauaguuauucuggaguggaaggagaagguuuacauaaacuuggauauaucuugcgagacauauccaaaauuccuggaggggcaauguaugcagaugacacugcaggaugggauacucgaauuacggaagacgaucuucauaaugaagagaaaauaacucaacaaauggauccagaacacagacaacuagccaaugcgaucuucaaacugacauaccaaaauaagguuguaaaaguucaaagaccuacaccaacaggcacaguuauggauauaaucagcaggaaagaucaacgcgguucagggcaagugggaacuuauggacuaaauacuuuuacaaauauggaagcacaguugauuagacagauggaaggggaaggcguucucucaaaagccgaucuagaaaauccucaucuuuccgagaagaaaauaacucaauggcucgaaacuaaggggguugaaagacuuaaaagaauggcuauuucuggcgaugauuguguagucaagccaaucgacgauagauuugcuaaugcauuguuagcucuuaacgacaugggcaaaguaagaaaggauauaccgcaauggcaaccaaguaaaggguggcacgauuggcaacaaguuccuuuuuguucccaccauuuucacgaauuaauuaugaaagacggacggaaacuugucgucccauguaggccacaagacgagcucauaggucgcgcccgaauaucacaaggagcuggguggucguugcgggaaaccgcaugucucggaaaagccuaugcgcaaauguggaguuuaauguauuuccauaggcgagaucuaaggcucgcaucaaaugccauuugcucggcuguccccguccacuggguaccgacaagucgcacuacauggucuauccaugcgcaucaucaauggaugacaacugaagacaugcugacaguuuggaaccgaguauggauagaagacaauccauggauggaggacaaaacgccuguuacaacaugggaaaauguacccuacuuaggaaaaagagaagaccagugguguggaucacuuauaggacuaaccucgagagcuacuugggcgcaaaacauuccaacggccauucagcaaguacguucgcugauagguaaugaagaauuuuuagacuauaugccgucuaugaaacguuuuagaaaagaagaagaaagugaaggugcuauaugguag

SEQ ID NO: 23340 - RNA, 9873 nt, Artificial Sequence
  derived and/or modified CDS sequence (opt6) from DENV-3__FJ182008__SS-prME
acauccuuaugcauaaugaugauccuaccugcugcucucgcauuccaucuaacgucaagagacggagaaccuaggaugaucguuggcaaaaaugaaagagguaaaagccuccuuuucaaaacagcaucagggaucaacauguguacacucauagcaauggaucuaggugaaaugugugaugauacuguaacauauaaaugcccacacauaacagaaguugaaccggaagacaucgacuguuggugcaauuuaacaaguacuugggugacauauggcacauguaaucaggcuggugaacaucggcgagauaaaagaaguguggcccuugcaccgcauguugggauggguuuagacacccggacucaaacauggaugagcgcggaaggagcguggagacaaguugaaaaaguagaaacaugggcccuaagacacccgggguuuacaauacuggcacuguuucuagcacauuauauaggaaccucauuaacacagaaaguugucauuuuuauccuucugaugcucguaacuccauccaugacgaugcgaugcgugggggucggaaacagagauuucgucgaaggacugaguggagcaacuuggguagauguugucuuggaacauggggguuguguuacaacaauggccaaaaacaaaccaacuuuagacauagaacuucagaaaacggaagcuacacaacuugcaacauuacguaaacucugcaucgaagguaaaauaacuaauauaaccacggacucucgauguccgacucaaggagaagcuguucuaccagaagaacaagaucaaaauuacguuugcaaacacacauacguagauaggggaugggguaaugguugugguuuguuugguaaagguagcuuagugacaugugcaaaauuccaaugccucgaaccaauagaaggaaaaguaguucaguaugaaaauuuaaaauauacugugauaauaaccguacacacaggggaucaacaucaagucggcaacgaaacacaaggcgugacugcagaaauaacaccacaagccucuacaaccgaagcaauuuuacccgaauacggcacucuuggauuagaaugcaguccaagaaccggauuagauuucaacgaaaugauauuacuaaccaugaaaaauaaagcauggaugguacauagacagugguucuucgaccuaccucucccauggacaagcggggcuacuacggaaacucccacuuggaauagaaaagaauuauuaguaacuuuuaaaaaugcacaugcaaagaaacaagaaguaguaguacucgggucacaggaaggagcuaugcacacggcacugacgggagcuacagaaauucaaaauaguggugguacuucuauauucgcuggacacuugaaauguagauuaaaaauggacaaauuagaauugaaaggcaugucauaugcgaugugcacuaacacuuuuguucuaaagaaagaaguaucagaaacgcaacacggaacaauacuuauaaaaguugaauacaaaggagaagaugcgccaugcaaaauaccauucagcacggaagauggacagggaaaagcucauaauggcagacucauaacagcaaacccagucguuacgaagaaagaggaacccguaaauauagaagccgaaccuccauucggagagucuaacaucguaauugguauaggagacaacgcauugaaaauuaauugguauaagaaaggcucaucaauuggcaaaauguuugaggcaacagcccgaggagcucguagaauggcaauucuaggcgauacagcuugggauuucgguuccguaggagggguacuaaacucauugggcaaaaugguacaucaaauuuucgguucggcauacacugcacucuuuucaggugucucguggguaaugaaaauaggaauuggagugcucuugacauggauagggcucaauuccaaaaauacaucaauguccuuuaguuguauugcuauaggggugauaacacuguaucuuggcgcgguuguacaagccgacauggguuguguaauaaauuggaaagguaaagagcugaaaugcgguagugguaucuucgucacgaaugaagugcacacguggacugaacaauauaaauuucaagcagauucuccaaaacgacucgccacugcaauagcuggugccugggaaaacggaguuugugguauccgaucaacaacacguauggaaaaucugcuuuggaaacaaauagcaaacgagcuaaacuauauacucugggaaaacaauaucaaauugaccgugguagucggggauaucauuggcguucuagaacaaggaaaacgcacguuaacuccucaaccgauggaacucaaauauucuuggaaaacuuggggcaaagcuaaaauaguaacagcugaaacacaaaauagcucuuucauaauugauggucccaauacaccggaaugcccaucggcuucaagagcauggaacguaugggaaguagaagacuauggcuucgguguguucacaacaaacauuugguuaaaacucagggaaguguauacacaauugugcgaccaccgacuuaugagugcagcuguaaaagacgaaagagcgguacaugcugauaugggcuacuggauagaaucacagaaaaacgggucauggaaacuugagaaggccucccuaauagaaguaaaaacauguacauggccgaaaucgcauacauuguggagcaauggggucuuagaaagcgauaugaucauaccuaaaagucuagcgggaccuauaagccaacauaauuacagaccugguuaccauacucaaaccgcugggccauggcauuuaggcaaauuagaacuggauuuuaacuauugugaaggcacuacaguuguaauuacggaaaauugcggaacuagaggccccucauuaagaacaacaaccgugucgggaaaacuuauacacgaauggugcugccguucaugcacucuaccuccacuaagauacaugggcgaagacggcuguugguacgggauggaaauacgcccuauauccgaaaaggaagaaaauaugguaaaaucccuaguauccgcaggcagugggaagguugacaauuucacaaugggagugcuauguuuagcgauuuuguuugaagaaguaaugagaggaaaauuugguaagaaacacaugauugcgggaguauucuucacuuucguccuccuucuuaguggccaaaucacauggagagacauggcucauacacugauaaugaucggaaguaaugcuucugacaaaaugggaaugggcguuacauaucuagcguuaauugcaacauucaaaauacaaccauuucuagcuuuagguuucuuucuuagaaaacucacgaguagagaaaaccuauuauuaggggugggacuagcaauggccacuacacuacaguugcccgaagacauagagcaaauggcgaaugggauagcauuaggacucauggcuuugaaguugauaacccaguucgaaacauaucaauuauggacugcuuuaauaucucuaacauguaguaacaccauguuuacgcuaacgguugcguggagaacugcaacgcugauauuagccggaguauccuuacugccaguuugucaaucuucaucaaugcgaaaaacugauuggcuaccgauggcaguagcugcaauggggguucccccguuaccacuuuuuaucuuuucgcugaaagacacacuuaaaagaagaaguuggccccucaaugagggcguaauggcugucgggcuuguuucuauacucgcuagcucucuucuccggaaugauguacccauggccggcccauuaguggccgguggucuauugauagcguguuauguuauaacaggaacaagugcugauuugacaguugagaaggcagcagauauuacuugggaagaggaggcugagcaaaccgguguaucucauaauuugaugauaacuguggaugaugacgguacaaugaggauaaaagaugacgaaaccgaaaauauacucacaguauuacuaaaaaccgcgcuguuaauuauaucuggaguuuucccauacucaaucccugcuacauuauuaguuuggcauaccuggcaaaaacaaacacagagaucuggaguauugugggaugugccaucaccucccgaaacacaaaaagcagaauuagaagaagggguauaucgaauuaaacagcaaggaauauucggaaaaacacaaguuggagucggaguccaaaaagaagggguguuucacaccauguggcauguaacaaggggagcaguacuaacauauaacgggaaacgauuagaaccuaauugggccuccguuaagaaagaucuuauaaguuacggcgggggcuggagacuuagcgcccaauggcagaaaggggaagaaguacaaguuauagcggucgaaccaggcaaaaauccuaagaacuuucaaacgaugccggggacauuucaaacuaccacuggggagauuggugcaauugcuuuagauuucaagccaggaacauccggaucaccgaucauaaaucgcgaggggaaaguugucggacuauauggaaauggcguaguaacuaagaauggaggguacguaagcggaauagcccaaacgaacgcagaaccugauggcccgacgccagaacuagaagaagaaauguuuaagaagcgaaacuugaccauaauggauuuacacccagguagcggcaaaacgcgaaaauaucucccugcuaucguacgagaagcaaucaagcguagauuaagaacccuaauuuuagccccuacucgcguuguugcagcugaaauggaagaagcauuaaaaggccuuccaauaagauaccaaacaacugccacaaagucugaacacacuggacgugaaauagucgaccucaugugccaugcgacauuuacuaugcgacugcugucaccuguaagaguuccgaauuauaauuugauaauaauggaugaagcccauuuuacugaccccgcgagcauugcugcgcgaggauauauaucaacccguguagggaugggcgaagcugcagcuauauucaugacugcuacacccccuggaacugccgaugccuuuccucaaucuaacgcuccuauacaagaugaagaaagagacauacccgagagaaguuggaacucugguaacgaauggauuacugauuuugcaggaaaaacugucugguuuguacccagcaucaaggccgggaaugacaucgccaauugccuacguaaaaaugggaagaaaguaauacaacuaucacgaaaaaccuuugauacugaguaucagaaaacaaaacuaaaugauugggacuuuguugugacaacugacauuucagaaaugggugcaaacuucaaggccgauagaguaauagacccaaggagaugucuuaaaccaguuauucugacugacgggcccgaaaggguaauacuagcggggccuaugccuguuaccgcagcaucugcugcacaacggcgcggaagagucggaagaaauccccaaaaggagaaugaccaguauauauuuacaggacaaccacuaaacaacgacgaagaccaugcucacuggacagaagcgaaaauguuacuagacaacauuaauacuccugaaggaauuauucccgcacuuuuugagccugagcgagagaaaagugcugcgaucgacggugaauaucguuuaaaaggagaaaguagaaaaacuuuuguagaacucaugagaagaggggaucucccuguuuggcuugcgcauaaaguggccucugagggaauuaaauauacugaucgaaaaugguguuuugaugggcaacguaauaaucagauauuagaagaaaauauggaugucgaaauauggacaaaagaaggcgagaagaagaaacugagaccccggugguuagaugcgcguacguauucagauccguuagcacuaaaagaauuuaaagauuuugcggcuggaagaaaaucaaucgccuuggacuuagugaccgagauaggacgaguaccaagucaccuggcacaucggacaaggaaugcucuagauaauuuaguaauguugcauacaagcgagcauggcggccgagccuaccgucaugcaguagaagaacuaccugaaacaauggaaacauuauuacuacuaggucucaugauucuuuuaacuggaggugcgauguuauucuugauuuccggcaaaggcauaggaaaaacgucuauuggcuuaauaugcgucauagccaguucuggaauguuguggauggcagaaauuccacuacaauggauagcaagugccauaguuuuagaguucuuuaugaugguacuucuaauaccugaaccugagaaacaaaggaccccacaagacaaucaauuggcguauguagugaucggaauuuuaacauuagcagcuauaauagccgcuaacgagaugggguuacuagagacaacuaaacgugacuuagguaugucaaaggaaccaggaguaguaucaccgaccagcuaccuagacgucgauuuacacccggcaucggcuuggaccuuguacgcaguggcgacgacuguaauaaccccaaugcugcgccacacaauagaaaacuccacagccaacgucucguuagcggcaauagcaaaucaagcgguuguccugaugggauuagacaaagguuggccgaucucaaaaauggaucuaggcgucccacuacuugccuuaggaugcuacagccagguaaauccguuaacacugacagcagcaguuuuacuacugaucacacauuacgcgauuauagggccuggccuccaagcuaaggcuacaagggaagcacaaaagcgcaccgcugccggaauaaugaaaaauccuacaguugacgggaucaugacuauagacuuagaucccgucauuuaugacucuaaauuugaaaaacaauugggacaagugaugcucuuaguguuaugugcuguacaacugcuacuuaugcggacaagcugggcauugugugaggccuuaacccuagcaacagggccaauuaccacacuaugggaagguagucccgguaaauucuggaauacuacuauugcugugagcauggcaaauauauucagagguagcuauuuagcuggcgcgggccuugcauuuaguauaaugaaaaguguagguaccgguaaaagagguacgggaucccaaggggaaacauuaggagaaaaguggaagaagaaauuaaaucaauuaagccggaaagaauuugaccuuuauaaaaagucggggauaacggaagucgauagaaccgaagcaaaagaaggucucaaacgaggugaaacaacacaucaugccguuuccagaggaacugcuaaacuccaaugguuuguagaaagaaacaugguaauuccagaaggacggguaauugaucugggguguggucgagguggauggaguuauuacugcgccggacuuaagaaagugacggaaguaagaggcuacacuaagggcggaccaggccacgaagaaccaguaccgaugagcacauacggguggaauauaguuaaacugauguccggaaaggacguauucuacuuaccuccagaaaaaugcgauaccuuacucugugauaucggagaaucaucaccuucacccacaguugaagagucuagaacgauaagagugcugaaaauggucgaaccuugguuaaagaauaaccaauuuuguauaaaaguacuaaaucccuacaugccuacuguuauagagcaccuugaacgucuccagagaaaacauggagguaugcuuguacgaaacccacucucacgaaauagcacacaugagauguauuggauaaguaauggaacgggaaauauagucgcaagcgucaauauggugagccgccuauuguuaaacagauucacgaugacucaucgccguccaaccauagagaaggacguggaccuuggugcaggaacuagacauguaaaugccgagccagaaacaccgaacauggauguaauaggagaaagaaucaaaaggaucaaagaagaacauaacucuaccuggcacuacgacgacgaaaaucccuauaaaacuugggcuuaucauggaucauacgagguuaaagccacagguagcgcaaguucgaugauaaacggaguggucaaacuauugacaaagccaugggacgugguuccuaugguuacacagauggccaugacagacacaaccccguucggccagcaaagagucuuuaaagagaaagucgacacuagaacgccaagaucuaugccaggaacaagaagaguuauggggauaacagcggaaugguuauggagaacucuaggacgaaauaagaaacccaggcuuuguacacgagaggaguucacuaagaaaguucgaacaaaugcggcuaugggugcuguauuuacagaagaaaaucaaugggacucggcuaaagcagccguagaagaugaagacuuuuggaagcuaguggacagggagcgagaacuucacaaauugggcaaguguggaucauguguguauaacaugauggguaaaagggagaagaaacuaggugaauuugggaaggcaaaagggucaagagccauuugguacauguggcuuggagcccgauaucuagaguuugaggcccuaggauuucuuaacgaagaucacugguuuaguagagaaaacucauauucaggcguagaaggcgaagguuugcacaaauugggguauaucuuaagagacauaagcaaaauaccagguggagcgauguacgcagaugauacagcagggugggauacaaggaucacugaagacgaucuucauaaugaggagaaaauuacacaacaaauggacccugagcacagacaauuagcaaaugcaaucuuuaaacugacguaucagaauaaaguagucaaaguccaacgaccuacaccaacugguaccguuauggauauaaucuccaggaaagaucaaaggggaagcgggcaaguugguacauacggcuuaaacacauucacaaacauggaagcucaauuaauacggcagauggaaggagaaggaguucuuaguaaagcagaccuagaaaacccacacuugccagagaagaaaauuacucaauggcuugagacaaaaggaguagaacgacucagacgaauggcuaucaguggggaugauugcguaguuaaaccuauagacgauagauucgcuaaugcccuguuagcacucaaugacauggggaaaguacguaaagauauaccacaauggcagccgaguaagggauggcacgauuggcaacaagucccauuuuguagccaucacuuccaugaguugauaaugaaggaugguagaaaacucguagucccuugcagaccacaagaugaacucauagggagggcacgaauaagucaaggggcagggugguccuuaagagaaacggcgugcuuaggcaaagccuacgcgcaaauguggucguuaauguauuuucacagaagagaucugagacuugcuagcaaugcuaucuguucagccguucccguucacuggguaccgacaucccgaacaaccuggucgauacacgcucaccaccaauggaugaccacagaggauauguuaacaguauggaauagaguauggauugaagauaacccauggauggaagauaaaacuccuguuacaacaugggaaaauguaccauaucuagguaagagggaggaccaauggugcggauccuugauuggacuaacuuccagagcaacuugggcgcagaacauaccaacugcaauacaacagguuagaucacuaauagggaaugaagaguuccuugauuacaugccaucuaugaaacgcuuucgcaaagaagaagaaucagaaggugcgauuugguag

SEQ ID NO: 23341 - RNA, 9873 nt, Artificial Sequence
  derived and/or modified CDS sequence (opt6) from DENV-3__FJ182010__SS-prME
acuagcuuaugccugaugaugauacuuccagcggcauuagccuuucauuugacaucucgcgauggggaaccaagaaugaucguuggcaaaaacgaaagaggaaaaucauuauuauucaaaacggcuuccgggaucaauauguguacacucaucgcuauggaucucggggaaaugugugaugauacugugacauauaaaugcccacauauagcagaaguggaaccggaagauauugauugcuggugcaauuuaacaagcacgugggugacauaugguacauguaaccaagcaggggaacauagaagagauaaaagaagcguagcguuagcaccacacguagguaugggcuuagacacgagaacccaaacuuggaugucggcagaaggugcauggcgacaaguagaaaaaguggaaacaugggcauuacggcauccuggcuucacgauauuggcuuuguuucuugcgcauuacauaggaacaagccuaacucaaaaaguagugaucuuuguucugcugaugcucguaacuccgaguaugacuaugcgaugugucggaguaggcaauagagauuuuguugaaggucuuuccggcgcaaccugggucgacguuguucuugaacacggagguugcguuacgacuauggccaaaaacaaaccgacucuagacaucgagcuccagaaaacugaagcuacacaacuagcgacucuuagaaaauuauguaucgaagggaaaauuacuaauauaaccacggauucaagauguccgacccaaggugaggcagugcugccagaagaacaagaucaaaauuauguuuguaaacauacguacguagacagaggcuggggcaaugguugcggucuuuuuggcaaaggaagccuaguaacaugugcaaaauuccagugccuugaaccaauagaaggaaaaguaguacaauaugagaaccuaaaauacacaguuaucauuacaguacauacgggggaucagcaucaaguaggaaaugaaacucaagggguaacggcagaaauaacgccacaagccucaacgacggaggccaucuuaccagaguaugguacuuuagguuuggaguguaguccaagaacgggcuuggacuuuaaugaaaugauacuuuugacaaugaaaaacaaggcuuggaugguacauagacaaugguucuuugauuugccucuaccguggaccuccggugccacaacggaaacgccgacguggaaccgaaaagaauuauugguaacauuuaaaaaugcacacgcuaagaaacaagaagucguaguacuaggaagccaggaaggugcuaugcacacagcacuuacuggggcaacugaaauacaaaacagugggggaaccagcauuuucgcuggucaccuuaaauguagauuaaaaauggacaaacuagaacucaaaggaaugaguuaugcaauguguacuaauacauuuguacuaaagaaagagguuagugaaacucaacauggaaccauacuaauaaaagucgaauauaaaggugaagacgcaccauguaaaauuccauuuaguacugaagauggacaaggcaaagcacacaacggucgucuaauuacggcaaaucccguagugacgaagaaagaagaaccuguuaacauagaagcagagccucccuuuggagaaucaaacaucgucauagggauaggggacaaugcacuaaaaauuaacugguauaagaaagggaguuccauuggaaaaauguucgaagcgacagcacguggagcucgacgcauggccaucuugggagauacagcaugggauuucggauccgucggaggaguuuugaauagucuagguaaaauggugcaccagauauuuggauccgcauauacagcgcuauuuucaggaguuaguugggucaugaaaaucggcauaggggugcuacuaacauggauaggucuaaauagcaaaaauacaaguaugucauuuucaugcaucgcuauaggcaucauaacacuauaccucggagcuguaguacaagcugauacuggcuguguaauuaauuggaaaggaaaagaacuuaaaugugggagugguauauucgucacaaaugaagugcacaccuggacagaacaauacaaauuccaagcagacagcccaaaaaggcuagcaacagcuauugcuggugcuugggaaaacggcguuuguggcauaagaucaacaacgagaauggagaacuuauuauggaaacaggucgcaaacgaacugaauuauauauuaugggaaaacaauauuaaacuaacgguuguaguaggugacauuauugggguauuagagcaaggcaaacggacacugacaccacaaccuauggaguugaaauauucauggaaaaccugggggaaagcgaaaauaguuacggcagaaacacagaauagcagcuuuauaauugauggcccgaauacaccggagugcccuagugcgucgagggcuuggaauguaugggaaguagaagauuauggguuuggaguuuucacuaccaacauauggcugaaacugagagaggucuauacacaacuaugcgaucauagacuuaugagcgcagcaguaaaagaugagagggccguucaugcagauaugggcuauuggauagaaucccagaaaaacggaucauggaaacuugaaaaggcuucguugauagaaguaaaaacuugcaccuggccaaaaagucauacacuguggucaaauggugucuuggaaagcgacaugauuaucccaaaaucccuagcgggaccaauaucacaacauaauuacagaccaggauaucacacucaaacagcgggcccauggcacuuagguaaacuugagcucgauuuuaauuauugugaagggacgacuguaguaaucacugaaaauugcggcacacgcggcccaagucuuaggacgacaaccgucucugggaaacuuauacaugaguggugcuguagaagcuguacuuuaccaccacuuagauauaugggcgaagauggcugcugguacggaauggagauuagaccuauuucagagaaagaagaaaacauggucaaaucucuuguuagugcagggucgggcaaagucgauaacuucacuauggguguauuauguuuagcuauauuauuugaagaggucaugcgaggaaaauuugguaagaaacacaugauugcgggcgucuuuuucaccuuugucuuacuauugagcgggcagauaacauggagagacauggcccacacguugauuaugauaggaagcaaugcaucagaucggaugggcauggguguaacguaccuugccuugauugcuacauucaaaauacagccauuucuugcacucggauuuuuccuucguaaacuuacaaguagggagaauuuacuacucggaguaggacuagcuauggcaacaacacuacaauugccugaggacauagaacagauggcgaacgguauugcacuaggccuaauggcccuaaaacuuaucacucaauuugaaacuuaccaacuguggacggcacugaucagccugacuuguagcaacacgauuuuuacacugacaguugcauggagaacagcaacccucaucuuagcuggagugucgcuauugcccguaugccaguccaguucaaugcgaaaaucagacuggcuaccuaugacugucgcagcaaugggcguacccccgcuaccauuguucauauucucuuuaaaagauacacuaaaacguagaaguuggccucucaaugagggaguaauggcaguaggcuuaguaucaauucuagcaucuucacuauuacgaaaugaugugccaauggcaggaccacuuguagccgggggauuacuaauagcguguuacgucauuaccgguacgucagcagaccuaaccguagagaaagcggccgacguaacuugggaagaagaggcugaacaaaccggaguuucacauaacuuaaugauaaccguagaugaugacgguacuaugaggauaaaagacgacgagaccgaaaauauacuaacaguuuuauugaaaaccgcacugcugauaguuagcggcauauuuccuuauucgauaccugcuacgcuccucguauggcauacguggcagaaacaaacacggcgcucuggaguauugugggauguaccaucaccaccagaaacucaaaaagcagaacuagaagaaggcguuuaucguaucaaacagcaaggaauauuugguaaaacucagguagguguaggggugcaaaaagaaggcgucuuucauacuauguggcaugucacacgcggagcaguucuaaccuacaauggaaaaagauuagagccuaauugggcuucugucaagaaagacuuaauuucauaugggggcggcuggcguuuaagcgcccaauggcaaaagggggaggaagugcaagugauugccguugagccugggaaaaaucccaaaaauuuccaaaccaugcccgguaccuuucagacaacgacaggcgagauuggugcaaucgcauuagauuuuaaaccugggacuagcgguaguccaauaauuaauagagaaggcaaaguagugggacuauacggaaaugggguggugaccaaaaaugguggcuacguaagcgguauugcacagacaaaugccgaacccgauggaccaacaccagagcuagaagaggaaauguuuaagaaacgcaaucucacaaucauggaucuucauccggggucggguaaaacaagaaaauaucuccccgccaucguccgugaggccauaaaacgaagacuucgaacacucauuuuagcucccacuagagucguagcggcagagauggaagaagcacuuaaaggucucccaaucagauaccaaacaacagcgacaaagucagagcacacagggagagaaauaguggacuuaaugugccaugcaaccuuuacgaugagacuacugagcccgguacgagucccaaacuacaacuugauaauuauggacgaagcucauuuuacggaccccgcuucaauagcugcccggggauacauuucaacaagagucgguaugggagaagcugccgcaauuuuuaugacagcaacaccuccaggcaccgcggaugcauucccacagaguaacgcaccaauacaggacgaagaacgagacauaccggaaagaaguuggaacagugguaaugaguggauaaccgacuuugcagggaaaacggucugguucgucccaaguauaaaagcuggaaaugauauagcaaacugucugaggaaaaacggcaagaaagucauucaauuaagucguaaaacguuugauacggaauaucagaaaacgaaacuaaaugauugggacuucgucgucacuacggauauaagugagaugggagcgaacuuuaaagcugaucgagucaucgauccgagaagaugccuaaagccugugauucucaccgaugggccagaaagagucauacuggcugguccgaugccaguuaccgccgcaucugcugcacaaaggcgaggccggguagggcgcaauccacagaaagaaaacgaccaauacauauuuacuggacaaccccuaaauaaugaugaagaucaugcucacuggacugaagccaaaaugcuacucgacaacauaaauacucccgagggaauaauaccggcacucuucgagccugaacgcgagaagagugcagccauagauggugaauaccgacuuaagggagagucacguaaaacauuuguggaacuaaugaggagaggggaucuaccaguuugguuggcgcauaagguagcaagcgaagguauuaaauacacagaccgaaaaugguguuuugacggacaacguaacaaucaaauacuugaagagaauauggacguagaaauauggacgaaggaaggugagaagaagaaauuaagaccgagauggcuugacgccagaacauacagugacccgcuugcguuaaaagaauuuaaggauuuugcagcaggcagaaaaucaauugcacuugauuuagugacagaaauagggcgagugccgagccaccuagcgcaccgaaccagaaacgcccuagacaauuugguaaugcugcacacauccgaacacgguggaaaagccuaucgacacgcuguugaagaauuaccagagacaauggagacauuacuacuuuuaggucuuaugauacuuuugacuggaggggcaaugcuauuuuugauaagugguaagggcaucggaaaaacaucgauagggcuaauauguguaaucgcaagcucagguaugcucuggauggccgaaauaccuuuacaauggauugcaucugcaauaguccuugaguucuuuaugaugguuuuacugauacccgaacccgaaaaacaaaggacaccccaagauaaucagcuagcuuacguugucauuggaauuuuaacucucgcagcuaucaucgcagcaaacgaaaugggacuuuuagaaacuaccaaacgggaucugggcaugagcaaagaacccgggguaguaucaccaaccaguuaucucgauguugacuuacauccagcaagugcauggacucuauacgccguugcuacaacaguaaucacgccaaugcucagacauacuauugaaaacucaacggcuaacguaagucuggcagcgauagcgaaccaggcaguaguauugaugggucuggauaaaggauggccaaucaguaaaauggaucugggaguaccucugcuagcauuggguugcuacucacaaguuaauccguuaaccuuaacagcggcuguacuucuucuuaucacacauuacgcuauaauaggcccaggccuacaagcaaaagcuaccagagaagcccagaagcguaccgcggcaggaauuaugaaaaauccgacuguugauggaauaaugaccauugacuuagauccaguaauuuaugauuccaaauucgagaaacaacuuggacaaguuauguugcucguacuuugugcuguccagcuuuuguuaaugagaacgucuugggcacuaugugaagcgcucacgcuagcaacaggacccauaacgacccucugggaaggcucaccaggcaaguuuuggaacacaacuauugcgguaagcauggcaaauauauuccgagggucauaccuggccggugcuggacuagccuuuucuauuaugaaaucaguuggaacugggaaaagagguacaggaagccaaggagagacauuaggagaaaaauggaagaagaaauuaaaccaauugucucggaaagaguucgauuuauauaagaaaucugggauaacggagguagaccguacagaagcuaaagagggauuaaaaagaggugaaauaacucaucacgcuguguccagaggcagugccaagcugcaaugguuuguugaacgcaauaugguaauccccgaaggccgaguaauagaccuuggaugcggcagaggaggauggagcuacuauugcgcaggauuaaagaaaguuacugaaguaagaggcuacacaaaaggaggaccaggacacgaagaaccaguacccaugucuaccuauggguggaauaucguaaaauugaugagcgguaaggacguguuuuaucugccaccagaaaaaugcgacacauuguuaugugauaucggcgaaucaaguccuagccccacuguagaagaaaguagaacaauccguguccuaaaaaugguagaaccuuggcugaaaaauaaccaauucugcauuaaaguuuugaauccguauaugcccacuguaaucgaacacuuagaaagacuccaacgaaaacacggagggauguuaguuagaaauccacuuuccagaaauuccacacaugaaauguacuggauaagcaacggcacuggaaauauuguagcauccguaaacaugguuucccgccuccuauuaaauagauucacuaugacucacaggcggcccacaauugaaaaagauguggauuuaggagcuggcacccgucacguuaacgccgaaccagagacaccuaacauggacguuauaggagagcgaauaaaacgaauuaaagaagaacauaauucuacguggcauuaugacgaugagaaccccuauaaaacuugggcuuaucauggcagcuaugaggucaaagcaaccggaagugcuaguucgaugauuaacggagucgucaaacuacucacaaagccaugggaugugguaccuaugguaacacaaauggcuaugacagauacaacaccauuuggccaacagcguguuuuuaaagagaaaguugauacaaggacuccaagaucaaugccggguacccgcagagucaugggaauaacagcggaauggcuuuggagaacccuaggucgaaauaagaaaccaagauuauguacaagagaagaauuuacaaagaaaguacguaccaacgcagcgaugggagcuguauuuacggaagaaaaucaaugggacucggcaaaagcggcaguugaagacgaagauuucuggaaguuaguagauagagaaagagaguugcauaaauuagguaaauguggaucguguguauauaauaugaugggcaaacgagaaaagaaacugggugaauuugggaaggcaaaagguagccgggcgauuugguauaugugguugggcgcucgauaucuugaauuugaggcacuaggauuuuuaaaugaagaccacugguucucacgagaaaauucauauucuggugucgaaggugaaggcuuacauaagcugggauauauacugagagacauaagcaaaaucccgggaggagcaauguacgcggaugauaccgcugggugggacaccagaaucacagaggaugaccugcacaaugaagagaaaauuacacaacagauggauccggaacaccgacaacuagcugaugcuauauuuaaacucacguaccaaaacaagguaguaaaagugcaacgacccacaccgacggguacaguaauggacauaaucucccgcaaggaucagcgcgggagugggcaagucggaacauauggauuaaauacuuuuacuaacauggaagcacaacuaauaagacagauggagggggaagguguacuuaccaaagcagaucucgagaauccacaccucuccgagaagaaaauaacucaauggcucgagacaaaagggguagaaagauuaaaaaggauggcuaucucgggagacgacugugucgucaagcccauagacgaccgauuugcuaaugcgcucuuagcuuuaaaugacaugggaaaaguaagaaaagauauaccacaauggcagccuagcaagggcuggcaugacuggcaacaaguuccuuuuugcagucaucacuuucacgaacuuauuaugaaagacggaaggaaacuuguuguuccauguagaccacaagacgagcuuauuggccgcgcuagaauaagucaaggcgcggguuggagcuuaagagaaaccgccuguuuagguaaggcauaugcccaaauguggucucucauguacuuucacagaagagaucuuaggcuagccucaaaugcaauaugcagcgccguuccaguccauugggucccgaccucgcguacgacauggaguauacacgcccaccaucaauggaugacaacggaagauauguuaacaguauggaaucgaguauggauagaagauaacccauggauggaagauaaaacaccagugaccacuugggagaauguaccuuauuugggaaaaagagaggaucaaugguguggaucucuaauaggacuaacgagcagagccacaugggcacaaaauauuccuacagccauacaacaaguuagaagccucauaggaaacgaggaguucuuagacuacaugccaaguaugaaaagauuucguaaggaagaagaaucugaaggcgcuauaugguaa

SEQ ID NO: 23342 - RNA, 9873 nt, Artificial Sequence
  derived and/or modified CDS sequence (opt6) from DENV-3__FJ182011__SS-prME
acuagcuuauguuuaaugaugaucuuaccggcugcucuugcauuucaucugaccucacgggauggagaaccccgaaugauaguggguaaaaaugaacgcgguaaaucuuuauuauuuaaaacugcuucagguauaaauaugugcacauuaauugcuauggaccugggugaaaugugcgacgacacagugacuuacaaaugcccccacauugcggaaguagaaccugaggacauagauugcuggugcaacuuaacaucaacaugggucacguauggcacguguaaucaagcgggagagcaucgucgcgacaaaagaaguguggcgcuugccccacauguagggaugggacuugacacucguacacagacuuggaugagugcagaaggagccuggagacaaguugagaaaguagaaacgugggcgcuaagacauccaggauucaccaucuuagcguuauucuuagcccauuauauaggaaccucguugacgcaaaaaguagucauuuucauacuacuuauguuaguaacaccaucuaugaccaugagaugcguuggaguaggaaacagagacuucgucgaggguuuaucaggggcgaccuggguggauguaguacuggaacacggagggugcguaacuacaauggcuaaaaauaaacccacacuagacauagagcuacagaaaacugaagcaacucaacuagcuacauuaaggaaauuauguauugagggaaaaauaaccaacaucaccaccgauucgcgaugcccuacccaaggagaagcuguauugccagaagaacaagaccaaaauuauguaugcaaacauaccuauguggauaggggcugggggaacgguugcggcuuauucggaaaaggcagucugguuaccugugcaaaauuucaaugucuugaaccaauugaaggcaaagucguccaauaugaaaaccucaaauauacggucauaauaacuguccauacgggggaccaacaucaaguuggcaaugaaacccaagguguaacagccgagauaacaccacaagcaucuacaacggaagccauauuaccugaguauggaacccucggucuagaaugcagcccccguacaggacuugauuucaacgaaaugauacuauugacuaugaaaaacaaagcauggaugguacaccgucagugguucuuugaucuaccgcuuccauggacaaguggcgcgaccacggaaacacccacauggaauaggaaagaacuauuagugacauuuaaaaaugcucacgccaagaaacaggaggugguaguguugggaucgcaagaaggggccaugcauacagcauuaacaggcgccacugaaauucaaaacucgggcggcacgagcauauuugcaggucaucugaaaugcagacuaaaaauggauaaauuagaacuuaaaggcauguccuaugccaugugcacuaauacuuucguuuugaagaaagaagucagcgagacccagcaugguacgauacuaauaaaaguugaauauaaaggagaagaugccccuuguaaaaucccguuuuccacagaggaugggcaggggaaagcucauaacggaagacuuaucacagcaaaucccguuguuacgaaaaaggaggaaccuguuaauaucgaagcugaaccgccauuuggcgagucuaauauugucauagguauaggggauaacgcuuuaaaaauuaacugguauaagaaagggucgagcaucggaaaaauguuugaggcgacagcucggggagcccguaggauggccauauugggugauaccgccugggacuuugggagcguaggcgguguauuaaauucacuuggaaaaaugguacaucagauuuucgggucagcauauacagcgcuauuuucgggcgucagcugggucaugaaaauugguauugguguucuacuaaccuggauuggacuaaauucuaaaaauaccaguaugaguuuuucauguaucgccauagguauuauuacucuuuaccugggagcggucguucaagcugacacuggaugugugauaaauuggaaaggcaaagaauuaaaauguggaucugguaucuuugugacaaacgaaguacauacguggacagaacaguauaaauuucaagcggauucucccaaacgauuggcaacagcaauagcuggagccugggagaacgguguaugcggaauccgaaguacaacuagaauggaaaaucuauuguggaaacaaaucgccaacgaguuaaauuauauauuaugggaaaauaacauaaaacuuacugugguugucggagacauaauugggguacuagaacaaggaaaacgaacucuaacgccacaaccaauggaacuaaaauauucauggaaaacauggggaaaagcgaaaauagucacagcagagacccagaacuccaguuucauuauugacggcccaaacaccccugaaugcccuucggcuucacgugcauggaacgucugggagguagaagauuacggguucggaguauuuacuaccaauauauggcucaaacuucgcgaaguauauacacagcuaugcgaccauaggcuuaugagugcggcaguaaaagacgaacgagcagugcaugccgacaugggauauuggauugaaucacagaaaaauggaucauggaaacucgaaaaagcaaguuuaauugaaguuaagacauguacauggccuaaaucacauacuuuauggucaaacggaguucuagaaucagauaugauuauuccuaagucucuugcagguccuauaucgcaacauaacuaucgaccuggauaucacacacaaacagcugguccguggcacuuaggaaaguuagaacuagauuuuaauuacugugagggaacgacaguuguaauaacagacaauugcggaacccgaggaccaucacuucguacuacuacgguaagugguaaacuaauacaugaaugguguuguaggagcuguacguugccaccucuucgauauaugggggaagauggcuguugguacgggauggaaauuaggccuauuucagagaaagaggagaacauggucaagagucuuguaagcgcaggaagugggaagguagacaauuuuacaaugggcguucuaugcuuagcaauucuauuugaagaagugaugcguggcaaauucggcaagaaacacaugauagcuggcguauucuuuaccuuuguucuucuauugagcggucaaauaacuuggagagacauggcgcauacuuugauaaugauagguucgaaugccucagaccgaauggguaugggagugacuuaucuagcuuuaauugcuacauuuaaaauacagccuuuucuagcuuuaggguucuuucucagaaaauuaacuucaagggaaaaucuccuauuaggcguagggcuagcaauggcaacaacucuacaauuaccagaagauauugaacaaauggcaaaugggauagcucuagguuuaauggcuuuaaaacucauaacacaauuugagacauaucagcuguggacagcgcuaauauccuuaacguguuccaauacuauuuuuacgcucacaguagcauggaggacagcgacauugaucuuagcaggaguaagccuucugccaguaugccaaucuucaucaaugcguaaaucagauuggcuaccaaugacuguagcugcaaugggagucccuccauuaccacuguucauauucuccuuaaaagauacccuaaagaggagaucauggccacuaaacgagggugucauggccguuggacucguuucaauuuuggccucuucccugcuaaggaacgauguaccaauggcggggccucuaguagcuggagguuuauugaucgcauguuacgucauaacaggaacaagugcagaucuaacuguagagaaagcggcagacguaacaugggaagaagaagcugaacagacuggaguaagccacaaucuaaugauaacaguggaugacgauggaacuaugaggauaaaagacgaugaaacagagaacauccugacggucuuacugaaaacugcgcuacugaucgucucgggaaucuuuccauacagcauuccugcgacucucuugguauggcacacauggcaaaaacaaacucgccgcagcggaguucuaugggauguuccauccccacccgaaacccagaaggcugaacuagaagaaggaguuuaucgaauuaaacaacaaggaaucuucggaaagacccagguaggaguagggguacaaaaagaaggaguuuuccacacuauguggcacgucacuagaggagcgguacuaaccuacaauggaaagagacuggaaccaaauugggcuagcguaaagaaagaccucauuagcuauggcgggggcuggcgacucagugcccaguggcaaaaaggcgaagaaguucagguaauagcaguggaaccugggaagaacccuaagaauuuucaaacaaugccuggaacauuccagacgaccacuggugaaauuggagcaauagcauuagauuuuaaaccuggcacuucaggcagcccaaucauaaacagagaagggaaaguagucggucucuacgguaacgggguaguaacuaaaaauggggguuacguuucuggcauugcgcaaacaaaugcagaaccugaugguccgacaccagaauuagaggaagagauguuuaaaaagcguaauuuaaccauaauggacuuacauccuggcuccgguaagacaagaaaauaucuuccugcuauuguccgagaagcuauuaaaagacgccuuagaaccuuaauacuugcaccaacacgaguaguugcagccgaaauggaagaagcacuaaaaggacuaccuauuagauaucaaacuacagcaacuaaaagcgaacauacuggacgagaaaucguagaccuaaugugccaugcuacuuucaccaugcggcugcuaagcccaguucgugugcccaauuacaaccuaauaauaauggacgaagcacauuucacagacccugcaucgauugcggcccgggguuacauuagcacacgcguagggaugggcgaagcagcagcgauuuucaugaccgcaacaccaccagguaccgccgaugcauucccgcaaucgaacgcaccuauucaagaugaagaacgcgauauacccgaacgaucuuggaacuccggaaaugaauggaucacagauuucgcaggaaaaacugucugguucguuccaaguauaaaagcagggaacgacauugcaaauugcuuacguaagaacgguaagaaaguuauacaacuuucgaggaagacuuuugacacagaguaccaaaagacaaaacuaaaugauugggacuucguagugacaacagacauaucagaaaugggagcgaacuuuaaagcagaccggguaauugacccucguaggugccugaagccaguaauacucacagaugggccagaaagggugaucuuggccggaccaaugccaguuacggcagcaagugcagcccaaagaagagggcggguagguaggaacccgcaaaaagagaacgaucaguauauuuucacgggucaaccacugaacaaugacgaagaucacgcccacuggacagaagcuaaaaugcuacuugacaauauuaacacacccgaaggcaucauuccagcacuuuuugagccagagagggagaagucugcagccauagauggcgaguaccgacuuaagggugaaagucgaaaaacauuugucgaacucaugagaagaggggaccuaccaguaugguuagcucauaaaguggcgagugagggaauaaaauauacagaccgaaaguggugcuucgauggacaacgcaauaaccagauacucgaagaaaauauggauguagaaauauggacaaaggaaggagaaaagaagaaacuucgcccgcggugguuagacgccagaacguacucugauccuuuagcccuaaaagaguucaaagacuucgcagcugguagaaaaaguauagcuuuagaucugguaacggaaauuggaagaguaccuucacaccuugcccacagaacgagaaaugcguuggauaaccuaguaaugcuucauacuagcgagcauggagggaaagccuauagacacgcaguggaagaauuaccagagacaauggagacgcuucuauuacuuggguuaaugauacuccuaacagguggagcaaugcuauuucucauuucuggaaaaggaauagggaaaacuucaauaggucuaauuugugucauagccucaaguggcauguuguggauggcggagaucccauugcaguggauugcgucugcaaucguacuagaguucuucaugaugguguuacuaaucccagagccugagaaacaaagaacaccacaagauaaucaguuagcuuacguugugaucggaauccuaacauuagcugcgauaauugcugcaaaugaaaugggguuacuugaaaccacaaaaagagacuuaggaaugagcaaagaaccuggcguagucucgccaacgucauaucuagaugucgauuuacaucccgccucggcauggacauuauacgccguggcuacaaccguaauaacgccuauguuaagacauacaauagaaaauucaacagcuaaugucucauuagcagcuauugcaaaccaagcgguaguacuaaugggacuugauaaaggguggccaauuucuaaaauggaccuuggugucccacuacuugcauuaggguguuacucccaggugaauccucuaacacugacagcugcuguccuauuacucauaacacacuaugcaauaauagguccuggacugcaagcaaaggcuacgagagaagcucaaaaacguacugcugcaggaauaaugaaaaacccaacagucgacgguauaaugacaauugaucucgauccagugauauaugauagcaaauucgaaaaacagcuuggucaaguaauguuacuggugcugugcgccguucagcuguuacuaaugcgcacaaguugggcauuaugugaagcucuaacauuggcuacggguccuauaacaacgcugugggaggggagcccuggaaaauuuuggaauacuacaauagcugugagcauggccaauauuuuuagagguucauaucuugcaggagcugguuuagcauucagcauaaugaaaagcguugguacuggaaaaagaggaacagggucccaaggagaaacccuaggggaaaaauggaagaagaaauuaaaucagcuuucuagaaaagaguucgauuuauacaagaaaaguggaauuacagaagucgauaggacggaagcaaaagaagggcugaaaagaggcgaaaucacacaccaugcaguaagccguggauccgcaaaauuacaaugguuuguagaacggaauaugguaauuccagaaggaagaguaauugauuuaggaugcgguaggggaggauggaguuauuauugcgcggggcuaaagaaaguuacagaaguuagaggauauacuaagggcggcccaggccaugaagaaccaguuccaaugucaacauacggauggaauauaguuaagcuaauguccggaaaggacguauuuuaccuacccccggaaaaaugugauacguuauugugugauaucggugaaaguagcccauccccuacuguagaagaaucccggacaaucagaguuuuaaagaugguugaaccuuggcugaaaaacaaucaguucuguauaaaaguacuuaacccauauaugccgacaguaaucgagcauuuagaaagacuccaacguaaacauggcggcauguugguuagaaacccacucagcaggaacucaacccaugaaauguacuggauuaguaacgggaccggaaauauaguagcauccguaaauaugguuaguaggcucuuacugaacagauuuacgaugacacauagacgcccuacaauagagaaagauguagaccuaggcgcagguacucggcacguuaacgccgagcccgaaacgccgaauauggacguaauaggggaaaggauaaaaagaauuaaagaagaacauaacucgacauggcauuaugaugaugaaaacccuuauaaaacgugggcauaccaugggucauaugaagucaaagcaacaggaagcgccucaaguaugauaaaugggguugucaaauuacuaacgaaacccugggacguaguaccaaugguaacacagauggcuaugacggauaccacucccuuuggucaacagcguguguuuaaagaaaaaguggacacacggacuccucguucgaugccaggaacucggcgagugauggggauaacugcagaaugguuauggcguacguuagggagaaauaagaagccaagacuuugcacgagggaagaauuuacuaagaaaguaaggacgaaugcagcuaugggugcgguauuuacagaagaaaaucagugggauagugccaaagcggcaguagaggaugaagacuuuuggaaguuaguagaccgugagagggaauugcauaaguuaggaaagugugguagcugcguuuauaacaugaugggaaaaagagagaagaaacuaggagaguucgguaaagcaaaaggauccagagcaauuugguauauguggcucggagcacgauacuuagaauuugaagcucugggauucuuaaaugaagaucacugguuuucuagagaaaacuccuacagcggcguagaaggggaaggccuacacaaauuaggguauauacugagagacauaaguaaaauacccggaggagcaauguacgcugacgauacugcuggaugggauacaagaauaaccgaggacgaucuacacaaugaggagaaaauuacucaccaaauggauccugaacauagacaauuggcuaacgcaaucuuuaaacuaacuuaccagaauaaggucgugaagguucaaaggccaacaccaacugguacuguaauggauauaauuucaagaaaagaucaacgagguucggggcagguaggaacguaugguuugaauacauucacgaauauggaagcgcaacugauaagacaaauggaaggagaaggcguucuauccaaggccgauuuagaaaacccacaucuaucagaaaagaaaauaacacaauggcuagagaccaaagguguugaaagacuuaaacgcauggcgauuucuggggaugauugugucgucaaaccuaucgaugaucgauuugcaaacgcuuuguuagcacugaaugauaugggaaagguccgcaaggauauaccacaguggcagccgucgaaaggauggcacgauuggcaacaaguaccauuuuguucacaucauuuucaugaacuaauuaugaaagauggacgaaaguuagucguaccauguagaccucaggaugagcuuauagggcgugcacguaucagccaaggggcagguuggucacucagggagacagcgugucuuggaaaagcauaugcacaaauguggagucugauguauuuccaucgucgggauuuaagauuagcuuccaaugcuauaugcagcgcgguaccuguacauuggguuccaaccucccgcacaacguggagcauacacgcucaucaccaauggaugaccacugaggauaugcuaacaguauggaacagagucuggauugaggauaauccguggauggaagacaaaacaccaguaacaacaugggaaaaugucccauaccucggaaagagagaagaucaguggugcggaaguuuaauagguuugaccucccgagcgacgugggcacaaaauauaccuacugcaauucagcagguuagaucauuaauaggcaaugaagaguucuuagauuauaugccaagcaugaagagguuucgcaaagaagaagagucagaaggggcgaucugguag

SEQ ID NO: 23343 - RNA, 9873 nt, Artificial Sequence
  derived and/or modified CDS sequence (opt6) from DENV-3__FJ182038__SS-prME
accucucuuugcuuaaugaugauuuuaccggcagccuuagcauuucauuuaaccucuagggauggugaaccccgaaugauuguuggcaaaaacgaacguggaaaaucacuacuauuuaaaaccgccagcgggauuaacaugugcacgcuaaucgccauggaucuaggagaaaugugugacgacaccguaacguacaaauguccgcacauaacagaaguagaaccggaagacauagauuguugguguaaucuaacuucaacauggguuacuuacggaacuugcaaucaagccggugaacaucgccgugauaaacggagugucgcuuuagcuccucauguugguaugggucuggauacucgaacgcaaacauggaugagugcugaaggagcguggagacaagucgaaaaaguugagaccugggcguuacgucauccuggcuucacgauacuugccuuguuuuuggcacacuauauuggaacuucauuaacacaaaaaguaguuauauuuauuuuacucaugcugguaacuccaucuaugacgaugcgcuguguuggugugggaaaccgagacuucguagaaggucugucuggcgccacauggguggacgugguucuagaacacggaggaugcguaaccacuauggcgaaaaauaaaccuacauuagauauagaacuucagaaaacagaagcaacucaacuagccacgcuacgcaaauuauguaucgaaggaaaaauuacaaacauaacaaccgauaguagauguccaacacaaggagaagcaguucuaccggaagaacaagaucaaaauuaugugugcaaacauacauacguugaucgcggaugggguaaugguuguggguuauucggaaaagggagcuuagugacgugugcaaaauuccagugucucgagccaauagaagguaaaguaguucaauacgaaaaccuaaaauauaccguaauaauaacuguucauacaggggaccaacaccaagucggcaaugaaacacaagggguaacugcagaaaucacaccacaagcauccacuacagaagcgauucucccggaauacggcacgcuaggcuuggaauguucgccuagaacaggucucgauuucaaugagaugauucuauuaaccaugaaaaacaaagcauggaugguacauagacaaugguuuuucgauuuaccauuaccauggacuuccggagcgacgacagagacaccuacuuggaauagaaaagagcuucuuguaacuuucaaaaaugcgcacgcgaagaaacaggaagucguuguucuugguagccaggaaggagcaaugcacacggcucuaacgggagcgacagaaauccaaaacagcggcggaacuuccauuuucgcuggccauuuaaaauguaggcuaaaaauggacaaauuagaauugaaagguaugagcuacgcuaugugcacaaauacuuuuguacuuaagaaagaaguaagugaaacacagcauggaacaauucuaauaaaagucgaauauaaaggagaagacgccccuuguaaaauucccuucucaacugaagacggucaaggaaaagcccacaacggaagauuaaucacggcaaacccuguagucacgaagaaagaagaacccguaaacauugaagcugaaccaccuuuuggagagucaaauauagucaucgggauuggagauaaugcuuuaaaaauaaauugguauaagaaaggauccucgauuggaaaaauguuugaagcaacggcucgaggugcaagacgaauggcaauauugggagauacggcaugggauuuuggaagcguagggggaguucuaaacagccuuggaaaaaugguucaucaaauuuucggcagcgccuauacgacauuauucucggggguaucgugggugaugaaaauaggaauaggcguuuugcuaacauggauuggacuaaacaguaaaaacacaagcaugagcuuuuccuguaucgcgauaggcguaauaacccuguaccuuggcgcagucguacaagcagacaugggaugugucauaaauuggaaagguaaagagcuaaaaugugggucuggcauauuugucacaaaugaagugcacacauggacagaacaauacaaauuucaagcagauucaccaaaaagacucgcaaccgcgauagcuggugcaugggagaacgguguaugcggaauaagaaguacuacaagaauggagaacuugcuauggaaacaaauagcaaaugaauuaaacuacauacuaugggaaaauaacauuaaacuuacgguugucguaggugauauuauagggguacucgaacagggcaaaagaacauuaaccccgcaaccuauggaacuaaaauauucauggaagaccugggguaaagcaaaaauaguaacugcggagacccaaaauucuucauuuauaauugaugggccaaacacaccggaauguccgucggcuucccgggcuuggaauguuugggaaguugaagacuacggguucgguguuuuuacgacaaacauuugguuaaaauuaagagaaguauacacucaacucugcgaccaccgguugaugagugcugccguaaaggacgaaagagccguucaugcagauaugggguacuggauugaaagucagaaaaacgggucuuggaaauuagaaaaggcuucguuaauugaaguaaaaacuuguacauggccaaaaucucacacccuauggucgaauggaguauuggagucagauaugauaauuccaaaaucacuugcgggaccgauaucucaacacaacuacaggccggguuaucauacacaaacagccgggccauggcaccuaggaaaguuagagcuagauuuuaauuauugcgaaggaacaacugucguaauuaccgaaaacuguggaacacggggcccgucccuccggacaaccacagucagcgggaagcugauacacgaaugguguuguagauccuguacgcuuccacccuuaagguacaugggggaggauggaugcugguacgggauggaaauaagaccuauuuccgagaaggaagaaaauaugguaaaaucucuagucagcgccggcucaggcaaagucgauaauuuuaccaugggaguucuuugucuagccauucuguuugaagaaguaaugcgagggaaauuugguaagaaacauaugauugcugguguguucuuuacguuuguacucuuauuaucggggcaaaucacuuggagggauauggcgcacacacuaauaaugauaggaucaaacgcaagcgacaagaugggcauggguguuacguaccucgcacuaauagcaacauuuaaaauccaaccauuuuuagcauuaggauucuucuuaagaaaauuaacaagcagagaaaauuuauuacuggguguaggucuagccauggccacaacuuuacaauugccagaagacauugaacaaauggcuaaugguauugcgcugggguugauggcacuuaaguuaauaacucaauuugaaacauaucaacuauggacagcuuuaaucagcuuaacuuguaguaacaccauguuuaccuuaacaguugcauggcguacagcuacgcuaauauuagcaggcgugagccucuuaccagucugucagaguucuucaaugaggaaaacagauugguuaccaauggcuguagcugcgaugggcguaccuccguugccgcuguuuauauucucauugaaagacacacuuaaaagaagaaguuggccucuaaacgaagguguuauggcgguaggcuuaguaaguauacuggcuaguucccuccugcggaacgaugugccaauggcgggccccuuaguagcaggcgguuugcuuauugccuguuauguaauuaccggcacaagugcggauuuaacaguggaaaaggcggcagacauaacuugggaggaagaagcagaacagacuggaguuucacauaaucugaugaucacaguagaugaugaugggacgaugagaauuaaagaugacgagacagaaaauauauugacugugcuucuuaagacagcacucuugauagugaguggcgucuuucccuauucgauaccggcgacuuugcuagucuggcacacauggcagaaacagacacaaaggagugguguacuaugggaugugcccaguccuccggaaacacaaaaagcggaacuagaagaaggaguuuauagaauaaaacaacagggcauuuuugguaaaacgcaaguuggagucggagugcaaaaagaaggugucuuccauacgauguggcacgugacccgaggagcugucuuaaccuacaaugguaaaagauuagaaccuaacugggccucagucaagaaagauuugauaaguuacgguggaggauggcgauuaucggcccaauggcaaaaaggagaagaaguacaaguuauugcuguagaacccggaaagaauccuaagaauuuucagaccaugccgggaacuuuucaaaccacaacaggagaaaucggagcaauagcauuagacuuuaagcccgggacaucagggucaccuauaauuaaccgcgagggaaaaguugucggucuauaugguaacgguguaguaaccaaaaaugguggauacgucucuggaauagcgcaaaccaaugcagaaccagauggaccgacgccugaacuggaagaagaaauguucaagaaacgaaaucucacaauaauggaccuacacccugguaguggcaaaacaaggaaauaucugccagcgauaguacgugaagcgauaaaacguagauugagaacacuuauacuagcacccacacgaguuguugcagcugaaauggaggaagcauuaaaaggguuaccgauuagauaucagacgacggcuaccaaguccgaacauaccggacgggaaauaguugacuuaaugugucacgccacauuuacgaugagauugcucucgccaguaagagucccgaacuauaaccucauaauaauggaugaagcacauuucacugacccagcuaguaucgccgcaagagguuacauaagcacuagaguaggaaugggagaggcugcagcuauauucaugacagcuacgccuccgggcacagcagacgccuucccucagaguaaugcaccaauccaagaugaagaacgugacauaccugaaagauccuggaauagugguaaugaguggauuacagacuucgcaggaaaaacaguaugguucguccccaguauuaaagcagguaaugauaucgcgaacugccuacgcaagaauggaaagaaagucauacagcucucuagaaagaccuucgauacagaauaccagaaaacaaaacuuaaugacugggacuucgugguaacuacagacauauccgaaaugggugcaaacuucaaagccgaccggguaauagauccgaggagaugccuaaaaccagugauacugaccgauggaccugaaaggguaauccuagcggggccaaugccuguaacagccgccagcgcugcacagagaagagggaggguaggacgaaacccacagaaagagaaugaucaguauauauuuaugggacaaccccuuaauaaugacgaagaccaugcccauuggacagaagcgaagauguuauuagacaauauaaauacuccagaagggaucauaccugcgcucuuugagccagaaagagagaaaucggcagcuauagauggagaguaucgauuaaaaggugaaagccgaaagacauuuguagaacugaugcgucgaggcgaucuucccguauggcucgcacauaaaguggcgagcgaggguaucaaguauacggaccguaaauggugcuuugauggucaaagaaacaaucagauauuagaagaaaauauggauguagaaauauggaccaaggaaggugagaagaagaaacuuagaccgcgcuggcuggacgcuagaacuuauagugauccacuagcguuaaaagaguuuaaagauuucgccgcaggucgaaaauccauugcauuagaucucgucaccgagauaggaaggguaccaucacaucuagcacacagaacaagaaacgcucuugacaauuuaguuauguuacauacaagugaacacgguggacgagcauacagacaugcuguagaagaacuucccgagacuauggaaacacuccuuuuacucggucuaaugauccucuuaacgggaggcgcuaugcuauucuuaauaagcggaaaaggaauagggaagacaaguauaggacugauaugugugauugcuaguagugguauguuauggauggcagaaauaccucuacaguggauagcaagcgcaaucguauuggaguucuucaugaugguguuacuaauuccugaacccgaaaaacaacggacaccacaagacaaucaacucgccuacgucguuauuggaauauugacacuugcagccacaaucgcagccaaugagaugggcuuauuagaaacaacaaagagagacuuaggaaugucaaaagaaccagggguagucagcccuacauccuaucuagacguggauuuacauccagcaucagcauggacauuauaugccgucgcuacaacaguaauaacgccaaugcugcggcauacgauagaaaauucuacggcaaauguaucauuggcugcgauugcuaaccaagcaguaguacuaaugggauuggauaagggcuggccuauaucuaaaauggaccuagguguuccccuauuagcauuaggaugcuacagccagguuaaucccuugacuuuaacagcggcgguacuacuccuaauuacacauuaugcaauaaucggacccggccugcaagcuaaagccacacgugaggcgcagaaacgaacagcugcaggaauaaugaaaaauccaacuguagauggaauaaugacaauugacuuagauccaguuaucuaugauucuaaauucgaaaaacaauuaggucaaguuauguuacuuguuuuaugugcuguacaacuauuacuuaugagaacaucuugggcucuuugugaagcacuaacacuugcuacgggcccaauaacgacauuaugggaagggaguccaggaaaguucuggaacacaacaaucgcaguaucuauggcaaacaucuuccgaggaucguaccucgccggagcaggacuagcuuuuucaauaaugaaaagcguagguacugguaaacgaggcacagguagccagggugaaacauuaggagagaaauggaagaagaagcucaaucaacuuucaagaaaggaguuugauuuauacaaaaagagcgguauaacggagguagaucgcaccgaagccaaggaaggucuuaaaaggggagagacaacacaucaugcaguuagcagagguacagcaaaguuacaaugguuuguagaaaggaacauggucauaccggaagguagagugauagaccuaggaugugggcgaggcgguuggucuuauuacugugcgggacuuaagaaaguaaccgaagugcguggcuauacaaaagguggaccugggcaugaagaaccagugccuauguccacauauggauggaauauaguaaaguugauguccggaaaagacguauuuuauuuacccccugaaaaaugugacacacuacucugugauauaggggaaaguucuccgaguccgacaguggaagaaagucguacaauuaggguuuugaaaaugguugaaccguggcugaaaaauaaccaauucuguauuaaaguacuaaacccuuauaugccuaccgucauagaacaucucgagagguuacaaaggaaacauggaggaaugcuaguacgaaacccuuugucucgaaauucaacacaugaaauguacuggauaagcaacggcacgggaaacauaguugccaguguuaacauggucucgcgacuauuacuaaaucguuucacgaugacccauagaagacccacaauagaaaaagacguugaucuaggugcagguacacgucacguuaaugcugagccugagacuccaaacauggaugucaucggagaacgaauaaaacgaauuaaagaagaacauaauuccacauggcauuaugaugaugaaaauccauauaaaacgugggcguaucacgggucuuacgaaguaaaggcuacgggaagugcaagcaguaugauaaacggugugguuaaauuacugaccaaaccaugggacguaguaccaaugguaacacaaauggcgaugacagauaccacaccuuucggccaacaaagagucuuuaaagaaaaaguugacacuagaacuccacguucuaugccagggacacgacgaguaauggguaucacugcagaguggcucuggcgcaccuuaggaagaaauaagaaaccaagauuauguacacgagaagaguucacuaagaaaguacgaacaaacgcugccaugggcgccguuuucacggaagaaaaucaaugggauuccgcaaaggcugccguagaagaugaagauuucuggaaacuuguugacagagaacgagaacuacauaaauuagguaagugcgguagcugcguguauaacaugaugggaaaaagagagaagaaauuaggugaauuuggaaaggcaaaaggcaguagagcaaucugguauauguggcuaggugcacgguaucuugaguuugaggcauuagguuuucugaaugaagaucacugguucuccagggaaaauucuuacagcgggguggaaggagaagguuuacacaaauuggguuauauauuacgagauaucagcaaaauaccaggaggagccauguacgcagacgacacugcugguugggauacaagaaucacggaagaugauuuacacaacgaagagaaaauaacacagcaaauggauccagagcauaggcaauuagcuaacgcaauuuucaaguugaccuaccaaaauaaaguuguaaaaguacaaagaccaacaccuacugggacuguuauggauaucauuucaagaaaagaccagaggggaagcggucaaguggguacuuacggguuaaacacauucacgaacauggaagcgcaacuaauucgucagauggagggcgaaggaguauuauccaaagcggaucuugaaaauccacaucuucccgaaaagaaaauaacucaauggcuggagacaaaggggguugaacgguugagacgaauggcgauuucuggugacgauugcgugguuaaaccaauagaugaccguuucgccaacgcccuacuagcccuuaaugacaugggaaagguucguaaagacauaccacaauggcaaccuaguaaaggauggcaugacuggcaacagguaccuuucugcucacaucauuuucacgaacucaucaugaaagaugggcgaaagcuagucguaccuugucguccccaagaugaacuuauuggcagagcgaggauaucacagggcgccggcuggucuuugcgagagacugcuugccuggguaaggcuuaugcccaaauguggucauugauguacuuucacagaagagauuuacgacucgcaucaaacgcuauauguucugcgguaccaguccauuggguuccaaccucucguacaaccuggagcauacaugcccaucaccaguggaugacaacagaagauauguuaacuguuuggaaucgaguauggauugaggauaacccuuggauggaggauaagaccccuguuacuacuugggagaacguaccauaccuaggaaaaagagaagaucagugguguggaucucuuauagguuuaacgucaagagcuacaugggcacagaacauacccacagcgauccaacaagugcguucuuugauuggaaacgaagaguuucuagacuacaugccgucgaugaagagauucagaaaggaggaggaaucggaaggagcaauuugguga

SEQ ID NO: 23344 - RNA, 9873 nt, Artificial Sequence
  derived and/or modified CDS sequence (opt6) from DENV-3__FJ182041__SS-prME
acuucacuuuguuuaaugaugauucuacccgcugcacuugcguuucacuuaaccagccgagauggagagccucgaaugauaguggguaaaaacgaacguggaaaaucuuuacucuuuaaaacugcaucgggaaucaauaugugcacgcuaauagcaauggaucuaggugaaaugugugaugauacuguaacauacaaauguccucacauugcagaaguugaaccugaagacauugacuguugguguaauuuaaccucaacauggguuacuuacggaaccugcaaucaggcaggcgaacauagacgcgauaaaagaucuguugcacuagcaccgcauguaggaaugggguuagauacgcgaacccaaacuuggaugucugcagaaggagcauggagacaaguagaaaaaguagaaacuugggcacugagacauccaggauuuacgauucuagcucucuuucuggcacacuauaucggaacgucgcuaacccagaaaguaguuauauuuauuuuacuaaugcuaguaacuccaucaaugaccaugagaugcguugguguaggaaaucgagauuucguggaaggccuaaguggagcaaccuggguagauguaguccuggaacacggagguugcguaacaacuauggcuaaaaacaaaccaacucuggauauagaauuacagaaaacggaagcgacgcagcuagcuacucucagaaaauuauguauagaagguaaaauaacgaauauuaccacugauucucgcuguccaacucaaggugaagccgucuuacccgaagaacaagaccagaauuaugucugcaaacacacauaugucgauaggggauggggaaacggaugugguuuauuuggaaaagguaguuuggugacaugugcaaaauuucaaugccuagaaccaaucgaaggaaaaguaguacaauaugaaaaccucaaauauacaguaauuauaacaguacacacaggagaucaacaucaaguuggaaaugagacacaagguguaacugcugaaauaacaccacaagcaagcacaacagaagcgauacuucccgaguacggaacacuaggauuagaauguucaccucgaacagguuuagauuuuaacgaaaugauccuacuaacuaugaaaaauaaagcguggaugguacacagacaaugguucuuugaucuaccccuacccuggacaucaggagccacaacugaaacuccgacguggaaccguaaagaguugcuuguaacauucaaaaacgcucaugccaagaaacaagaaguuguuguacuagggagccaggaaggggcgaugcauaccgcccuaacaggugcaacagagauacaaaauuccggagggacgagcauauuugcaggccacuuaaaaugucgucugaaaauggacaaacuugaguuaaaaggaauguccuacgcuaugugcaccaacacuuuuguacuaaagaaagaggugagugaaacccagcauggaacaauccuuauuaaaguagaguauaaaggggaagacguuccuugcaaaauaccauuuuccacagaggauggucaagguaaggcucauaauggacgccugaucacggcaaaccccgugguuacuaaaaaggaagaaccaguaaauauugaagcagaaccaccauuuggggagucgaauauaguuauagguauuggcgauaaugcguuaaaaauuaauugguacaagaaagguagcucaaucggaaaaauguuugaagcaacagcuagaggggcuaggcguauggccauauuaggugauaccgccugggauuuuggaaguguaggaggagucuuaaauagccucggaaaaaugguacaucaaaucuucgguagcgccuauacagcguuguuuagcggaguaaguuggguuaugaaaauagguauagguguguuacuaacuuggauagguuuaaacuccaagaauacuagcaugaguuuuucauguaucgcuaucgggaucaucacuuuguauuuaggggcgguaguacaagcagacacaggcugcguaauuaauuggaaggggaaggaacuaaaauguggcucagggauauucguaaccaacgaagugcauacguggacagaacaguauaaauuucaagcugauucacccaaaagauuggcaacagcaaucgcgggggcaugggaaaauggugugugcggaauacguucaacuacacggauggaaaaucuccuuuggaaacaaauagcaaacgaacuaaacuauauacuaugggagaauaacaucaaauuaacggucguuguaggagauauuauaggagucuuagagcaggguaaaagaacccucacaccgcaaccaauggagcucaaguacucguggaaaacgugggguaaagcuaaaauagugacagcggaaacacaaaacaguaguuuuaucaucgacggcccuaacacaccugaauguccaucagcuucucgugcauggaacgucugggaaguugaggauuaugguuucggaguguuuacaacuaauauuugguuaaaacuccgagagguguauacacaauugugcgaucaccguuuaaugucagcagcugucaaagaugaaagagcgguacaugcugacaugggauauuggaucgaaucccaaaagaaugguaguuggaaacuugaaaaagccagcuugauugagguaaagacaugcaccuggccaaaaucacauacacucuggucaaacggaguucuagagucugacaugauaauuccgaaaagccuagccgggcccauaagccagcauaauuauagaccgggauaucacacacaaacggcaggucccuggcaccuaggaaaauuagaauuagauuuuaauuacugugaagggacaacaguaguuauaacagaaaacuguggaacaaggggcccuucacuaagaacaacaacaguuagcggaaaguugauacaugaaugguguugcagaaguuguacccuuccaccgcugcgauacaugggagaagaugguuguugguacggaauggaaauaagaccgaucagcgaaaaagaggagaauauggugaaaagccucguuucugcuggaucugguaaaguugauaauuuuacuaugggggucuuaugcuuggcuaucuuauuugaagaagugaugaggggaaaauuugguaagaaacacaugauagcgggaguguucuuuaccuuuguauuacuacucuccgggcagauuaccuggcgcgauauggcacacacauugauuaugauagggagcaaugcaagugaucguaugggcaugggggugacauaucucgcguuaauugcaacauucaagauacaaccauuucuagcuuuaggauucuuccuacgaaaacuaaccuccagagaaaauuuauuauuaggugugggacucgcuauggcuacgacucuacaacuacccgaagauauagagcaaauggcuaauggaauagcuuuaggccuaauggcacugaaguuaauuacucaauuugaaacauaccaacuguggacagcuuuaaucagucuaacaugcaguaauacaauuuucacacuaacaguagcauggcguacugcuacgcugauauuagcaggggugucgcuacugcccgucugccagucuuccucuaugcggaagucagacuggcuuccuaugaccguggcggcuaugggaguaccuccuuuaccguuauucauuuucucucuaaaggauacauuaaaacgaagaucuuggccucuaaaugaaggaguaauggccgucggacucguauccauucuugcgagcucauuguugagaaacgauguccccauggccggaccauugguugcuggugguuugcugauagcgugcuacgucaucacagggacaagugcagauuuaacggucgagaaagcagcagacgucacgugggaggaagaagcagaacaaacggguguaucacauaaccugaugauuacaguugaugaugauggaacuaugcgaauaaaagacgacgaaacggaaaauauccugacaguucuucuaaaaacugcauuauuaaucgucuccgggauauuuccuuacaguauuccugcaacacuacugguauggcacacuuggcaaaagcagacacaacggucaggaguuuugugggauguuccauccccaccugagacucaaaaagccgagcucgaggaaggugucuacaggauuaaacaacaaggaauauuugggaaaacgcaaguuggugucggagugcaaaaagaagguguuuuccacacuauguggcacguaacucguggagcggugcucaccuacaauggcaagcgauuagaaccuaauugggcuucuguuaagaaagacuuaauaucuuauggaggaggguggcgcuugucugcucaauggcaaaaaggagaggaaguacaagugaucgccguagaaccgggcaaaaacccaaagaauuuucaaacaaugcccgguacauuucagacuacaacaggagaaauaggcgcuauagcucuggacuuuaaaccgggcaccucuggaagucccauaaucaacagagagggcaaggucguuggauuauauggcaacggcguaguaacuaaaaauggcgguuaugucucaggaauagcacaaacaaaugcagaaccagauggcccaacuccagagcucgaagaagaaauguucaaaaagagaaaucuaacaaucauggauuuacacccagguagcggcaagacaagaaaauaucuaccggcgauuguuagggaagcaauaaaacgaagacuacguaccuugaucuuagcaccaacucgagugguagcagccgaaauggaagaggcauugaaaggacuucccauacguuaccagacuacagccacuaaaagugagcauacugggcgggaaauagucgaccucaugugucaugccaccuuuacaaugcgccuucucucuccuguccgcguaccaaauuauaaccuaauaaucauggacgaagcacacuucacggacccagcaaguauugcugcacggggguacauuaguacaagaguugggaugggcgaagcugcagccaucuuuaugaccgcgacuccuccagggacggcugacgcguucccucagaguaaugcgccgauacaagaugaagaaagagauauaccugagagaucuuggaauagcgguaacgaauggauaaccgacuucgcuggaaaaacuguaugguuugugccaaguauuaaagcagguaacgauauugcaaacugucuacguaaaaaugggaagaaagucauacaacuaucaagaaagacuuucgacacagaguaucagaagacaaaauuaaacgauugggacuucguaguaaccacugauauuagugagaugggugcuaauuuuaaggcagauaggguaauagacccaagacgauguuuaaaaccaguuauauuaacugauggacccgaaagaguaauauuagcuggaccaaugccaguaaccgccgcaagugcggcucaacgcagaggaagaguaggucgaaauccacaaaaggagaacgaucaauacauauuuacgggccaaccguuaaacaacgaugaggaucaugcacacuggacggaagcuaaaaugcuguuagauaacauaaauacgccagaaggcaucauaccugccuuguuugagccagaacgcgagaaaucagccgcuauugacggggaauauagacucaaaggagaaucccguaagacauuugucgaacucaugcgcagaggagauuuaccgguaugguuagcccauaaaguugcgagugaagguauaaaauacacagauagaaaauggugcuuugauggacaaagaaacaaccaaauuuuggaggaaaacauggauguggaaauauggacgaaagaaggagagaaaaagaaacugcgaccacgauggcucgacgcaaggacguauucggauccacucgcguuaaaagaauuuaaagauuucgccgccggucgcaaaaguaucgcccuugaucuagugacugagauuggucgaguaccaagucacuuagcccauaggacacggaacgcacucgacaaucucguaauguuacauaccagcgaacauggcggaaaggcuuaccgucacgcuguagaagaauuaccugagacaauggaaacguuacuauuacuagguuuaaugauauuguuaacaggcggggcgaugcuauuucuuauuuccgggaaaggcauaggaaaaacaucgaucgguuuaauuugcgucauugcuucaucuggcaugcuauggauggcagaaauuccacuacaauggauugcaucagccauaguguuggaguucuuuaugaugguccuacucaucccugaaccagaaaaacaacgaacuccucaagauaaucaauuagccuauguuguuaucgguauucucacucuagcagcaaucauagcugcgaacgaaaugggauuacuugaaacuacaaaacgagauuuaggaaugucaaaagaaccaggagucguauccccuacuucauauuuagauguggaucuucaucccgcaucggccuggacgcuauacgcaguggcuacgacagucaucacgccaauguugcgucauaccauugaaaauucaacggcaaaugugucccuagcugccaucgcgaaucaagcagugguauuaaugggacucgauaaggguuggccgaucucaaaaauggacuuggggguuccacuacuagcucucgguuguuauucgcaaguaaacccuuugacauugacggcugccguuuugcugcucauaacucacuacgcaauaauugggcccggcuuacaagcuaaagcaacaagagaagcacagaaacgaaccgcagcugguauuaugaaaaacccaaccguugaugguaucaugacaauugaccuggauccagucauauaugauucuaaguucgaaaagcaacuaggacaggugaugcuacuuguacugugugcaguacaauuauuacucaugcgaacuagcugggcgcuaugcgaagcauuaacgcuagcaaccgguccaauuacuacgcuuugggaaggcucuccgggaaaauucuggaauacaacgaucgcagucaguauggcgaacaucuuucgugguucguauuuggcaggggcaggacuagcuuuuagcauaaugaaaaguguuggaacugguaaaaggggcacaggcacacaaggagaaacauuaggcgaaaaauggaagaagaaacugaaucaacucucaaggaaagaguuugacuuauauaagaaaagcggcauaacagagguugaucggacugaggcaaaagaaggacuaaagagaggggaaauaacccaccaugccgucucgaggggcucugccaaauuacaaugguuuguagaaagaaacauggugauuccggaagguagggucaucgaucucggguguggcagaggagguuggaguuacuauugugccggauuaaagaaaguuacugagguacgugguuacacuaaaggaggaccuggacaugaggaaccaguacccaugaguacauacggauggaauauagugaaguugaugagcgguaaggauguauuuuacuuaccuccagaaaaaugugacacacuccuaugugauaucggugaauccucaccaucuccaacuguggaagagagucguaccauacgaguucuuaaaaugguagaaccguggcugaaaaacaaccaauuuugcauaaaaguguugaauccuuauaugccaacuguaauugagcauuuagaaagacugcaaaggaagcauggaggaauguuagugcgaaauccccugucgcgaaauuccacacaugaaauguacuggaucagcaaugguacugguaacauagucgcuaguguaaacaugguuuccagauuauuguuaaacagauuuacaaugacacacagaaggccaaccauagaaaaagauguugacuuaggugcgggaacaagacauguaaaugccgaaccggaaacaccuaacauggacguuauaggugaacgcauuaaacgaauaaaggaagaacauaauagcacuuggcauuaugaugacgaaaaucccuacaaaacaugggcauaucaugguucuuacgaaguaaaagccacggggagcgcgagcucaaugauaaauggaguuguaaaguugcuaacgaaaccuugggacguaguaccuauggucacacaaauggcaaugacggauacaacaccauuuggacagcagagagucuuuaaagagaaggucgacacgaggacaccuagaucuaugcccgguacgcgacgaguaaugggcaucacagcggaaugguuauggaggacuuuaggucgcaauaagaaaccacgucuauguacucgcgaggaauuuacgaagaaagucagaaccaaugcagcaaugggagccguauuuacggaagaaaaccaaugggauucagcgaaggccgcuguugaagaugaagauuucuggaaguuagucgacagagaacgagaacugcacaaacuuggcaaauguggauccuguguguauaauaugauggguaaacgcgaaaagaagcugggugaauuuggaaaagccaaaggaucaagggcuauaugguacaugugguuaggcgcacgauaucuagaauuugaagcguugggauuucuuaaugaagaccacugguuuagcagggaaaacucuuauucuggggucgaaggagaggguuuacauaaacuuggauacauacuucgagauauaucaaaaaucccagguggagccauguacgcagaugauacugcagggugggauacaagaauaacugaagacgaucuacacaaugaagagaagauaacccaacaaauggacccggagcauaggcagcuagcaaacgcgauuuuuaaauugacauaucaaaauaagguagucaagguucaaaggcccacucccaccggcacaguuauggauauuauuucacgaaaagaucaacgcggaaguggacaaguggguacauauggacuaaacacuuuuacaaauauggaagcacaacuaauacgacaaauggaaggugaaggagugcucucaaaggcggacuuagagaauccacauuuaagcgagaagaaaauaacucaauggcucgaaaccaaagguguugaaaggcugaaaagaauggcuauaaguggcgaugacuguguuguaaaaccaauagacgaucgauuugcgaaugcacuucuggcuuuaaaugauaugggcaaaguaaggaaagauauaccccaguggcaaccaaguaagggauggcaugacuggcaacaggugcccuucugcucucaccauuuucacgagcuuauuaugaaagacggaagaaagcuagucguaccuuguagaccacaagacgaacugauaggacgagcucgaauuagccaaggagcgggguggaguuuaagagagacagcauguuugggcaaagcguaugcccagauguggucgcuaauguauuuccaccgaagagacuuacgucuagcuucaaaugcaauauguuccgcagucccaguucauugggugcccacaucucgcacgacuuggucuauacaugcacaucaccaauggaugacaaccgaagacaugcuuacaguauggaaucgaguauggauagaagauaauccuuggauggaggauaaaacuccugucacaacuugggagaauguaccuuacuuggggaaaagagaagaucaaugguguggcagccucauuggacuaacaucccgugccacgugggcacaaaauauuccaacagccauccaacaggugcggagucuuauaggaaacgaagaguuucuugauuacaugccuagcaugaaaagauuucguaaggaagaagaaucggaaggagcaauuugguaa

SEQ ID NO: 23345 - RNA, 9873 nt, Artificial Sequence
  derived and/or modified CDS sequence (opt6) from DENV-3__FJ390371__SS-prME
acguccuugugcuuaaugaugauacuaccagcugcauuagcauuccauuuaacaucacgcgauggagaacccagaaugaucgugggcaaaaaugaaagagggaaaucauuauuauuuaaaacggcuucagguauuaauauguguacuuuaauagcgauggaucugggugaaaugugugaugauacaguuacauauaaaugcccccauauagcagaaguugaaccagaagauauagauugcuggugcaaccuaacaucuacaugggucacguaugggacguguaaucaggcuggagaacaccggagagauaaaaggaguguagcucuagcuccacauguggguaugggacuggauacacgaacacaaacauggaugucggccgaaggagcguggaggcaaguugaaaaaguagaaacgugggcauugagacacccuggauuuacaauuuuagcacuauuuuuggcacacuacauagggacaucccugacacagaaagucgucauauucauacuuuuaaugcuaguaacaccuaguaugacaaugagauguguaggugucggaaauagagauuuuguagaagggcuuucaggugcaacuuggguagacgugguccucgaacacgggggauguguaaccaccauggccaaaaauaaacccacgcuagauauugaacuacagaaaaccgaagcgacccaguuagccacuuugcgaaaacuuuguaucgaaggcaaaauaacaaauauaaccacagauucgcgauguccgacacaaggagaagcaguauugccugaagaacaagaucagaauuacguuuguaaacacacauauguagaccgaggauggggaaacggcuguggcuuauuuggaaaagguagucuugucacaugugccaaauuccaguguuuagaaccaaucgaagguaaaguaguacaauacgaaaacuugaaauauacaguaauuauuacaguccauacaggagaccaacaccaaguagguaaugagacucaaggugucacggcagaaauaacaccccaagcaucuaccacagaggccauccucccggaguacggaacgcuuggguuagagugcuccccaagaacugguuuagacuucaacgagaugauauuauuaacaaugaaaaacaaagcauggaugguucauagacaaugguucuucgacuuaccucucccuuggacuucuggugcaacuacagaaacgccgacuuggaaucguaaagaacucuuaguuacauucaaaaacgcacaugccaagaaacaagaaguaguaguguugggcagucaggaaggcgcaaugcacacagcuuuaacuggagcgacugaaauucaaaauucuggaggcacaucaaucuucgcaggucaccucaaaugucgacucaaaauggacaaacuagaauugaaaggaaugucuuaugcaaugugcacuaacacauucguucuuaagaaagaaguuucagaaacucagcacggaacgauauugaucaaaguugaguacaaaggagaagaugcucccugcaaaaucccuuuuagcacagaagacgggcagggaaaagcucauaauggucgauugauuacggcaaaucccgucguuacuaagaaagaagaaccaguuaauauagaggcagagccacccuucggagaaucaaauaucguaauagguauuggagauaaugcgcuuaaaauaaacugguacaagaaaggcucaaguauaggaaaaauguucgaagcaacugcaagaggcgcacgacgaauggcaauacucggagauacagccugggauuuuggcucuguugguggaguacucaauucauuagggaaaaugguucaccagauauuugggagugcauacacugccuuauucucaggaguuagcuggguuaugaaaaucggaauuggugugcuccuaacauggauuggauuaaacagcaaaaauacgaguaugucauucucauguauagccauuggcauaauaaccuuauauuuaggggcuguaguccaagcagacaccgggugcguaauaaauuggaaaggaaaagagcuaaaaugugguucagggauauucguaacaaaugaaguacacacauggacagaacaauacaaauuucaagcugauaguccuaaacggcuggcgacagcaaucgcaggcgcaugggaaaauggcguaugcggcauacggucuaccacaagaauggaaaaucugcuuuggaaacaaauagcaaaugagcuuaacuauauacuuugggaaaacaauauaaaacucacuguagucgugggagauauuaucggagugcuagaacaaggaaaacgaacauuaacaccacaaccaauggagcugaaguauagcuggaaaaccuggggcaaagcuaaaaucguaacugcagaaacccaaaauaguaguuuuauaauugaugggccaaauacaccugaaugucccucagccucucgcgcguggaauguaugggaaguggaagacuauggguucgguguauuuacuacaaacauauggcuaaaguuacgagaagucuauacccagcuaugugaucauagacuaaugagcgccgcugugaaagaugaaagagcgguacaugccgacaugggauauuggauugagagucagaaaaaugguaguuggaaauuagagaaggcaucccuuauagagguuaaaacauguacuuggccaaagucacauacacucuggagcaacgguguauuggagucagacaugaucauacccaaaucauuggcuggaccuaucucacagcacaauuauagacccggguaucauacgcaaacugcagggcccuggcaccuuggaaaacuugagcuggauuucaauuauugugaagggacaacaguugugauuacagagaauugugguacucgaggaccaucucucaggacaacaacugugaguggcaagcuaauacaugaauggugcugccgaaguugcacucuaccgccacuucgauacaugggagaagacgguuguugguacgguauggaaauaaggccaauuagcgaaaaagaagaaaacaugguuaaaucguuagugucugcgggauccggaaagguugauaauuuuacuaugggaguauuaugucuagccauacuguucgaggaaguaaugagggguaaauuugggaagaaacacaugauagcuggagucuucuuuacuuucguucugcuucuaucgggucagaucaccuggcgggacauggcucacacccuuauaaugauaggaagcaaugcaagugacagaauggguaugggggucacuuaucuagcauuaauugcuacauuuaaaauacagcccuuccuugcccuaggguucuuccuaagaaaauuaaccucccgugagaaucuauuauuaggcguuggguuagccauggccacuacuuugcaacuaccugaagauauugaacagauggcaaacgguauugcacuugguuuaauggcucuaaaauuaauuacucaauuugaaacauaccaacuauggacagcccugauuaguuugacauguagcaauacaauauuuacucuuaccgucgcauggagaaccgcaacguugauacucgcuggcgucagucugcugccugucugucagucauccaguaugagaaaauccgacugguuaccuaugaccguagccgcaaugggaguacccccacucccauuauuuauuuucucacuaaaagauacgcuaaagagaaggaguuggccguuaaaugaaggaguaauggcaguuggacuuguaaguauucucgcaucaucacuccuaagaaacgauguaccuauggcaggaccccuaguagcagggggucuccuuauugcauguuauguaauaacggguaccucugcugaccuaacaguugagaaagcugcugaugugacaugggaagaggaagcagagcaaacaggaguaucacauaacuuaaugauaacaguugaugacgacggcacuaugaggaucaaggacgaugagacagagaacauucuuacaguucuauuaaaaacagcauuauuaaucguaaguggcauauuuccauauucaauacccgcaacccuauuaguauggcauacuuggcaaaaacagacuagaagaaguggaguauuaugggauguacccuccccucccgagacgcaaaaggccgagcuagaagaaggcguauauaggauaaaacagcaaggcaucuuuggaaaaacacaaguaggaguagggguacaaaaagagggcguauuccauacgauguggcaugugacuagaggagccguucugacauauaacggaaaacgguuagaaccaaauugggcuagugucaagaaagacuugauaaguuaugguggaggguggagacuaucugcgcaguggcaaaaaggcgaagaaguacaaguaauagcuguagagccaggcaaaaaucccaaaaauuuccaaaccaugccugggacuuuucaaacaacaaccggcgagauuggagcuauagcguuagauuucaaaccaggcaccucggggucgccuaucaucaacagagaggguaaaguuguaggcuuauacggaaaugggguaguaacaaagaacggugguuauguauccgguauugcucaaacuaacgcagaaccugaugguccaacacccgaauuagaagaagagauguuuaaaaagcgcaauuuaacaauaauggacuugcauccgggcuccggaaaaacacguaaauacuugccagcuauuguacgagaagccauaaagcgaagauuaagaacccuaaucuuggcacccacaagggugguagcagcugagauggaagaagcucuuaaaggccuaccgauaagauaccaaacaacagcaacaaaaagugaacauacgggcagagaaauuguagaucuuaugugccacgcuacauuuacaaugagacuacucucaccgguacguguuccuaauuacaaucucaucaucauggacgaggcccauuuuacugacccagcaucuauagcugcgagagguuauauaaguacaagaguaggaaugggggaagccgcugcgauuuucaugacagcuacuccuccugguacggcugacgcuuucccacagaguaaugcgcccauacaagacgaagagagagacauaccugaaagaucguggaacaguggaaaugaauggauuacagauuuugcaggaaaaacugucugguucguaccaaguauuaaggcggguaaugauauugcaaacugcuugcgaaagaauggaaagaaagucauacaauuaagcaggaagacguuugauacagaauaccaaaagacgaaacuaaaugauugggacuuugugguaacuacugacauuucggaaaugggagcaaacuuuaaagcugauagagucauagacccuagacgaugucuaaaacccguuaucuuaacugaugguccugagcgcguaauauuggcaggaccuaugccaguuacagcagcguccgcagcccaaaggagaggucgggucggcaggaauccacagaaagaaaaugaccaauauauauuuacagggcaaccgcugaacaacgaugaggaucaugcccacuggacugaagcaaaaauguuacuagauaacauaaacacaccugaagguauaauaccagcgcuauuugaaccugagcgugagaagucugcggcaauagacggagaguauaggcugaagggagaaucucgcaaaacuuucguagagcugaugaggcgaggcgacuuaccagugugguuagcacauaaaguagcaagugagggcauaaaauauacugacagaaaaugguguuucgauggacaaaggaauaaccaaauucucgaagagaauauggauguagaaauauggaccaaagagggggaaaagaagaaauugaggcccaggugguuagaugcaagaacauacagcgauccauuagcauuaaaggaguucaaagacuucgccgcaggaaggaaaucuaucgcuuuagaucuaguaacagaaaucggucgcguuccuucacauuuagcacaucgaacccguaaugcuuuggacaaucugguaaugcuacacaccuccgaacauggagguaaagcauaccgucaugcgguggaagaacugccagaaacgauggaaacacucuuacuucugggccuaaugauuuuacuaaccggaggugcuauguuauuccuaaucagcgguaaaggaauaggaaagaccucaauuggauuaauaugcgucauugcuaguucaggcaugcuauggauggcagaaaucccccuucaauggaucgcaagugcaaucguuuuggaauuuuucaugauggugcuauuaauaccugagccagagaaacagcgaacgccccaagacaaucaauuagcuuacguuguaauaggaauccucacccuagcugcgaucauagcagcgaaugaaaugggacuuuuagaaaccaccaaaagggacuuagguaugaguaaagagccaggaguuguaagcccaacuagcuauuuggacguugaccuacacccagcaagcgccuggacauuauacgccguagcaaccacgguaauuacucccaugcuucgacauacaaucgaaaauaguacagcgaacgucucguuggcagcuauugcgaaucaggcaguuguccuaaugggauuagacaagggguggccuaucucuaagauggaccuaggcguuccauuauuagcucuaggauguuacucucaagucaacccauuaacuuuaacagccgcuguucuucuauugaucacucauuaugcgauaauugggccaggauuacaagcaaaggcaaccagggaagcucagaaacgaacugcggcgggcaucaugaaaaaccccacaguagauggaauaaugaccauagaucuugauccagugauauaugauucuaaauuugaaaaacagcucggucagguuauguugcuaguccuaugcgccguucaacuauuauuaaugagaacaucaugggccuuaugugaagcauugacccuagcaaccggaccgauaacuaccuuaugggaagguucuccgggaaaguuuuggaacacaacaaucgcuguaucaauggcaaacauuuuuagagguucguacuuggcgggugccgggcuugcauuuaguaucaugaaaucaguugggaccggaaaacgcgguaccggaagccagggugagacccuuggggaaaaauggaaaaagaaauugaaucaacugucucguaaagaguucgacuuauauaaaaagucagggauaacagaaguagaucgaacagaggcaaaggaaggucuaaaacgaggcgaaauaacccaucacgcagugucccgaggaucugcgaaauugcaaugguucguagagcgaaauauggucauccccgagggcagaguuauagaucuugguugcggacgagguggauggucuuauuauugcgcgggacuaaagaaagugacagaagugcgaggguacaccaagggaggcccaggucaugaagaaccgguacccaugucuaccuaugguuggaauauuguaaaauuaaugucgggcaaagacguauuuuaccugccgccugaaaaaugcgauacuuuauuaugugacauaggagaaagcaguccaaguccuacaguagaagaaagucguacuauacgaguauuaaaaaugguagaaccauggcucaaaaauaaucaguuuuguauaaaaguccuaaacccguauaugccgacaguaauugaacaccuggagcguuuacaacgaaaacacggcgguauguuagugcgcaauccauuaucccgaaauucuacacaugaaauguauuggauuuccaacgguacagguaauauaguagcuagcgucaauauggucagcagacuacuacuuaaccgauuuaccaugacccauagacgaccuacaauugagaaagauguggaucucggagcuggcacucgccacgucaaugcagaacccgagacacccaauauggacguaaucggagaacgcauaaagaggauaaaagaagaacauaacucgacuuggcauuaugaugacgaaaauccuuauaaaacaugggccuaccauggaucauacgaagugaaagcuaccggaagugcuagcucuaugauaaacgggguaguuaaacuauuaacgaagccaugggauguggucccaaugguaacccaaauggcuaugacagauacaacaccguucggacaacaacgaguauuuaaagaaaaaguugauacccgaaccccaagauccaugccagggacacgacgagucauggguauaacggcagaauggcucuggagaacuuuaggcagaaacaagaaaccuagacuuugcacucgagaagaguuuacgaagaaaguacggacaaacgccgcgaugggagcuguuuucacagaggaaaaucaaugggauuccgcaaaagcugccguggaagacgaggauuucuggaaauuaguugaucgugagagagaauuacacaaauuggggaagugcgggucauguguuuauaacaugaugggaaaaagggagaagaaacuaggagaguucgguaaagcaaaaggcucaagagcuauaugguauaugugguuaggggcacgauaccuagaguucgaagcucuuggauuuuuaaacgaggaccauugguucagccgagaaaauucauacagcggaguagaaggggagggauuacacaaacugggguauauacuaagagacauaaguaagauaccuggaggcgccauguacgcggaugauacagccgggugggauacacguauuacagaagacgaucuucacaacgaagagaaaaucacucaacaaauggacccagagcaucggcaacuggcuaacgcuaucuuuaaguugacauaucagaacaaggucguuaaaguucaaagacccacgccaacaggaacaguuauggauauuauaagccguaaagaccaaagaggaucgggacaagugggcacguacggcuuaaacacuuuuacuaacauggaagcccaauuaauaaggcaaauggaaggagagggaguacuaacaaaggcagaucuagaaaauccucauuugucugagaagaaaauuacucaguggcuugaaacuaagggaguagaaagauuaaaaagaauggcgauauccggugaugauuguguuguaaaaccaauagacgaccgauuugcaaaugcauuauuagcguugaaugacaugggcaaagucaggaaagauauuccacaauggcaaccaagcaaaggguggcaugacuggcaacaaguaccauucugcucucaucacuuucaugaguuaaucaugaaggacgggaggaaauugguuguaccaugucggccacaagaugaauuaaucggcagggcuagaauaucccaaggugcaggcuggucucuucgugaaacagcaugucuuggaaaagcauacgcgcaaauguggagucuaauguauuuucauagacgugauuugcgauuagcaucgaacgccaucuguuccgccguuccugugcauugggucccuacaagucgcacaacaugguccauacaugcucaccaccaauggaugacgacagaagacauguuaacagucuggaaucguguauggauugaggacaauccuuggauggaagauaaaacuccuguuaccacuugggaaaacguuccguacuugggaaaacgggaggaucaguggugcgguagcuugauagggcugaccucaagggccacaugggcacaaaauauacccacugcuauacaacaagucaggagccucauaggcaacgaagaguuuuuagauuacaugccgucaaugaagagguuucgcaaagaagaggagucagagggggcaauuugguag

SEQ ID NO: 23346 - RNA, 9873 nt, Artificial Sequence
  derived and/or modified CDS sequence (opt6) from DENV-3__FJ390372__SS-prME
acuagcuuaugcuuaaugaugguucuaccugcagcauuagccuuucaccugaccucccgugacggagaaccuaggaugauuguggguaaaaacgaaagggggaaaagucugcuauucaaaacagcauccgguauaaauauguguaccuuaauugcuauggaccuuggugaaaugugcgaugauacuguuaccuauaaaugcccucacauuacugaaguggaaccugaagacauagacuguuggugcaacuugaccucaacauggguaacauacgggacaugcaaccaagccggugagcacagaagggauaaaagaucgguugcccuagcuccucacguaggaauggggcuugacacaagaacacaaaccuggaugagcgcugaaggagcuuggaggcagguugagaaaguggaaacaugggcucugagacauccaggcuuuacuauacuagcccuauuucuagcacauuauaucggcacaaguuuaacacaaaaaguaguuauuuuuauauuauuaauguuaguuacaccaucaaugaccaugagauguguaggcgucggaaacagagacuuugucgaggggcuaucaggcgcuacauggguagauguaguauuagaacacggcggaugugucaccacuauggccaaaaacaaaccuaccuuggacauagaacuucagaaaacagaagccacucaacuagccacacuaagaaaacuauguauugaagguaaaauaaccaauauaacuacagacucccggugccccacgcaaggggaggcgguguuaccagaagaacaagaucaaaauuauguguguaaacacacauacguugaucggggcuggggaaacggauguggcuuauuuggcaaaggcucgcuaguaacaugugcaaaauuucaguguuuagagccgaucgaagggaaaguuguucaauacgaaaaucuaaaauacacaguaauaauaacaguacacacgggugaucaacaucagguaggaaaugaaacucaaggagugacagcagaaauaacaccacaagcuagcacaacagaagccauacuaccugaauacgggacccuaggucucgaaugcagcccucguaccggacuugacuuuaaugagaugauacuucuuacaaugaaaaauaaagcauggaugguacauagacagugguucuucgacuuaccacucccauggacuagcggcgcaacuacggaaacgccaacauggaaucgcaaagagcuucuagucacuuucaaaaacgcgcacgccaagaaacaagaaguuguaguauuaggcucacaagaaggugcuaugcacacagcucuuacgggcgccacugagauacaaaauaguggaggaacgagcaucuucgcgggucauuuaaaauguaggcuuaaaauggauaaauuagaacucaaaggcaugucguaugccauguguacaaauacuuucguccucaagaaagaagucucagaaacucaacacggaaccauccugauaaaaguagaguauaaaggugaagaugcaccaugcaaaauaccguuuaguacggaagauggacaaggaaaagcacacaauggcagauuaauaacggcuaacccuguagucacuaagaaagaagaaccaguaaauauagaagcugaaccaccguucggcgagucuaauauaguaauugguauuggcgacaaugcauuaaaaauuaacugguauaagaaagguaguagcauaggaaaaauguucgaggcgacagcacgaggagccaggcguauggcaauauuaggggacacggcuugggauuuugguaguguaggcgguguucucaauagccuaggcaaaaugguucaccaaaucuuugggucagccuacaccgcguuauuuaguggugucagcugggucaugaaaauagggauaggaguucuacucaccuggauaggauuaaauaguaaaaacacgucaaugucauucaguuguaucgcuauugggguaauaacauuauauuuaggagcaguaguccaggccgacaugggaugcguaaucaacuggaaaggaaaagaauuaaaauguggcucaggaauuuucgugaccaaugaaguccauacguggacugaacaauacaaauuccaggccgauaguccuaaaaggcuagccaccgcaauagcaggagcaugggaaaacgguguaugugguauaagaucuacgaccagaauggagaaucuacuauggaaacaaauagcaaacgaacuaaauuauauauugugggaaaacaauauaaaauuaacuguaguaguaggggauauaauuggaguccuugaacaaggcaaaaggacccuaacaccacagccaauggagcugaaauacucguggaaaacuugggguaaagcgaaaaucguaacugcagaaacacaaaauucuaguuuuauaauagauggaccuaacacuccagaaugccccagcgcgagcagagcauggaacgucugggaaguagaagauuauggauuugguguauuuacaacuaauauuugguuaaagcugcgggaaguuuacacccaauuaugcgaccauaggcuaaugucggcugcaguaaaggaugaacgagcgguccacgccgacauggguuacuggaucgaaagccagaagaaugguaguuggaaauuagaaaaagcaucgcucauagaaguaaaaacauguacguggcccaaaucacauacuuuguggucgaacggugugcuagagucugauaugauuauacccaaaagccuagcgggacccauuagucaacauaaccacagaccuggguaucauacucaaacagcaggaccauggcaccuggguaaacuagagcuagacuuuaacuacugcgaagguacaacgguaguuauuacagaaaauugugggacacgaggaccguccuuaagaacgaccacagugagcgguaaguuaauacacgaguggugcuguagaucuugcacguuaccgccauuaagauauaugggggaagauggcugcugguacgggauggaaauaagaccgauuuccgaaaaagaggaaaauaugguuaaaagucuugugucggcggguucaggaaagguagacaacuuuaccaugggaguacuaugccuugccauuuuauucgaggaggugaugcgcgguaaauuuggcaagaaacacaugauagccggcguauucuuuacauuuguguuauuguuaaguggacagauuaccuggagagauauggcccacacguugauuaugauagguucaaaugcaagugauaggauggguaugggagugaccuauuuagcucuaauugcuacauuuaaaauccaaccauuuuuagcauuggguuucuucuuaagaaagcugacaucaagagagaaucuauuguuagguguaggauuagcuauggccacuacauuacaauuaccugaagauauagaacagauggcuaacggaauagcauugggccuaauggcccuaaagcuaauaacacaauuugagacauaucaacucuggacagcauuaaucagucugacuuguagcaauacaauguuuacacuaacuguagcauggcguacugcgacguugauauuagccggaguaagucuucucccaguaugccagagcagcaguaugagaaaaacggauuggcuacccauggcaguggccgcaaugggagugccgccacuaccuuuguuuauauuuucacuaaaagauacccuaaaaagaagaucguggcccuuaaacgaaggcguaauggcggugggccuugucucuauccucgcgaguagucuccuacgaaaugauguuccaauggccggaccccuuguugcaggcgggcuauuaauagcauguuauguuaucacggguacaagugccgaccuuacgguggaaaaagcagcggauauuacuugggaagaagaagcagagcaaacugguguaucacacaaccuaaugauuaccguagacgacgaugggacaaugcgaauaaaagacgaugagacagagaacauacuaacaguacuacugaaaacugcauugcugaucguaaguggggucuucccauauucaauaccagcuacucuguuggucuggcacacuuggcagaaacagacccagcguuccggcguacuaugggauguacccucacccccagaaacucaaaaggcagaauuagaggaaggaguguacaggauaaaacagcaagggauuuucggaaagacucaaguaggaguaggggugcaaaaagaagggguguuccauacuauguggcaugucacuaggggcgcuguccuaacguacaauggaaagaggcuagaacccaauugggcuuccgucaaaaaggauuuaauuagcuauggaggaggauggagauuaagcgcacaauggcaaaaaggcgaagaagugcaagugauugcgguugaaccgggcaaaaaccccaaaaacuuucaaacaaugccugguacauuccaaacaacaaccggugaaaucggagcuauagcucuugauuucaaaccaggaacgagcggaucgcccaucauaaaccgggaaggaaaaguuguuggccucuacgggaauggcgugguuacaaagaacggaggauacguuagcggaauagcacagaccaaugcagaaccugaugggccaacaccugagcuugaggaggaaauguuuaagaaaagaaauuuaacaaucauggauuugcauccgggauccggaaaaacgagaaaguaucucccugcaauagucagagaagcaauaaagcgacgacuucggacacuuauauuagcgccuacuagaguaguggcagcggagauggaagaagccuuaaaagguuuaccuauucgguaucagacuacggcaaccaaguccgaacauacgggaagagagauuguagaucucaugugucacgcuaccuuuacuaugcgucuccuuucaccgguucgaguaccaaacuauaaccugauaaucauggaugaagcacauuuuacagauccagcaucuauugcugcaagaggguacauaucaacaagagucggaaugggagaggcugcagcaauuuuuaugacagccacaccaccuggaacagcagaugcguuuccacaaucaaaugcaccaauucaagaugaggagaaagacauaccugaacgaaguuggaauaguggaaaugaauggaucacagauuuugcugguaaaacugugugguucguaccuucuauuaaagccggaaaugauauagcuaauugucuuagaaagaaugggaagaagguaauacaguugucucgcaagacauucgauaccgaauaucagaaaacaaaauuaaacgacugggauuuuguuguaacaacagacauauccgaaaugggagcgaauuuuaaggcagacagaguaaucgacccaagaagaugucucaaaccaguaauacuuacggauggacccgagagagugauauuagcagggcccaugccggucacagcagcaucggccgcacaaagacgaggacgcguugggagaaauccacaaaaggaaaacgaucaauauaucuucacuggucagccacuaaauaacgacgaagaucaugcucauuggacugaggccaaaauguuauuggauaacauaaauacuccagaaggcauaaucccggcauuauuugaaccggaaagagagaaaagugcggcuauagacggggaguacagacugaaaggagaaucccgaaagacauuuguagaacuaaugcgaaggggagaucuaccaguauggcuagcucauaagguagcuucagaaggaauaaaguacacagauagaaagugguguuuugauggucagagaaauaaucaaauacuggaggaaaacauggaugucgaaauauggacaaaagaaggcgagaagaagaaauuacgaccacgauggcuugaugcucggacauauuccgacccccuagcauuaaaagaguuuaaagacuuugcagcuggaagaaaaagcauagcauuagaucuaguaacagaaaucgggagaguaccgagucaccucgcccaucgcacaagaaacgcacucgacaauuuagucaugcuacauacguccgagcacggaggacgggcuuaccgacacgcuguagaggaauugccagagacuauggaaacuuuguuacuccugggacucaugauucucuuaacggguggagcaaugcucuuuuugauaagcggaaagggcauagguaaaacaucgauuggauugauauguguuauugcaucaaguggaaugcuguggauggcagaaaucccccuacaauggaucgcaucugccauaguauuggaguuuuucaugaugguauuguuaauacccgaaccagaaaaacaacgaacaccccaagauaaucagcuggcguacgugguuauagggauucugacguuagcugcaaucauugcagcaaacgaaaugggacugcuggaaacuacaaaacgagauuuagguaugagcaaagagccaggugucguaaguccaacgucauauuuagaugucgaucuacauccugcaagcgcuuggacuuuguacgcaguggcuacaacagucauaaccccaaugcuuagacacacaauagaaaauucaacagcuaacguuucgcuagcagcaauugcuaaucaggccguaguauuaaugggucucgacaaaggcuggccaauaaguaaaauggauuuaggaguacccuugcuagcuuuagguuguuacagccaagugaacccucuaacguuaacggcugcaguccuauuacuaauaacgcauuacgcaauuauaggaccgggauugcaagcgaaggcgacccgagaggcucagaaacgaacugcagcuggaauuaugaaaaacccaaccgucgaugggauuaugacaaucgaucuagacccagugauuuaugauucaaaauuugagaagcaauugggacagguaaugcuccuagucuugugugccguacagcuauuacuaaugagaacaucaugggcacuuugcgaggcguugacauuagccacaggaccaauaacaacccugugggaagggucgccggguaaauuuuggaacacgacaauagcaguaaguauggcaaauauuuucagaggaucauacuuagcaggggcagguuuagcauuuucuauuaugaaaucuguagggaccggcaagagaggaacaggcagccaaggggaaacacucggggaaaaguggaagaagaaauugaaucaguuaucacgaaaagaauuugaccuauacaagaaaucuggcauuacugagguugacagaacagaagcaaaggaaggauugaagcguggugagacuacucaccacgcuguaucacgcggcaccgcaaaacuucaaugguuuguugagaggaauaugguaaucccugaaggcaggguuauugaccuagggugcggaagaggaggguggaguuacuauugcgcaggccucaagaaaguaacagaggugcgaggguacacgaaaggcgguccaggacaugaagaaccaguuccuaugagcacauauggguggaacaucguuaagcugaugucugguaaagauguauucuauuuaccaccagaaaaaugugacacucuucucugugacauaggcgaaagcucaccaucacccacugucgaagaaagcaggacgauucgagugcuuaaaaugguagaaccguggcuuaaaaauaaucaauucuguauaaaaguucuuaacccauauaugccaacaguaauugaacauuuagagcgacuacagagaaaacauggagguauguuggugcguaauccucugucuagaaacucaacucacgaaauguauuggauuaguaacggaacuggaaacauaguagcuucaguuaacaugguuuccagacuauugcuuaauagauucaccaugacacacaggagaccuacaauagaaaaagacguggaucugggggcaggaacaagacacguaaacgcugaaccagaaaccccgaauauggauguaauaggcgaacgcauaaaaagaauaaaggaagaacacaauucuacuuggcauuacgacgaugaaaaccccuacaaaacuugggccuaucauggaucuuaugaagucaaagcuacgggcagugccucuuccaugauaaauggcguaguaaaauuauuaacuaaaccaugggacguaguaccaaugguaacacagauggcaaugaccgauacgacaccguuuggucaccaaagaguauuuaaggagaaaguagauacuagaacgccacggucuaugcccgguccgaggagagcgaugggaauaacagcugaauggcuauggagaacccuuggaagaaacaagaaacccagguuaugcacacgugaagaguuuacuaagaaaggacguacuaacgcagcgaugggugccguuuuuacggaagaaaaccaaugggauucggcaaaggcggcuguagaagaugaagacuuuuggaaauuggucgauagagaacgugaacuccauaaacuuggaaagugcgggucuuguguuuacaauaugauggggaagagagagaagaaacuaggugaguuuggaaaggccaaagguucucgagcaaucugguacaugugguuaggagcacgcuaucuggaauuugaagcgcuaggauuccuuaaugaagaccauugguuuucaagagaaaauagcuacucagggguagaaggcgaggguuuacauaaacucggcuauauacugagagacaucagcaaaauccccgguggagcaauguacgccgacgccacugcagguugggauacccgcauuacagaagaugaccuucacaaugaagagaaaaucacucaacaaauggauccagaucauagacaacuagcgaccgccauuuuuaaacucacuuaucaaaauaaagucgucaaaguccagagaccgacaccaacaggaaccguuauggauauaauuuccagaaaagaccagcgaggcuccggacagguggguaccuauggucuaaacacauucacaaauauggaagcacaacuaauucgacagauggaaggagagggaguguuaagcaaggcugaccuugagaauccucacuuacccgaaaagaagauuacacaaugguuagaaacaaaggggguggaaaggcuuaggcgcauggcaauuucgggcgaugauugcguuguaaaaccaauagaugauagauucgcaaaugcccuucuagcacuuaaugauauggggaaagucagaaaagacaucccacaauggcaaccuucaaagggauggcacgacuggcaacaaguccccuucuguucgcaucauuuucaugaacuaauaaugaaagacggaagaaagcuagucguaccguguagaccucaagaugaauuaauugggagggcaaggauuucgcaaggugcaggcuggaguuuaagggaaacugccuguuuaggcaaggccuaugcgcaaauguggaguuuaauguacuuucaucgccgggaucuaagacucgcaagcaaugcuaucugcucagcuguaccaguacacuggguccccaccucacggacaacguggagcauacaugcacaccaccaguggaugacaacagaagauaugcuuaccguuuggaaccgcguauggauagaagauaacccuuggauggaagauaaaacuccuguaacaacuugggaaaauguaccauaccuaggaaaaagggaagaccaauggugugguucgcuaauagguuuaacaucacgugcuacaugggcccaaaacauuccaacagcaauacaacaaguuagaucuuuaauagggaaugaagaauuuuuggacuacaugcccagcaugaaacgauucagaaaagaagaagaaagcgaaggugcgauaugguaa

SEQ ID NO: 23347 - RNA, 9873 nt, Artificial Sequence
  derived and/or modified CDS sequence (opt6) from DENV-3__FJ205870__SS-prME
acuucguuaugcuuaaugaugauucugccugcagcgcuagcauuucauuuaacgucaagagauggagaaccgaggaugauaguuggcaaaaaugaacgcggaaaaucacuacuauuuaaaaccgcaucgggaauaaauauguguacuuuaauugcaauggaucuaggagagaugugugacgacacaguaaccuacaaaugcccucacauugcagaaguugaaccagaagacaucgauugcugguguaaccuaacuagcaccuggguuacauauggaaccugcaaucaagcaggagaacacaggcgggauaaacgaucuguugcgcucgcuccucaugugggaaugggauuagauacacgaacucaaacguggaugucagcagagggagcguggagacaaguugaaaaaguagaaaccugggcuuuacgucaccccggauuuacuauccuugcacuauuccuagcacauuauauuggaacuagcuuaacucagaaaguuguuauauuuauccuuuuaauguuagugacgcccuccaugacaaugagaugcgucggaguagggaaucgagauuuuguagagggacuaucaggagcgaccuggguagacguaguucuugaacacggugggugugucacuacgauggccaaaaacaaacccacccuggauauagaacuucagaaaacagaagcaacccaacuggcaacguuacgaaaauuauguauagaggguaaaauaacgaauauuaccacagauuccagaugcccaacacaaggggaggcuguguuaccugaggaacaggaucaaaauuauguaugcaaacacacuuaugucgacaggggauggggaaacggaugcgguuuguuugggaaagguagccuagugacaugugcuaaauuucaaugucuugaaccuaucgaagguaaaguaguacaguaugagaaccuaaaauauacgguaauaauuacaguucauacaggcgaucagcaccaaguagguaaugaaacacaaggagucacagcagagauuacaccucaggcuaguacaacugaagccauauuaccagaauauggcacacuagggcuagaguguagcccccgcacaggacuagacuuuaaugaaaugauccuucuuacaaugaaaaauaaagcauggaugguacaucggcaaugguucuuugacuuaccucuuccuuggacgucaggugcuacuacagaaaccccgacauggaauaggaaagaacuauugguuacauuuaaaaaugcgcaugcgaagaaacaggaaguaguaguacuaggaucucaagaaggugcaaugcacacagcacugaccggugcaacugaaauucaaaauuccgggggcaccuccauauuugcaggucacuuaaaaugccgacuuaaaauggauaaacuugaacuaaaaggcaugucuuacgcaaugugcacaaacacauucgucuugaagaaagaggugagugaaacgcaacacggaacaauauugauaaaaguagaguauaaaggugaagauguuccguguaaaauacccuucucuacagaagauggucaaggaaaagcacacaacgguaggcuuauaacagcaaaucccguuguaacgaagaaagaagaaccgguaaacaucgaagcugaaccaccauuuggagaaucuaacauuguaauagggauuggggauaacgcccucaaaauuaauugguauaagaaagggaguucaauaggcaaaauguuugaggcuacagcgcgaggggcuagaaggauggcuauccuaggcgacacagcuugggacuucggaagcguuggagguguucuaaauucucuuggaaaaauggugcaucaaaucuucgguuccgccuauaccgcuuuguuuaguggaguaucuuggguuaugaaaauaggaauugguguacuuuugacguggauaggucuaaacaguaaaaauacaucaaugucauuuagcuguauagccauuggaaucauaacacucuaccuaggggcuguaguacaagcggacaccgguugcgugauaaauuggaaagguaaagaauuaaaauguggaucugguauauuugucacgaacgaagugcacaccuggacagaacaguauaaauuucaggcggauucuccgaaacguuuagcaaccgccaucgccggugcaugggaaaaugguguuugugggauucguucaacaacgcgcauggagaacuuacucuggaaacaaaucgcaaacgagcuuaauuauauauuaugggaaaauaacauuaaauuaaccguuguaguuggggauaucauaggcauuuuagaacaaggcaaaagaacucucacaccccaaccaauggagcuuaaauacucguggaaaacuugggggaaagcaaaaauuguuacagccgagacacaaaacagcucuuuuauaauagacggcccaaauacuccggaaugcccauccgcauccagagccuggaacguaugggaaguggaggauuacggauuuggugucuuuacuacaaacauuuggcugaaacuccgagaaguauauacccaguugugugaccauagacuuaugucagcugccgucaaagaugagcgagcaguacacgcagauauggguuauuggauagaaucccagaaaaaugguuccuggaaacuggagaaagcaucacuaauugaagucaaaacuuguacauggccaaaaucgcauacucuauggaguaacggaguauuagaauccgacaugaucauaccgaaaucauuggcagguccuauuucgcaacauaauuauagaccuggauaucacacccaaacagcaggcccauggcaucuuggaaaacuggaacucgauuuuaauuauugugaggguacaacaguagugauaaccgaaaauugcggcacccgcgguccgucacuucggacaacaacaguuagugguaaauugauacaugaaugguguugccgcaguuguacgcuuccaccucuucguuacaugggagaagacgguuguugguacggcauggaaauaaggccaauuagugaaaaagaagaaaauauggugaaaagccuugugucagcaggcucuggcaaaguagauaauuucacaauggguguauuaugcuuagcaauacuauuugaagaaguaaugcgaggaaaauucgguaagaaacauaugaucgcgggaguauucuuuacauuuguacuguugcugaguggacaaauuaccuggagagacauggcucacacauugauaaugauaggcaguaacgcguccgaccgaaugggaaugggagugacuuaucuagcguuaaucgcaacguuuaaaauucaaccauucuuggcucugggcuucuuucuucggaaauuaaccucuagagaaaaucuacuacuggggguaggcuuagcuauggcaacaaccuuacaauuaccagaggacaucgaacaaauggcaaacggaaucgcccuagguuuaauggcguugaaauuaauaacacaguucgagacguaucaacuguggacagcauuaauuuccuugaccugcucaaacacgauuuuuacauuaacaguugccuggagaaccgcaacguuaauucuugcuggaguaucuauauuaccagucugucaauccaguagcaugcgaaaaagugauuggcuaccaaugacuguagcagcuaugggaguaccacccuuacccuuauuuauuuucucucuuaaagacacucucaagagaaggagcuggccgcuuaaugagggcguaauggcaguuggacuuguaagcaucuuagcaagcagccuacuacggaaugauguaccuauggcugguccauuaguagcaggggguuuacucaucgcguguuauguaauaaccggaaccucagcagaucuuacgguagagaaggcagcagacguaacuugggaagaagaagcagaacaaacugggguuucucauaaucuaaugauuacaguugaugacgacggcaccaugagaauaaaagaugaugaaacggaaaauauacuaacgguccuccugaaaacugcucucuuaauaguuagcggaauauuuccuuacucuaucccggcaacacuuuuagucuggcauacuuggcagaaacagacgaggcguucaggaguauugugggacguuccuuccccgccggaaacucagaaagcagagcucgaagagggcguauaucggauuaaacaacaggggauauucggaaaaacccagguuggcgugggcguccaaaaagaggggguauuucauaccauguggcauguaacgaggggugcagugcuuacauacaacgguaagagauuggaacccaauugggcuagugucaaaaaggaccuuauuucauaugguggagguuggcgacuaucagcacaguggcagaaaggagaagaaguucaaguuaucgcuguggaacccgggaaaaaucccaaaaacuuucaaacaaugcccggaaccuuucagacuacaacaggggagauuggggcgauugcauuagauuucaaaccagggacaagugggagcccuauaauaaaucgugaaggaaaaguaguaggucuguacggaaaugguguaguuacuaaaaacggaggauacguaucagguauagcacaaacgaacgccgagccggaugguccaacgccggaauuagaagaggagauguuuaagaaaagaaaccugacgauuauggaccuucacccgggaaguggaaaaacgagaaaauaucugccugccauagugagagaggcuauuaagaggcgauugcggacacuuauuuuagcucccacucguguugucgcugcggagauggaagaagccuugaagggcuuaccgauuagauaccaaaccacagccacgaaaucagaacauacaggaagggaaauuguugauuuaaugugucacgcuacauucacaaugcgcuuauuguccccuguaaggguaccuaacuacaauuuaaucauaauggaugaagcacauuuuacggaucccgcaucgauagcagcgagggguuauauaucaacaaggguaggaaugggcgaggccgcggccauauuuaugaccgcaacaccgccuggaacggcugacgccuuuccucaaagcaaugcaccaauacaggaugaagaacgggauauuccagaaaggaguuggaacucugguaaugaauggaucacugauuuugcaggaaaaaccguuugguuuguaccuucaauuaaggcaggcaaugauauagcuaacugucuucgcaaaaacggcaagaaaguaauacaauuaagucgaaaaacauuugacacagaauaucagaagacuaaauugaacgacugggauuuuguuguuaccacggacauaagugaaaugggggcuaacuuuaaagcugaucgcgucaucgacccaagacgcugcuuaaagccaguaauauuaacagauggcccugaaagggucauauuagccgggccaaugccuguuacugcugcauccgcugcacaacgacggggcagaguaggacgaaauccucaaaaagagaacgaucaauacauauuuacugggcaaccauugaauaaugacgaagaucacgcacacuggacagaagcaaaaaugcuucuugacaacauaaauaccccggagggcauaauaccagcccuauuugagccagaacgugaaaagagcgcagccaucgacggcgaguacagacuaaaaggagaaucuagaaagacguucguagaacuaaugcgcagaggagaccuaccggucugguuagcgcauaagguagcaucagagggcauaaaauauaccgauagaaaauggugcuucgacggucaaaggaacaaucaaauacuugaagagaauauggaugucgaaauuuggacuaaagaaggagagaagaagaaauugcggccaaggugguuagaugcaaggacauauagcgauccacuugcucugaaagaauuuaaagacuucgcagccgggagaaagucaaucgccuuggaucucguuacugaaauagguagaguacccucacaucuggcccauagaacuagaaacgcgcuagauaauuuagugauguuacacacaagcgaacaugggggcaaagccuauaggcacgccguagaagaguugccagagacuauggaaacauugcuauugcuuggccucaugauuuugcuaacggguggcgcuaugcucuuuuuaauaucgggaaaaggaauaggaaaaacuuccauaggccuaauaugugucauugcuuccucugggauguuauggauggcugaaauuccuuuacaauggauugcgucagcaauaguauuagaauuuuucaugauggugcucuugaucccugaaccggagaagcaaagaacaccgcaagauaaccaguuagcauauguagugauaggcauucucacauuagcagcaauaauagccgcaaaugaaaugggucucuuagagacaacaaaaagggaccuuggcaugucuaaagaaccagggguaguaaguccaacuuccuauuuggauguagaucugcauccagcaucagcauggacauuguaugccgucgcuacaacagucauaacgccgauguuacgucauacaauagaaaauaguacagcgaacgucagccucgccgcuauugccaaucaggcagucguguuaaugggcuuggauaaaggauggccaauaucgaagauggacuuagggguacccuuguuagcauuaggauguuauagucaggugaauccgcuuacguuaacggcagcaguacucuugcuaauaacacauuaugcaauaauagguccgggauuacaagcuaaggcgacuagggaagcacaaaaacguacugcagcaggaauaaugaaaaauccaacgguagauggcauaaugacgauugaccuggauccgguaauuuaugauucgaaauuugaaaagcagcugggucaaguaaugcuacuugugcuuugcgcaguacaacuucuacuaaugagaacaaguugggcucuuugugaagcacuuacacuagcgacuggcccaaucacaacauuaugggaaggcagcccagguaaauucuggaauacuaccauagcuguauccauggccaacaucuuucgagguaguuaucuagccggugcaggacuugcuuuuucuauuaugaaaagcguagggacagggaaaagaggcacaggaucccaaggagagacacucggagagaaauggaagaagaaguuaaaucaacuuucucgaaaggaauuugacuuguauaagaaaucaggaaucacggagguagaucggacggaagccaaggaaggucuaaaacgaggagagauaacgcaucaugcagucucacgagguagugccaaacuucagugguucguggaacggaacaugguaauuccagaaggcagaguuauugacuuagggugugggcgcggaggguggucuuauuauugugcugguuuaaagaaggugaccgagguaagaggauacacaaaaggggguccaggacaugaagaaccagugccaaugaguacauacgguuggaacaucguuaaacuuaugagcgggaaagauguauuuuacuuaccacccgaaaaaugugacacccuucuuugcgauauaggcgagaguaguccaucuccaacuguugaagaaagucggacaauuagaguuuuaaaaauggucgaaccuuggcucaaaaauaaucaauucuguauaaaagucuuaaauccauauaugccaacuguaauagagcauuuagaaagacuucaacgaaaacacggcgguauguuagugaggaacccucuuucucggaauaguacucacgaaauguacuggauaucuaauggaacagggaauaucguugcuagcguaaacaugguaucgcgucuucuacuuaaccgauuuacaaugacacauaggcgcccuacaauagagaaagacguugaccugggagcaggaacccgccaugucaacgcggagccugagacuccaaauauggauguuauaggagaacgcaucaagagaauaaaagaggaacauaauucaacguggcauuacgaugaugaaaauccuuauaaaacuugggcuuaucaugguaguuaugaaguaaaggcaacuggaagcgcauccagcaugauuaacggagucguaaaguuauugacuaagccuugggacguagugccaaugguaacacaaauggcaaugaccgauaccaccccauuugggcaacaacguguguuuaaagaaaagguagacacacgaacaccacgaagcaugccuggaacaagacgaguaaugggcauaacugcugaauggcuauggagaacgcuugggagaaacaagaagccaagacugugcacgagggaagaauuuacgaagaaaguuagaaccaaugcggcuaugggcgcuguuuuuacugaagaaaaccaaugggacucagcgaaagccgcgguggaagaugaagauuuuuggaaguugguugacagagagagagaacuacacaaacuagggaaaugcggguccugugucuauaacaugaugggcaaacgagagaagaaacuuggcgaguuuggaaaagcgaagggcucgcgggcgauaugguauauguggcuuggcgcgagguaucuggaauuugaagcguuaggcuuuuuaaaugaggaccauugguucagcagagaaaacucuuauucuggugucgaaggagaaggauuaccuaaacuugguuacauucugagagacauaucaaaaauuccagguggugcaauguaugcagaugauacugcaggaugggacacccguaucacugaagaugaccuccauaacgaggagaaaauuacacaacaaauggauccagaacauagacaacuagccaaugcuaucuucaaauugacuuaccaaaacaaaguaguaaaaguccagagaccuacacccaccggcacuguaauggacauaauuaguaggaaagaucagagaggaucaggacaaguugguacuuauggacuuaauacauucacaaacauggaagcacaacucaucaggcagauggaaggggaaggaguacuaaguaaggcagauuuagaaaauccacaccucucugagaagaaaauaacacaaugguuagagacaaagggaguggaaaggcuaaagcgcauggcuaucaguggugacgauuguguaguaaaaccaauagaugauagauuugcuaacgcauuauuagcucuaaaugacaugggcaaagugcggaaagauaucccgcaauggcaacccaguaaaggcuggcaugacuggcaacaaguacccuuuugcucccaucauuuccaugaauuaauaaugaaggaugggagaaagcuagucgucccuugcagaccucaagacgaauugauuggcagagcaagaauuucacaaggagcggguuggucacuacgcgagacugcaugccuuggcaaggcuuaugcccaaauguggucuuuaauguauuuucacaggcgggauuuaagauuagcaucaaaugcaauauguucugcagucccaguccacuggguaccaacaagucgaacuacauggucgauacaugcgcaucaccaauggaugacaacggaagacauguuaacagucuggaauagaguauggaucgaagacaauccauggauggaggauaaaacuccggucaccaccugggaaaaugucccauauuugggaaaacgagaagaccaaugguguggcucacuaauuggacuaaccuccagagcuacuugggcgcaaaacauaccaaccgcuauacagcaagugagaucauuaauugguaacgaagaauuucucgauuacaugccauccaugaaacguuuuagaaaagaagaagagagugaaggugcaauaugguaa

SEQ ID NO: 23348 - RNA, 9873 nt, Artificial Sequence
  derived and/or modified CDS sequence (opt6) from DENV-3__FJ390373__SS-prME
acaucucuuugccuuaugaugauacuaccagccgcuuuagcauuccauuuaaccucacgggauggggaaccucguaugaucguaggaaaaaaugagaggggaaaaagccuuuuguuuaagacagcaucugguauuaauaugugcacccuaauagcaauggaucuaggagaaaugugcgaugacacuguaacauauaaguguccucauauaacagagguugagccugaagauauagauuguuggugcaauuuaacaucuacauggguuacauacggaacguguaaucaagccggagaacaccggagagauaaaagauccguagcuuuggcaccacauguaggcaugggauuagacacccgcacacagacuuggaugucugccgaaggagccuggagacaaguggaaaaagucgagacuugggcauuaaggcacccuggauuuacaauccuagcccuuuuucuagcucacuauaucggaaccaguuugacucaaaagguagugauuuucaucuuauugauguuagugacaccaucaaugacaaugaggugcguggggguggguaauagagauuucguugaaggauugucaggagcaacauggguagacgucguacuagaacauggcgggugugugacaacaauggccaaaaacaaacccacgcucgacaucgaauugcaaaaaacugaagcuacacaacuggcuacauugagaaagcuauguauugaagguaaaauaacuaauaucacaacagacucgagguguccuacccaaggcgaagcaguauuaccagaggagcaggaccaaaacuacguaugcaaacacacguauguagaccgagguuggggaaacggcugcggauuauuugguaaaggaucgcuaguaacgugugcgaaauuccaguguuuagaaccuauugaaggaaaaguuguucaguacgaaaaccuuaaguacacuguaauuauuaccguccauacgggugaucaacaucaaguuggaaacgaaacacagggugugacugcagaaauaaccccacaagcuucuaccacugaagcaauauuaccggaauaugguacguuaggacucgaauguucacccagaacuggguuagacuuuaaugaaaugauucugcuaacaaugaagaauaaagcauggaugguacauagacagugguucuucgaccuuccauuaccauggacaaguggugccacaacggaaaccccaacuuggaauagaaaagaauuauuaguuacuuuuaaaaaugcgcaugcaaaaaagcaagaaguagucguacuagggucgcaagaaggcgccaugcauaccgcuuuaacaggcgcgaccgagauucaaaauucuggugguacaaguauauuugcgggucaccuaaaaugccgacugaaaauggacaagcuugaguuaaaagguaugagcuaugcaaugugcacaaacaccuuuguucuuaagaaagaagucucagagacccagcauggaacaauucuaauuaaagucgaauacaagggcgaagacgucccauguaaaauaccauuuucuaccgaagacggacgcggaaaggcucacaacggaaggcucaucacagcaaauccaguagucaccaaaaaagaggaaccuguaaauauagaagcggagcccccuuucggagaaagcaauauagugauugguauaggugauaaugcguuaaagauaaauugguauaagaaagguucgucaauaggaaaaauguuugaagcuacagcacgcggcgcuagacguauggcgauauugggagauacagcaugggacuuuggcuccguugggggcgucuugaauucacuaggaaaaauggugcaucaaauuuucggaagcgcguauacagcccuauuuaguggugucaguugggugaugaaaauagguauagguguacuacuuacuuggauaggacuuaauucaaaaaacacauccaugucauuuucuuguaucgcuauaggaauuaucacacuuuaucuuggagcagucguucaagcggauaugggauguguaauaaauuggaaaggaaaagaauuaaaaugugggagcggaauauuugugacaaaugaagugcauacuuggacggagcaguauaaauuccaggcagauagcccuaaaagauuggcaacggcaauagcuggcgcaugggagaaugguguaugcggaauaagaucgaccacaagaauggaaaaccuacuauggaagcagauugcgaacgaacuuaauuauauauuaugggaaaacaacaucaaacuaacuguuguggugggugauaccauugguguacuagaacaagguaaacguacuuuaacgccccaaccaauggaauugaaauauucguggaaaacuuggggaaaagcaaagauagugacagcugaaacacaaaauaguuccuuuauaauugacggcccaaacacuccagaaugcccguccgcaagucgagcguggaacguuugggagguugaagauuauggauucggaguauuuacaaccaacauuuggcugaaguugagggaagucuauacucaacucugugaccaucgacuaaugagugcagcaguaaaagaugaacgugcaguccaugcagauauggguuacuggaucgagucucagaaaaauggaagcuggaaacucgagaaagccucacuuauagagguuaaaacauguacauggcccaagucucauacguuguggucaaauggaguauuagagagugauaugauaaucccuaaaucucuugcaggaccaauuagucaacauaacuaucggccaggcuaccauacucagacagcaggacccuggcaucuaggcaaauuagaauuagacuuuaacuacugcgaagggaccacuguaguuauaaccgaaaacugugggacacgaggaccaagccuacgcacgacgacgguaagugggaagcuuauacaugaguggugcuguagaaguuguaccuuacccccuuuaagguauaugggugaagauggcuguugguaugguauggaaauaaggccuauaucggaaaaagaagaaaacaugguuaagaguuuaguaucugcaggaucagguaagguagauaauuucaccaugggaguauuaugucuugccauacuuuuugaggaaguuaugaggggcaaauucgggaaaaaacacaugauagcgggaguauucuuuaccuuuguacuacuucuuucuggacaaauuacauggcgagauauggcacacacuuuaauaaugauaggaucaaaugccucagaucguauggguauggguguuacauaccuagcauugauugcaacuuuuaaaauacagccauucuuagcuuuggguuucuuucuacguaaauuaacgucacgugaaaacuuacuauuggggguaggauuagcgauggcaacuacacuucagcuuccagaagauauugaacagauggccaacggaauugcacuaggucuaauggcucucaagcucacuacucaauucgaaacuuaccaauuauggacagcguuaauaucccuaacuuguucaaacaccauauucacauuaacaguggcguggagaaccgcaacguugauacuagcagggguaucgcuauugccggugugucagucuaguucuaugcgaaaaacagauugguuaccgaugacgguggcugcaaugggcguaccgccauugccucuuuucauuuucucacuuaaagacacacuuaaacguaggagcuggccauuaaaugagggaguaauggcaguaggacuuguuagcauacuggcuaguucucuauuacgaaaugaugugccuauggcgggaccguuaguagcaggagguuuguugauugcaugcuaugugauaacugggacaucagcggaucuuacuguugagaaagccgcagacgucacaugggaggaagaggcagaacagacuggagugucccauaaucuuaugauaacaguagaugaugauggaacuaugcgcauaaaagacgaugaaacagaaaacauccugacugugcuauuaaagacagcuuuauugauugugaguggcauauuuccuuauucgauaccagcaacacuccucguauggcauacuuggcaaaaacagacccaaagaucaggaguacuaugggacgugccuagcccuccugagacucaaaaagcagaauuagaagaaggugucuaucguauaaagcagcaggggauauucggaaaaacacagguaggagucggaguacaaaaagagggaguauuccacaccauguggcacguaacaaggggugccgucuugacauauaaugggaaaagacuagaacccaauugggccucggucaagaaagacuuaauuaguuacggaggaggauggcgauuaucagcgcaauggcaaaaaggagaagagguccaggugaucgcaguggagcccggaaaaaauccaaaaaauuuccagacaaugccaggaaccuuccaaacuacuacuggagaaauaggugcgauagcauuagacuuuaaacccgggacaagcggcaguccuauaauuaauagagaagguaaaguaguaggucuauacggaaacgggguaguaacuaaaaauggcgguuauguuucagguauagcacaaacgaaugcagagccagacggaccuacaccagaguuagaagaagaaauguuuaaaaaacggaaucuaacaauuauggacuuacacccaggcagcggaaaaacgagaaaauaucuacccgcuauuguuagagaagcuauaaaacggcgauuacgaacccuuauccucgcgccaacccguguaguugcugcggagauggaggaagcuuuaaaaggucuaccgauuagauaccaaacuacagcaacgaaguccgaacauacaggaagagaaauaguagauuuaaugugucacgccacguucacgaugcggcuacuaagcccaguacgagucccgaauuacaauuuaauuauaauggaugaagcccauuuuacagauccugcuucaaucgccgcgaggggauauauuucgacaagggugggaaugggugaagccgcagcuaucuuuaugaccgcaacaccccccggaacggcggacgcuuucccgcaaucgaaugcuccgauccaggaugaggaacgagauaucccugagagaucguggaacaguggaaacgaauggauaacugacuuugcaggaaaaaccgugugguucgucccaaguauaaaagcaggaaacgacaucgcaaauugucuacgaaaaaauggaaaaaaaguuauacaauuaucacgaaagaccuucgauacagaguaucaaaaaaccaaacuaaaugauugggacuucguugugacaacagauauaucggaaaugggagccaauuuuaaggccgaucgugugauagacccgcgcagaugcuuaaagcccgugauauugacugauggcccagaaagagucauauuggcaggaccaaugccuguaaccgccgcuagcgccgcgcagcgaaggggaagaguuggaaggaacccacaaaaagaaaaugaucaauauauuuucacuggacaaccucuuaauaaugacgaagaucacgcgcauuggacagaagcaaaaauguuauuagauaauaucaauaccccggaagggauuauaccugcuuuauucgaaccagaaagggaaaaaucagcagcuauagauggugaguacagacuaaaaggugaaucgagaaaaacauuugucgaacuuaugagaaggggcgcauuaccgguuuggcuagcccauaagguugcuagugaagggaucaaauauacagauaggaaguggugcuuugauggacagaggaauaaucaaauuuuagaagaaaauauggaugucgagauauggacaaaagaaggagaaaaaaaaaagcugagaccacggugguuggacgcucgcacauauuccgaccccuuggcacuuaaagaauucaaggacuucgcugcagggcguaaaucaauugcacucgaucuagugacagaaauaggccguguuccgucucacuuagcacaccgaacaagaaacgcauuggauaaccugguaauguugcacaccagcgaacauggagggaaggcguaucgucacgcaguagaagaacucccugaaacaauggaaacacuuuuauuguuagguuuaaugauccuauuaaccgguggagccaugcuuuuucuaauuucaggaaaagggauaggcaagacauccauuggccuaauauguguuauugcguccucagguaugcuguggauggcugaaaucccacuucaauggauagcaagcgcaauuguccuggaauucuuuaugaugguccuauugaucccggagccugaaaaacaacgaacgccucaagauaaccagcuugccuauguuguuauaggcauacuaacgcuagcugcaauuauugcagcuaacgaaauggggcuacuggaaacaacaaagagagacuuggguaugucgaaagaaccuggagugguuuccccaacaagcuaucucgacguggaccuucacccagccagugcuuggacgcuauaugcgguugcuacuacuguaaucaccccuauguuaaggcacacuauugaaaauucaaccgccaacgugucauuagcggcuauagccaaccaggcuguugugcuaauggguuuggacaagggguggccaauaaguaaaauggauuuagguguaccacuacuggcgcuagguuguuacagccaagugaacccccucacucuuacagcagcagugcuacuacuuauuacacauuaugccaucauugguccaggauuacaagcaaaagcuacacgagaagcccagaaaagaacagcugcgggaauaaugaagaauccuacaguagauggcauaaugacaauugauuuagauccaguaauauacgauaguaaguucgaaaaacaauugggacaagugauguuauuaguucuaugugcgguacaacuauugcucaugcguaccaguugggcguuaugcgaagcgcuaacucuugcaacgggcccaauaacaacauuaugggaagggucucccggaaaauucuggaauaccacgauagccgucagcauggcgaauauauucagaggaagcuaucuggccggagcagguuuagcuuucaguauuaugaagucaguagguacagguaaaagaggaacaggaucgcaaggggaaacauugggugaaaaauggaaaaaaaaacugaaccaacuuuccagaaaagaauuugaucuauauaagaaaucagguauuacagaaguugaucguacggaggcuaaagaaggacucaaaagaggcgaaauaacgcaucacgcuguaucaaggggcagugcaaagcuccagugguuugucgaaagaaauauggugauaccagaaggacgugucaucgauuuaggcugcggaaggggagguuggucguauuauugcgcagggcuaaaaaaaguuacagagguucgaggauacacuaaaggggguccaggucacgaagaaccaguaccaaugucuacauauggcuggaacauugugaagcuaaugucugguaaagauguuuuuuaucugcccccagaaaaaugugacacucuacuuugugacaucggcgaaucuagcccaucaccgacgguugaggaaucgcgcacuauccguguauugaaaaugguugaaccaugguugaagaauaaucaguucugcauaaaaguacucaaucccuauaugccaaccguaauagaacauuuagaacgauuacaacguaaacauggggguaugcucgugagaaauccguuaagcagaaauaguacucacgagauguacuggauaucgaacggaacugguaauauuguagcaucgguuaauaugguaucuagauuacuguuaaacagguuuacgaugacgcacagaagaccaacaauugagaaagauguagacuuaggcgccgguacacggcacgugaaugcugaaccugaaaccccaaauauggaugugauaggagagcgaauaaaacggauaaaagaagaacauaacucaacauggcauuaugaugacgaaaacccuuauaagaccugggcguaccacggcucguacgaaguuaaagcaacaggaucugcaaguaguaugauaaacggaguaguuaaacuauuaacaaaaccaugggacguaguaccgaugguaacucagauggcaaugacugauacaacacccuuuggacaacaacgaguauuuaaagagaagguagacacccgaaccccaagaucuaugccugggacuagacgugucaugggaauaaccgcagaauggcuauggagaacauuaggaaggaacaagaaaccaagacucuguacacgugaagaauuuacgaaaaagguuagaacaaaugcggccaugggcgcaguauucacagaggaaaaucaaugggauucagcaaaagccgccguagaggacgaggauuuuuggaagcugguagaucgagagcgugaauuacacaaacuugguaaauguggaaguuguguauauaacaugauggggaaaagagaaaaaaaacuuggugaguuuggaaaagcaaagggaucgcgcgcgauaugguauaugugguuaggagccagauaucuggaauuugaagcguuggguuuccuaaaugaagaucauugguucuccagggaaaauucauauucaggaguugaaggcgaaggauuacauaaauuagguuauauccuuagggauauaucgaaaauuccuggaggagcgauguacgccgaugauacugcugguugggauacacgcauuacggaggaugaucugcauaacgaagaaaagauuacucaacagauggauccugagcauaggcaacuagcaaacgcgauauucaaacugacuuaccaaaauaaaguaguaaagguccaaagaccgacaccaacugguacgguuauggacauuaucaguagaaaagaccaaagagguaguggccagguagguacauacggauuaaauacauuuacuaauauggaggcacaguuaauaaggcagauggaaggagaaggcguuuuaucgaaagccgauuuagagaauccacaccugccagagaaaaaaauaacucaguggcuugaaacaaaagggguagaaagacuaaagcgaauggcuauaucaggugaugacugcguaguuaaaccuauagaugacagauuugcaaacgcacuacuagcauuaaacgacauggguaaaguccgaaaagauaucccgcaguggcaaccuuccaaaggauggcacgacuggcaacagguaccauuuugcagucaucacuuucaugaguuaaucaugaaggacggcaggaaauugguaguaccaugucgcccacaagaugaguuaaucggucgagcuaggauuagucaaggugcaggauggagcuuacgagaaacggcuugcuuagggaaggcauaugcacagauguggagucuuauguacuuccaccgacgagauuuaagacucgcuucaaaugcgauauguucagccguuccuguccacuggguccccacuucuagaacaacuuggucgauccacgcacaucaucaauggaugaccaccgaagauauguugacaguuuggaacagagucuggaucgaagacaacccauggauggaggauaaaacgccuguaacgacaugggaaaacgucccguaccuagguaaaagagaagaucagugguguggaucccuaauaggacuaacaucccgugcgacuugggcucagaauauaccuacggcuauacaacagguacgaucguugauuggaaaugaggaauuccucgauuauaugccgagcaugaaacgcuucagaaaagaagaggagucagaaggcgcaauaugguaa

SEQ ID NO: 23349 - RNA, 9873 nt, Artificial Sequence
  derived and/or modified CDS sequence (opt6) from DENV-3__FJ205871__SS-prME
acuucuuugugcuuaaugaugauuuuaccagcagcacuugcuuuucaccuaacuucgagagacggggaaccuagaaugaucguugggaaaaaugaaagaggaaaaagccuacuuuuuaaaacagcgucaggaauuaauauguguacucuaauagcuauggaccuuggagaaaugugugacgacaccguaacuuauaaauguccacauauuacagaaguagaaccagaagauaucgauuguuggugcaaucuaaccucuacauggguaaccuacgggacaugcaaucaagcgggugaacaccgaagagauaaacggagcguugcucuggcaccccacgugggaaugggacuagacacgagaacccaaaccuggaugagugcugaaggagcauggcgccaagucgaaaaaguggaaacaugggccuuacgucauccaggcuuuaccauccuagcgcuauuucuagcgcauuacaucggaacuagccucacacaaaaaguuguaaucuuuauauuguugauguuaguaacucccucaaugaccaugaggugcgugggagucgguaauagggauuuuguugaaggucugucaggggcuacguggguagacgugguccuugaacauggaggaugcguuacaacuauggcuaaaaauaaaccaacauuagauauugaguuacagaaaacggaggcaacacaacuagcaacgcugaggaaauuauguauugaaggaaaaauaaccaauauuacgaccgauucgagaugcccgacacaaggcgaagcgguacuucccgaggaacaagaucaaaacuauguuugcaaacacacauauguugacagaggauggggaaauggaugcggauuguucggcaaagguucauuaguaacaugcgcaaaauuucaaugccuugagccaauagaagguaaagucguacaauacgaaaaccucaaauacacaguaauaauaacuguccauacgggagaucagcaucaagucgggaacgaaacucaagguguaacugcagaaauuacgccucaagcaaguacaacggaagccauucugccagaauauggaacacucgggcuagaaugcaguccuaggacgggucuugacuucaacgagaugauccuacugaccaugaaaaacaaagcguggaugguacaucgucaaugguucuuugauuugccauuaccuuggaccagcggugccacuacagagacaccuacuuggaauagaaaagagcuauuaguuacuuuuaaaaacgcucaugccaagaaacaagagguagugguauuagguagucaagaaggugcuaugcauaccgcauuaacaggcgcgaccgaaauucaaaauucuggugggacaaguauauuugccggucauuuaaaauguagauuaaaaauggacaaacucgaacuaaagggaaugucauaugcuauguguacgaauacuuucgugcucaagaaagaaguuagcgaaacgcaacacgggacgauauugaucaagguagaauacaaaggagaagaugugccuuguaaaauaccauucuccacagaagauggacaaggaaaagcccauaacggaagacuuaucacugccaauccuguaguuaccaagaaagaggagccuguaaauaucgaagcagaaccuccauuuggggaaucuaauaucguaauaggaauaggggacaaugcucuuaaaauaaacugguauaagaaagguaguaguauuggcaaaauguucgaggccacagcccgaggcgcucgaaggauggcuauacuaggugauaccgccugggauuuugggucgguaggugguguuuuaaauagcuuaggcaagaugguucaucaaauuuuuggaucggccuauacagcauuauucucaggagucucauggguaaugaaaaucgggauuggaguacuacuuacauggauuggacuaaacucuaagaacacuucuaugucuuuuucauguauugcaauuggaauaauaacauuauacuuaggagcaguaguacaagcagauauggggugugugauuaacuggaaaggcaaagagcuaaaaugugggucugguauuuuuguaacgaacgaaguucauacuuggaccgaacaauauaaauuccaggcggacucaccgaaacgcuuagcaaccgcuaucgccggagcuugggagaacgguguuugcggaaucagauccacaacaagaauggagaacuuauuauggaaacagauugcuaaugagcucaacuauauccuaugggagaauaauaucaaauuaacaguaguagugggcgauaccauuggagugcuugaacaaggcaaaagaacauuaacgccacagccuauggaauugaaauacuccuggaaaacuugggggaaagcgaaaauaguaaccgcagaaacucaaaauaguaguuuuauuauagacggacccaacacacccgaguguccguccgcuagccgggcauggaauguaugggaaguugaagacuacggcuuugguguguuuaccaccaauauauggcuaaaacucagagaggcuuauacgcaacuuugugaucaucgauugaugucugcggccgugaaagaugaaagagccguccaugcagacaugggcuauuggauugaaagccaaaagaacgguaguuggaaacuagagaaagccagcuuaauagagguaaaaacauguaccuggccaaaaucacacacuuuguggucaaauggcgugcuugaaucagacaugauaauacccaaaucacucgcugguccgauaucacaacacaacuacagaccaggauaccauacucaaacagcggggccauggcacuuagguaaauuagaauuagauuucaacuauugugaaggcacuacaguggucauaaccgaaaauuguggaacaagagggcccucacugcgaacuacgacaguaaguggaaaguuaauacaugaauggugcugcagguccugcacuuuaccuccacuaagauauaugggagaagauggcugcugguacgguauggaaauacgacccaucagugaaaaagaagagaauauggugaaaagucuaguuucagcgggauccgguaagguugauaauuuuacuaugggaguucuguguuuggcaauacuauucgaagaaguaaugcgaggaaaguucggaaagaaacauaugauagccgguguguuuuucacuuuugugcuguugcuuucagggcaaaucacguggcgagauauggcccacaccuuaauaaugauagguagcaacgcuagcgaccgaaugggcaugggagugaccuauuuagcacuaauagcaacuuuuaaaauucagccauuuuuagcucucggauuuuucuuaagaaaacuaacaucucgcgaaaacuuacuauuagguguaggauuagcaauggcuacuacauugcaguugccugaagacauugagcaaauggcaaacggaauagcguuaggacuuauggcacuaaagcuaacaacacaguuugaaacuuaccaacuauggacugccuuaauaucacuaaccugcucaaauaccaucuucacacucacgguugcauggagaacagccacuuuaauauuagcuggaguuaguuuguugccagugugccagaguucgaguaugcguaaaacagacuggcuaccuaugacaguugcugcaauggguguaccuccuuuaccucucuucauauuuucacuaaaggauacacuuaaacggagaucuuggccacucaacgagggagucauggcggugggauuaguaucgauucuagccucuagucuauuacguaacgacguaccuauggccggcccacucgucgcggguggucuccuaauugcaugcuacgucauuaccggaacaagcgcagaccuaacuguugaaaaagcggcggaugugacuugggaagaggaagcagaacaaacaggagugucccauaaucucaugauaaccguugacgaugacgguacgaugaggauuaaagacgaugaaaccgaaaacauacuuaccguauuacuuaaaacugcuuuauuaauagucucgggaaucuuuccuuauaguauaccugcgacgcuauuaguauggcauaccuggcaaaagcaaacucaaagaucgggaguacugugggauguaccaucaccacccgaaacacaaaaagcagaacuagaagaaggcgucuaucgaaucaaacaacaagguauauuugggaaaacacaaguuggaguaggaguccaaaaagaaggugucuuccacaccauguggcacguaacaagaggugcuguucucaccuauaacgguaaaagauuagaacccaauugggcaagugucaagaaagaucucauuucauauggaggaggguggaggcuuucagcucaauggcaaaaaggcgaagaagugcaggucauugcaguggagccaggaaagaauccaaagaauuuccaaacaaugccugggacauuucaaacuacaacaggugaaauuggagcuauagcuuuagauuucaaaccaggaacaucaggauccccgauuauuaauagagaagggaagguuguuggucuauacgggaauggggugguuacuaaaaauggaggauacguuagugguauagcucagacgaaugcggaaccugacgguccaacacccgaacuggaggaggagauguucaagaaacgaaaccuuaccauuauggauuuacauccgggaaguggcaaaacacgcaaguaccucccggcuauaguucgggaagcaaucaaaaggcgauugcgaacauuaauacuugcuccaacaaggguaguagcagcggaaauggaagaagcucuaaaagguuuaccaaucagguaucaaacaacggcgacuaaaucagaacauacgggucgcgaaaucguagaucuaaugugucaugccaccuucacaaugagauuacugagccccguacgcguuccgaauuacaacuuaaucauuauggacgaagcacauuuuaccgauccagcaagcauagcagcaagggguuauauaaguacaagaguagggaugggugaagcugcagcuauauuuaugacagcaacaccacccgggacagcggaugcuuucccucaaagcaaugcaccgauucaagacgaagagagagauauacccgaaagaucuuggaacucugggaaugaauggaucaccgacuuugcagggaaaacaguaugguuuguaccgaguauaaaggcaggcaaugauauagccaauuguuuacggaaaaauggcaaaaaggugauucagcugucacgcaaaacauuugauacagaauaccaaaagacaaaguuaaaugauugggauuuugugguaacaacagauauaucagaaaugggagcuaauuuuaaagcugaccgaguaauagacccucgaagaugucuaaaaccaguuauacuaacagacgguccugagcggguuauucuagcuggaccaaugccuguaacggcugcaucagcugcacaacgacgcgguaggguuggacgaaauccccaaaaggaaaacgaucaauacauauucaccggacaaccuuuaaacaaugacgaagaccaugcacauuggacugaagccaaaauguuguuagauaacauuaauacuccagagggaauaauaccugcucuguucgagcccgagcgcgaaaagagcgccgcuauugacggugaguacagacuuaagggagaaucacgaaaaaccuucgucgaauuaaugagaagaggcgauuuaccgguuugguuggcccauaaaguagcaagugaagggauaaaauauacugauagaaaguggugcuuugacggucagagaaacaaccagauccuggaggaaaauauggacguugaaauauggacaaaagagggggaaaagaagaaacuuagaccacgguggcuagaugcaaggacauauuccgauccucuugcccucaaagaguuuaaagacuuugcugccggccgaaaaaguauagcuuuggaucuggucacugaaauagggagaguaccaucccacuuagcccacaggacaagaaacgcuuuagacaacuuaguaauguugcacacaucagaacauggugggaaggccuauaggcaugcaguagaagaacuacccgaaaccauggagacccuccuccuccuaggauuaaugauucugcuaacgggaggagcgauguuauuuuuaaucaguggaaaggguauuggaaaaacaaguaucggguuaaucugcgucaucgcaagcagcggcauguuauggauggccgaaauaccauuacaguggaucgccagugccauaguucuggaguucuuuaugaugguauuauuaauaccagagccagagaaacagcguacuccacaagauaaucagcuugcauaugugguaauaggaauacuaacauuagcugcuaucauagcggcuaacgaaaugggguuauuagaaacaacaaagagggaucuaggaaugaguaaagaaccugguguaguaagcccuacaucguaucucgauguagauuuacaucccgcauccgcauggacguuauaugcuguagcaacaacaguaaucacgccaaugcugagacacacaauagaaaauaguacugccaacguuucguuggcagcaaucgccaaucaagcagugguacucaugggacuagacaaaggguggccaauauccaagauggauuuaggaguuccuuuacuugcacucggcuguuauagccagguuaauccguuaacgcucacagcggcuguguuacuauuaauaacacauuacgcaauaauuggaccuggccuacaagcaaaagcaacgagagaggcccagaaaaggaccgcagcuggaaucaugaaaaacccaaccgucgaugguauuaugacuauagaucuugauccgguuauuuaugauagcaaguucgagaaacaacuuggucaaguaauguuacugguucucugugcgguacaauuacuacuaaugcgaaccaguugggcucuaugcgaagccuuaacucucgcuaccggccccaucacgaccuuaugggaagguagcccagguaaguuuuggaauacaacgaucgcugucagcauggcaaauauauuucgcgggaguuauuuggcuggagcgggccuugcauucaguauaaugaagucuguaggaaccggaaaaagagguacgggaucgcaaggagaaaccuugggcgaaaaauggaaaaagaaauuaaaucaauugucacguaaggaguucgaucuguacaagaaaagugguauuacggaagucgaucgaaccgaagcaaaggaaggcuuaaaaagaggagagaucacucaucacgcuguuaguagagguucggccaaacuacaaugguuuguggaaagaaauaugguaaucccugaagggagagucauugacuuaggaugcggaaggggcggauggaguuacuauugcgcaggacuuaagaagguaacagaaguaaggggcuauacaaaaggcggacccgggcaugaagaacccguaccaaugucuacguacggcuggaacauagucaaguuaaugaguggaaaagacguauuuuacuuaccucccgaaaaaugugacaccuugcuuugugacauaggcgagucaucucccagcccuacaguggaggaaagcaggacaauaaggguucuaaaaaugguagaaccaugguuaaagaauaaccaauucuguauuaaaguuuuaaauccguauaugcccacagugauagaacaccuugaaagacugcaaagaaaacacgguggaauguuggugcguaauccccuuaguagaaauucaacacaugagauguacuggauuagcaacgggacugguaauauuguggcuaguguaaauauggugucccggcugcuguugaauagguuuacaaugacacauagaaggccaacaauagaaaaagauguugauuugggagcgggaaccaggcacguaaaugcagaacccgaaaccccaaacauggacguuauaggugaacgaaucaaaagaauuaaagaggaacacaauaguacauggcacuacgacgacgaaaacccauauaaaacgugggccuaccauggaucauaugaaguuaaagcgacggguucagccucauccaugauaaacgggguuguaaagcuacugacuaaaccaugggacguuguaccuauggugacacagauggcgaugaccgacacgacuccguuugggcaacaaagaguauuuaaggaaaaggucgauacaagaacucccaggagcaugccaggcacaagaagaguaauggguauaacagcagaauggcuauggagaacguuagguaggaacaaaaagccuagacucugcacacgcgaggaauuuaccaagaaaguccgaacaaaugccgcgaugggugcugucuucacggaagaaaaucaaugggauucagccaaagcugcaguagaggacgaagauuucuggaagcuaguagauagagaacgggaacugcauaagcuaggaaaaugcggaucuugcguauauaauaugaugggaaaaagggagaagaaacuaggagaguucggaaaagcaaaagggucacgagcaauaugguauauguggcuaggggcaagauaucucgaguucgaagcgcuaggguuuuuaaacgaggaucauugguucucccgggaaaauagcuauuccggcgucgagggagagggacuccauaaacuagguuauauauugcgagauauuucaaaaauaccugguggugcuauguacgcagaugauacagcaggaugggacacacgcauaaccgaagaugauuugcauaaugaagagaaaauuacucaacaaauggaucccgaacauaggcagcuagcuaaugcgaucuuuaaauuaaccuaccaaaacaaaguuguaaagguucaaagaccuacuccgacagguacgguaauggacaucauaucacguaaggaucagagaggaaguggucagguaggcacuuauggccucaauacguucacaaauauggaagcucagcuuaucaggcagauggaaggagagggaguauugagcaaagcagacuuagaaaauccccauuuaccagagaaaaagauuacacaguggcuagaaaccaaggggguggaacgccugaaacggauggcaauaucaggugaugauuguguggugaaaccaauagaugaucguuucgcaaacgcgcuuuuggcccugaaugauauggguaaagucagaaaagauauaccucaauggcaaccaucgaaggguuggcacgacuggcaacagguaccauuuuguucucaccauuuucacgaauugauaaugaaagaugggagaaaacuggugguaccuugcagaccacaagacgaacucauaggucgagcuaggauuagucagggugcuggguggucguuaagagagacugcauguuugggaaaagcauaugcgcaaauguggucucuaauguauuuucaucggcgagacuuaagguuggcgagcaacgcuauaugcucggcaguaccaguucacuggguaccaaccucacggacuacauggagcauacaugcacaccaucaguggaugacgacagaagauaugcugacuguuuggaaucgaguguggaucgaagacaacccuuggauggaagacaaaacaccugucacgacuugggaaaacguucccuacuuagggaaacgcgaagaucaauggugugguuccuuaauaggauugacaucacgcgcaacuugggcccaaaacauacccacugccauacagcaaguucgcucacuuaucggaaacgaggaauuuuuggacuacaugccaucuaugaaaagauuucguaaagaagaggaaagcgaaggagcuauuugguga

SEQ ID NO: 23350 - RNA, 9873 nt, Artificial Sequence
  derived and/or modified CDS sequence (opt6) from DENV-3__FJ390375__SS-prME
acuucauugugccuuaugaugauucuaccagcagcacuagcauuccaucuuacaaguagagacggugaaccacgcaugaucguagguaaaaacgaaagaggaaaaagucuauuauucaaaacagcaucugggauaaacaugugcacuuuaaucgccauggaucuuggugaaaugugcgaugauaccguaacauacaaauguccucauaucacagaaguggaaccagaagauauugauugcuggugcaaccucacauccacuuggguuacauauggaaccugcaaucaagcuggugaacaucgcagagacaaaaggucuguugcguuagcaccucauguagguauggguuuagacacacggacgcaaacuuggaugagugcggaaggcgcuuggcggcaaguugaaaaaguugaaaccugggcacuaagacauccagguuuuacgauucucgcuuuauuucuggcacacuacaucggcacuucacugacccaaaaaguugugauauuuauucugcuuauguugguaacaccaucuaugacuaugcguuguguuggagucgguaaccgagauuucguugaagggcuuucaggugcuacguggguagauguuguauuagaacacggugguugcguaaccacaauggccaaaaauaaacccacguuagauauugaacuacagaaaacagaagcuacacaauuggcaacauuacguaaacuuugcauugaagguaaaauaacaaacaucacgacggauaguagauguccaacacagggugaagcaguacuccccgaagaacaagaucaaaauuaugucugcaaacauacguauguagauagagguugggggaacggcugcgggcuuuuuggcaaagguucuuuagucacgugcgcuaaauuccaguguuuagaaccgauagaaggaaaagugguccaguaugaaaacuugaaauauacugucauuauaacaguucacacuggagaccaacaccaaguuggaaaugagacacaaggugucacagcagagauaacaccacaagccucaacuacagaagcaauacuaccugaauacggaacucuuggucuagaaugcucgcccaggacugguuuggacuuuaacgaaaugauauuacuaacgaugaaaaacaaagcguggaugguucauagacagugguuuuucgaccuccccuuaccuuggacgaguggugcuacaacugagacaccaacuuggaauagaaaagaacuucuuguuaccuuuaaaaaugcucacgccaagaaacaggaagucgugguacuaggaagucaagagggugcaaugcacacagcuuuaacuggggcaacugaaauacaaaauaguggaggaacaucuauuuuugcgggccaccucaaaugucgacuaaaaauggauaaacuagaauuaaaaggcaugaguuaugcaaugugcacaaauacuuuuguacugaagaaagaaguaagcgaaacgcaacauggaacaauucuaauaaaaguugaguauaaaggugaagauguaccuuguaaaauaccauuuucgaccgaagacggacaagggaaagcucacaacgguagauuaauaaccgcuaacccaguuguuacuaagaaagaagaacccguaaauauugaagcagaaccgccuuuuggcgaaucaaauauaguuaucgggauaggugauaacgcccuaaaaauaaauugguacaagaaaggcucaagcaucggcaaaauguuugaggcuacagcaagaggcgcaaggagaauggccauauugggagacacugcaugggauuucggaucgguuggaggcguauuaaauagucuagggaaaaugguccaccaaaucuuugguucagcuuauacagcacuauuuucaggugucaguuggguaaugaaaauaggaauugguguucuacuaacuuggauugggcugaauaguaagaacacaucaaugucuuuuucauguauagcuauaggaauaauuacguuauaccuuggcgccguugugcaagcagauaugggcugugucauaaauuggaaagguaaagaacuaaaauguggauccggaauauucguuacuaacgaaguacacacauggacagaacaauacaaguuccaagcggacucaccgaaacguuuagcaacagcaauagcaggagcaugggaaaacggaguaugcggaauacguagcacaacuagaauggaaaaucuauuauggaaacaaaucgcgaaugaacuaaauuacauacugugggaaaacaacaucaagcuaacggucguuguaggggacaccauaggggugcuugaacagggaaaacgcacacuuacuccgcagcccauggaacugaaauauucauggaaaacuugggguaaagcuaaaauaguaacggcagaaacucagaacucgucguucauuauagacgguccaaauaccccagagugucccagugcaucaagagcguggaaugugugggagguagaggacuaugguuuuggaguuuucacgaccaacauuugguuaaaacuccgggagguguacacgcaauuaugcgaccaucggcuaaugagugcugcggucaaagaugagcgagcggugcaugcggauauggguuauuggauagagucccagaaaaaugggucauggaaauuggaaaaggcuuccuugauagaaguuaaaacauguacauggccaaaaucucauacacuuuggucaaaugguguacuugaaucagauaugauaauaccuaagucuuuggccgguccaauaucgcaacauaauuacaggccuggguaccauacgcaaaccgcggggccguggcaucuugguaaacucgaauuagauuuuaacuauugcgaaggcacaaccguaguuauaaccgaaaacuguggaacaagaggaccaaguuugcguacaacgacaguuuccgguaaacuuauacacgaauggugcugccgcucuugcacguuaccucccuuacgguacaugggagaagauggauguugguacggcauggaaauaagacccauaucagaaaaagaagaaaauauggucaaaucauuagucucagcagggucaggaaaaguggauaauuucacgauggguguauuaugccucgcaauccuguucgaagaaguuaugagaggcaaauucggaaagaagcauaugauugcaggaguauucuucacuuucguauuacuccuaaguggacagauaaccuggagggacauggcucauacauuaauaaugaucgggaguaaugcaagugacagaaugggaaugggcgugacauauuuagcacuaaucgcuacauucaaaauccaacccuuucuagcauuaggauucuuucuuagaaaacuaacauccagggaaaaucucuuacuagguguagguuuagcaauggccacuacguugcaauuaccagaagacaucgagcaaauggcaaacggcauagcacuaggucuaauggcccuuaaauuaacaacucaauucgaaacuuaucaacuuuggacggcauugauuucccuaacaugcagcaacacaauauucacccugacaguagcauggcgaaccgcgacacuaauauuggccgguguaucuuuauuaccaguaugccaaucuucuucuaugcgaaaaacugauuggcugccgaugacaguagcagcaauggggguaccaccucuuccguuauucaucuucucccucaaagacacacugaaacguagaucuuggccccuaaaugaaggcguuauggccgugggauuagucagcauuuuagcaaguucauugcuuagaaacgacguaccuauggcagggccccuaguagccggugguuugcuaauagcauguuauguaauaacuggaacuagcgcugaucuuacuguagaaaaggcagcggaugugacaugggaagaagaagcagagcaaacuggggucucucacaauuuaaugauuacggucgaugaugaugguacaaugcgaauuaaagacgacgaaacggaaaauauccuuacggucuuguuaaaaacggccuuacucauugucucggguauauuuccauauuccauaccagcaacguuacuuguuuggcauacuuggcagaaacaaacucaaagaagcgggguuuuaugggaugucccaagcccgccagaaacucaaaaagcagaauuagaagaagguguuuaucgaauaaaacagcaaggcauauuugggaaaacacaaguaggaguggggguacaaaaagaagguguguuccauacaauguggcacgucacaagaggggcuguauugacauauaaugguaagaggcuagaaccuaauugggcgucagucaagaaggacuuaauauccuacggcggagguuggagguuaagugcacaauggcaaaaaggugaagagguccaaguaauagcaguugagccaggcaaaaauccaaagaacuuucaaacuaugcccggcaccuuucaaacaaccacgggggaaauaggagcaauagcauuagauuucaaaccuggcacgagcggaaguccuauaauaaauagagagggcaagguaguuggauuauacgggaacggagugguaacuaagaacgguggauaugucagcggcauagcacaaacaaaugccgaaccggacggcccaacgccagagcucgaagaagaaauguucaagaaacgaaauuuaacaaucauggaccuucauccagguagcgggaaaaccagaaaauaucucccagcgaucguaagagaggcaauuaaacgacgauugcgcacacuuauucuagcuccuacgcgcguaguugcagcagagauggaggaagcacuaaaaggcuuaccaauacgcuaucagacuaccgcaacaaaaagugaacauacaggcagggaaauaguugaucucaugugucaugcaacuuucacuaugagacuacuaagcccuguacgaguuccaaacuacaauuuaauuaucauggacgaagcccacuuuacggauccagcaucaauagcggccaggggcuacauaucuacccgugucggcaugggggaagccgcagccaucuuuaugacagcaacaccuccgggcacagcggaugcauucccgcaaagcaaugcuccgauacaagaugaggaaagagauaucccagaaagaucauggaauaguggaaacgaauggauaacagauuuugcugguaaaacugucugguucguaccguccauaaaagcaggaaacgacaucgccaauugucugcguaaaaaugguaagaaagugauucaacuauccagaaaaacauucgacaccgaauaucagaaaaccaaacugaacgauugggacuucgucguaaccaccgauauuagcgagaugggggcaaacuucaaagcagaucgaguuauugacccucgacgauguuuaaagccggugauacuaacagauggaccugaacgcgucauucuagcugguccaaugccagugaccgcggcaagcgcagcucaacgacgaggaagaguaggaaggaauccucagaaagaaaacgaucaauauauauucacgggucagccuuuaaacaaugacgaagaucacgcccacuggacagaagccaagaugcugcucgacaacauaaacaccccggaaggaauaauaccggcgcuauucgaacccgaaagagaaaaauccgcugccauagauggugaauauagauuaaagggugaaucuagaaaaacguuuguagaacuaaugcguagaggagaccuuccgguuuggcuagcucacaaaguugccagugaaggaauaaaauauacagaucgaaaaugguguuuugauggccagcggaauaaucagauauuagaagaaaauauggauguugaaauuuggacuaaagagggagagaagaagaaacuaagaccaagauggcucgaugcucguacguacagugauccacuggcauugaaagaauuuaaagauuucgcugcaggaagaaaaucuauagcacuggaucucgucacagaaauuggaagaguaccaucgcauuuagcacauagaacacggaacgcauuggacaaucucguaaugcuucacaccucagaacacggugggaaagcauacagacacgcagucgaggaauuaccugaaacaauggaaacacuacuccuccuaggauuaaugauccugcuaacuggcggcgcaaugcuauucuuaaucucuggcaagggcauagggaagacaucaauaggacuaauaugcguaauagccucgucuggaauguuauggauggcugaaauaccucuacaguggauagcaagcgcaauaguucucgaguucuuuaugaugguucuguugauaccugaaccagaaaagcaaaggaccccacaagauaaccaacuugccuauguugugauaggcauacugacucuugcagcaauaauagcugccaacgaaaugggucuuuuagaaacaacaaaacgugauuuagguaugucaaaggaaccugguguagugucaccaaccucuuauuuagaugucgaucuacacccagcaucagcauggacacuuuaugcaguagcaacuacaguaauaacacccauguuacgucauacuauagaaaacucgaccgcgaauguuucauuggcugcaauagccaaucaggcgguaguucucaugggcuuagauaaaggcuggccaauaagcaaaauggaccuugguguaccacucuuggcacugggcuguuacucucaaguuaauccacuaacccuaacggccgcagucuugcugcuuauaacacacuaugcaaucauaggucccggucuacaagcgaaagccacgagggaagcgcagaaacguacugcagcaggaauaaugaaaaauccaacaguggacggcauaaugacaauugaucuagaucccgugauuuacgauucaaaauuugagaagcaguuaggucaaguuaugcuccugguucucugcgcaguucaacuucugcuuaugcgaacaucaugggcauugugcgaggccuuaacgcuugcgacuggaccuaucacuacucuaugggaaggaucgccuggcaaguucuggaauacuacaaucgcggugaguauggcgaauauauucagaggaagcuacuuggcuggagcgggacuugccuuuaguauuaugaagucagucgguacaggaaaaagaggaacaggaagccagggggagacacuaggcgagaaauggaaaaagaaacuaaaucaacugaguagaaaagaguucgaccuauacaagaaaagugguaucacagaaguagaccgcaccgaggcaaaagaaggcuugaaaaggggugagauaacgcaucacgcgguuagucgugggucagcuaaacuucaaugguuuguugagagaaauaugguaauaccagaagguagggugauugaucuagggugugguagaggaggauggucauauuauugugccggacuaaagaaaguaacggagguacgaggcuacacuaaagggggucccggucaugaagaaccaguaccgauguccaccuacggauggaauauugucaaacuaaugucaggcaaagauguauucuauuuaccuccagaaaagugcgauacucuucuuugcgacauaggugaaaguucuccaucaccaacaguggaagaaucgcgaacaauaagagugcugaaaaugguagaaccguggcuaaagaacaaccaauuuuguauaaaaguccucaaucccuauaugccaacuguaaucgaacaucuugaaagacuccaacguaagcauggagggaugcuaguacgcaauccucuuucaaggaacagcacacaugaaauguacuggauuagcaacgguacaggaaauauugucgccaguguaaauauggucagccggcuacuccugaaucguuuuacgaugacacaucgaagaccaaccauugagaaggacguagacuuaggggcaggcacuagacauguuaacgcagaacccgaaacacccaacauggacgugauuggugaaaggaucaaaagaauuaaagaagaacauaauaguacauggcauuaugaugaugagaaucccuauaagacuugggcauaccacggaucuuaugaaguaaaagccacaggcucugcuuccuccaugauaaacggagucgucaaguuacuaacaaagccaugggaugucgucccuaugguaacccaaauggccaugacagacacaacaccuuuugggcaacaacggguguuuaaagaaaaagucgauacucgaacccccaggucgaugccugguacacgaaggguuauggguaucacugcagaaugguuauggagaacacuaggucgaaacaagaaaccaaggcuuuguacuagggaagaguucacuaagaaagugcgaacaaaugccgcaaugggagcggucuuuacggaagagaaccaaugggauucggcaaaagcugcaguagaagacgaagauuuuuggaagcuaguugauagagaaagagaacuacacaaacuaggaaaauguggcucaugugucuauaauaugauggguaagagagaaaagaaauuaggagaguucgguaaagcuaaggguagcagggccauaugguacauguggcucggagcuagguaucucgaauuugaggcuuuaggcuuuuuaaaugaagaucauugguucucccgggaaaauucuuacuccggaguugaaggcgaagguuuacauaaacuggguuacauccuaagagacaucagcaagauuccugguggcgcuauguaugcagaugauaccgcaggaugggauacaagaauaacagaagacgaccuccacaaugaagagaaaauuacucaacaaauggauccagaacauagacaacuagcgaaugcuauauucaagcuaacauaucaaaauaaagucgugaaaguacagcggcccacucccacugguacuguuauggacauaauuucacgcaaggaccaaagagguucuggccaaguaggcacuuauggauuaaauacauuuaccaauauggaagcacaacuuauaagacaaauggaaggcgaaggaguucucaguaaagccgauuuagaaaauccgcaucuaccugagaagaaaauaacacaaugguuggaaacaaaggguguggaacgccuaaaaagaauggcaauauccggagaugacugugucguaaaaccgauugacgauagauucgcaaacgcauuauuagcgcucaaugauaugggcaaaguccguaaagauauuccucaguggcaacccaguaaagguuggcacgauuggcaacaaguaccguuuuguagccaccacuuucacgaauugauaaugaaggauggacgaaaacuuguggucccaugucgaccacaagacgagcucauaggacgagccagaauaucucaaggcgcggguuggucacuaagggaaacagcaugucuaggaaaggcuuaugcgcaaauguggucccucauguauuuccacagaagagauuugagacucgcaucaaaugccauuuguagcgcgguaccaguccacuggguaccuacuagccgaacgacuuggagcauacacgcgcaccaucaauggaugaccaccgaagacauguuaaccguauggaaucgcguuuggaucgaggauaauccuuggauggaagacaaaacuccaguuacaacuugggagaauguaccauaucuagguaagagagaagaucaguggugcgguucccuuauaggacuuacaagcagagcaacuugggcucaaaacauuccaacagcaauucaacagguucguagucucaucggcaaugaggaguuuuuagacuauaugccaucgaugaagagguuccgaaaggaggaagaaagugaaggagcuauaugguaa

SEQ ID NO: 23351 - RNA, 9873 nt, Artificial Sequence
  derived and/or modified CDS sequence (opt6) from DENV-3__FJ390376__SS-prME
acguccuuaugucugaugaugauuuuaccggcggcacuagcauuccaucuuacaucccgugauggagaaccacggaugauaguagguaaaaaugaacgaggaaaaucauuauuauucaaaacugcuagcggaauuaacaugugcacucuuauagcuauggaccuaggagaaaugugugaugacacuguaacuuauaaaugcccacacauuacggaaguagaaccagaagauauugacuguuggugcaaucuuacuuccacuuggguaacauaugguacauguaaccaagcaggagaacaccgucgugacaaaagaucaguagcccuagcuccacauguaggaaugggacuagacacacgaacacaaaccuggauguccgccgaaggagcauggcgacaaguagaaaaaguugaaacuugggcacuuagacauccgggcuuuacuauacuggcacuauuuuuggcgcacuacauuggaacaagccuaacucaaaaagucguaaucuuuacguuguugauguuaguaacuccuaguaugacuaugcgaugcguaggaguagggaauagagauuuuguugaaggacugaguggagccacauggguugacgugguuuuagaacauggaggaugcguaaccacaauggccaaaaacaaaccaaccuuggacaucgaauuacagaaaacagaagcaacacaacucgcaacacugcguaaauuaugcauagaaggcaaaauuacaaauauaacuacugauucgagaugcccaacacaaggggaagcagucuuaccagaagaacaggaucaaaacuacguuuguaaacauacauauguggaucgaggauggggaaauggauguggguuauuugggaaaggaucgcuuguuacaugugcaaaauuucaauguuuagaaccgauagaggggaaaguagugcaauaugagaaccuaaaauauacaguuauaauuacgguccauacuggagaucagcaucagguagguaacgaaacccaaggggugacagcagagauaacuccacaagcaaguacaaccgaagcaauucuacccgaauauggcacacuuggacuagaguguaguccgaggaccggacuugauuuuaacgaaaugauauuacugacuaugaaaaacaaagcauggaugguacaccggcagugguucuuugaccuacccuuaccuuggacaagcggagcaaccacggaaacacccacauggaauagaaaagaauuacucguaaccuucaaaaaugcacacgcuaagaaacaagaaguugucgucuuaggaucucaagagggcgcuaugcauacggcguuaacuggagcgacggaaauccagaauagcggagguacgucgaucuucgcaggacacuuaaaaugccgacuaaaaauggauaaauuagaauugaaaggaaugucauaugcgauguguacaaacacuuuuguacuaaagaaagaggugucggagacucaacaugggacgauauuaauaaagguagaauacaaaggugaggauguaccauguaaaauucccuucucuaccgaagauggccaaggaaaggcacauaauggccgcuuaauuacagcaaauccuguaguaacgaagaaagaagaacccguuaauauugaagcugaacccccauucggcgaaucuaauauuguuauuggcauaggagauaaugcuuuaaaaauaaauugguacaagaaagguucaaguauagggaaaauguuugaagccacggcaagaggggcaaggcguauggcaauauuaggcgacaccgcuugggauuuuggaagugucggcggcguacuaaacagccuagguaagaugguucaucaaaucuuuggaagcgcguauaccgcuuuguuuucaggaguuucauggguaaugaaaauagguauagggguacuacugaccuggauaggccuaaauucuaagaauaccuccauguccuuuaguugcaucgcuaucggaauaauaacacuuuaucugggugcaguaguacaagccgacauggguuguguaauaaacuggaaaggaaaagaacugaaauguggaaguggaaucuuuguaaccaaugagguccacacauggaccgaacaauauaaauuucaagcagauucccccaaacgacuggcaacagcaauugcuggugcuugggagaacgggguauguggaauaaggagcacaacuaggauggaaaacuugcuguggaaacaaaucgcgaaugagcuaaacuauauacucugggagaauaacauaaaguuaacagucguggucggggacaucauagggguuuuagaacaagguaaaaggacacuaacaccacaacccauggaguuaaaguacagcuggaaaacuuggggaaaggcaaaaauaguaaccgcagaaacacagaacaguucuuuuauaauugacgguccgaauaccccagaauguccgagugcgucuagggcauggaacgucugggaaguagaagauuacggauucggaguauuuacgacaaacaucugguugaaauugcgagagguguacacucaauuaugcgaucaccgcuuaaugucggcugcuguaaaagaugaacgagcuguucaugcugacaugggauacuggaucgaaagucagaaaaauggaucauggaaguuagaaaaagcgucucuuaucgaaguaaaaacuugcacauggccuaaaucucacacauuaugguccaacggcguauuagaauccgacaugauaaucccuaaaucgcucgccggaccuauaucucaacacaacuauagaccuggauaucauacacagacagcugggccauggcaucucggaaaauuagagcuagauuuuaacuauugcgaaggaacuacagucguuaucaccgaaaauuguggaacgagaggaccuucucuaagaacuacaacuguuucugguaaacuaauacacgaaugguguugccguaguuguacuuuaccgccuuuacgguauaugggugaagaugguugcugguacggaauggaaauuaggcccaucucagaacgggaagaaaacauggucaagucuuuagugagcgcugguucggguaaaguagacaacuuuacuaugggcgugcucugucuggcaauucucuucgaagaaguuaugagagguaaauuuggcaagaaacauaugauagcggggguguuuuucacauucguacuucuuuugucaggacaaauaauuuggcgggacauggcucauacauuaauuaugauugguaguaacgcuucggaucgcauggguauggguguuacauacuuagcacucauagcgacauuuaaaauacaaccguuccucgcacuaggauucuuccugcgcaaacugaccucccgagaaaacuuacuacuaggaguuggcuuagcgauggcaacgacacugcaacuuccugaagacauagagcagauggcuaacgguauugcgcuuggacuaauggcgcuaaaauuaaucacacaauucgaaacuuaucaacuauggacugcauugaucucacuaacuugcagcaauacuauuuucacucugacgguggcuuggagaacggcaacucuaauauuagcgggggugucacuucucccuguaugccaaaguuccucaaugagaaaaaccgauugguuaccgaugaccguagcagcaaugggggucccaccacuaccucuauuuauauuuucccuaaaagauaccuuaaagagacgaucauggccgcuaaacgaaggcguaauggcaguaggauuaguuagcauucucgccuccucguuguuaagaaaugauguaccgauggcggggccccuaguagcaggaggacuucuaauugcaugcuacguuaucacugguacgagcgcugauuugacaguagaaaaggccgcagaugucacaugggaagaagaggcagaacagacagggguaucacauaauuuaaugauaacaguugaugaugaugguacaaugagaauaaaagacgacgagacagaaaauaucuugacaguucuuuuaaagacagccuuauuaauaguaucuggaaucuucccauauucuauuccagcuacguuacugguuuggcauacauggcaaaaacaaacucagaggucugguguucugugggacguuccuagcccuccagaaacacaaaaagcugaauuggaagaggggguauauagaauuaaacagcaagguaucuuuggaaaaacacaaguagguguagggguacaaaaggaagggguauuccacacaauguggcauguaaccagaggagcggugcucacauauaacggaaaacgucuagaaccuaacugggccucugucaagaaagacuuaauauccuaugguggaggauggagacuaucagcacaguggcagaaaggggaagagguucaagucauagcaguugaacccggaaagaaccccaaaaacuuucaaaccaugccagguacuuuccaaacuacgacaggagagauaggagcaauugcauuagacuucaaaccagguacaagcggaaguccuauuaucaacagagaagguaaagucguuggucuguaugguaauggcguuguaacgaaaaacggcggauacguaagcggaauagcucagacuaacgccgagccagauggaccaacaccagaacuggaagaagaaauguucaagaaacguaaccuuacgauaauggauuugcauccaggaucaggaaaaacaagaaaguauuuaccagcuauuguaagagaagcuauaaaaagacgauuacgcacuuuaauauuagcacccacaagaguaguagcugcugagauggaagaggcauuaaaaggacugccaauucgguaucaaacuacagccacgaaauccgaacacacagguagggaaauugucgaucuuaugugccaugcgaccuuuaccaugagacuacuaagccccgugagagucccaaacuauaaucuaauaauaauggacgaagcucauuuuacugaucccgcaagcauagcagcacgugguuauauaagcacgagagucggaaugggagaggcagcugcuauauucaugacggcgacgccucccggcacugcagaugccuucccccagaguaaugcuccgauacaggaugaagagagagauaucccagagaggucguggaauagcgguaaugaauggauaacggauuuugccgguaaaaccgugugguuugucccaucgauaaaggcaggaaacgauauagccaacuguuuaaggaaaaaugggaagaaagucauucagcuuucgaggaagacuuucgacacagaauaucagaaaacgaaacucaacgauugggauuuuguuguaacuaccgacauuucugagaugggagcaaauuucaaagcagaccgugucaucgauccaagaaggugccuaaaaccgguaauucugacagacggcccagaaagaguuauauuagcagggcccaugccagugaccgcagcauccgcggcucagcgaagaggaagaguaggucggaauccccaaaaagaaaaugaucaguauaucuucacgggucagccuuuaaauaacgacgaagaucacgcacacuggacagaggccaagauguuacuugacaauauaaacacacccgaaggcaucauaccagcuuuauuugagccugaaagagagaaaagugcggcuauugacggggaauaccgucucaaaggagaaucgcguaaaacguucguagaauuaaugaggagaggcgauuuaccaguguggcuagcgcauaagguagcaagugaagguauaaaauacacugauagaaaaugguguuucgauggucagagaaauaaccaaauucuagaggaaaauauggauguagaaauuuggacaaaggaaggagaaaagaagaaacuucgaccaagguggcuugaugcuagaacuuauucagauccacuugcgcuaaaggaauuuaaagauuuugcagcagguagaaaaucuaucgcucuggaucuugucacagaaauaggaagaguccccucacaccuagcccauaggacaagaaaugcgcuggauaaucuggugaugcuacauacauccgaacacggggguaaagcguaccgacaugccguagaagaauuacccgagacaauggaaacacuucuuuuauuaggguuaaugauucuacugacuggaggagcaauguuauuccugauaaguggaaaaggaauugguaaaacauccaucggauugauuugugucauagcaucaucugguaugcucuggauggccgaaauuccguuacaguggauagcuagcgccauagugcuagaguucuuuaugauggugcuacuaauucccgaaccagaaaaacagcgaacuccacaggacaaucagcuagccuauguaguuaucgggaucuuaacgcuggccgcuauuauugcggcgaaugagauggguuuauuagaaacgaccaagagggaucuugguaugaguaaagagcccggaguaguaaguccaacaagcuaucuagacguagaucuucauccugcaucagcauggacuuuauacgcgguggcgacuaccguuauaacucccaugcuccgacauacgauugagaacuccaccgcaaaugucagucuagcagcaauugcuaaccaagcuguaguacuaaugggauuagacaaagguuggcccauuagcaaaauggaucuaggggugccucuauuagccuuagguugcuacagccaaguaaacccauugacauugacugcagcaguauuacuccugaucacucauuacgcgauaauagggccuggcuuacaagcaaaggcgacaagagaggcacagaaacgaacagcagcugguauaaugaagaauccaacuguagauggaauuaugaccauagauuuggacccggugaucuaugacucuaaguucgaaaaacagcugggucagguuaugcuauuaguacuuugugcuguacaacuauuacucaugcgcaccagcugggcucuaugcgaagcacuuacauuagcgacgggaccuaucacuacccucugggagggaucuccuggaaaauuuuggaauacuacgauagcggugucgauggcaaacauuuucagaggcuccuaucuggcaggagccgguuuagcuuuuaguauuaugaaaucaguugguacuggcaaaagaggaacaggcucucaaggugaaaccuuaggugagaaguggaaaaagaaguuaaaccaauugucgcggaaagaauuugaucuguacaagaagucuggcauaacggagguagaucgaacagaggcgaaagaaggucugaaacgaggugaaaucacccaccaugcggucucccgagguagugcuaaguugcaaugguuugucgaaagaaauaugguaauaccagaaggcagaguaauugaucuaggaugcgggagagggggauggucuuauuacugugcaggccucaagaaaguuacugaaguucgaggcuauacuaaaggagguccagggcacgaagaaccuguuccaaugucaacguauggcuggaauaucguuaaguuaauguccgggaaggauguguucuaccuuccaccugagaagugugacacgcuauuaugugauauuggagaaaguucaccgagcccaacuguugaagaaagucggacaauuagagucuuaaaaaugguugaaccauggcugaaaaauaaucaauucuguauaaaaguacuaaaccccuauaugccuacuguuauugaacauuuggaaagauugcaaagaaaacauggugggaugcucguaaggaaucccuuaucucguaauucuacccaugaaauguacuggauuaguaacgguaccggcaacauaguggcuucagucaauaugguaucccgcuuacucuuaaacagguucaccaugacucauagacgcccaacgauagaaaaggaugucgauuuaggagcaggaacacggcaugugaacgcagaacccgagacgccaaauauggacguuauaggggaaagaauuaaaagaaucaaagaagaacauaauagcacuuggcacuacgaugacgaaaauccauacaaaacgugggcuuaucaugguaguuaugaagucaaagcgaccggaagcgcuucaaguaugauaaacggaguaguaaaauuacuuacaaaaccaugggauguuguaccaaugguuacgcaaauggcaaugacagauacaacgccuuuuggucagcaaaggguuuuuaaagaaaaaguagauacuaggaccccaaggucgaugccugguacuagacggguuaugggaauaacugccgaaugguuguggagaacacugggacguaacaagaaacccagauuguguacaagagaagaguucaccaagaaaguaagaaccaaugccgcgaugggagcuguuuucacggaagaaaaucaaugggacagugccaaagcugcuguagaagacgaagauuucuggaaguuaguagauagagaaagagagcuccauaaauuagggaaauguggaucgugugucuacaacaugauggggaagcgggaaaagaaacuuggagaguucggaaaagccaaaggaagcagagcgauuugguauaugugguugggugcaagguaccuagaguucgaggcucuaggauucuugaaugaagaucauugguuuucucgggaaaacagcuauagugguguagaaggagagggauuacacaaauuagguuacauuuuaagagauaucucaaaaauaccagggggcgcaauguacgcugaugauacugcaggaugggauacaaggaucacugaagaugaucuacauaacgaggagaaaauaacacagcagauggacccagaacaucgacaacuugcaaacgccaucuuuaaauugacauaccaaaauaaagugguaaaaguacaacgcccaacgccaacugggaccgucauggauauaauaagccggaaagaucagcguggaagcggucaagugggaacuuauggauugaacacauuuaccaauauggaagcacagcucauacgucaaauggaaggagagggaguauuaagcaaagcagauuuagaaaacccucaccuuccagagaagaaaauaacacaguggcuagaaacgaaaggcguagaaagacuuaaaagaauggcgauuagcggugaugacugcguggucaaaccuauugaugaccgauucgcaaacgcccuauuagcauugaaugacauggguaaaguucgaaaagauaucccgcaguggcagccaaguaaagguuggcacgauuggcagcaaguaccguuuugcucacaccauuuucaugaacucauuaugaaagauggcagaaaauuggugguaccauguagaccucaagaugaauuaaucggucgggcgcgcauaucgcaaggagccggauggagccuaagagaaaccgcuuguuuagggaaagccuaugcacaaauguggucuuugauguauuuucacagacgagauuuaagacuugcuagcaacgcuaucuguucggcagugccggugcauugggugcccacaucaaggaccacauggucuauucacgcacaccaccaauggaugacaaccgaagacaugcuaacagucuggaauagaguauggauugaggauaacccuuggauggaggauaaaaccccaguaacuacgugggaaaauguuccauaucuuggcaagcgagaggaccaauggugcggauccuuaauagggcuuacaucgagagccacaugggcucaaaauaucccuacagcgauacagcaaguuagguccuugauagggaacgaggaguuccuagacuacaugcccagcaugaaaagauucagaaaagaagaagaaucagaaggcgccaucugguaa

SEQ ID NO: 23352 - RNA, 9873 nt, Artificial Sequence
  derived and/or modified CDS sequence (opt6) from DENV-3__FJ390377__SS-prME
acuucacuaugucuaaugaugauacuuccugcagccuuagcauuccaucuaacaucaagagacggggaacccagaaugauaguaggcaaaaaugaacgaggaaaaucuuuauuauucaaaacagcaucaggaaucaauauguguacccuaauagcaauggaucuaggugaaaugugcgaugauacgguuacauacaaaugcccccauauaacugaaguggaacccgaagacauagacugcugguguaaucuuacuagcacguggguuacauacgguacguguaaccaagcuggagaacaucggcgggacaaacgcagcguggcauuagcaccacacguuggaauggguuuagauacacgcacacaaacguggaugucagcugaaggagcguggcgccaaguagagaaaguggagacuugggcauuacgccaccccgguuucaccauacuagcauuauuccuagcacauuauauuggaacgagccuaacucaaaaaguuguuaucuuuacauuguuaauguuaguuacgccgaguaugacaaugagaugcguaggaguaggcaauagagauuucguggaaggguuaucuggagcaacauggguggacgugguacuagaacacgguggcugcgugacuacaauggccaaaaauaaacccacccuugauauagaacuacagaaaacagaagcgacgcaauuggcuacauuacggaaacuaugcauugaagggaaaauuaccaauauaacgaccgauuccagaugcccaacacaaggcgaagcgguauuaccugaagaacaagaccaaaacuauguauguaaacauacauauguagauagagggugggggaauggauguggcuuauuuggaaaaggcucauugguaacaugcgccaaguuucaaugccuggagccuauugagggaaaaguuguccaauacgagaauuuaaaauacaccgucauaaucaccgugcauacuggggaucaacaucaaguaggaaaugagacucaaggcguaacugcagagauaaccccucaggcaagcacaacagaagcuauuuugccagaauacgguaccuuagguuuagaauguucgccaagaacugguuuggauuuuaaugaaaugauccuuuuaacaaugaaaaacaaggcauggaugguucaccgacagugguucuuugaccucccgcuccccuggacaucaggagcaacgacugaaacccccacguggaauagaaaagaauugcuaguuacguuuaaaaaugcccacgccaagaaacaggaggugguagugcugggcucacaagaaggagcaaugcacacggcauuaaccggcgcaacggaaauacaaaacuccgguggaacaaguauauuugcugggcacuuaaaguguagacuuaaaauggauaaacuagaauugaagggaaugucguacgcuauguguacuaauacauuuguacucaagaaagaaguuucagaaacgcaacauggcaccauauuaauaaaagucgaauauaaaggagaagacgucccauguaagauaccguuuucuaccgaagacggucaagggaaggcucauaauggucgacuaauaacugcuaacccagucguaacuaagaaagaagaaccagugaacauugaagccgagccgcccuuuggggaaaguaacaucguaauaggaaucggcgauaacgcauuaaaaauaaacugguauaagaaagguaguuccaucggaaaaauguucgaagcaacagccagaggagcucgaagaauggccauuuuaggagauacugcuugggacuuugggucagucgguggagugcuuaacagccuaggaaaaauggugcaccaaauauuuggaucagcauauacggcacuauuuucaggagugaguuggguaaugaaaauagguauuggagucuuguuaaccuggaucggacuaaacagcaaaaauacuagcaugucauuuucauguauagccauuggaaucauaacacuauauuuaggagcagugguacaagcugacaugggaugugugauaaauuggaaagggaaggaacuaaaauguggauccggaauuuuuguaacaaacgagguucauaccuggacagaacaauauaaauuucaagccgauucaccaaaaagacuagccacagcaauagcgggcgcgugggaaaacgguguuugcgguaucaggucaacaacaagaauggagaaucugcuuuggaaacagauagcgaacgaacucaacuauauccuaugggagaacaauauuaaguuaacuguaguaguaggugauauaauaggaguauuggaacaggguaaaaggacucuuacuccacagccaauggaauuaaaauacucguggaaaaccuggggaaaggccaaaaucguuacugcggaaacacaaaauucaucauuuauaauagaugggccgaacacaccagaauguccaagugcgucuagagcauggaaugugugggaaguagaagacuaugguuuuggcguauuuaccaccaacauauggcuuaaauuaagggaaguuuacacucaacucugcgaucacagacuaauguccgcugccguaaaagaugaaagagcaguucacgccgauauggguuacuggauugagucucagaaaaauggaagcuggaaacucgaaaaggcuaguuugaucgaagucaaaacuuguacuuggcccaaaucucauacacuuuggaguaaugggguauuagaaucagauaugaucauuccuaagagccuagccggaccaauaucacaacauaauuaccguccuggcuaucauacgcaaacagccggaccguggcaucuagggaaacuagaauuggauuucaauuauugugaagggacaacugucguuauaacugagaacugcggaacacgaggcccuaguuuacgcaccacgacuguuucugguaaacuaauucaugagugguguugccguuccugcacacuuccacccuugagauacaugggagaagacggauguugguauggcauggaaauaaggcccaucuccgagaaggaagaaaauaugguuaagucccuaguaagugcagguucgggaaagguagauaacuucacgauggggguguugugucuagcuauccucuucgaggaaguuaugagggguaaauucggcaagaagcauaugauagcgggaguauucuuuacauuuguccuacuacuaucgggccagauaacauggagagacauggcgcacacuuuaauuaugauuggaagcaaugcaagugaccgaauggguaugggaguuacauauuuagcauuaauagcuacuuucaaaauucagccguuucucgcucucggauuuuucuuaagaaaacuuaccucacgugaaaauuuacuacuaggaguuggucucgcgauggcaacaaccuugcaacuuccagaagauauagagcaaauggcuaacggaauugccuugggacuaauggcacuaaaacuaauuacgcaauucgaaacuuaucagcuuuggacagcauuaauuucacucacauguucuaauacgauauuuacgcuaaccguagccuggcguacagcaacuuuaauauuagcaggaguaaguuugcuuccaguaugucaaucuuccaguaugaggaagacggacuggcuuccgaugacaguagcugcuauggguguaccuccacucccguuauuuaucuuuaguuuaaaagacacgcuaaaaaggcgcagcuggcccuugaaugaagggguaauggcagucggguugguauccauauuagcgaguucccuauuaagaaacgauguaccaauggcuggaccucugguagcgggugguuuauuaauagcauguuauguuauaaccggaacaagcgccgauuugacugucgaaaaagcugcugauguaaccugggaagaggaagcggaacagacugggguaagucacaaucucaugauaacuguagaugacgauggaacaaugagaaucaaagaugacgaaacggagaauauacugacugucuuauugaaaaccgcauuguugauaguaaguggaauuuuuccuuauagcauuccagcgacacuuuuaguuuggcauaccuggcaaaaacaaacccaacgaucgggaguauuaugggauguaccaucaccgccagagacucaaaaagcugaacuugaagaaggcgucuaucgaauuaagcagcaaggcaucuucggcaaaacacaagucggaguaggaguacagaaagagggaguguuucauacaauguggcacguaacgagaggagcaguacucacauacaacgggaaaagauuagaaccaaacugggcaagugucaagaaagaucuaauaagcuauggugguggcuggcgauuaagugcucaguggcaaaaaggagaggagguucaggugauagcagucgaaccagggaaaaaccccaaaaauuuucaaacuaugccugguacuuuucaaacaacaacaggagaaauaggagcuauagcccuagacuucaaaccuggcacaucgggcucaccuauaauaaaccgcgagggaaaggugguaggauuauauggcaaugguguaguaaccaaaaauggagguuaugucucaggaauugcacaaacaaacgcagagccugauggcccaacaccugaguuggaggaagagauguucaagaaaagaaauuuaacuauuauggaucuacaucccgggucagguaaaacucgcaaauauuugccugccauaguucgagaagccaucaagcgaagauuacgaacccuaaucuuagcuccuacaagaguuguagcugcugaaauggaggaggcguuaaagggacuaccuauacgauaucagaccacugcgacgaaaucugaacauacuggaagggaaauuguugaucuuaugugucaugcgacguuuacuaugagguugcuaucgccuguuagagugccaaacuacaauuuaauuauaauggaugaagcucacuuuacggaccccgcaucaauugccgccaggggauauauuuccacuagagucggaaugggagaggcagcagcuaucuucaugacagcuacaccuccaggaacagcugaugccuucccucaaucgaaugccccaauacaagacgaagaaagagacauacccgagagaaguuggaacucagggaacgaauggauuacugauuuugcagggaaaaccguuugguuuguaccauccaucaaggcuggaaaugacauugcgaauugucucagaaagaaugguaagaaaguuauacaacuuagucggaaaacuuucgacaccgaauaucagaaaacaaaacugaaugacugggacuucgucguaacgaccgauauaucugaaaugggcgcaaauuuuaaagcagauagaguaauugacccacgcagauguuuaaaaccagugauauugacagacgguccagaacgugugauucuagcagguccaaugccaguuacagcagcaagcgcugcacagcgccguggacgugucggaagaaacccccaaaaagaaaacgaucaguacauauuuacaggccagccgcuuaauaacgaugaagaucaugcccauuggacagaggccaaaaugcuauuagauaauauuaacacaccagagggaaucauaccugcucuguucgaaccugaacgggaaaaaucugccgcgaucgauggugaauauagauugaaaggugaaucaaggaaaacauucgucgaauugaugaggcgcggagaccuaccagucuggcuagcacacaaaguugcaagcgaggguauaaaauauacagaccggaaguggugcuuugacggucagagaaauaaucaaauauuagaagaaaacauggauguugaaauuuggacaaaagaaggagagaaaaagaaauuaaggccacggugguuagacgcacguacuuauagugauccguuagcauuaaaagaauuuaaggauuuugcggcaggacguaaaagcauagcgcuugacuugguaacagagauugggcgcgucccaucucaucuagcacauagaacuagaaaugcauuagacaacuuaguaaugcugcauacaagcgagcaugguggaaaagcauaucgacacgcaguugaagaauuaccugaaacuauggaaacccuguuauuacuuggguugaugauucugcugacagguggagcaauguuauuuuuaauuuccgguaaaggcauagggaaaaccaguauuggucuaauauguguuauagccucaucugguauguuauggauggcagagauaccccuacaauggauugcuucugcgaucguguuagaguucuuuaugaugguguuauuaauacccgagcccgaaaaacaaaggacaccacaggauaaccaauuggcguacguggugaucgguaucuuaacgcuugcagcgauaauagccgcuaaugagaugggauuacucgagacaacaaaaagggaucuagguaugaguaaagagccuggagugguaagcccaaccucauauuuagauguagaucuacacccggcaucugcuuggacacuauaugcuguagccacaacaguaauuacuccaaugcuucgccauaccauagagaauaguacagcaaacgucuccuuggcagcaauugcgaaucaagcaguggugcuuaugggacuggauaaaggauggcccauaucgaaaauggaucuugguguaccacuguuggcacucggaugcuauucacaaguuaaucccuuaacauugacagcagcgguauuauuacuuauaacccauuaugcgauaauagggccgggauuacaagcaaaagcgacacgagaagcacagaaaagaacugcugcaggcaucaugaagaauccaacuguagaugggauaaugacaaucgaccuagaucccguaauuuacgacaguaaguucgaaaaacaacuuggacaaguuaugcucuuaguauuaugcgcaguucagcuacuacuuaugcgcacgucaugggcacuaugcgaagcccucacuuuagcgaccggaccgauaacaacucucugggaagggucaccaggcaaguucuggaauaccacaauagcuguuucuauggccaauauauuccgagggucauaucuagcaggggccgguuuagccuucucuauaaugaaaaguguggggaccggaaagcgugguacuggaucccaaggugaaaccuugggggaaaaguggaagaagaaacucaaucaacuaagcagaaaagaauuugaccuuuauaagaaauccggaaucacugaaguagacagaaccgaagcaaaggaagggcucaagaggggugaaaucacgcaucaugcugugagcagggggucugcuaagcuccaaugguucgucgagcguaacaugguaauuccagagggaagagugauagaccuugguugcgggagaggaggguggaguuacuacugcgcaggacuaaagaaaguaacugagguaaggggguauaccaaaggagggccgggccacgaagaacccguaccaaugaguacauauggguggaauauaguaaaauugauguccggcaaagacguauucuaucuaccuccugaaaaaugcgauacgcuccuuugugacauuggagagucaaguccaucgccuacgguagaagaaucucgaacgaucagaguacuuaaaaugguugaaccauggcuaaagaauaaucaauuuuguauuaaaguauuaaauccguauaugccgacugucauagaacauuuggagagacuacaacgaaaacauggaggcauguuaguucgaaaccccuuaaguagaaauuccacacaugaaauguauuggaucucaaacggcacaggcaauauuguagcaucaguaaauaugguaucaagacuauuauuaaaucgcuuuacuaugacacauagacgccccacuauugaaaaagauguggaucugggcgcaggaacuaggcaugucaacgcggaaccugaaacuccgaacauggacguaauuggugaaagaauaaaacguaucaaagaggaacauaacucuacuuggcacuaugacgaugaaaaucccuacaaaacgugggcauaucaugggucuuacgaaguaaaagcuacagggagugcuuccucaaugaucaacggggugguuaaacuuuuaacuaagccgugggaugugguaccaauggucacacagauggcuaugacagacacgacgccauuuggucagcagagaguauuuaaggagaaaguugacacaaggaccccucgauccaugccuggaacuagacggguuauggggauuacagcugaaugguuauggcggacuuuagggcgaaauaagaaaccgcguuugugcacuagggaagaauuuaccaagaaaguaagaacaaaugcggcaaugggggcaguauucacggaagaaaaucaaugggacagugcaaaagcggcuguagaagacgaagauuucuggaaauuaguagauagagaacgagagcuacauaaacuaggcaaaugcggcaguuguguauacaauaugaugggcaaaagggagaagaaauugggggaguuuggaaaagcgaaagguucucgagcuauaugguauauguggcuaggagcucgauaucuagaguucgaagcacuugguuuccuaaaugaggaccacugguucucaagagaaaauaguuacaguggaguagagggugagggucuucauaaacuuggauacauauuacgcgacaucagcaaaauaccgggaggcgccauguaugcagaugauacggcuggcugggauacgagaauuacggaagacgaucuacacaaugaagagaaaauaacacaacaaauggauccggagcauagacaacuggcaaacgcuaucuucaaauuaacauaccagaauaagguugucaaaguccaacgcccaacuccgacugguacgguaauggauaucauaucaagaaaagaccaacguggcucaggacaaguaggaacuuacggauuaaauacauuuacaaauauggaggcgcaauuaauccgccagauggagggggaaggaguguuaaguaaagcugacuuagaaaauccacaucuuccagaaaagaaaauuacacagugguuggaaacgaaaggugucgaacguuuaaaacguauggcaauaaguggugaugacuguguuguaaagcccauugaugauagauuugcuaacgcgcuacuagcauugaacgauaugggaaaaguucgaaaggauaucccacaauggcaaccaaguaagggcuggcaugauuggcaacaagucccguuuuguucacaucacuuucacgaauuaaucaugaaagacggucgcaaacugguuguaccauguaggccccaagacgaacuaauuggccgugcaaggauuucccagggggcaggcuggagcuuaagggaaaccgcaugucuaggaaaggcuuacgcacaaauguggucguuaauguacuuccauagaagagaucugcgucuagccucaaacgcuauauguucggcuguaccaguacauuggguuccuaccucucgaacuacuuggaguauacaugcacaccaucaauggaugacaacagaggauaugcuaacaguauggaauagaguuuggauagaagacaauccauggauggaggauaaaacccccgucacuacaugggagaacgucccauaccucggcaaacgggaggaucaguggugugggucguugauuggacuuacaagccgugcgaccugggcccaaaauaucccgacggcgauacagcaaguaagaagucuaauuggaaaugaggaguuccuagacuacaugccaaguaugaaacgauuuagaaaagaagaagagucagagggagcgauaugguaa

SEQ ID NO: 23353 - RNA, 9873 nt, Artificial Sequence
  derived and/or modified CDS sequence (opt6) from DENV-3__FJ547069__SS-prME
acgucauuguguuuaaugaugauauuaccugcagcacuugcauuucaccuuacuucuagagacggggaaccgcgaaugauaguggguaaaaaugaacggggaaaaucucuucuauuuaaaacggcaucaggaaucaauauguguacuuuaauagcuauggacuuaggggaaaugugcgacgauacagugaccuauaaauguccgcacaucaccgaaguagaaccagaagacauagauugcugguguaacuuaacaaguacgugggucaccuaugguaccuguaaucaagcuggugaacaccgcagggacaaacgaaguguggcacucgcuccacacguaggaaugggucuagauacacgaacccaaacauggaugucagcugaaggggcauggcgccaaguagaaaaaguggaaacgugggcacuucgacaucccggauucaccauauuagcccuguuccuagcacauuauauagguacgucacuaacccaaaaaguuguaauauuuauauuauuaauguuagucacuccaucuaugacuaugcguuguguagggguugguaauagagauuuuguagaaggguuaaguggagcaacuuggguugacguaguucuggaacauggaggauguguuacaacgauggcgaagaauaagccaacauuagauauagaauuacagaaaacagaggcaacacaacucgcuacucuaaggaaauuauguaucgagggcaaaauuacaaacauaacaacagauagucgauguccuacacaaggugaagccguacuaccagaggaacaagaucaaaauuacguauguaagcauacauauguugaccgcggaugggguaaugggugcgguuuauuugguaaaggaucuuuaguaacaugugcuaaauuucaaugucuggaaccuauugagggcaaaguuguacaauacgaaaaccuaaaguauacagucauaauaacugugcauacuggagaccaacaccaaguggguaacgaaacucaagguguaacugccgaaauaacaccacaagcaucuacaacagaagcaauacugccagaauaugggacucuaggucucgaguguucaccuaggacgggucucgauuuuaacgaaaugauacuuuuaacaaugaaaaacaaagcauggaugguucaccggcagugguucuucgacuugccuuuacccuggacaucaggagcaacuacggaaacaccgacuuggaacagaaaagaacuacuuguuaccuucaaaaaugcacaugcuaagaaacaagaagucguuguacuuggaagccaagaaggagccaugcacacagcacuaacuggagcaacugagauacaaaaucuuggugguacaaguauauucgcaggccaucuaaaaugcaggcugaaaauggauaaacuugagcuaaaaggaaugucauacgcaauguguacuaauacuuucgugcucaagaaagaaguauccgagacacagcaugguaccauacuaauuaagguagaauauaaaggggaagauguaccuuguaaaauaccauucagcacagaagauggacagggaaaagcacacaauggacgccucaucacagccaacccagugguuaccaagaaagaagaaccuguaaauauugaagcagaacccccguuuggugaaucuaauauaguaaucgguaucggagauaacgccuuaaaaaucaauugguacaagaaaggaagcucaauaggaaaaauguuugaggccacagcucguggggccagacgcauggcaauauuaggagauacggcgugggauuucgguucaguaggcggaguuuuaaacaguuuggggaagaugguacaucagauauuuggcucagcguauacagcacuauuuucaggaguaagcuggguaaugaaaauugguauaggagucuuauuaacauggauuggguugaauaguaaaaauaccucgaugucauuuucauguaucgcgaucgguauuauaacucucuaucucggagcaguagugcaggcagauauggguuguguaaucaauuggaaagguaaagagcuuaaaugcggaucgggaauauuugucacgaaugaagugcacaccuggacugaacaauauaaguuucaagcugauucucccaaaagacucgcaacagcuauagcgggggcaugggaaaaugguguaugugguauucgcaguacaacaagaauggagaaucuauuauggaaacaaaucgccaacgaauugaacuacauauuaugggaaaacaauauaaaacuaacagucguuguaggugauaucauagguguucuggagcaaggaaaacguacccucacaccucaaccaauggagcuaaaauauucauggaaaaccugggggaaagccaaaauagucacugcugaaacccaaaauucaucuuucauaauagauggcccgaauacaccugaauguccauccgcaucucgcgccuggaauguaugggagguagaagauuacggcuucgggguauucacaacgaauaucuggcuuaaacuuagagaagucuauacacaauugugcgaucaccgacuaaugagugcagcaguuaaggacgaaagagccguucaugccgauaugggguacuggauugagucucagaaaaauggaaguuggaagcuggagaaggcuaguuugauagaaguaaaaacaugcacauggccgaaaucgcauacuuuguggucuaacggagugcuagaaucggauaugauaauaccaaagagcuuagcaggcccgauaucucaacauaauuacagaccgggauaucauacgcagacggcaggcccguggcacuugggcaaacuugaauuagacuuuaauuauugugagggaacuacaguaguuauuacugaaaauugcgguacacgaggaccgucacuacgaacaacaacugucucaggaaaacuuauccacgaaugguguugcagauccugcaccuuaccgcccuugagguacaugggagaagacggauguugguacggaauggagauaagaccgauaucagaaaaagaagaaaacaugguaaaaucuuuggugucagcggggaguggcaagguugauaacuuuacgaugggaguauuaugccucgcuauucuuuucgaagaagucaugcgaggcaaauuugggaaaaagcauaugaucgccgguguauucuuuacuuucguccuucuuuuaagcggccaaauaacuuggcgagauauggcucacacacuuaucaugauagguagcaacgcauccgacagaauggggauggguguaacauauuuggcgcuaauagcgacuuuuaagauacagccuuuucuagcguuaggcuuuuucuuaagaaaacuuaccagccgagaaaauuuacugcuagguguagguuuagcaauggcgacuacccuacaacucccugaagauauagaacagauggcgaacgggauagcucuugggcucauggcauuaaaauuaauuacgcaguucgaaacauaucaauuauggacagcauugauuucauuaaccuguucaaacaccaucuuuaccuuaacaguagcauggcguacagcgacauuaauacuagccgguguaucacuacuacccguaugccaaucuucaagcaugcgaaaaacagacuggcuucccaugacaguagccgcaaugggagugccaccuuuaccucuuuuuauauucucucugaaagacacucuaaaacgaagaagcuggccucuaaaugaagggguaauggcagucggacuuguaucaauuuuagccuccagucugcuacgaaacgacguaccaauggccggaccccugguagcaggaggacuauuaauagcuuguuaugucauaacagggaccucugcagaccuaacuguagaaaaagcugcggauguaaccugggaagaggaagccgagcaaacuggaguuagccacaacuugaugauaacaguugacgaugacgguacuaugagaaucaaagacgacgagacagagaauauccuuaccguuuuguuaaagacagcauuauuaaucguaucaggaauuuucccuuauaguauccccgcgacgcuacugguuuggcauacauggcaaaaacaaacucagaggagugggguauuaugggacgugccaucuccuccagaaacucagaaagcugaguuggaagaaggaguauacagaauaaaacaacaaggcauauucgggaaaacccaagucggaguuggggugcagaaagaagggguauuccacacuauguggcauguaacacgcggagccguucucaccuauaauggcaagcguuuagaaccaaauugggccagcgugaagaaagaucuuauuagcuauggaggaggauggcgacuauccgcacaguggcagaagggugaagagguucaaguuauagcuguggaaccagguaaaaaucccaaaaauuuucaaaccaugccuggaacauuccagacuacaacaggagagaucggugcuauagcauuagacuuuaagcccggaacaagcgggaguccaauaaucaacagagaaggaaaagucguaggcuuguauggaaacggaguagugacuaaaaaugguggcuacgucagcggcauagcccaaacaaaugccgaaccggacgggccaacaccagaauuagaagaagaaauguuuaaaaagaggaacuuaacuauuauggauuuacauccagggucuggaaagacucggaaauauuuaccagcaauugugagagaggccauaaaaaggcggcuaaggacacuuaucuuagcgcccaccagaguaguagcggcagaaauggaagaagcacuuaagggacuuccuauaagauaucagacuacagcaacaaaaagcgagcacacgggaagggagauaguugauuuaaugugucaugcaacauuuacaaugcgauuauuaucaccuguaagggugccuaacuauaaccuaauaauaauggaugaagcacacuucacggauccagcguccauugcggcucgagguuacauuucaacacgugucgggaugggagaggcugcugccauauucaugacagcaacgccaccggguacagcugaugcauuuccccaaucaaaugcgccaauccaggacgaagaaagagauauaccugagcggucguggaacucaggaaacgaauggauaacugauuuugcagggaaaacagugugguuugucccuagcauaaaagcaggcaacgauaucgcaaacuguuugaggaaaaauggcaagaaagucauacaauuaucacguaagacauucgauacagaauaccagaaaaccaaguugaaugauugggacuuuguuguaacaacugacauaucugaaaugggugcaaauuuuaaagcagaccgagucaucgacccgaggagaugcuuaaagccuguaaucuuaacggauggaccugaacggguaauucuugcugggccgaugccaguuacagcggccucggcagcccaacgacguggaaggguagguagaaacccacagaaggagaacgaucaauauauauuuaccggacaaccuuugaauaaugaugaagaccaugcucacuggacggaagccaagauguuacuugauaauauaaacacgcccgaaggcauuauaccagcuuuauucgaaccagaaagagaaaaaucagccgccauugauggagaauacagguuaaaaggagaaaguagaaaaacuuuuguggaacucaugcgacgaggggaucuaccaguuugguuagcucauaaaguagcaucugaggggaucaaauacacggaccgcaaauggugcuuugauggacaacgaaauaaccaaauucuugaagagaacauggauguagaaauauggacgaaggaaggagaaaagaagaaacucagaccucgguggcucgaugcuaggacauauagugacccauuagcccuaaaagaguucaaagauuucgcagcaggccgaaaaaguauagccuuagauuugguaacagaaauuggaagaguaccaucgcaucuggcacaucguacgcgaaacgcauuggacaaccuaguuauguuacauacauccgaacacggaggaaaagcguaucgacacgcgguagaagaauugccggagacaauggaaacccuauuacuauuagguuuaaugaucuuauugacaggaggggccaugcuguuucucauuagcggcaaaggcauaggcaagacaucaauuggcuuaauaugcguaauugcuuccucugguaugcuuuggauggcggaaaucccauugcaauggauagcuucugcaauuguacuugaauuuuucaugauggugcuucuaauaccugaaccugaaaaacaacgaacgccccaggacaaucaauuagcuuacguaguaauaggaauccucacccucgcggccaucauagcagcaaaugaaaugggucuacucgaaacuacuaaacgggaucuggggaugaguaaagaaccuggaguugugucaccuacaucauaccuagauguagaucuucauccugcuucugcuuggacacuguaugccguggcaacgacagucauaacaccaauguuacgacauacuauugaaaauaguaccgcaaacgucucacuugcggcaauagcaaaccaagcaguaguucuaaugggacuugauaaagguuggccgauaagcaaaauggauuuaggcgucccacuacuagcccuggggugcuauucccaggucaauccacuaacccuaaccgcugcuguauuauuacuaauaacgcauuaugcuauaauuggcccaggauuacaagcaaaagcgacaagagaggcucagaaaagaacggcugcuggaauuaugaaaaauccaaccguggacggaauaaugacuauugacuuagacccgguaaucuacgacuccaaauuugaaaaacaauuagggcaagucauguuacuuguucuaugugcgguccaacuauuauuaaugcgcacuucuugggcacuuugcgaggcucuaacguuggcaaccgguccaauuacgacucugugggagggaagcccgggaaaguuuuggaacaccacuauagcuguaucuauggcaaauauauucaggggcucauaucuagcuggagcgggauuagccuuuagcauaaugaagaguguagguaccggaaagagaggaacgggaucccaaggcgagacucucggagaaaaauggaagaagaaguuaaaccaauuaucccgaaaggaguucgauuuauauaagaaaagcgguauaacagaaguagacaggacagaggcaaaggaagguuuaaagcguggcgaaauaacccaccacgcaguaucacgagguucagcgaaguuacaaugguucguagaaagaaauauggucauaccagaaggacgagucaucgaccucgguuguggaagaggcggaugguccuacuacugcgcuggccugaagaaaguaacugaagugaggggauauaccaaaggaggaccaggacaugaagaaccggugccgaugucaacguauggauggaauaucgugaagcucaugucaggaaaagaugucuuuuauuugccaccugaaaaaugcgauacacuccucugcgauauuggcgaauccagcccuaguccuaccgucgaagaaucacggacuauucguguuuuaaaaaugguagaaccauggcuaaagaacaaucaauucugcaucaaaguguuaaacccuuauaugccaacagucaucgagcaccuagaaagacugcagaggaagcacggaggcauguuaguaagaaacccacugucgagaaacucaacccacgagauguacuggauaucaaacgguacgggcaauauaguagcgucaguaaauauggucucaagacuccugcuaaaucguuuuacuaugacccauagaagacccacaauugaaaaagacguggacuuaggggcuggaacccgucauguuaaugcugaaccugaaaccccaaauauggacguuauaggugaaagaaucaaacgcaucaaggaagaacacaauucaacguggcacuacgaugaugaaaacccuuacaaaaccugggcauaucacggaucuuacgaaguuaaagcuacaggaagcgcaagcuccaugauuaauggcguaguuaaguuacuaacuaaaccaugggauguaguaccuaugguuacacaaauggcgaugacagauacaacuccuuuuggccaacaacgaguuuuuaaagaaaaaguagauacaagaacuccaagaucaaugccaggaacuagaagagucaugggcauaaccgcagaaugguuguggcggacacuaggaagaaacaagaaaccgaggcugugcacacgcgaggaguucacgaagaaagucagaacaaaugcugcaaugggcgcggucuuuacagaagaaaaccaaugggacagugccaaagcagcaguagaggaugaagacuuuuggaaacucguugaucgagagagggaguuacacaaacuagguaaauguggcucauguguauacaacaugauggguaaaagagagaagaaauuaggcgaguucgggaaagcuaaggguaguagagcaauaugguacauguggcuuggagccagauauuuagaguucgaagcacugggguuucugaaugaggaccauugguuuagcagagaaaauucuuauucuggagucgaaggagaaggucuccauaaauuaggguauauuuugagggacauuaguaaaaucccaggcggugcaauguacgcugaugauacagcugggugggacacucgcauaacggaagaugaccuccauaacgaagagaaaauaacacaacaaauggauccggaacaucgacaauuggccaaugcaauauuuaaacugacauaucaaaacaaaguaguaaagguccaacggccaacgcccacaggaacagugauggauauaauaucacgaaaagaccaaagaggcuccggccagguugguacguauggacugaauacuuucacgaacauggaggcucagcuaauuagacaaauggaaggugaaggcguuuuaucgaaggccgaccuagaaaacccacacuuaccugagaagaaaauaacccagugguuagaaaccaaagguguugaaagacucaaaagaauggcaauuucgggugaugauuguguuguaaaaccuauugaugauagguuugcgaaugcacucuuagcucuaaacgauauggguaaggugagaaaagauaucccacaguggcaaccaaguaaaggguggcacgauuggcaacagguaccuuucugcucacaucauuuucaugaacucaucaugaaagauggaagaaaacucguaguaccauguagaccccaagacgaacuuaucggucgagcuagaauaucacaaggagcuggcuggagucuuagagagacagccugucucgguaaggcuuacgcucaaauguggucuuuaauguauuuucacagaagagacuuacgacuugccagcaaugcuauuugcagcgcaguaccgguacacugggucccuacuucucgaacaacauggucuauucaugcgcaucaucaauggaugacgaccgaagauaugcuaaccgucuggaaccgagucuggauagaggauaacccguggauggaagauaaaacaccugucaccacgugggagaauguaccauauuuaggaaaacgugaagaccaaugguguggaagucuaaucggacugaccaguagagcuaccugggcacagaauauuccuacugcuauccaacaagugagaucacugauuggcaaugaagaauuucuagauuauaugccaaguaugaagcgguuucgcaaggaagaagaaucagagggcgccauuugguaa

SEQ ID NO: 23354 - RNA, 9873 nt, Artificial Sequence
  derived and/or modified CDS sequence (opt6) from DENV-3__FJ562107__SS-prME
acgucauugugcuuaaugaugauuuuaccagcggcauuagcuuuccaccugaccucgcgagacggagaaccuagaaugauaguaggcaaaaacgaacgcgguaaaucuuuacuauuuaaaacugcaucgggcaucaauauguguacacugaucgcaauggauuuaggagaaaugugcgaugacacaguaacauauaaaugcccccacauuacagagguugaacccgaagacauugauugcugguguaaucucacaagcacgugggucacguacggaaccugcaaccaagccggggaacaucguagagauaaacgcucagucgcauuggccccacacgugggaaugggguuagacacaagaacucaaacauggaugucugcagaaggggcauggcgacaaguagaaaaaguagaaacuugggcccucaggcaucccgguuucacaauauuagcacuuuuccuggcacacuauauuggaacaucauugacucagaaaguaguuaucuuuauauugcucaugcuaguaacuccaucgaugacuaugagauguguagggguagggaaucgugacuucgucgaagguuuauccggagcaaccuggguugacguaguacuagaacacggugguugugugacaacaauggccaaaaauaaaccaacguuagauauugaacuucagaaaaccgaagcaacgcagcucgcuacgcuaagaaaacuaugcauagaaggcaaaauuaccaauauaaccacugauagcagauguccgacucaaggagaggcaguacuuccugaagaacaagaucaaaauuauguauguaaacauaccuacgucgaccgcggaugggggaauggcugcggacucuucggcaaagggagcuuaguaaccugcgcaaaauuccaauguuuggagcccauagaggggaaaguaguucaguacgaaaauuuaaaauauacaguaaucaucacagugcacacuggagaccaacaccaaguaggaaacgagacccaaggagugacagcagaaauaaccccgcaagcaagcacaaccgaagcuauccuucccgaguaugguacucuaggauuggaaugcagucccagaacaggucuugauuuuaacgaaaugauccuacuuacgaugaaaaauaaggcuuggaugguacaucgucagugguucuuugauuuacccuuaccauggacgucaggagcaacuacagaaacgccgacuuggaaucgaaaagaacuacuggugacauuuaaaaaugcccaugcuaagaaacaagaggucguuguuuugggaucucaggagggagccaugcauacagcauugacaggcgccacagagauacaaaauagugguggaacaucgaucuuugcuggccaccucaaauguagguugaaaauggauaaacuugaauugaaaggaaugucuuacgcaauguguaccaacacauuuguguugaagaaagaaguuucggagacucaacacgggacuauuuuaauaaaaguggaguacaaaggugaagacgugcccuguaaaauuccauuuaguacggaagauggccaaggaaaagcucauaauggcagguuaauaacagcuaauccuguugucacuaagaaagaagaaccagucaacaucgaagcggaaccaccauuuggugaaaguaauauagugauaggaauuggcgacaacgcuuuaaaaauaaacugguauaagaaagggucgagcauaggcaaaauguuugaagcuaccgcaagaggggccagaagaauggcgauauuaggcgauacagcaugggauuuugggagcgucggagggguccuaaauagucuaggaaaaauggugcaucagaucuuuggaagugcauauacagcacuguucucaggugugucauggguuaugaaaauagguauaggaguguugcuuacuuggauuggucuuaacucaaagaacacaucaaugucuuucagcugcauugucauugguaucaucacauuauaucuaggugcugucguacaagcagauaugggcuguguuauuaacuggaaaggcaaagaauugaaaugugguaguggaauuuucguaacuaacgaaguucauacauggaccgagcaauauaaauuucaagccgauucgccuaaaagacuggcgaccgcaauagccggugcaugggaaaauggcguauguggaauuagaucaacaacgagaauggaaaaucuauuauggaaacagauugcaaacgagcugaauuauauauuaugggaaaacaauauaaaauuaaccgucgugguaggugacauuauaggaguguuagaacaaggcaaaagaacguuaacgccacaaccaauggaauuaaaauacucuuggaaaacauggggaaaagcgaagauaguaacggcugagacucaaaacucaucuuuuauaauagacggaccuaacacaccagaaugucccucggcaaguagagcuuggaacgucugggaaguugaagacuaugguuucggaguguuuacaacaaauauuuggcucaaacuaagagaaguuuacacgcagcuaugcgaucaccgcuuaaugucggcugcaguaaaagaugaaagagcuguacaugcggauaugggguauuggauugagucgcaaaagaauggaaguuggaaguuggaaaaggcaucucuuaucgagguuaaaacguguacguggccgaaaucgcacacacuguggaguaaugguguauuagagucagacaugauaauaccaaaaucccuugcaggaccaauuucgcaacacaauuauagaccgggcuaccacacucaaacugccgggccguggcacuuaggaaaacuagagcuagacuucaacuacugugaaggaacaaccguagucauaacugaaaacugcggaacuagagggccgucguuacggacaaccacggugucggguaaguuaauccacgaaugguguuguaggucauguaccuuaccaccucuaagauacaugggagaggacggaugcugguacgguauggagaucagaccgauuucggaaaaagaagaaaauaugguaaagucguugguaagcgcagggagcgggaaaguugauaacuuuacaauggggguacuaugucuugcuauucuuuuugaggaagucaugcgaggcaaauuugguaaaaagcauaugauagcgggaguauucuuuacuuucguauuacuauuaucagggcaaauuacguggcgagauauggcacauacauugaucaugauaggaucaaaugcuucagacaggauggguaugggcguaacauaucuugcacucauugcaacauucaaaauucaaccauuuuuggcacuaggauucuuuuugagaaaacuaacgucaagagaaaacuugcuauuaggaguuggcuuagcaauggcgacaacacuacaacuuccggaagauaucgaacaaauggcuaauggcauagccuuaggauuaauggcuuuaaaacugaucacacaauuugaaacguaucaacuauggacggccuugauuucuuuaacaugcaguaauacaauuuuuacccuuaccguugcauggcguacagccacauugauccuggcaggcguaagucuacuaccugugugccagaguagcaguaugaggaagaccgauugguuaccgaugacaguugcugcaaugggaguaccuccauuaccccuauucauauuuucuuuaaaagauacuuuaaagcgaagauccuggccuuuaaacgaaggaguaauggccguuggcuuaguuucuauauuagcuucaucuuuauuacgcaaugacguaccaauggcaggccccuugguagcuggagguuuauuaaucgcguguuacgugauuacagguacaagugcggacuuaaccguagagaaagcagcagacguaacuugggaagaagaagcggagcaaacagguguaagucauaauuuaaugauaaccguagacgacgauggaaccaugagaauuaaagaugaugaaaccgaaaauaucuuaacuguguuguuaaagacugcauuacuuauagugucagguaucuuucccuauaguaucccagcaacgcuccuugucuggcauacauggcaaaagcaaacccaaagguccgggguuuugugggauguuccaucuccuccagaaacacagaaggcugagcuagaagaaggcgucuauagaauuaaacaacagggaauuuuugggaaaacgcaagugggaguuggaguacaaaaagaaggcguauuccauaccauguggcaugucacuagaggagccguacuaacauauaacggaaaaagguuagagccaaauugggcuagcguaaagaaagaccuuaucuccuacggaggcggauggagguuaucggcacaauggcaaaagggcgaagaagugcagguuauugcuguugagccggggaaaaauccuaaaaauuuccaaaccaugccagguacuuuccaaacaaccacaggagaaauaggggcgauagcacucgacuucaaacccggcaccucaggaucaccuauaauaaacagggaaggaaaggugguuggacuauauggaaacggaguggugacgaaaaacgggggauacgucaguggaaucgcccaaacuaaugcugaaccggacggaccuacgccagagcuagaggaagaaauguuuaagaaaaggaaucucacgauuauggaccuucauccaggcucaggcaaaacuaggaaauaucuuccggcuauaguaagagaagcaauaaaaaggcgcuugcguacguuaauuuuagccccaacucgcguaguugcugcggagauggaagaggcauuaaagggccugccaauacgcuaucaaaccacagccacaaaaucagaacacacaggaagagaaauuguggacuuaaugugccacgcaaccuuuacaaugcgacuauugagcccuguuagggucccaaacuacaaucucauuaucauggacgaagcacacuuuacagaucccgcaucuauagcugcaagagguuacauuucuacacgugucggcaugggugaagcggcagcuauuuuuaugacagccacgccuccaggcacggcagaugcauuuccucaaagcaacgcccccauacaggaugaagaacgagauauaccagaaagaagcuggaauagugggaacgaauggauaacagacuucgcagggaagacugucugguuuguuccgucaauaaaagcuggaaaugauaucgcuaauuguuuaaggaagaacgguaagaaaguaauucaauugaguaggaagacauuugacacggaguaccagaaaacaaaauuaaaugacugggauuucguaguuacaacagauauaucugaaaugggagcgaauuuuaaagcggauaggguaauagauccucgaaggugccuuaaaccugugauauugacggacggcccugagcguguuauacuggcugguccaaugccaguaaccgcugcaucugcagcccaaaggaggggcagaguuggaaggaauccccaaaaagaaaaugaucaguauauauucacaggacaaccauuaaauaaugaugaagaucaugcgcacuggacugaagccaagaugcuauuggacaauauuaauacaccugaaggaaucauaccugcacuauuugagcccgagcgagagaaaagugccgccauugacggcgaauauagacucaaaggcgaaagcagaaagaccuucguagaacuaaugagacgcggagacuuaccaguuuggcuagcauauaaaguggcaagugaaggaauaaaguauacggaccgcaaauggugcuucgauggacaaagaaauaaccaaauauuggaagaaaauauggacguagaaaucuggaccaaagaaggagagaagaagaaacuacgaccaagauggcuagaugccagaacuuacuccgauccauuagcucuuaaagaguuuaaagauuuugccgcuggucgaaaaucuauugcccuugaccugguaacagaaauaggaaggguaccaagccauuuagcccaccgcacaagaaacgcgcuugauaaucuaguaaugcuucauacuucagagcauggcggcaaggcuuauagacacgcaguagaagaacuaccggaaacuauggagacauuauuauuauuaggauuaaugauccuacuaacagguggugcaaugcuauuuuugauaagugguaaagggauuggaaaaacaucaauaggcuuaauuugcguuauugcaucaucagggaugcuuuggauggcggagaucccauuacaauggaucgcuagugcaauaguauuagaguucuuuaugaugguguuauuaauaccugaaccugaaaagcaaaggacaccgcaagauaaccaacuagcauacguuguuaucgguauuuuaacccuugccgcuauaauagcggcuaacgaaaugggacuacuggaaaccacaaagagagaucucggcaugucaaaagaaccuggaguaguuucgccuacuucauaccuggacguagacuugcauccagcaagcgcuuggacacuauaugccgucgcaacaacuguaauaaccccgaugcucaggcacacgaucgaaaacaguaccgcaaauguaaguuuagcagcgauagcaaaucaggccguuguacugaugggauuagauaaaggauggcccauuucgaaaauggauuuaggagugccgcuucuggcauuaggauguuauucucaggugaacccacuuacacuuacugcugcaguacuccuucucauaacgcauuaugcaauaauaggucccggcuuacaagccaaagcaacacgagaggcccaaaagcguacagcugcggguauuaugaagaaccccacaguagacgguauuaugacaauagaucuggacccuguuauauacgauaguaaguucgaaaagcagcugggacaagucaugcuauuaguauuaugcgccguacaauuacuccucaugagaacaucgugggcucucugugaagcacugaccuuagcaacgggaccaauaacaacucuuugggaaggcucuccugguaaguuuuggaauacaacuauagcgguaucaauggcgaauauauuccgaggcucauaucuggcuggugcuggauuggcauuuagcauaaugaaaucagucggcacggguaagagaggcacuggaucacaaggagaaacauuaggcgagaaguggaagaagaaauugaaccaacugagucgaaaggaauuugaucuguauaagaaaaguggaauuacagagguagauaggacggaggcuaaagaaggauuaaagagaggggaaauaacacaucaugcgguaagccgagggucugcaaaauuacaaugguuugucgaacguaacauggucaucccugaaggaagaguaaucgaucugggaugcggacggggaggauggucauauuauugcgcaggucuaaagaaagucaccgagguaagaggauauacaaagggaggucccggacaugaggaaccagugccaaugaguacauauggguggaacauagucaaguugaugaguggcaaagacguauucuauuuaccuccggaaaaaugcgauacauuacugugcgauauuggugaaaguagcccaagcccuacagucgaggaaucccgaacuaucagaguucuaaaaaugguagaaccauggcugaaaaauaaucaauuuugcauuaagguacucaauccauauaugccuacuguaauagaacaucucgaaagauugcaaaggaaacauggagggaugcuugucagaaauccccuuaguagaaauaguacgcaugaaauguacuggaucucuaaugguacaggaaacaucguugcaucgguaaauaugguuucacgauuacuccucaacagauuuacuaugacucauagaagaccaacaaucgaaaaagauguagaucuaggugcgggaacucgucauguaaacgccgaaccugagacacccaauauggaugugauaggugaacgaaucaagcgaauuaaagaagaacauaauaguacauggcauuaugacgaugaaaaccccuacaaaacuugggcauaccauggaaguuacgaaguuaaagccaccgggucagcaaguaguaugauaaauggcguuguaaaguuauuaaccaagcccugggauguugucccaaugguaacacaaauggcgaugaccgauacuacuccguuuggucaacagcggguuuucaaagaaaaaguagauacgaggaccccucgcucaaugccagggaccagacgugucaugggaaucacggcugaaugguuauggcguaccuuaggacgaaacaagaaaccacgacuaugcacgagagaggaauuuacaaagaaaguucgaacuaacgcagcaaugggcgccguguuuacugaggaaaaccagugggacucagcuaaagcagccguggaagaugaggauuuuuggauacucguagacagggaacgggaacuccacaaacuuggaaaauguggaucauguguauauaauaugaugggaaaaagagagaagaaauuaggagaguuuggcaaagcuaaaggauccagagcaauuugguauaugugguuaggggcucgauauuuagaauuugaagcgcuaggguucuuaaacgaagaucauugguucucacgagaaaacucauacagcggcguagaaggugaaggccuacauaaauuagguuacauucuacgugauauaucuaagauaccggguggagcgauguaugcagacgacacagcugggugggacacucgaauaaccgaagaugacuuacacaacgaagagaaaaucacacagcaaauggaucccgaacaccgacaacuugcaaaugcaauauuuaaacuaacuuaccaaaauaaaguaguuaaggugcagaggccgacgcccacugguacagugauggauauaauaagcaggaaagaucaacgaggcucgggccaaguuggaacguacggucuuaauacguuuacaaacauggaagcgcaacuaauacgacaaauggaaggagaaggaguauugaguaaggcagaccuugaaaacccgcaucugccugagaagaagauaacacaaugguuggaaacaaaaggaguugaaagauuaaaaagaauggcuauaucaggugacgacuguguagugaaaccaauagaugaucgguuugcuaacgcgcuauuagcauuaaaugacaugggcaagguuaggaaggacauaccgcaauggcaaccuaguaagggguggcacgacuggcaacaaguuccauucugcagccaccauuuccaugaacuuauaaugaaagauggucgaaaacucgugguaccaugcaggccacaagacgagcuaauaggaagggcccgcauuucacaaggcgccgguuggucuuugagagaaacagcauguuuagggaaagcauacgcucaaauguggagccucauguacuuucaucgacgagauuuacgacuagccucaaaugcuauauguagcgccguuccugugcauuggguuccgacuucuagaacuaccuggucaauucacgcacaucaccaauggaugacuaccgaggacaugcuaacaguauggaacagaguauggaucgaggauaaucccuggauggaagacaaaacaccuguuacaacgugggaaaacguuccauauuuaggcaaaagagaggaucaaugguguggaucauuaauuggccucaccucuagggcuacaugggcacagaauauacccacagcaauacaacaaguccgcagcuuaaucgguaacgaagaguucuuggacuauaugccuaguaugaagcgauuuagaaaagaagaggagucagaaggugcaauaugguaa

SEQ ID NO: 23355 - RNA, 9873 nt, Artificial Sequence
  derived and/or modified CDS sequence (opt6) from DENV-3__FJ547071__SS-prME
acgagcuuauguuuaaugaugauccuaccugcugcacuagcuuuccauuuaacuagcagagacggagaaccaagaaugauaguaggcaaaaaugaaagagguaaaucacugcucuuuaaaacugcuucaggaauaaacaugugcacucugauugcuauggaucuuggagaaaugugcgaugauacaguuacuuacaaauguccacacauaacugaagucgaaccagaagacauugacuguuggugcaauuuaacaucuacauggguuacuuauggaacuugcaaccaagcuggagaacacagaagagauaaaaggucaguagcguuagcuccgcacguggggaugggccuagauacaagaacccaaaccuggaugucugcugaaggagcauggagacaaguggaaaaaguugaaacaugggcgcuacgacaccccggauucacaauauuagcucuauuucuagcucacuacauaggcacuucccuuacacaaaaaguaguaauuuuuauauuacuuauguuagucacaccauccaugacaaugcgcuguguaggagugggaaauagagauuuuguagaaggauuaagcggagccacaugggucgacguaguacuugagcauggugguugugugaccacaauggccaaaaacaaaccaacauuagacaucgaguugcagaaaacagaagccacacaacuugcgacgcuaagaaaacugugcauugaagguaaaauaacuaauauuacuacggauucgcgaugucccacucaaggagaggcaguacuuccugaggaacaagaucaaaauuauguaugcaaacacacguauguagacagagguugggguaacggaugugggcuauucggaaaagggucacuuguaacaugugcuaaauuucaaugucucgaaccuauugaaggcaaaguagugcaauaugaaaaccuaaaauauacaguaauuauaacaguacacacgggggaccaacaucaaguugggaacgaaacccaaggcguaacggccgaaauaacaccccaagcaucaacaacagaagccauacuaccagaauacgguacacuaggacucgaauguuccccaaggacaggauuggauuuuaaugaaaugauacugcuuacaaugaaaaacaaagcauggaugguucauagacaaugguucuucgaucuuccucuaccauggacaaguggagcgacaaccgagacaccaacauggaauaggaaagagcuauuagugacauucaaaaaugcccaugccaagaaacaagaaguaguuguuuuagguucucaagagggcgcaaugcacacugcacugaccggagcgacagaaauucaaaacucaggugguacaaguaucuuugccggacaccucaaaugccgccuaaaaauggauaaauuagaacuaaaaggcaugagcuaugcuauguguacgaauacauucguccuaaagaaagagguuagugaaacccaacauggcacuauauuaauaaaaguugaauauaaaggugaagacguuccuuguaaaauccccuucaguacagaggauggacagggaaaagcacauaauggaagacuuauaaccgccaaucccguaguaacaaagaaggaggaaccaguuaauaucgaggcugagccaccguuuggcgaaaguaauauuguaauaggaaucggggauaaugcuuuaaagauaaacugguacaaaaagggaucuagcauagguaagauguuugaggcaacagcucgaggggccagaagaauggcaauacuuggagacacggccugggauuucgguucgguaggggguguacuuaauucccuagggaaaaugguucaucagauauuuggaagcgcuuauacagcucuauucucaggaguaagcuggguaaugaaaauaggaauugggguccuguugacauggaucgggcuaaauucuaaaaacaccucaauguccuucucuuguauugcaauaggaauaauaacucuauaccucggcgccguaguucaagcagauaugggaugcgugauaaacuggaaaggaaaagaacuaaaguguggcagcgggauuuuuguaacgaacgaaguucacacuuggacagaacaauacaaguuucaagcagauucacccaagcgcuuagccacagccaucgcuggagccugggaaaacgguguauguggaauacgaucaacgacacgaauggaaaauuuauuauggaagcaaauagcaaacgaacugaacuauauucuuugggaaaauaauaucaaacuuaccgucguugucggagauauuauuggaguuuuagaacaggguaagcgaacuuuaacgccucaaccaauggaguuaaaauacuccuggaaaacauggggaaaagcaaaaauagucacugcagaaacccaaaauaguucauucauuaucgauggcccaaauacaccagaaugcccgucugcaucccgagcguggaauguaugggaagucgaagacuaugguuucgguguuuuuacuacuaauauaugguuaaaacuccgagaaguuuacacucaacucugugaccaccggcugaugagugcugcaguaaaagacgaacgcgccgugcacgcagauauggguuacuggauugaaucccagaaaaacggaucguggaagcucgaaaaagcaucguugauugagguaaaaacauguaccuggcccaagucccauacucuguggagcaaugguguguuagaaucugauaugauuaucccaaaaagucuugccgguccgauuucacagcauaauuaccgcccuggauaucacacacaaacggccggcccuuggcaucucggaaaacuugaacucgacuuuaauuacugugaagguacaaccguuguaauuaccgagaacugcggcacgaggggucccucccuaagaacaacaacagugucggggaaacugauucaugaaugguguugccgaucgugcacacuaccuccucuaagauacaugggagaagaugguuguugguacggcauggaaaucagaccaauaucagaaaaagaggaaaauaugguaaaaagucugguaucggcuggcucgggcaaaguggauaacuucacuauggguguucuuuguuuagcuauacuauuugaagaagucaugaggggaaaguucggcaagaaacacaugauagcaggcguauucuuuacuuuugucuuguuguuaucgggucagauaacuuggcgggauauggcacauacacuuauuaugauugguucaaaugcaucugaucguaugggcaugggugugacauaucucgcacucauagcaacauuuaagauacaaccguuccuagcauuaggauucuuucugagaaaacuaacaucgcgcgaaaaucuuuuguugggagucggguuggcgauggccacaacuuuacaguugccugaagacauugaacagauggcuaaugggauagcguuagggcuaauggcauuaaaguuaauuacacaauuugaaacguaucaacuauggacugcuuuaaucagcuuaacguguaguaauaccauauucacgcuaacuguugccuggcgcacagcuaccuuaauacuagcaggagugaguuugcuacccgucugucaaaguuccuccaugaggaaaacugauugguuaccaaugacuguagcagcuauggggguuccucccuuaccauuauuuauuuucucauuaaaagacaccuuaaaacguagauccuggccauuaaacgaaggaguaauggcagucggauuggugaguaucuuggcaucaucucuguuaagaaaugauguuccaauggcaggucccuuaguugcugguggauuacucauagcuuguuacguuaucacagguacaucugcugaccucacaguggagaaaacugccgacgucacaugggaagaagaagcugaacaaaccggcguuagucacaaccuaaugauuaccguugaugacgaugguacuaugaggauaaaagaugacgagacugaaaacauccuaacaguacuguuaaaaacagcgcuucugauaguaagugguaucuuucccuauaguauaccagcaacauuguugguguggcauacauggcagaaacaaacccaaagauccggaguccuuugggauguuccaucacccccagaaacccagaaggccgaacuagaagagggcguauacagaauaaaacaacaagguauauuugggaaaacacaagucggcguaggugugcaaaaagaaggcguauuccauacgauguggcaugucacaagaggcgcugucuuaacuuacaauggaaaaagguuagaacccaacugggcuaguguuaagaaagacuuaaucucuuauggcggcggguggagauuaagugcacaauggcagaaaggagaagagguacaaguaauagcaguagaaccuggcaaaaaccccaaaaauuuccaaacaaugccaggaacauuucaaaccaccaccggagaaauaggugcaauagcuuuagacuucaaacccggcacauccgguaguccgauuaucaaucgugaagggaaaguagucggacuauacggaaauggaguagucacaaagaauggagguuacguuucggguauugcucaaaccaaugcagaaccugaugguccaacaccugaguuagaggaggagauguuuaaaaagaggaaucugaccaucauggaccuacauccgggcucaggaaaaacaagaaaguaucuaccugcgauaguaagagaagcaauaaaaagacgauugcgcacacuuauacuagcaccaacacgaguaguagcggcugaaauggaagaagccuuaaaagguuugccaauuagauaucagacaacugcaacaaaaucugagcauacuggucgugaaauuguagauuugaugugucacgcgacauuuacaaugagauugcucaguccaguaaggguacccaacuauaauuuaauaauuauggaugaggcccauuuuacggauccagccucaauagcagcacggggcuauauaaguacuaggguugguaugggagaagcagccgccauauuuaugacugcuacuccgccagguacggcagacgccuucccacaaucaaaugcuccaauucaagaugaggaacgugauauaccggaacguaguuggaacucuggcaacgaauggauuacggauuuugccgggaaaacaguuugguuuguuccuuccauuaaagccgguaacgacauagcaaacugucuacguaaaaacggcaagaaaguaauucaacuuucacguaaaacauuugacacagaauaccaaaagacaaaauuaaaugacugggacuuuguagucacaacggacaucuccgaaaugggugcaaacuuuaaagcggauagagugauagacccccgucgaugucugaaaccagucauacuuacugacggcccugagagagugauucuugcuggcccuaugccaguaacagcggccucagcagcccaacgucgugggcguguaggccguaauccgcaaaaagaaaaugaccaauauaucuuuacuggucaaccucuuaauaaugacgaagaucacgcacauuggacagaggcaaaaaugcuacuagacaacauaaacacacccgagggaauuauacccgcacuguuugagcccgaaagagaaaagagugcagcaauugauggggaauaccguuugaagggagagucacgaaaaacauucguggaauuaaugagaagaggagaccuaccaguuugguuggcacauaaaguagccagugaagguauaaaauacaccgacagaaaauggugcuucgaugggcaaagaaauaaccaaaucuuagaggaaaauauggauguagagauauggaccaaagagggugaaaagaaaaaguuacggcccaggugguuggaugcccguacauacucagauccccuggcgcuaaaagaauuuaaggauuuugcagcagguaggaagucaauagcucuagacuuagucacggaaauuggacgugugccuagucacuuggcucaccgaacacgcaaugcacucgauaaucugguuaugcuacacaccagcgagcauggaggaaaggcuuauagacacgcagucgaggagcuuccagagacaauggagacuuuauuauuguuaggguuaaugauacuguugacuggaggggcaaugcuauuucuaauaagugguaaaggaauaggaaaaacaagcauaggauuaauaugugugaucgcuaguucgggaaugcucuggauggcggaaauaccauuacaguggauagcaucagcuauaguauuagaguucuuuaugaugguacuguuaauucccgaaccugaaaaacaacguacaccccaagauaaucagcucgccuacguagugauagggauuuugacgcuggcagcaaucauagcagcuaaugaaaugggauuauuagaaacuacaaaaagggacuuaggaaugagcaaggaacccggcguaguaucaccaacaaguuauuuagacguggauuuacacccagcaucugcguggacauuauacgcaguagcuacgacaguuauuacuccaaugcuaaggcauacgauagagaacaguacugcaaauguaagucuagccgcaaucgcaaaucaagcuguuguauuaaugggcuuagauaaaggcuggccaauuuccaaaauggaucuugggguuccucucuuagcuuuggguugcuauucccaaguuaauccauuaacacuaacugcugccguauuguuguuaaucacucauuacgcaaucauaggaccaggauuacaagcuaaagccacucgugaagcccagaaacggacagcugcggggaucaugaaaaacccaaccguagacgggauaaugacaauagaccuagaccccguuaucuaugacagcaaauuugaaaaacaauuaggucaaguaauguuguuaauauuaugcgcaguacagcucuuguuaaugcgaacaaguugggcauuaugugaagcauuaacgcucgccacgggacccauuacgacacuuugggaaggauccccagggaaauuuuggaauacuacaauagcagugagcauggcuaacauauuuagagguaguuaccuagcuggagcggguuuggcauucagcauaaugaagucagucgggacaggaaaacgaggaacgggcucucaaggcgaaaccuuaggagagaaauggaagaagaaauugaaucaauuaagccgaaaagaguuugaucuguacaagaaaucaggcauaacagagguugacaggacugaagcaaaagagggauuaaagagaggggagauaacacaucaugcaguaagcagaggcagugcaaaauuacaaugguuuguugaaagaaauauggucauacccgaaggaagaguuauagacuuaggaugcgggagaggaggcugguccuauuauugugcaggccugaagaagguuaccgaagugcgaggauacacaaaaggaggacccgggcacgaagaacccgugccuaugucuaccuacggcuggaauauugucaaacuaaugaguggcaaagacguauucuaccuaccgccagaaaagugcgacacuuuacuaugugauauaggagaauccucuccgaguccuacaguggaagaaagucguaccaucagaguacuuaagauggucgagcccugguuaaagaauaaucaauuuugcauaaaaguacuaaauccauacaugccaacuguuaucgaacaucuagaaagauuacaacgcaaacauggaggcaugcuaguaaggaauccgcuaucaagaaauucaacccacgagauguacuggauaucaaauggcacagggaacaucguagcaagcguaaacaugguaagccggcuucuuuuaaacagauuuacaaugacucauagaagaccgacuauagagaaagaugucgaccucggagcagguacucgccaugucaaugccgagccugaaaccccaaauauggacgugauaggagagcggaucaagcgaauuaaagaggaacacaacaguacguggcauuaugacgaugaaaacccguauaagaccugggccuaucaugguucauaugaaguaaaagcgacaggaucggcuaguucgaugauaaacgguguggucaaacuauuaacaaaaccuugggacgucguaccuaugguaacccagauggcaaugacggauacuacaccguucggacagcaaagaguuuuuaaggagaaagucgacacaaggacgcccagaucgaugccaggcacucgaaggguaaugggaaucacagcggagugguuauggcgaacacuaggaaggaauaagaaaccccggcuaugcacaagagaggaguucacuaagaaaguccguaccaaugcagcaaugggagcaguuuuuaccgaagagaaucagugggauucagcuaaggcagcaguagaagacgaagacuucuggaaauuaguagacagagagcgagaauuacacaaacuaggaaaaugcggaagcuguguuuauaauaugaugggaaagcgggagaagaaacuuggagaguucgguaaagcgaaaggaagucgugcuauuugguauaugugguuaggugcaagauauuuagaguucgaagcguuaggauuucucaacgaagaccauugguucucacgagaaaacucguauaguggcguggaaggcgagggguuacauaaacucggguauauauuaagagauaucucgaaaauaccuggaggagcuauguaugcagaugauacagcgggaugggacacccgcauuacugaggacgaccugcacaaugaggagaaaauaacgcaacaaauggacccagaacauagacagcuggcgaacgccauauuuaaauuaacuuaccagaacaagguaguaaaaguacaaagaccuacgcccacgggcacgguaauggauauaauuucgcggaaggaucagcgggguagugggcaaguagggaccuaugguuuaaacaccuucacaaauauggaagcccaauuaauaaggcaaauggaaggugaagggguacuaaguaaagcugaucuagaaaacccccaccuuccugagaagaaaauaacucagugguuggaaacaaaaggcguagaacgauuaaaacgaauggcuauaaguggggaugauugcguaguaaaacccauugaugaucgauuugcaaacgccuuauuggcauuaaaugacaugggaaaagugcgcaaagacauaccucaauggcaaccguccaaagguuggcacgacuggcaacaaguaccuuuuugcucacaccacuuucaugaacucauaaugaaagacggccgcaaacucguggucccauguagaccccaagaugagcuaauagggagagccagaauuucacaaggugcaggcuggagccuacgugaaacagccugucugggaaaggcauacgcccagauguggagucuaauguacuuucauagacgagauuugcgcuuagcaagcaacgccauauguucggcuguaccaguacacuggguaccaacgucgcgcacgaccuggucaauacaugcacaucaccaauggaugacaacagaagacaugcuaacaguguggaauagaguauggauagaagacaauccauggauggaggacaaaacucccguuaccacgugggaaaauguucccuaucuaggcaagcgggaagaucagugguguggaagccugauaggucuaacaagccgggcaacaugggcucaaaacauaccuacagcgauucaacaaguuagaaguuuaauagggaaugaagaauuucuugauuacaugccuaguaugaaaagauuccggaaggaagaagaaagugaaggugcaaucugguag

SEQ ID NO: 23356 - RNA, 9873 nt, Artificial Sequence
  derived and/or modified CDS sequence (opt6) from DENV-3__FJ410176__SS-prME
acuucguuaugccuaaugaugauacuaccugcagcacuugcauuucaccuuacuucgcgcgacggggaaccccgcaugauugucggcaaaaaugaaagaggaaaaucuuuacuauucaaaacagcuucagguauaaacauguguacauuaauugcaauggaccuaggagaaaugugugaugauacugugacguauaaauguccacauauaacagagguugagccugaagacauagacugcuggugcaauuuaacauccacguggguaacauacgguacaugcaaucaagcgggagagcacaggcgggauaaaagaucgguugcauuggcgccgcauguuggaaugggacuggauacaaggacgcaaacuuggauguccgcugagggagcuuggagacaaguagaaaaaguagaaacuugggcccuucgccacccgggauucacaauccuagcacuauuuuuggcacacuacauagguacaucgcuaacucaaaaagucgucauauuuauucuacucauguuagucaccccaagcaugacuaugaggugcguaggaguaggaaacagagacuucgucgagggucuaucaggugccacguggguugacguaguuuuagaacauggggguugugucaccacgauggccaaaaacaagcccacacuagacaucgaauuacagaaaacugaagcaacgcaacuugcgacauuaaggaaauuaugcaucgaaggaaaaauaacaaauauuacaacugacagucgguguccuacgcaaggggaagcuguauugccagaagaacaagaucagaauuacguauguaaacacacauaugucgaucgggguuggggaaauggaugugguuuauucggaaaagguagucuugucacgugugccaaauuucaauguuuggaaccaauagagggaaagguaguccaauaugaaaauuuaaaauauacgguuaucauuaccguacauaccggggaucaacaucaaguugguaacgaaacacagggagugaccgcagaaauuacaccacaggcuuccacgaccgaagcgauauuaccagaauacggaacuuuaggauuagaguguucaccucguacaggucuagacuucaacgaaaugauacuguugaccaugaaaaauaaagccuggaugguacaccgacaaugguucuuugaucuuccccugccauggacaaguggagcgacuaccgagacccccacguggaaccgcaaagagcuccuagugacuuuuaaaaacgcacaugcgaagaaacaggaaguaguuguacuggggucccaggagggcgccaugcauaccgcacugacaggagcuacggaaauucaaaauagugggggcacgucaauuuucgcuggucaucuaaaauguagacuaaagauggauaaauuagaacucaaaggaaugucauaugcuauguguacuaauacguuuguauuaaagaaagaagucucugaaacgcagcauggaacaauacuaauaaagguagaauauaagggagaagauguacccuguaagauaccuuucucuaccgaagauggacaaggcaaagcacacaauggaaggcuaauaacagcgaauccugucguaacuaagaaagaagaaccugugaauauagaggcagaaccacccuuuggagaauccaauauaguaauuggaauaggugauaaugcucucaaaauuaauugguauaagaaaggaucaagcauugguaagauguucgaagcaacagcucggggcgcaagaagaauggccauacuuggagauacagcaugggacuuuggaucaguugguggaguuuugaauagccucgguaaaaugguacaccaaauauuuggcucugcguauacagcauuauuuucaggagucagcuggguaaugaaaauaggcauuggaguauuauuaacguggauaggucucaauucuaaaaauacaucgauguccuuuucauguauagcgaucgguauaaucacccucuaccuaggagcuguaguacaagccgauaugggauguguaauuaauuggaagggcaaggaauuaaaauguggcucagguauauucgugacaaacgaaguucauacguggacugaacaauacaaauuccaagcagauuccccuaagaggcucgcgacggccauagccggagcuugggaaaacggaguaugcggcauucgcucuacuacacgaauggaaaaccuuuuauggaaacaaauagcgaacgaacuuaacuauauauuaugggagaacaacauaaaguuaacaguaguuguaggugacacaauaggaguucuugagcaaggaaaaagaacgcuuacuccucaaccgauggaauuaaaauauaguuggaagacauggggaaaagccaaaauaguuacggccgaaacacagaauaguucguuuauuauugaugggccuaauacccccgaauguccaagugcaagcagagccuggaauguuugggagguagaagauuauggauuuggaguguuuacgacaaacauuugguuaaaacuaagagagguauauacacaguuaugcgaccacagguugaugucugcagcggugaaagaugagagagcuguccacgcagauaugggcuauuggauagaaucacagaaaaacggauccuggaagcuggaaaaagccucguuaauagaagucaaaacaugcacuuggccaaaaucacacacauuauggucuaacggcguccuagaaucagacaugauaauuccaaaaaguuuagcagguccaaucucucagcacaauuacagacccggcuaccacacgcaaacagcgggucccuggcauuugggcaaacucgaguuggauuucaauuauugugaagggacaacaguaguaauaaccgaaaacuguggaacaagaggaucgucacucagaaccacgacgguaagugguaaacuaauccacgaaugguguuguaggaguugcaccuugcccccauuaagauacaugggagaagacggauguugguacgguauggagauaagacccauaucggaaaaagaagaaaacaugguaaaauccuuaguuucagcgggcucugguaaaguagacaacuuuacaaugggaguacuuuguuuagcaauucuauuugaagaaguuaugagagguaaauuugggaagaaacacaugauugcaggaguacuuuuuacuuucguacuucuacuaagugggcaaauuacuuggcgugauauggcucauacccugaucaugauaggcaguaacgcuagcgauagaaugggaauggguguuaccuaccuagcacugauugcaaccuuuaaaauucaaccauuuuuagcauuaggauucuuucugcgaaaacuaacuagcagagaaaacuuauuacuaggagugggucuagcuauggcaacaacuuuacaguugccagaagauauagaacaaauggcgaauggaauugcauuagggcuaauggcauuaaaacuuaccacacaauuugagacauaucaacuguggacugcacuaauuucauuaacguguaguaauacuauauucacacuuacuguagcauggcggaccgccacccuuauauuagcugguguuucuuuacugccaguaugucaaaguagcucuaugagaaaaacugacugguuaccgaugacuguagcagcgaugggaguacccccgcucccucuauuuauauuuucacuuaaagacacauuaaaacgcagauccuggccuuuaaaugaaggcgucauggcuguaggacuggugucuauauuagccagcucuuuacuaaggaaugacguaccaauggcuggaccacucguagcugguggcuuacuaauugcaugcuauguaauaacagguaccagugccgacuuaaccguagaaaaggcggcagacguuacaugggaagaagaagcagaacaaaccgguguaagccauaacuugaugaucacaguagacgaugacggaaccaugcgaauaaaagaugaugaaacagagaacaucuuaacaguauuguuaaagacugcauuacuuauuguaagcggcauuuucccauauuccauucccgcgacucuacugguuuggcacacauggcaaaaacagacgcagagaagcggaguacugugggacguaccuucaccucccgaaacgcaaaaagccgaacuggaagaaggaguuuauagaauuaaacagcagggaauauuugguaaaacgcaaguaggaguagggguacaaaaagaggguguauuucauacaauguggcauguaacacguggugcaguauuaacauauaauggaaaaagacuggagcccaauugggcaagcguuaagaaagaucugauaaguuacggagggggcuggagacuaucagcgcaguggcaaaaaggcgaagaaguacaagugauagcgguggaaccuggcaagaaucccaaaaauuuucaaacaaugccgggcacauuccaaacaaccacaggagaaauaggugcuauagcgcuagacuuuaagccuggaacaaguggaagcccaauuaucaauagggaagguaaagugguuggguuauacggaaauggugugguaacuaaaaauggaggcuacgugucaggaauagcgcagacaaaugcugagccugacggaccgacaccagaacuugaagaagaaauguucaaaaagcgaaaucucacuauuauggaucuacauccgggaucugguaaaacaagaaaguauuugcccgcgaucgugagagaagcuaucaaacgccgauuaagaacccucauauuggccccgacccgcgucguggcugcagaaauggaagaggcacuaaaaggguuaccuauuagauaucaaacaacagcuacgaaaucggaacauacugguagagaaauugucgauuugaugugucaugcaacauucacuaugcguuuauuaucaccagugcgugugccaaauuauaacuuaauaauuauggaugaggcacauuucacugaccccgcaucaaucgcggcccggggguauauuucaacacgaguaggaaugggagaggccgcugcgauuuucaugacggcaacacccccagguacugcagacgcauuuccccaaucgaaugccccaauucaagaugaagagagagauauaccggaaaggaguuggaauagcggaaacgaauggaucacugacuucgccgguaaaacaguaugguuugucccuaguaucaaggcaggaaacgauauugcuaacugccuacgaaagaauggcaaaaaggugauacaauuaaguagaaaaacauuugauacugaauaucagaaaacaaaacugaaugacugggauuuugucguaacaacugauauaucagaaaugggugcaaauuucaaggcagacagagugauugacccuagacguuguuuaaagcccguaauacugacagaugguccugagcgaguaauacuagcagguccgaugccgguaacagcugcaagugcugcacaaagaagaggaagagugggcagaaacccacaaaaggaaaaugaccaauauauauuuaccggucaaccacuaaacaacgaugaagaccacgcccauuggacggaagccaaaaugcuauuggauaacauaaacacaccugaaggcauuauuccagcccuguuugagccagaaagggagaaaagcgcggccaucgauggagaguauagacugaagggagaaaguagaaaaacuuucguggaauuaaugagacguggagauuuaccggucugguuagcacauaagguugcuucugaaggcauaaaauacacagaucggaaauggugcuucgauggacaacgaaacaaccaaauacuggaagaaaacauggacguggaaauuuggacaaaagaaggcgagaagaagaaacuacgcccucgauggcuugaugcccgcacauauucugacccucuugcuuuaaaagaauuuaaagauuuugcagcaggaagaaaguccauagcuuuagaucuaguaacagaaauuggaagaguuccaagucaccuagcccauaggacaaggaacgcuuuggacaauuuggucauguuacacacgagcgaacacggaggcaaagccuaccgucaugcaguagaagaguugccagaaacgauggaaacgcuguuguuauuaggacuaaugauauuacuaacaggaggugcaaugcuuuuucuaauaagugggaagggaauugggaagacaaguauaggauuaaucugcguuauugcaucgucugguauguuauggauggcggaaauuccucuucaauggauagcaagugcaauagucuuggaauuuuucaugaugguccuucugauaccagagcccgaaaaacagagaacaccgcaagacaaucaguuagcauacguaguaauuggaauacuuacacuagcagcuaucauagcagcaaaugagaugggccuauuggagaccacuaagcgggaccuagguaugucuaaggaacccgggguugugagcccaaccucuuaccucgauguggauuuacauccagcaucggcauggacccuuuacgcuguagcgacuacuguuaucaccccaauguugcgacauacuaucgagaauagcacugcgaacgugucucuagcugccauagcuaaucaagcaguuguacuaaugggacuagacaaaggauggccaauaucuaaaauggaccucggaguaccccucuuagcacuagguuguuacucacaaguaaauccacuaacccuaacagcggcuguauuauuguuaaucacucacuaugcuauaaucgguccagguuuacaagcaaaggcaacgcgcgaagcccaaaaacgcacagccgcagguauuaugaaaaauccaacuguggaugggaucaugacgauagauuuagacccuguuauuuaugacucaaaauuugagaaacaacuaggccaagucauguuacucguauugugugcaguccaauuacuccuaaugaggacuucaugggcucuuugcgaagcguugacauuagcgacgggaccaauuacaacacuuugggaagguucuccgggaaaauucuggaacacuacgauugcuguaucgauggcgaacauauuccgcgggaguuaucuugccggcgcuggacuagccuuuucuaucaugaagucagucgguacgggcaaaagagggaccgggagucaaggagaaacccuaggcgagaaauggaaaaagaaacucaaucaacuaucacgaaaagaguuugauuuauauaaaaagagugguaucacugaaguagauagaaccgaagcaaaagaaggucuaaagcgaggugaaauaacacaccacgcaguuagcagaggcucggccaaacuucagugguucguugaaagaaacauggugauaccugaagguagggucauugaccucggaugugguagaggagguuggagcuauuacugcgcaggacuaaagaaaguaaccgaaguaagagguuacacaaaagguggaccggggcaugaagaacccguuccuaugucuacuuauggauggaacauuguuaaauuaaugucaggaaaagacguauuuuaucuucccccagagaaaugugauaccuuauugugcgauauaggugaaucuucaccuucaccaacaguugaagaaagucguacaauucgaguuuuaaaaaugguugaaccuuggcucaaaaauaaucaauuuuguaucaagguauuaaaucccuacaugcccacuguaauagaacaucuagaacgauugcaacgaaagcaugguggaauguuaguaagaaacccacugagccgcaacucaacucaugagauguacuggauaagcaaugguaccggaaauauaguagcaucuguuaauauggugaguagacuacuucucaauagguucacaaugacucaucgacgaccgacaaucgaaaaagauguagaucuaggugcuggcacacgacaugucaacgcagagcccgagacuccaaacauggacgugaucggugaaagaaucaaaagaauaaaggaagaacauaauucuacuuggcacuaugaugaugagaacccuuacaaaacgugggcauaucacgguucauacgaaguuaaagcaacuggaucagcgaguucaaugauaaauggagugguaaaacuuuuaacaaaaccgugggacguagugccgauggucacacaaauggccaugacagauacuacuccauucgggcaacagcggguauucaaagagaaaguagacacaagaacaccaaggucaaugccggggacgagacgaguuaugggaauaaccgcggaaugguuauggcguacuuugggaagaaacaaaaagccuagauuguguacccgugaggaguucaccaagaaaguacguacuaaugcugcaaugggagcagucuuuacagaagaaaaccagugggauucagcaaaagcagccgucgaggaugaagacuuuuggaaauugguagaucgagaacgcgaauuacauaaacuaggcaagugcggcucaugcguauacaauaugaugggaaaaagagaaaagaaauuaggugaauuuggaaaggcuaaaggaucuagagcuauaugguauauguggcuuggugcgagauaccuagaauuugaagcacucgguuucuuaaacgaagaccacugguuuucaagagagaauaguuauuccggcgucgagggcgaaggguuacacaaacuuggcuauauucuaagggauauaagcaaaauuccaggaggugcaauguaugccgaugauacugcaggaugggauacaagaauaacagaggaugaucugcacaaugaggaaaagauaacacaacaaauggauccagaacauagacaauuagcgaaugcuauauuuaaauuaacauaccaaaacaaaguggucaaaguccagagaccaaccccaacgggcacagucauggauauaaucaguagaaaggaucagcgcggaucuggacaaguugguacguacgggcuuaacacguuuacuaacauggaagcgcaacuuaucagacagauggagggggaaggaguacugucuaaggcagauuuagaaaauccucaucuucccgagaagaaaauuacgcaauggcuugaaacuaaaggaguagaacgauuaaagcguauggcaauaucgggcgacgacuguguagucaaaccaauagaugaucgauuugcuaacgcauuauuagccuugaaugauaugggaaaaguuaggaaggauaucccgcaguggcagcccaguaaaggauggcaugacuggcaacaaguaccauuuuguagucaccauuuucaugaauugauaaugaaagauggucguaaauuaguuguuccauguagaccccaagaugaacuaauagggcgagcucgcauaucgcaaggggcgggcuggucgcugagagaaacagcauguuuaggaaaagcauacgcucaaauguggagcuugauguacuuucauagacgagauuuacgacuggcuagcaaugcgauauguagugcgguaccuguacauugggucccuaccucaagaacaacauggagcauucaugcgcaccaucaauggaugacuacugaagacaugcugacugucuggaauagagucuggauagaagacaacccauggauggaagauaaaaccccaguuacaacaugggagaauguaccguaccucgguaaacgagaggaucaguggugugguagcuuaauuggccucacaagucgggcaacuugggcacagaauauaccaacagcaauacaacaaguucggucacugauagggaaugaagaguuccuagacuacaugcccucuaugaaaagguuucgcaaagaggaggagucggagggagcgauaugguag

SEQ ID NO: 23357 - RNA, 9873 nt, Artificial Sequence
  derived and/or modified CDS sequence (opt6) from DENV-3__FJ410177__SS-prME
acaucuuuauguuugaugaugauucuuccagcugccuuggcauuucaucugacaucaagggacggagaaccaagaaugaucguagguaaaaacgaaagaggaaaaagccuauuauucaaaacagcaagcggaauaaauauguguacccuaauagcgauggauuugggagaaaugugugaugauaccguuacuuauaaaugcccgcacauaaccgaaguugaaccugaagacaucgauuguuggugcaaccuaacgaguaccuggguaacuuauggaacaugcaaccaagccggagaacauaggcgugauaaaaggucuguugcacucgccccucaugugggaaugggauuagauacacgaacacaaacuuggaugagugcugaaggugcauggcggcaaguagaaaaaguugaaacgugggcacuucgccauccaggauucaccauauuagcccuauuucucgcacauuauaucgguacaaguuuaacccagaaaguaguaaucuuuauacuuuugaugcugguaacaccaagcaugacaaugcgauguguaggagucggaaaccgggauuuuguagagggacuaagcggggcaacaugggucgacguuguacuggaacauggaggaugugugacuacaauggcuaaaaauaaaccaacauuggacauugaacuucagaaaaccgaagcgacgcaacuggcaacauugagaaaacuauguauagaaggaaaaauaacuaacauaaccacagacagucguugcccgacacagggugaggcuguauuaccagaggaacaagaucaaaauuauguauguaaacauacauauguugacagggguugggggaacgguugcggacucuucggaaaaggaaguuuagugacgugugcaaaauuucaaugucucgaaccgauagaagggaaaguaguccaauaugagaaccuuaaauauacaguuaucauaaccguacacacaggugaccaacaucaggucggcaaugaaacacagggugucacugcagagauaacaccacaagcaucaacaaccgaagcaauauuaccagaguacggcacgcuuggucuagaauguucaccccgaacgggccuugauuucaacgaaaugaucuuguuaaccaugaaaaauaaagcauggaugguucaucgucaaugguucuuugaccucccuuuaccauggacaaguggcgccacgacggaaacuccgacguggaauagaaaagaauugcuaguaaccuuuaagaaugcucaugccaagaaacaggaaguaguugucuugggaucucaggagggagcaaugcacacugcuuugacaggcgcaacagagauccagaacaguggaggaaccucaauauuugccggucauuuaaaaugccgcuugaaaauggauaaauuggaacuuaaagggaugucauacgcuauguguacaaacacuuucguucuaaagaaagaaguaucggaaacacaacaugguacaauucuaaucaaaguagaguacaaaggggaggacguuccuuguaaaauaccguuuagcacagaggauggucagggaaaagcucauaacgggagacuuauaacagccaauccaguaguaacgaagaaagaagaaccgguuaacauagaggcggaaccuccuuuuggugagaguaauaucguuaucggaauuggagacaaugcgcugaaaauaaauugguauaaaaagggauccucaauaggaaagauguuugaagcaacagcuaggggagcgagaaggauggcaaucuugggagauaccgcaugggauuuugguagcguaggaggugucuuaaauagccuugguaagaugguucaccaaauuuuuggaucagcauauacagcucucuuuuccggggucaguugggucaugaaaauaggcauagguguauuauuaacuuggauuggucuuaauagcaaaaauacgucgaugaguuuuaguuguauugcuauaggaauuauaacauuauauuugggugcgguggugcaagcggauauggguugugucaucaauuggaaggggaaagaauuaaaauguggauccggcauuuuugucacgaaugaaguacacacuuggaccgaacaauauaaguuccaagcggacagcccuaaaagacuugcuacagcuauagcgggugcuugggaaaaugguguaugugguauucgaaguacaacaaggauggaaaacuuauuauggaaacaaauagcgaacgaacugaacuacauccuaugggaaaacaauauuaaacuuacugucgucgucggcgauacgauagguguuuuggaacaaggaaagcgaacguuaacaccucaaccuauggaguuaaaguauucuuggaaaacauggggaaaagcaaaaauagugacagcagaaacccaaaacucuucuuuuauaaucgaugggccaaacacucccgaguguccaucugcaucaagagcauggaacguaugggaaguggaggacuauggauucggaguauuuaccaccaauauauggcuaaaacuucgugagguauauacucagcucugugaccauagacuuaugucagcggcaguuaaagaugaacgagcaguacacgcagauauggguuacuggaucgaaucgcagaaaaaugguagcuggaaguuagaaaaagccucccuaauugaaguaaaaacaugcacuuggccaaaaagccacacucucuggucaaauggcguguuagaaagcgauaugauuauuccaaaaucgcucgccgguccgaucucacaacauaauuauagacccgguuaccauacucaaaccgcgggacccuggcacuuaggcaaacuggaauuagauuuuaacuacugcgaaggaacaacuguagugauaacagaaaauugcggcacugggggcccuagucuaagaaccaccacugucucaggaaaacuuauccacgaauggugcugucgaucuuguaccuuaccgccauuacgauauaugggagaagauggcuguugguauggaauggagauaagaccaauuucagagaaggaggaaaauauggugaaaagccugguaucagcugguucaggaaaaguugauaauuucacaaugggugugcuaugucuggcuauacuauuugaggaaguaaugaggggcaaguucggcaagaaacauaugaucgcggguguauucuuuacauuuguauuauuacuuaguggacagauaacauggagggauauggcacauacgcuuauaaugauagguagcaaugcuucggaucgcaugggaaugggugugacauaccuagccuuaauagcaacuuucaagauacaacccuuucuagcacucggcuucuuuuuaagaaaacuaacaagccgggaaaacuuacuacuagguguugguuuggcgauggccaccacgcugcaauuaccugaagauaucgaacaaauggcaaacgguaucgccuugggacucauggcgcuuaagcugaccacucaauuugaaacguaucaacuauggacagccuuaauuucauuaacuuguucaaacacaauuuucacccuaaccguggcauggcgaacugccacucuaauuuuagcuggaguaaguuugcuaccuguaugucaaucgagcaguaugagaaaaacugauuggcuaccaaugacaguugccgcaaugggagucccaccccuuccucucuuuauauuuucacugaaagauacuuuaaaacguaggucauggccauugaaugaaggaguaauggcaguaggauuaguuuccauucuggcgaguucccuacugcgaaacgacguucccauggcaggaccauuagucgcaggggguuuacugauagcauguuacgucauaacagggaccagcgcggaccuuacagucgaaaaggcagcugauguaacuugggaggaagaagcagaacaaacugggguuagccauaacuuaaugauuacgguggacgacgauggaacgaugagaaucaaagaugaugaaacagaaaacauucuaaccguacuccugaaaacagcacuuuugauaguaucgggaaucuucccuuacucaauccccgcuacauuauuaguauggcauacauggcagaaacaaacgcaacguaguggaguucuuugggacguaccuuccccaccugaaacacagaaagccgagcuagaagaggggguauaucguauuaagcaacagggaauuuucgguaaaacacaaguuggcgugggcguacaaaaggaggggguguuccauacaauguggcacguaaccaggggcgcagugcugacauacaaugggaagagauuggaacccaauugggccucaguaaagaaagaccuuauaucauauggcggagguuggagacuaagcgcccaguggcaaaagggugaagaaguacaagucaucgcaguugaaccaggaaagaacccgaaaaacuuucaaacaaugccagggacauuucaaacgacaaccggagaaauuggugcuauagcacuagacuucaaaccuggaacuuccgguucuccaauuauaaacagagaaggaaaggugguaggcuuauacgguaacggcgucguaacgaagaaugguggguauguuucggguauugcucaaacaaaugcugaaccagauggccccacucccgaacuagaagaagaaauguucaagaaaagaaauuugaccauaauggauuuacaucccgguagugggaaaacgcgcaaauaccucccugcuauaguaagggaagcgauaaaacggcggcuucgcacucugauauuggcgccaacacgaguaguagcagcagaaauggaagaggcacuuaaggguuuaccaauaagauaucaaacuacugcaacaaaauccgaacacacuggacgagaaauuguagaccuaaugugucaugccacauuuacuaugagguuauugucuccuguacgaguaccuaacuacaaccugaucaucauggacgaagcucauuuuaccgacccugccucgauagccgcacgcggauacauaucaacaagaguaggcaugggugaagcagcagcgaucuucaugacugcaacuccaccugguacagcagaugcuuuuccacagagcaaugcaccuauacaggacgaggagagagauauaccugagcgcuccuggaacucugggaacgaauggauuaccgauuuugcuggaaaaacuguaugguucgucccgucaaucaaggccggaaacgacaucgcaaauugccuucguaaaaauggcaagaaaguaauacaauugaguaggaaaacuuuugauacagaauaucagaaaacaaaauugaaugacugggauuuuguuguuaccacagauaucucggaaaugggggcuaauuucaaggcugauagagugauugauccacgaagaugucuuaagccaguuaucuugaccgauggaccugaacgcgucauauuggcaggccccaugcccgugacagcggcuucggcagcgcaaagacguggacgcgucggcagaaauccacaaaaagagaaugaccaauauauauuuaccggacaaccacuaaauaaugacgaggaccaugcacauuggaccgaagcaaaaauguuacuagauaauaucaauacuccagaagguauaauuccagcauuauucgaaccugaaagggaaaaguccgcugcaauugacggggaauacagguuaaaaggagaaagucgaaaaacauucgucgaauuaaugaggagaggugaucucccaguguggcuggcgcauaaaguggccuccgaagguauaaaguauacugaucgaaaaugguguuucgauggucagagaaauaaucaaauauuagaggaaaauauggauguagaaauuuggacaaaggagggagagaagaagaaacuuagaccaaggugguuggaugcuagaacuuauucagaucccuuagcucuuaaagaauuuaaagacuuugcagcaggaagaaaaucaauugcgcuugaucuuguaacggaaauuggacgcguacccucacaucuggcacauagaacacguaacgcgcuagacaaucucguaauguugcacacaucagaacauggggguaaagcguacagacacgcggucgaagaauuaccugaaaccauggaaacacuuuuauuacuggguuugaugauacucuuaacaggaggugcaaugcuauuucuuauaucugguaaaggaaucggcaaaacuucgauuggguuaauaugcguaaucgccuccaguggaauguuauggauggcagaaauuccucuucaauggauagcuucagcaauuguacuagaguuuuucaugaugguacucuuaaucccggagccggaaaaacagagaacgccucaggacaaucagcuagcauacguuguuauagggauucucaccuuagcagcgauaauagcagcaaacgaaaugggucugcuagaaacuacaaaacgagauuuaggcaugagcaaagagcccggaguaguaucuccaacuagcuaccucgauguugauuuacauccugccucagcuuggacauuauaugcugucgcgacaacaguaaucacaccuaugcuuagacauacuaucgagaacaguacugccaauguuucgcuagccgccauagcuaaucaggcaguaguacuuaugggcuuggauaagggauggccaauaagcaaaauggaccuagguguaccacuucuugcacuaggguguuacucacaagugaaccccuugacucugacugcugcgguguuauuguugauaacacauuaugcgauuauaggaccuggacugcaagcaaaagcgacaagagaagcccaaaagcgaacggcagcaggaaucaugaagaauccgaccgucgauggcaucaugaccauagaucuagaccccgucauauacgauucaaaauuugagaaacaacuugggcaggucaugcuacugguacuaugcgccguucaauuacuucuaaugcgcaccucaugggccuuaugcgaagccuuaacccuggcaacuggcccaauaacuacuuuaugggaagggagcccgggaaaauuuuggaacacaacuauugcuguaagcauggcuaauaucuuccgaggaucguauuuagccggugcuggacucgcauucuccauaaugaaaucaguagguacuggaaagcgggggaccgggagccaaggagaaacgcucggagaaaaauggaaaaagaaauuaaaccaauuguccagaaaggaauuugaucuauauaagaaauccggaauaacugaaguagaccgaacugaggcgaaagaaggacucaaacguggagaaauaacgcaccaugcagugaguagagggucugcgaaacuacagugguucguagaacggaacaugguuauuccagaagggagaguaauagaucuaggaugcgguaggggaggaugguccuacuauugugcaggauuaaagaaagucacugaaguacgugguuacacaaaaggagguccgggucacgaagaaccuguuccgaugucaacuuauggcuggaacauuguaaaauuaaugucugguaaggauguauuuuauuuaccgccugaaaaaugugauacucuucuaugugacauaggagaaucauccccaucgccuacagucgaagaaaguagaacuauacgcguacugaagaugguagaaccauggcucaaaaauaaccaguucuguauuaaaguacuaaacccuuacaugccaacuguaauagaacaccuagaacgguuacagagaaaacacggagggaugcuaguucggaauccccuuucucgaaacucuacucaugaaauguacuggauauccaacggaacuggaaacaucguggcaaguguuaacauggugucgcggcuucuguuaaauagguuuacgaugacgcaucgaaggcccaccaucgagaaagauguugaucugggggcaggaacacggcauguaaacgcugagccggagacccccaacauggaugucauaggggagagaaucaaaaggauaaaagaagaacauaacuccacauggcacuaugacgaugaaaauccauauaaaaccugggcauaccacgggaguuacgaaguuaaagcaacagggucggcaagcaguaugauaaaugggguaguaaaauugcuuacaaaaccgugggacguuguuccgaugguaacacaaauggcaaugaccgauacgacacccuuugggcaacaacgaguauucaaagaaaagguagacacucgaacgccacgaucaaugccggggacgcgcagagugauggguauaacugcagaauggcuauggcggacacuagguagaaauaagaaacccagacugugcacaagagaggaauuuacuaagaaaguaagaaccaaugcggccaugggugccguauucacggaagaaaaccagugggacagcgcuaaagcagcagucgaagacgaagauuuuuggaaguuaguagaucgcgaaagagaacuucacaaacuaggaaaaugcgggaguuguguauacaacaugaugggcaaacgugaaaagaaacucggagaguucggaaaagcaaagggaucaagagcgaucugguauauguggcuaggugcuagguaccuagaguucgaagcguuaggguuucucaaugaagaucauugguuuucucgggaaaacuccuauagcggcgucgaaggugaaggucugcacaaacuaggauacauauugcgagacauuuccaaaaucccagguggagcaauguaugcugaugacaccgcgggaugggacacuaggauuacagaagaugacuugcauaacgaagagaaaaucacgcaacaaauggaccccgaacaccgucaacuagcaaacgcaauuuuuaaacuuacauaccaaaauaaaguagugaaaguacaaagaccaacaccaaccggaacaguaauggacauaauuucacgaaaagaucaaagagggagcgggcagguuggcacauaugguuugaacacuuuuaccaauauggaagcacaauugaucaggcaaauggaaggcgaaggcgucuuaaguaaagcagaucuugagaauccacauuuaccagagaagaaaauuacccaaugguuagagacaaagggcguugaaagauuaaaaagaauggccauaagcggagacgacuguguaguaaaaccaauagacgaccgauuugcuaacgcuuuauuagcccuuaaugauaugggcaaaguacggaaagauauaccacaauggcaaccgucaaaaggguggcaugacuggcaacaaguaccauucugcucacaucacuuucaugaauugauuaugaaggauggcagaaaauuaguagugccuuguaggccacaggaugaacuaauagggagagcacgcauaagucaaggagcaggguggucccuucgagaaacggcaugucuagguaaggcuuaugcccaaauguggagucugauguacuuucaccgaagagaccuaagauuagcuucaaaugcaaucugcagugcaguacccgugcauugggucccaacaucgcggaccacauggaguauccacgcacaccaucaguggaugacaacagaagacaugcuaacgguguggaaucgaguauggauagaagacaauccuuggauggaagacaagaccccuguuacaacaugggaaaauguccccuauuuaggaaaaagagaggaccaaugguguggauccuuaaucgggcucacaaguagagccaccugggcccaaaauauucccacagccauucaacaagugcguucauuaauagggaaugaggaguuucuggauuauaugcccagcaugaaacgcuuuagaaaagaagaagaaucagaaggugcgauaugguga

SEQ ID NO: 23358 - RNA, 9873 nt, Artificial Sequence
  derived and/or modified CDS sequence (opt6) from DENV-3__FJ547072__SS-prME
acaagucuuugccuaaugaugauucuacccgcugcucuagcuuuccaucuaacuucccgugacggagagcccagaaugauugucgggaaaaacgaaagaggacggucucugcuguuuaagaccgcaucagggaucaacaugugcacauuaaucgcaauggacuugggagaaaugugugacgacacagucacauauaaaugcccccauauaacggaaguagaacccgaagacauugacugcugguguaauuuaacaaguacaugggucacauauggcacgugcaaccaagccggagaacauagacgagauaaaagauccguggcguuagcaccacacguaggaauggggcuagauacacgaacucagacauggaugagugcugaaggggcuuggagacagguagaaaagguagaaacaugggcacuacgacacccgggauucaccauacuugcucucuuucuagcacacuauauugguaccucacuaacgcaaaaaguuguaaucuuuauacuccugaugcuaguuacuccaucuaugacaaugaggugcguaggaguuggaaacagagauuucguggaaggccuaaguggggcuacauggguggauguaguauuagaacauggcgggugugucacuacaauggcaaaaaacaagcccacuuuagauauugagcuacaaaagacggaagcuacucaguuggcaacgcuccgaaaacuaugcauugagggaaaaaucacaaacauuacuacugacucucgauguccuacccaaggugaagcaguccucccagaggagcaagaucaaaauuauguaugcaaacauacauauguagaccgcggcuggggcaauggauguggcuuauuuggcaagggaucuuugguuacaugugccaaguuucagugucuagaacccauagaaggcaaaguaguacaguaugagaaccugaaguacacggucauaaucacaguacacacaggcgaucaacaccaaguugguaaugaaacacaaggugugacagcugaaauuacgccacaggcuucaacaacggaagccauuuuaccagaauaugggacucuuggguuggaaugcagcccgcggacgggucuugauuucaacgaaaugauucucuuaacaaugaaaaacaaggcuuggaugguccaucgacaaugguucuuugaucuuccuuuaccguggaccucaggagcuacaaccgaaacuccgacauggaacagaaaagaguuacuaguuacuuucaaaaacgcgcaugcgaaaaaacaggaggucguaguauuaggaucacaagaaggagcuaugcauacggcccuaacuggggcaaccgaaauacagaacagcggugggaccucuauuuuugcagggcacuugaaaugucgacuaaagauggacaaauuagaacuaaaaggaaugucguaugcuauguguacaaacacguuuguauuaaagaaagaaguaagugaaacacaacauggaacaauccuuauuaaaguagaauauaagggagaggacgugccaugcaaaaucccauuuucaacagaagacggccaggguaaagcccacaauggcagauuaaucacggcgaauccaguugugacaaaaaaggaggaacccguaaauauugaggcagaaccgcccuucggagaaagcaacauuguaauagggaucggagauaacgcgcuaaaaauaaauugguacaaaaaggggagcuccauaggaaagauguuugaggccacugcacguggugcucgcagaauggcuauacucggagauacagcaugggacuucgggagugugggcggcguauuaaauucacucgguaaaauggugcaucagauuuuugggucugcauacacugcacuauuuaguggaguuaguuggguaaugaaaauaggaauuggcguccuguuaacauggaucggauugaauucaaaaaauacaucuaugucguuuucaugcauagugauagguauuaucaccuuguaucuaggugccguggugcaagccgauauggguugcgucauaaauuggaaaggaaaagaguugaaauguggaucaggcauauucguuacuaaugaaguccauacuuggacagaacaauauaaauuucaagcagauaguccaaaaagauuagcuaccgccauugcuggagcgugggaaaauggaguaugugggaucagaucgaccaccagaauggaaaaucuucuauggaaacagauagcaaaugaguuaaauuauauacuaugggaaaauaacauaaaacugaccgucgugguaggugauauaauaggaguacuagaacaaggaaaacgaacgcuaaccccacaaccgauggagcuaaaauauucauggaaaacaugggggaaggcuaaaauuguaacggccgagacgcagaacaguagcuuuauuauugacggcccaaacacaccagagugcccaucugcgucucgagcuuggaauguaugggagguugaagauuacgguuuugguguauuuacaacaaauauuuggcuaaaacugagggagguauacacccaacuuugugaucacaggcuaaugagugcugcugugaaagaugagcgugcgguacaugcugacaugggcuacuggauagaaucacaaaaaaaugguagcuggaaauuagaaaaagccagucuaauugaaguuaaaacgugcacuuggccaaagagucacacacuuuggaguaauggcgucuuagagagcgacaugauaaucccaaaaucuuuagcagguccaaucucacagcacaacuacagaccaggauaccauacacaaacggccggacccuggcaucuaggaaaauuagaguuggacuucaacuauugugaaggaacuacuguuguuauaacagagaauugcggaacaagaggcccuaguuuacgaacaacaacaguauccggaaaauugauacacgaaugguguuguaggaguugcacacugccgccuuuaagguauaugggagaagacggaugcugguauggaauggagaucaggccaauaagcgagaaagaggaaaauauggugaaaucuuuagucucagccggaagugggaagguagacaauuuuacuaugggaguuuuaugccuagccauacuuuuugaagagguaaugcgagguaaguuugggaaaaaacauaugauagcugguguauuuuuuacuuucguccuccuuuuguccgggcaaauaacuuggagagacauggcacauacucuaauaaugaucggaucaaacgcuucugaccgaauggguauggguguaacauauuuagcucuaauugccaccuucaaaauucaaccauuucuagcuuuagguuuuuuccuacgaaaacuaacuucaagagaaaaucuauugcugggaguuggacucgcuauggcuacaacgcuacaguuaccagaggauauagaacaaauggcaaacggcaucgccuuaggauuaauggcgcuaaaauuaauaacucaauucgaaacuuaucaauuguggacagcuuuaaucucacuaacgugcucgaacacuauuuuuacauuaacgguagcuuggcgaacggccacauuaauucuagcuggagucucacuacuacccgugugccaaaguagcucaaugcgcaaaaccgacuggcugccaaugacaguagcagcuauggguguaccuccucugccgcucuucauauuuaguuuaaaagauacuuuaaagcgccguagcuggccacuuaaugaggggguaauggcugugggccuagucucuauacuagcaagcucauuacuaagaaaugacguacccauggcagggccacuaguugccggaggccucuuaauagcuuguuaugucaucacuggaacaucugccgaccuuacgguggaaaaggcagcugaugucacgugggaagaggaagcagaacaaacagggguaagccacaacuugaugauuacagucgaugaugaugggacuaugcgaaucaaagacgaugaaacagagaauauucugacggugcuacuaaaaacugcauugcuuauaguguccgggauauucccuuauucaauuccagcaacuuuauuaguuuggcauaccuggcaaaaacaaacacaacgaucaggaguauugugggaugucccauccccgccagaaacacaaaaagccgaguuggaagaagguguguaucgcauuaaacaacaggguauauuugggaaaacucaggugggcguaggaguacaaaaggagggaguauuccacacuauguggcauguuacgagaggagcuguauuaaccuacaaugggaaaagacuugaaccuaauugggcuucggugaaaaaagauuuaauauccuauggcggcggauggcgacuaucagcacaauggcaaaaaggcgaggagguacaaguaaucgcgguagaaccuggaaaaaauccuaaaaauuuccagacgaugccagggacauuucaaacuacaacuggugaaaucggggcuauugcauuagauuuuaagccaggaaccucaggaaguccaaucauaaauagagaaggaaaaguaguagggcuuuacggaaauggagugguaacuaagaacggugguuacguuucuggaaucgcucaaaccaacgccgagcccgacggucccaccccagaauuagaggaagaaauguuuaaaaaaagaaaccuuacaauaauggaccuacacccaggauccgguaaaaccagaaaguaccugccagcaauagugagggaggcaauuaagagaagacuucgcacucuaauauuagcgccuacgagaguuguugccgcggaaauggaagaagcacuuaaaggguuaccuauacgguaucaaacuacugcuacaaagucugaacauacaggucgggaaaucguugaccuaaugugucacgcuacauuuacaaugagacuauuaaguccggugagaguuccaaacuauaacuugauaauuauggaugaagcacacuucacagacccagcauccaucgcagcacgaggauauauaaguacaagaguaggcaugggggaagccgccgccauauucaugacagcaacaccaccuggaacggccgacgcauuuccacaaagcaacgcgccuauccaagacgaagaacgagauaucccagaaaggucauggaauucaggcaaugaguggauaacagauuuugcagguaagacgguaugguuuguaccuucuauuaaagcaggaaacgauaucgccaacugccuccgaaaaaaugguaaaaagguaauacaauuaucucgaaaaacauuugauaccgaauaucaaaagacaaaguugaaugacugggauuucgucguuacaacagacauuuccgaaaugggagcuaauuuuaaagcugaccgaguuauagacccccgacguuguuuaaagccagucauuuuaacagacgguccagagagggucauacuggcagggccaaugccaguaaccgcagcaucagcugcucagcgcagagggagaguaggcagaaauccacagaaagaaaacgaucaauauauauucacuggacaaccauuaaauaaugacgaagaucaugcucacuggacagaagcuaaaauguuauuagauaauauaaacacaccagaagguauuauuccggcguuguucgaacccgaacgcgagaaaucagcugcaauagacggggaguaucgguuaaaaggagaaucuagaaaaacguuuguagaauugaugagacgaggugaucucccugugugguuagcucauaaaguggcuucagagggcauaaaauacacagaucguaaguggugcuuugacggacaaagaaauaaccaaauacuugaggagaacauggauguagaaauauggacaaaggaaggagaaaaaaaaaaguuaagaccuagauggcuagacgcuagaacuuacucagauccucuagcauugaaagaauuuaaggauuucgcagcggggagaaaaaguauagcauuagauuugguaacggaaauugguaggguuccuagucaucuggcgcauagaacucgaaacgcguuggauaacuugguaaugcuucacaccucagaacaugggggaaaggcguaccgacacgcgguggaggaacugccagaaaccauggagacccugcucuuauuaggacugaugauacuacuaacaggaggagcuaugcuuuucuuaauuagcggaaagggaauuggaaagacaagcaucggucuuaucugugucauugcaucaaguggaauguuauggauggcagaaauaccgcuacaauggauugcuagcgcaauaguauuagaauucuuuaugaugguacucuuaauaccugaacccgaaaaacaaagaacgccacaagauaaccaacuugccuauguggucauagguauccugacuuuagcagcaauaauagcagcaaacgagaugggacuauuagaaacaacgaaaagggauuuaggcaugucgaaagaaccgggagugguuucaccaacauccuaccuugacguagaucuucaccccgcgucugcauggacacuuuaugcagucgcuacuacggucauuacuccaaugcuacgacauaccauagagaauagcacagcaaauguaucuuuagccgccauagcaaaucaagcaguaguauuaauggguuuagauaaagguuggccuauauccaaaauggaucuaggaguuccauuguuagcauuagguuguuauucccagguaaacccccuuacauuaacagcggcaguacuacuucuaauaacccauuacgcuaucauagggcccgggcuucaagcuaaggcgacacgcgaggcacaaaagcggacugccgcgggaaucaugaaaaacccgacaguagauggcauaaugacuauagauuuggauccagugauuuacgacucaaaguucgagaaacaacuugggcaggugaugcuuuuaguucuuugcgccgugcaacucuuguugaugcguacuucaugggcccuuugugaagcccugacauuagcaacugguccaauaaccacguuaugggaagggucgccuggaaaauucuggaauaccacuauagccguuucgauggccaauauauuucgaggcucuuauuuggcgggagcaggacucgcauucucuauuaugaaaaguguggguacagggaagcgaggaacagggagucaaggugaaacauugggagaaaaguggaagaaaaaauuaaaccagcugaguaggaaagaauuugaccuauacaaaaaaucaggaauuacugaaguagaccgaacugaagcaaaagaggguuuaaaacguggggagauuacccaucacgcgguuuccagggggagcgcaaaauuacagugguucguagaaaggaacaugguuaucccagaagguagagucaucgauuuagguugugggagaggcgguuggucauacuauugcgcuggauuaaagaaaguaacggaaguaagggguuacaccaaagguggcccugggcacgaagagccaguaccaauguccacauacggauggaauauaguaaaauuaauguccggcaaggauguuuuuuacuugccaccagagaaaugugacaccuuauugugugacauaggugagucgaguccaucaccaacuguagaagaauccagaacuauuagaguucuuaagaugguagaaccauggcuuaaaaacaaucaauucugcauaaaaguucuaaacccuuauaugccaacuguuauagaacaccuagaaaggcuucaaaggaagcauggggguaugcucgugagaaacccauuaaguaggaacucaacacaugaaauguauuggauuucaaauggaacaggaaauauaguugcauccguaaauaugguaucccguuuacuacuaaauagauucacuaugacucacagacggccaacuauagagaaagauguagaccuaggcgcuggaaccaggcaugugaaugcagaaccggaaacaccaaacauggaugucauaggugaaagaaucaaaaggauuaaagaagaacacaacucuacauggcacuaugaugacgaaaauccuuauaagacaugggcauaucacggaucuuacgaagucaaagccacaggcagugcaucaaguaugauuaacggcguggugaaacuacuaacaaaaccaugggacgugguaccaaugguaacacaaauggcaaugacugauacuacaccguuuggacaacaaagaguuuuuaaagaaaagguugacacucggacuccgcguaguaugccggguaccagacgcguuaugggaauuacagcugaguggcucuggaggaccuuaggucgcaauaaaaagccacgacuuugcacaagagaagaauucacuaaaaaagucaggacaaaugcagcaaugggcgcaguauucacagaggagaaucaaugggauucagcuaaagcagcuguggaggacgaggauuucuggauauugguagacagggaacgugaacuccauaaacugggaaagugcgguucuuguguuuauaacaugaugggaaagcgugaaaagaaacucggagaauuuggaaaggcgaaaggaagucgugcaauuugguauauguggcuuggagccagauaucuagaguuugaagcuuugggcuuccuaaaugaggaucacugguucucaagagaaaacagcuauaguggaguagaaggugaaggccuucauaaauugggauacauucuaagagauauaaguaaaauuccuggcggagcgauguaugcugaugauacagcuggaugggauacucgaaucacagaagaugaucuucacaacgaagagaagauuacccaacagauggauccagaacaccgucagcucgcaaacgcaauauuuaaacucacuuaucaaaacaagguagugaaaguacagagaccaacccccacugggacggugauggauauuauaagucgaaaagaucaacgcgggucaggucaggucggaacguacggguugaacacuuucacuaauauggaagcucaacuaauacggcaaauggaaggagaagguguuuuaagcaaagcggauuuggaaaacccccaucuuccagaaaaaaagaucacgcaauggcuagaaacaaaaggaguagaaagauuaaaaagaauggcuauaucaggcgaugacugcguagucaaaccuaucgacgaccgcuuugcaaacgcgcuuuuggcuuugaaugauauggguaagguucgaaaagauauaccgcaauggcagcccaguaaagguuggcacgacuggcaacagguaccguuuugcagucaccauuuccaugaacugauaaugaaagacgguagaaaauuggucguaccuuguagaccucaagaugaauuaauaggcagagcgagaauuucacagggugcugggugguccuuacgagagacagcaugucuaggaaaggcuuaugcacaaauguggagccuuauguauuuccaucgucgugaccugagacuagcuaguaaugcuauaugcagugcaguaccuguccauugggucccaacaucaagaaccacguggucaauccacgcgcaucaccaauggaugacaaccgaagauauguuaacaguuuggaacagaguauggauagaggacaacccauggauggaggauaaaacuccuguuacuacaugggaaaacguuccguauuugggaaaaagagaagaucaguggugcgguucacuaaucggcuugacaagccgugcaacaugggcacagaacauaccaaccgcuauccaacaaguacguaguuuaauaggcaacgaagaauuucuagacuauaugcccaguaugaagagauuucgaaaagaagaagaaucugagggagcgaucugguga

SEQ ID NO: 23359 - RNA, 9873 nt, Artificial Sequence
  derived and/or modified CDS sequence (opt6) from DENV-3__FJ547073__SS-prME
acaagucugugcuuaaugaugauccuaccagccgcacuagccuuccaccuaacuucccgagauggugaaccaagaaugauaguagggaaaaaugaaagaggaaaauccuuacuauucaaaacagcaaguggaaucaacaugugcacuuuaaucgcgauggaucuaggcgaaaugugugacgauacuguaacuuacaaauguccccauauaacugaaguugaaccugaagauauagacugcugguguaacuugacgucuacauggguuacuuaugggacguguaaucaagcuggggaacaccgaagagacaaaagaucagucgcacuugcaccccauguagggaugggacuggauacucggacucaaacauggaugucugcugaaggugcauggcgacaaguugaaaaaguugaaacuugggccuuacgccauccagguuuuacuauccuagcucuuuuccuagcacauuacaucggaacgucucuaacgcaaaaagucguuauuuucauacuacugaugcuuguaacaccaucgaugacgaugagauguguaggaguugguaauagggauuuugucgaagggcuuaguggagcgacuugggucgauguaguauuagaacacggcggaugugugaccacaauggccaaaaauaaaccgacuuuggacauugaacuucaaaagacugaagccacgcaacuugcaacacuuagaaaacuguguauagaagggaaaauuacuaacauaacaacagauucucgguguccuacgcaaggagaagcagugcucccagaggaacaagaccaaaacuacguuugcaaacauacuuaugucgacagaggauggggaaauggaugcggacuuuuugguaaaggaucauuaguuacuugcgcgaaauuccaaugucuagaaccuauagaaggcaaaguaguacaauaugaaaaucuaaaauacacgguuaucauaacaguacacacaggagaucaacaucaaguugguaaugagacccaaggaguaacugcugagauaacgccacaggcuucaacaacugaagcuauacuaccggaauauggaacauuaggacuagaaugcaguccacgaacaggccuagacuuuaacgagaugauauuguuaacuaugaaaaauaaagcguggaugguacaccgucaaugguucuuugaucuuccguugccauggacaucaggugccacaacugaaaccccaacauggaaucggaaagagcuacuuguaacguucaaaaacgcacaugcuaagaaacaagaagucgucguucuugguucacaagaaggagcuaugcauacugcauugacaggagcuacagagauccaaaacucggguggaaccucaauauuugccggccaccuaaaaugucgauuaaaaauggacaaauuagaauuaaaaggaaugucauaugcaauguguacaaauacauuugucuugaagaaagaaguuucagagacacaacauggaacuauccucauaaaagucgaguacaaaggcgaggauguaccaugcaaaauaccauuuucaacugaagauggacaaggaaaagcacauaauggaagauuaaucacugcgaauccaguagugaccaagaaagaggagccuguaaauauagaagccgaaccgccuuuuggagaaagcaauaucguaauagguauaggugauaacgcgcucaaaauaaauugguauaagaaaggcaguucuauugggaaaauguuugaagcgacggcccgaggagcacgcagaauggcaauacuaggagauaccgccugggauuuuggcucgguugguggcguacugaacucacucgguaaaaugguucaccaaauauucggaagcgcuuacacugcguuguuuagugggguaagcuggguuaugaagauaggaauaggcguucuucuaacauggauaggauuaaauucuaaaaacacaucuaugagcuuuaguuguauugucaucgggauaaucacccuuuaucugggagcugugguccaggcugacaugggguguguaaucaacuggaaagguaaagaacugaaaugcggaucugguauuuuuguaacgaaugaaguucauacauggacugagcaauacaaauuucaggcagacagucccaaacgauuggcaaccgcaauagcuggcgcaugggagaacggaguauguggaauacgcucaaccacaagaauggagaaccuacuauggaaacagauagcuaacgaauugaacuauauuuugugggaaaacaauauaaaguuaaccguaguggucggcgauauaauaggcguauuagaacaaggaaaaaggacccucacaccgcaaccuauggaacugaaguacaguuggaaaacuugggggaaagcaaaaaucgucacggccgaaacacaaaauuccucauuuauaauugauggaccuaacacucccgaauguccgucagcauccagagccuggaaugugugggaaguugaagacuauggcuuuggagucuuuacaacaaacauuugguuaaaauugagagagguauauacacagcucugugaccacaggcuuaugucagcugcaguaaaagacgaacgcgcaguacaugcagacaugggauacuggauagaaucucagaaaaaugguucauggaaacuugaaaaggcuucauugaucgaggugaaaaccuguaccuggccgaaaucucauacgcucuggaguaacgguguauuagagucagauaugauaauaccgaaaagucuugcaggaccuaucucacaacauaauuauagaccuggcuaucauacccaaaccgccggcccuuggcaucucggcaaauuagaacuggacuuuaauuauugugaagguacaacagucguaaucacugaaaacugcggaacaagggggccuucauuaagaacaacaacaguaagugggaaacuuauucaugaauggugcugccgcucaugcacguuacccccucuuagauacaugggagaagauggaugcugguauggaauggaaauaagaccaauaucggagaaagaagaaaauauggugaaaucauuaguaagugcggguagcggaaagguagauaauuucaccaugggaguacuaugucuagcuauucuauuugaagagguaaugagaggcaaguuuggcaagaaacauaugauagcuggcguauucuucacuuucguacugcuuuugucaggacaaauaacguggagagacauggcccauacguuaaucaugauugguagcaacgcauccgauaggaugggaaugggagugacauauuuagcucuaauugcgacauucaaaauacaaccauuuuuagcccuuggcuuuuuccuacguaaguuaacaucaagggaaaaccuacuuuuaggagucggacucgcaauggcaaccacauuacaauugcccgaagauaucgaacagauggcgaaugggauugcucuuggauuaauggccuuaaaauuaauaacucaauuugaaacuuaucaauuguggaccgcauuaaucucgcuaacaugcucaaauacuauauuuacauugacuguagcauggcguacagcuacucuuaucuuggcugguguaaguuuacuaccgguaugccaaucgucaucaaugaggaaaaccgauugguugccaaugacaguugcggcgaugggaguuccaccccugccucuguuuauuuucucacuaaaggacacucuaaagcgacggagcuggccguuaaacgaagguguaauggcuguaggcuuagucaguauacuugcaucaagucuacuaagaaaugaugugccgauggcugguccucuuguggccggaggccuguuaauugcauguuauguaauaacugggacaagcgcagaucuuacggucgaaaaggccgccgaugugacuugggaagaagaagccgagcaaacgggaguaucacacaauuuaaugauaacaguagacgacgaugguacuaugagaaucaaggacgaugagacugagaauauacuaacugucuuacugaagacagcauuacuaauagucucaggaauauucccauauagcauaccagcaacacugcuaguauggcauacauggcaaaaacagacacaaagaaguggcgugcuaugggacguaccguccccacccgaaacacaaaaggcugaacuagaggaggguguauaucguauuaaacagcaagguauauucggaaaaacgcaaguaggcguugguguacaaaaggagggugucuuccauacgauguggcacguaacgcgaggagcgguucuuacuuauaaugguaaaagacuggaaccgaauugggcgucggugaaaaaggauuuaauuagcuauggaggcggauggagacuuucagcacaauggcagaaaggagaggaaguacaaguuauagcgguugaacccggcaaaaaucccaaaaacuuucaaacgaugcccggaacauuucaaacaaccacaggagaaauaggagcaauagcauuggauuuuaaacccgguacaucaggaaguccuauuauaaaucgugaagggaaaguaguaggauuauauggaaaugggguagucaccaagaacggcgguuauguaucagguaucgcacagacaaacgccgagccugacgggccgacgccagaauuggaagaggaaauguuuaagaaaaggaacuugaccauaauggaucuucaucccggaucaggcaaaacgcgcaaauaucuuccggcgauaguucgugaagcaauuaaacggagauuacgaacucucauacucgcacccacacguguuguugcagcagaaauggaagaagccuuaaaaggccuacccauacgauaucagacuacagcaacaaagagugaacauaccgggagagagauaguagacuuaaugugucacgcaacauuuacgaugagauuacuaucaccgguacguguaccuaauuacaaucuaaucauuauggaugaggcacauuuuacugacccagcaucaauugccgccagaggauauauuagcacaaggguuggaaugggagaagcugcggcaauuuucaugacugcaacaccaccaggaacugcugaugcguuuccacagagcaacgcaccaauacaagaugaggagcgagauaucccggagcgaaguuggaauagugggaaugaauggauaacggacuuugcaggaaaaacggugugguucguaccgucaauuaaagcaggaaaugauauugcgaacugcuuacggaaaaacgguaagaaagucauccaacuaagucguaaaaccuuugauacugaguaucagaaaacgaaacuaaaugauugggauuuugucguaacuacugauauuagcgaaaugggugcuaauuucaaagcugauagaguaaucgauccaagaagaugccuaaaaccaguaauauuaacggaugguccagagcguguuauauuagcaggaccaaugccaguaaccgcggcaucugcugcucagaggagaggaagagucggcagaaacccucaaaaagaaaaugaccaauauauauucacgggccaaccgcuuaauaaugaugaggaccacgcccauuggacggaagcaaaaaugcuccuugauaauauaaauaccccggaaggaauaauaccggcuuuguucgagccagaaagagagaaaagugcagcaauagacggugaauaucgacugaaaggagaaucacgaaagacauuuguugagcugaugagacgaggugauuuacccguaugguuagcacacaaaguagcaucggaagguaucaaguacacugaucgaaaguggugcuucgauggccaaagaaacaaccaaauccuagaagaaaauauggacgucgagauuuggacaaaagaaggggaaaagaagaaacugagaccaaggugguuagaugccagaacuuacagcgauccauuggcuuuaaaggaauuuaaagacuuugcagcuggccggaaguccauagcgcuugaucugguuaccgagauaggaaggguaccgucucauuuggcucaucgcacaagaaaugcauuggauaaucuuguaaugcuacacacuucugagcauggagguaaggcuuauagauaugcuguagaagaauugcccgaaacuauggaaacacuuuuacugcuggggcucaugaucuugcuuacagggggagcgaugcuguuuuuaauaagugguaaaggcauaggcaaaacaagcauuggauuaauaugcgugauagcuucaagcggaauguuauggauggcugagauuccucugcaguggauagcuucagcuauuguucucgaauuuuucaugaugguauuacugauaccagaacccgagaaacaaagaaccccucaagacaaucagcuggccuaugucguuauaggaauuuugacauuagccgccaucauugcggcaaacgaaaugggucugcuggaaacaacgaaaagagaucuagguaugaguaaagagccagguguugugucgcccacaaguuauuuagacguugauuuacauccagcgagcgcuuggacacuauaugcagucgcaacuacaguaauuacccccauguuacgccauacaauagaaaauucuacggcgaaugugucuuuagcagcaauagcaaaucaagcagucguacuaaugggauuagauaaaggcuggcccaucagcaagauggaucuagguguuccauuacucgcauuaggaugcuauucacaaguuaauccucucacauuaacugccgcuguauuguugcuuauaacccacuacgcaauuauugggccgggacuccaagcgaaggcuaccagagaagcacaaaaacgaacagccgcuggaauaaugaagaauccaacaguugauggcauaaugacuauagauuuagacccaguaauauaugacagcaaguuugaaaaacaacuaggacaaguaaugcuccuagugcucugugccguucaacuacuccuuaugcguacuucgugggcccuaugugaagcacuaacauuagcuacugggccgauaaccacauugugggaaggcucuccggggaaauuuuggaauaccacaauugcggucucuauggcgaacauuuuucgcgggagcuaccuggcaggcgcugguuuagcguucucgauaaugaaaucaguggguaccgggaaaaggggaacgggcagccagggagaaacgcuaggugaaaaauggaaaaagaaacuuaaucaauuaucacguaaggaguucgacuuauacaagaaaagcggcauaacggaaguagacaggaccgaagcuaaagaaggucugaagagaggggaaauaacacaccaugcaguuucgaggggcagugcuaaguugcaaugguuuguugaacgaaauaugguaauacccgaggguagaguaauugaccucggaugcggucgaggaggcuggagcuacuacugcgcuggguuaaagaaaguaaccgaaguaagagguuacacaaagggagggccaggucacgaggagccagucccaaugaguacuuacggguggaauauuguuaaacuaaugagcgguaaagacguauucuaccuuccacccgaaaaaugcgauacacuucuaugugacauaggagaaucaucacccaguccuacaguugaggagucuagaacaauaaggguacuaaaaaugguagaaccuuggcucaaaaacaaucaauucuguaucaaaguccugaauccauauaugccuaccgugaucgaacaucuagaaagauugcaaagaaaacauggcgggauguuaguuagaaauccuuugagcagaaauucaacccacgagauguauuggauuucaaauggaacagguaauauaguagcgucuguuaauaugguaucacgacugcuacuaaaucgauuuacuaugacacacagaaggccuaccauagaaaaggacguagaucuaggagcgggcacgaggcacguuaaugccgaaccagaaaccccaaauauggauguuaucggugaacgaauuaagcggauuaaggaagaacacaauucaacuuggcacuaugaugacgaaaacccguacaaaacaugggccuaucauggaaguuacgagguaaaagcaacggggucagcaaguagcaugaucaacggcguugucaaacucuuaacgaagccuugggacguaguacccaugguaacccaaauggcaaugacugauacgacccccuuuggucagcagagaguuuuuaaggagaaaguagacacccguaccccucgcaguaugccuggaacaagaaggguaaugggaauaacagcugaauggcuguggagaacacucggucggaauaagaagccucgucuaugcacuagggaagaauuuacuaagaaaguuagaacaaacgccgcgaugggggcgguuuuuacugaggaaaaucaaugggacucagcaaaagcagcgguugaagaugaagauuuuuggauauuaguagaucgagagagagaacuacacaaauuagggaaaugugguucuuguguuuauaauaugauggguaaaagagagaagaaacuuggcgaguucgguaaagcaaaaggaucaagagcaaucugguauaugugguuaggggcuagauauuuagaguuugaagcauuaggauuuuuaaaugaagaucauugguucucaagagaaaacuccuauucugguguagagggagagggucuccauaaacuuggauauauuuuaagagacauaucuaaaauuccaggaggagcuauguaugcugacgauacugcgggaugggacacgagaauaacagaagacgaccugcauaaugaagagaaaauuacacaacaaauggacccggagcaucgacaacuggcaaaugcaauauucaaauugacguaccaaaacaaaguagucaagguacagagaccaacuccaacgggaacuguaauggauaucaucaguagaaaagaucagagggguucugggcaaguggguacuuauggucuaaacacauucacaaauauggaagcgcaacuaauaaggcaaauggagggcgaagggguucucucaaaagcugaccuugaaaauccacaccuacccgagaagaaaauaacccaauggcuugaaacaaaaggcguggagagacuaaaacgaauggccauuagcggagaugauugugucguuaaacccauagacgaucguuuugcuaacgcucuuuuagcuuugaacgauaugggaaaagugcgaaaagacaucccgcaguggcagccuuccaaagguuggcacgacuggcaacaagucccguuuuguagccaucacuuccaugaguuaauaaugaaggauggaagaaagcuaguaguaccuugucguccgcaggaugaauuaauagguagggcgagaauaucucagggagcgggauggucccuacgcgaaacugcauguuuaggaaaagcauaugcgcaaauguggucccucauguacuuucaucgaagagauuuacgauuagcgucuaaugcaaucuguucugcaguaccuguacauuggguuccgacaucaaggaccacuuggucuauucaugcucaccaucaauggaugaccacggaagauaugcuaacuguuuggaacagagucuggauagaagauaauccuuggauggaagauaaaacaccugugacuacaugggaaaacgucccauaccucggaaagagagaggaccaaugguguggcaguuuaaucggucuaacaucacgagcuacaugggcacaaaacauuccaacugcuauacaacaggugagaucucuaaucggaaaugaagaguuucuagacuacaugccgucgaugaaaagauucagaaaggaagaggagucggaaggggcuauaugguag

SEQ ID NO: 23360 - RNA, 9873 nt, Artificial Sequence
  derived and/or modified CDS sequence (opt6) from DENV-3__FJ547074__SS-prME
acaagucuguguuuaaugaugauauuaccagcggcauuagcuuuccauuugacuucaagagacggagaaccgagaaugauaguaggcaaaaaugaaagagguaagagcuuguuguucaaaacagcaucugguaucaauauguguacauuaauugcuauggaccuaggagaaaugugugaugacacaguaacauauaaauguccucauauaacagaaguugaaccugaagacaucgauugcugguguaauuuaacuucuacguggguuacuuaugguaccugcaaccaagcuggugaacacaggagggauaagcgaucgguugccuuggccccucacgugggcaugggucuagauacuagaacacaaacauggaugagugcugaaggugcuuggcgucaaguagaaaaaguagaaacaugggcccuacggcauccaggcuucacuauacuagcucuguuuuuggcacacuauauugguaccucuuugacucaaaaaguugugauauuuauauuacuuaugcugguuacuccuucaaugacaaugcguugcguuggaguggggaauagagauuuuguggaaggacuaucaggugcgacguggguugacguaguucuggagcaugggggauguguaacaacgauggccaaaaauaaaccgacucuggacauugaauuacagaaaacugaagcuacucaauuagcgacacuaagaaaacuauguauagaaggaaaaauuacgaacauaacgacggacagcagaugucccacccaaggagaagcuguacugccugaagaacaagaucaaaacuauguauguaaacauaccuauguugaccguggcugggguaacgguuguggauuauuugggaaaggaucuuuagugacaugugcgaaauuucaauguuuagagccuauugaagggaaaguagugcaauacgagaaccucaaauauacaguaauaaucaccguacacacuggagaccaacaucaaguaggcaaugaaacccaaggaguuacagcagaaauuacuccccaagcaaguacuacagaagcuauuuuaccagaauacggaacgcuaggguuagaaugcagcccaagaacagggcucgauuuuaacgagaugaucuuguuaacuaugaaaaauaaagcguggaugguccacagacaaugguucuuugaucuacccuugccauggacaagcggagcuacaacagagacaccaacauggaacagaaaagaguugcuuguaacauucaaaaacgcacaugcaaagaaacaagaaguagucguucuugguagccaagaaggagcgaugcacaccgcucuaaccggcgccacagagauacaaaauucgggagggacuucuaucuuugcagggcacuuaaaauguagacugaaaauggauaaacuagaacucaaagguaugucguacgcaauguguacuaauacguuugugcuaaagaaagaagugucagaaacucaacauggaacgauccucauuaaaguugaauacaaaggcgaggaugucccgugcaaaauuccauuuaguaccgaagauggacaaggaaaagcucacaacgggcgucuaauaacugcuaauccgguaguaacaaagaaagaagaacccguaaauauagaagcugaaccgccuuuuggugaaucaaacaucguaauagguauaggagacaacgcauuaaaaauaaacugguauaagaaaggcucaagcauuggaaaaauguuugaagcaacagcucgaggugcgagacgcauggcuauacuaggcgauaccgcaugggauuuugguucaguaggaggaguuuuaaauucuuugggcaaaaugguacaucaaaucuuuggaucagcuuauacggcacuuuuuaguggaguaucauggguaaugaaaauugggauuggaguccugcuuaccuggauuggucucaacuccaaaaauacaucaaugaguuuuucaugcauuguaauagguauaauaacuuuauaccugggagccgugguacaagccgauauggguugugucaucaacuggaaaggaaaagaacuaaaauguggaagcggaauauuuguaacaaaugaaguucauacuuggacagaacaauacaaauuccaagcagacuccccaaaacgacuggcuacagcuauagccggugcuugggaaaauggaguuugcggcauuagaucuaccacgcgaauggaaaacuuacuuuggaaacagauugcaaaugaacuaaacuauaucuuaugggaaaacaauauuaaacuaaccgugguggugggcgauauuauaggaguguuagaacaaggcaaaaggacucuuaccccgcaacccauggagcuaaaauauucguggaaaacauggggaaaggccaaaaucgugacggcugaaacccaaaauaguucauuuauaauagauggucccaauacacccgaauguccaucugccagucgagcauggaacguuugggaagucgaagauuacgguuuugguguauuuacuaccaauauauggcuaaaguuaagagaaguguacacgcaacucugugaucacagauuaaugagugcagcagucaaagacgaacgugcagugcacgccgauaugggcuauuggaucgagagucagaaaaaugguaguuggaaacuugagaaggccucucuaauagaaguaaagaccuguacauggccaaaaagucauacucucuggagcaauggugugcuagaaagcgacaugaucauaccaaaaucccuagcagggccaauaucgcaacauaauuauaggccaggauaucauacucaaacggcaggcccauggcaucuagggaaauuagaauuggauuuuaacuacugugaggguacaacagucguaaucaccgaaaauugugguacacgggggccaaguuuacguacuacaacagucucuggcaaauugauacacgaaugguguuguaggucaugcacccuucccccucuaagauauaugggggaagaugguugcugguauggcauggagauucgcccaaucuccgaaaaagaagaaaauaugguaaaaucgcuuguauccgcggguagcggaaaaguugauaauuucacaaugggcguacuuugcuuagcuauuuuauuugaggaagucaugcgaggaaaguucggcaagaaacauaugauagcuggcguguucuuuacauuuguccuguugcugucaggacagauuacauggcgcgacauggcccacacacuaauuaugauaggauccaaugcuagcgauaggaugggcaugggaguuacauacuuggcguugauagcuaccuuuaaaauccaaccauucuuagcauuaggauucuuucuaagaaaacuaacgucccgagaaaaucugcuacuaggaguuggguuggccauggccacaacccuccaacucccagaagauauagaacaaauggcuaauggcauagcacuuggauuaauggcuuuaaaauuaauaacccaguucgagacauaucaacucuggacggcgcucauaucucucacgugcaguaauacuauauuuacauuaacaguagcauggagaacugcaacacuaauauuagcaggaguaucgcuauuaccaguuugccagagcucaucaaugcguaaaaccgauugguuacccaugacuguugcagcaaugggaguaccacccuuaccuuuauuuaucuuuucacuaaaagauacauuaaaaagacguucguggccucuuaacgaaggaguuauggcggucggucuagucucaauucucgcuucaagccuauuaaggaacgacgugccgauggcagggccauuaguagcgggaggguuacuaauagcuuguuauguaaucacuggcacgucugcugaucuaacgguagaaaaagcagcugaugucacaugggaggaagaagcagagcaaacaggagucucacauaauuuaaugauuacugucgacgacgauggaacuaugcgaauaaaagaugaugaaacggaaaauauucuaacaguuuuacugaaaacagcacucuugauaguuagcggcaucuucccuuauagcauaccagcuacacucuuaguuuggcacaccuggcaaaaacaaacacaaagauccggaguuuuaugggacguaccuucaccuccagaaacucaaaaggccgaacuugaagagggaguuuaccggauaaaacaacaagguauauuuggcaagacacaggugggaguaggcguacagaaggaaggaguuuuucacacaauguggcaugugaccagaggugcuguucuuacguacaauggcaaacguuuagagccuaacugggcuaguguuaagaaagaucuaauuucuuauggaggcggcuggaggcucagcgcccaguggcaaaaaggagaagaaguucaaguuauagccguagaaccugggaaaaaucccaaaaauuuccaaaccaugccuggaacauuucagacaacgacgggggaaauuggcgcaauugcacuagauuuuaaaccagguacaucgggaucaccaauuauaaacagagaggggaaaguagugggacuauacggaaauggagucguaacgaagaauggaggauacguuucugggauugcgcaaacaaacgcagagccugauggucccacuccagaauuagaggaagaaauguuuaagaaaagaaauuugacuauaauggaccuucaucccggaagcggaaaaacuagaaaauauuuaccggcuauaguacgagaggcaauaaagcgucgccuacgaacuuugauacuugccccuaccagagucguagcagcugaaauggaggaagcauugaagggauuaccaauaagauaucaaacuacugcgacgaaaucagaacacaccgggagggagauuguagacuuaaugugccaugcuacauuuaccaugagauuguuaucuccagugcggguacccaacuacaaucuaauaaucauggaugaagcgcauuucacugaucccgcaaguauugcggcucguggcuauauuucuacucgcguagggaugggcgaagccgcggccauauuuaugacagcgacgccuccugggacagcugacgcauucccucaaagcaacgcaccgauucaggacgaagaacgggacauaccugagcgaagcuggaacucuggaaaugaauggauaacugauuucgcagguaaaaccgucugguuugucccauccauaaaagcggggaacgauaucgcaaacuguuuaaggaaaaauggaaagaaaguaauacaauugagccguaaaacuuuugauacugaauaucagaaaacgaaacuuaacgacugggauuucguugugacgacagacauaagcgaaaugggagcaaauuuuaaagcggaccgagucauagacccucgacgcugucugaagccugugauacugacggaugggccggagcgcguuauauuggcugggccgaugcccguaacagcagcuucugcagcacaacgccgaggcagagucggaagaaacccgcaaaaagaaaacgaucaguacauauucaccggacagccccuaaauaaugaugaagaccaugcacauuggacugaagcuaagaugcuuuuagacaacauuaacaccccugaaggcauaauaccagcguuauuugaaccagaacgagagaaaagcgcagcaaucgauggugaguaccggcuaaaaggagaaagcagaaaaacguuuguggagcuaaugagacgaggugaccuaccaguauggcuagcucauaaaguagcaucggaagguaucaaguacacggaccguaaaugguguuucgauggacagcgcaacaaccagauacuagaggaaaacauggaugucgagauuuggacaaaagagggcgagaagaagaaauuacggccaagauggcuagaugcaagaacuuauagcgauccguuagcuuuaaaagaauuuaaagauuuugcugccggucgaaaaucaauugcguuagacuuagugacugaaauuggacguguaccaucacaccuggcucacagaacacgaaaugcucuagauaacuugguaauguugcauacuucagaacauggaggaaaagccuaccgccacgcgguggaggaauuaccagaaacaauggaaacccuauuauuauuaggauugaugauauuacuaacgggaggugccauguuauuuuuaauaagcgguaaggguaucggcaaaacuuccauagguuugauaugcguuauagcaucuagugggauguuguggauggcagaaaucccgcuccaauggaucgcgagcgcgauaguucucgaguucuuuaugauggugcuacuaauaccugaacccgaaaaacagagaacuccacaagacaaucaauuggccuaugucguuauaggaauauuaaccuuagcagcgauaauugcugccaaugagaugggauuauuagagacaacuaaacgagaccuuggaaugucaaaagaaccaggcgucguuuccccaacuucguacuuagauguggaccuacacccugcauccgcauggacccuuuaugcgguggcaacaacaguuauuacaccaaugcugagacacacaauagagaauaguacagcuaacguaucauuggcagcuaucgcaaaucaagccgucguuuuaaugggucuagauaagggauggcccauuucaaagauggauuuaggaguaccguuauuagcgcuugguuguuauucacaagucaauccucuaacacugacagcagcaguucucuuguuaauuacacacuaugcaauaauuggcccaggauugcaggcgaaagcaacccgugaagcacagaaaagaacagcagcagguauuaugaaaaauccgaccguagacggaauaaugacgaucgauuuggacccugucaucuaugauaguaaauucgaaaaacagcuaggacagguuaugcuucucguccucugugccgugcaacuuuuacucaugaggacuucaugggcgcuaugcgaagccuuaacucuagcaacagggccuaucacaacacuaugggaagguucgccaggaaaguuuuggaacacaacaauugcaguaucaauggcaaauauauuccgaggaagcuacuuagcaggagcaggauuagcauucucuauaaugaaauccguuggcacagguaaaagaggaacagguucucaaggugagacccucggagaaaaauggaagaagaaauugaaucaauugucacguaaagaauuugauuuguauaagaaaagugggauuacugagguagauagaacagaagcaaaggaaggacugaaacgaggagaaauuacacaucacgcaguaagucgagggagcgcuaaacuucaaugguuugucgagaggaacaugguuauaccagaagggagggugauugaccuagguugcggucgaggcggguggucauacuacugugcaggccuuaagaaaguaacugaaguucgagguuauacgaaaggagggccuggacaugaggagcccgugcccaugagcacuuauggauggaauaucguaaaacucaugucaggaaaagacguauuuuauuuaccucccgaaaaaugugauacauugcuuugcgauaucggcgagaguuccccgucaccaacuguugaagagucccgaacaauaagagugcugaaaaugguagaaccuugguugaaaaauaaccaauucugcauaaaaguguuaaaccccuauaugccaacagucauagaacaucuagagagacuacaaaggaaacauggggguaugcucguacgcaauccuuuaucgagaaacucaacacaugaaauguauuggaucagcaauggcacaggaaacaucguugcaucugucaacauggucucaagauuacuacucaacagguucacaaugacguacagacggccgacuauagaaaaagaugucguucuaggagcgggaacacgccauguaaaugcagaaccagaaaccccuaauauggacgucauuggugaacgcauuaagcguauuaaggaagaacauaauucaacguggcauuaugaugacgagaauccauacaaaacgugggcuuaucauggaagcuaugaggucaaggcuacuggaucggcuagcagcaugaucaauggcgucgugaaacuccuaacaaaaccaugggaugucguaccaauggucacccagauggcaaugacugacacuacaccuuuuggacagcaacggguauuuaaagaaaagguggauacucggacuccccgcuccaugccaggaacuagaagagucauggguauaacagcggaauggcuauggagaacccuugggcguaacaagaaacccagacuauguacgcgggaagaauuuaccaagaaaguacguacaaaugcagcuaugggagcuguauucaccgaagagaaucaaugggacagugcgaaagcugcaguagaagacgaagacuucuggauauuaguugacagagaaagagaauugcauaaauugggaaaguguggaagcugcguauauaauaugaugggcaagcgugagaagaaauuaggggaauuugguaaagcgaagggcagcagagccauaugguauaugugguuaggagcaagauacuuagaauuugaagcccuuggguuccucaaugaagaccacugguuuucaagagaaaauucguauagcggaguugagggggaaggauugcacaaauugggauacauccuccgcgauauuaguaagauccccgggggagcaauguaugccgacgauacggcaggaugggacacgcgaauaacggaagacgaucuucauaacgaagagaaaaucacgcagcaaauggauccagagcacagacaacucgccaaugcuauauuuaaguugacauaucaaaauaaaguaguaaaagugcaaagaccaacccccacggggacuguaauggacauaauuaguaggaaagaucaacgcggaagcggacaaguuggaacauauggucuaaauacauucacaaauauggaggcacaacuuauacgccagauggaaggagaaggcgugcuuucaaaggcugacuuagaaaauccucaucuuccugagaagaaaauaacacaauggcuugagaccaaaggaguugaaagacuaaagcgaauggcuauuagcggagaugacugugucguaaaaccuauagaugaucguuucgcgaaugcucuccuggcuuuaaaugauaugggcaaaguaagaaaagauauaccacaguggcaaccgagcaaaggauggcaugauuggcagcaagucccuuuuugcucucaucacuuccacgaacuaauuaugaaagacggaagaaaacuuguuguaccaugcagaccacaagaugaacuuauagggagggcaaggauaagucaaggagcgggauggagccuaagagaaaccgcgugccuggguaaagcguacgcacagauguggagucuuauguauuuccauagacgggacuugcggcuggcuaguaaugcaauauguagugcaguucccgugcauuggguuccaaccuccaggacaacguggagcauacaugcacaucaucaauggaugaccacagaagacaugcucacuguauggaauagaguauggauagaagauaauccauggauggaagacaaaacaccagucacgacuugggaaaacguuccauauuugggcaaacgcgaagaucaaugguguggcucgcuaauuggacucacuucuagggcaacgugggcacaaaacauacccacugcaauacaacaaguaaggagcuugauugguaaugaagaguucuuagauuauaugccaucuaugaagcgauucagaaaagaggaagaaucagagggcgcaauuugguag

SEQ ID NO: 23361 - RNA, 9873 nt, Artificial Sequence
  derived and/or modified CDS sequence (opt6) from DENV-3__FJ547075__SS-prME
accucguuaugucuuaugaugauauuaccagcggcacuagcauuccaucuuacuagccgugauggggaacccaggaugauaguagggaaaaaugaaagaggaaaaucuuuacuuuucaaaaccgcaucggggauaaauaugugcaccuuaauagcgauggauuuaggugaaaugugcgaugauacaguaacguauaaauguccccauauaacagaaguugaacccgaagauaucgacuguugguguaacuuaacaucaacguggguaaccuauggaaccugcaaucaagcgggcgaacaccguagagauaaacguucaguagcacuggcgccucacguuggcaugggauuagacacccggacacaaacauggaugucggcagaaggagcuuggcgacaaguugaaaaaguagaaacaugggcccuuaggcacccgggcuucacuauauuggcgcucuuucuagcucauuacaucgggacaucucucacucaaaaaguaguaauuuucauuuugcuaaugcugguaacuccaucaaugacaaugcgcugcguagguguaggaaauagagauuuuguagaaggccuaucgggugcaacguggguugaugucguacuugaacauggugguugugucacaacuauggcgaaaaacaaaccuacguuggauauagaacuccagaaaacugaagcaacacagcuagcuaccuuaaggaaauugugcaucgaaggaaaaauuacuaauauuacgacagacaguagaugcccgacgcaaggagaagcaguauuaccugaagaacaagaucagaacuacguguguaaacauacauauguagaucggggcugggguaauggauguggucuauuuggaaaaggaucacuuguaacgugugcaaaauuucaauguuuagaaccaauagaaggaaaaguagugcaauaugagaaucuaaaauacacuguaauuauuacgguacauacaggcgaccaacaucaaguaggaaacgagacgcaagguguaacugcugaaauaacaccacaagcaaguacuacugaggcaauauuacccgaauacggaacacucggccuagaauguagcccacgaaccgguuuagacuuuaaugaaaugauuuuguuaacaaugaaaaacaaagcauggaugguacacagacaaugguucuuugaucuuccuuuaccauggacuucuggggcgacgacggagacuccaaccuggaacaggaaagaacuauuaguaaccuuuaaaaaugcccaugccaagaaacaagaagucguuguuuuaggaucccaggaaggagcuaugcauacggcacucacaggagcaacugaaauccaaaauagcgguggaaccagcauuuucgccgggcaccuaaagugcagacuuaaaauggauaaacuagaauuaaaaggcaugagcuacgcuauguguacaaauacauuugugcugaaaaaggagguauccgaaacccaacauggcaccauauuaauuaaggucgaauacaagggcgaagaugugccaugcaaaauaccguucucaacggaggacggucaaggaaaagcgcauaaugggagauugauaaccgcaaacccaguuguaacaaagaaagaagaacccguaaauauugaagccgagccaccuuucggugaaucgaacauuguaauuggaauaggagauaacgcgcugaaaauaaacugguauaaaaagggcucaucuauuggcaaaauguuugaagcaacugcaagaggugcacgaagaauggcgaucuugggggauacugccugggacuuuggauccgucgguggaguacucaacagccuuggaaaaauggugcaccaaauuuucggaucugcauauacggccuuauuuucugggguaucuugggucaugaaaaucggaauagggguacuacuuacguggauaggacuaaauagcaaaaacacaaguaugaguuuuucaugcaucgugauaggcauaauaaccuuauacuuaggugcaguuguacaggcugacaugggaugcgucauaaacuggaaagggaaagaauuaaaaugcggaagcggcauauuugucacuaaugaaguacauacuuggaccgaacaauauaaauuccaagcagauucgccaaaaaggcuggcgacagcuaucgcaggcgcaugggaaaacggcgugugcgggauaagaucuaccacuagaauggaaaaucuucuauggaagcaaauagccaaugaacuuaacuauauacuuugggagaacaacaucaaacugacagugguuguuggagauauuauuggggugcucgaacaagggaaaagaacacuuacaccccaaccgauggaguuaaaauauaguuggaagacuuggggaaaagcaaagauaguaacugcugaaacacaaaauagcagcuuuauaauagauggacccaacacgcccgaaugcccuagcgcaucuagggcauggaaugucugggaagucgaagauuacggauucgggguuuuuacaacaaauauuuggcuaaaauuacgggaaguguauacacaauugugcgaccauagguuaaugucggcagcagucaaagacgaaagggcaguucaugcggacaugggguauuggauagaaagccaaaagaacgguucauggaaacuagaaaaagcuagucucauagaagucaaaaccugcacuuggccaaaaagucauacgcuguggucaaauggcguauuagagucggauaugauaaucccaaaaagucuagcaggaccaauaagucaacacaacuacagaccuggcuaccauacacagacugcagggccuuggcaucuaggaaaacucgaacuagauuuuaacuacugugaaggcacaacaguuguuauaacugaaaauugcggaacgcguggacccucucuucggacgacuacaguaagugggaaauuaauccacgagugguguuguagaucauguaccuugccuccucucagauacaugggugaagacgguuguugguaugggauggaaauuaggccuaucagugaaaaagaggagaauauggucaagucauuaguuagugcuggcaguggcaaaguagacaacuuuacaauggguguacuaugucuugcaauucuguuugaagaagucaugaggggaaaguuugguaagaaacauaugaucgccggaguguuuuucacuuucguacuucuauuaucuggucaaaucacauggcgugauauggcacauacauuaaucaugauuggaaguaaugcauccgacagaaugggcaugggaguuacguaucuugcauuaauugcaacguuuaaaauacaacccuucuuggcauugggauuuuuccuaagaaaauuaacuuccagggaaaacuuauuacucggugugggucuugcuauggcaacgacacuacaauugccagaagacauagaacaaauggcaaauggaauagcucuuggauugauggcucugaaacuuauaacucaauuugaaacuuaucaauuauggacggcacuaaucuccuugaccuguucaaacaccauuuuuacauuaacgguagcauggcggacugcaacacuuauacuagcaggcgugucacuacuaccaguaugucaaaguucaucaaugcgaaaaacggacuggcuuccuaugaccgucgcagcaaugggaguaccaccucuaccucuuuucaucuuuucccucaaagauacauugaagaggcgaagcuggccacuuaacgagggugucauggcagucggacugguaucaauucuagcgagcucguuacuucgaaaugacguuccgauggcagguccauuaguagcaggaggauuacuaauugcuuguuacguuauaacagguacgagcgccgacuuaacaguugagaaagcagcagacguaacaugggaagaggaggcggaacaaacgggggucagucauaaucuaaugauuacaguagaugaugacgguacgaugagaauuaaagaugaugaaacagaaaauauauuaacaguauugcucaaaacugcguuacugauuguuucgggcauauuuccuuauucaaucccugcgacacuuuugguuuggcauaccuggcaaaaacaaacacagagauccggaguauuaugggaugucccuagucccccugaaacccaaaaagccgaauuggaagaaggaguauaucguauuaaacaacaaggaauauuugguaaaacgcaaguaggaguaggcguacaaaaggaggguguguuucacacuauguggcaugugacuagaggugcaguuuugacuuauaaugggaaacgauuagaaccaaacugggccucugucaagaaagauuugauuaguuacggagguggauggagacuuagugcacaauggcaaaaaggugaggaagugcaaguaaucgcaguagagccaggcaaaaaccccaaaaauuuucaaacuaugcccggaacguuccagacaacaacaggugaaauuggagcgauugcacuugacuuuaaaccagggacaucgggaucuccuauaauaaacagagaaggaaaagucguaggauuguaugggaauggaguagugaccaaaaauggagguuauguaucuggcaucgcacagacaaacgcagaguccgacggucccacuccugaacuagaagaagagauguucaagaaaaggaaucucacuaucauggaucuacauccgggcagugguaagacgcggaaauauuugccggccauaguucgcgaagccauaaaaagaagacuaaggacccuaauauuggcuccuacccgugucguagcugcugaaauggaagaagcacuuaaaggacucccaauucgauaucaaacaacagccaccaaaucugaacacaccggacgagaaauagucgacuugaugugucacgcuaccuuuacuaugaggcuuuuaagcccgguuagagugccaaauuacaacuuaaucauaauggacgaagcucacuucacugacccugcaucuauagccgcucggggauauaucucaaccaggguaggcaugggugaagcagcagcgauauucaugaccgcgacgccucccggcacugcggaugcauuuccgcaaagcaacgcuccuauucaagacgaagagagagauauaccagagagaucuuggaacucaggcaaugaauggauaacugauuuugcaggaaaaacaguuugguuuguuccuucaauuaaagcugguaacgauaucgcuaauugccuccgaaagaauggaaagaaaguaauucaauugaguagaaaaacauucgacacugaauaccagaaaacuaaacugaaugauugggacuucgucguaacaacagacaucucagagaugggagccaauuucaaagcugauagaguaaucgauccuagaagaugucuaaagccagugauccuuacagaugguccagagcgaguuauccucgcagguccuaugccuguaacagcggcuucugcugcacaaagacgcgggagagugggcagaaacccacaaaaagagaacgaucaauacauauucaccgggcagcccuuaaacaaugacgaagaucaugcacacuggacugaagcaaaaaugcugcucgacaacauuaauacaccugaagggauaauaccugcucucuuugaaccagaacgggaaaagucagcugcaauagacggagaauauaggcugaaaggggagucacgaaagacauuuguugaauuaaugcguagaggagaucuucccguuuggcuagcgcauaagguugcuagugaaggaaucaaauacacggaucggaagugguguuuugacggucaaagaaauaaccaaauacuagaagaaaauauggacguagaaauuuggacaaaagaaggagagaagaagaaauuaagaccaagaugguuagacgcacgcacuuauagugauccacuggcuuugaaagaguucaaagacuuugcagccggacgcaaaucgaucgccuuagaucuuguuacagaaaucggcagagucccgucccacuuagcacacagaacacgcaaugcucuagauaauuuaguaauguugcacaccuccgaacaugggggaaaggcuuaucggcaugcuguugaagaauuaccagaaacgauggaaacauuauuauuauuaggcuugaugauucuccugaccggaggcgcuauguuauuuuuaauaaguggaaaagggauagggaaaacaaguauaggauugauaugcgucauagcaucaucugggaugcuauggauggccgaaaucccacugcaauggauugccuccgcgauugugcuagaguucuucaugauggugcuguuaauucccgagccugaaaaacaacgaacaccacaagacaaucaguuagcauaugucguaauagguauuuugacccuggccgcaaucauagccgcgaaugaaaugggccuccuagagacgacuaaacgcgacuuaggaaugucgaaagaaccgggcguuguuucaccgacaaguuauuuagauguagaccuacacccggcaagcgcuuggacuuuauacgcaguagcgacaacaguaauaacgccaauguuaagacacacuauagagaacucgacagcaaauguaucacuagcggcuauagcaaaucaagcugucguacugauggguuuagacaaagguuggcccauuucuaaaauggacuuggguguaccauuacuagcacuaggcuguuacucccaaguaaauccauugacacuaacagcagccguacuauuacugauaacacauuacgcgauuauaggucccggauuacaggcaaaagccacacgagaagcgcagaaaagaacugccgcugguauaaugaagaauccaacuguagaugggauaaugacaauagaucuugacccaguaauauacgacucuaaauuugaaaagcaauuaggccagguaauguugcucguauuaugugcuguucaacuacuacuaaugcgaacaucgugggcgcuaugugaagcccuuacccuagcuaccggaccgauaacuacauugugggaaggaaguccagguaaauuuuggaacaccacaauugcaguuucaauggccaacauauucagaggcagcuaucucgcuggagcgggacuagcauuuaguaucaugaagucaguuggaacggggaaacgaggaacgggaucucaaggcgagacucuuggugaaaaguggaagaagaaauugaaccaacuuuccagaaaagaguucgauuuauauaaaaagaguggcauuacagaaguagacaggacagaagcaaaggagggacuaaaacgaggcgagauaacacaucaugcuguaucuagaggcucagcuaagcuccaaugguuuguugaacgaaauaugguuauaccugaaggaaggguuauagacuugggaugugggcgaggugguuggagcuauuauugcgcuggucuuaagaaaguaacggaagucagagguuauaccaagggaggacccggacacgaagaaccaguaccuaugucgacguauggcuggaauaucguuaaauuaaugucugguaaagacguuuucuacuuaccuccugaaaaaugcgauacgcuacugugugacauuggcgaaucaucaccuucaccuacaguugaggaaucgcgaacuauuagaguacucaaaaugguagagccaugguugaaaaacaaucaauucuguauaaaaguuuuaaauccuuauaugcccacgguaauagaacauuuagaaaggcuccagcgaaagcauggcggaaugcucguacgaaacccccucuccagaaauuccacacaugaaauguauuggaucucgaauggcacuggaaacauaguagcaucggucaacaugguaagucggcuuuuacucaauagauuuacaaugacgcaucgacgccccacuauagagaaagacguagaccugggagcaggaacaagacacguuaacgcugaaccggaaacgccaaacauggauguaauaggugaaagaauaaaaagaauuaaagaggagcauaauucgacuuggcacuacgaugaugaaaaccccuauaaaacgugggcauaccacggcaguuacgaagugaaagcaacuggaagugcaucuucaaugauaaacggcguaguaaaacuucuaacuaaacccugggacgucguuccaaugguuacacaaauggcaaugacugauacaacccccuuuggucagcagcgcguuuuuaaagagaaaguagauacacguacaccgcgcucuaugccggguacgcguagagucaugggaaucaccgcagaaugguuguggcgaacuuuaggaaggaauaagaaaccuagacuauguacuagggaagaguuuacuaagaaaguaagaacaaaugccgcaaugggagcagucuucacggaggagaaccaaugggauagcgcaaaagccgcaguagaagacgaagauuucuggauccuugucgauagagaacgggaacuacauaaacuaggcaaaugcggcucuugcguauauaauaugauggggaaaagagaaaagaaauugggugaguuuggcaaagcgaaaggaucgcgagcaaucugguauauguggcuaggggcaagauaccuugaauuugaagcacugggguuccuaaacgaggaccacugguuuagccgagaaaauuccuacucagggguugagggagagggacuacauaaacuuggauauauacuaagagauaucucuaaaauaccuggaggcgcaauguacgccgaugauacugcggguugggauacacgcauaacugaagacgaucugcauaaugaagagaaaauaacgcaacagauggauccagaacaccgucaacuagcuaaugcaaucuucaagcuaaccuaucaaaauaagguugucaagguacaaaggccgacaccaacaggaacagugauggacaucauaucuagaaaagaucaaagaggaagcggccaaguugguacguauggucuaaacacauuuacuaauauggaagcccagcuaauaagacagauggaaggcgaagguguacuaucuaaagcagauuuggagaacccucaucuaccagagaagaaaauaacacagugguuggagacaaaaggaguugagagacuaaaacgcauggcaauaucaggugaugacuguguuguaaaacccauagaugacagauuugccaacgcauuguuggcauuaaacgauauggggaaaguacgaaaagauauuccacaauggcagccaucaaagggauggcacgauuggcagcagguucccuuuuguagucaucacuuucacgaauuaaucaugaaggacggucguaaacucguugugccguguagaccacaggacgaacuaauagguagggcaagaauaagucaaggagcugguuggagucuucgagagacugcaugucucgguaaagccuacgcacagauguggagucuuauguacuuccauaggagggacuuacgauuagcuagcaaugcuauuugcagugcuguccccguccacuggguuccuacaagcagaacgacuuggucaauacacgcgcaccaccaguggaugacaacggaagacauguuaacaguauggaauagaguauggauugaagacaauccauggauggaagauaaaacuccaguaacuaccugggaaaaugucccauaucuugguaaacgagaggaucaauggugugggucauugauaggacucacuucacgcgcaacuugggcacaaaacauaccaacagcaauacagcaaguccgcuccuuaauugguaaugaggaguucuuagacuauaugccauccaugaagcguuucaggaaagaggaagagucagaaggagcgauaugguaa

SEQ ID NO: 23362 - RNA, 9873 nt, Artificial Sequence
  derived and/or modified CDS sequence (opt6) from DENV-3__FJ547076__SS-prME
acgagccucugucuuaugaugauuuugccagcagccuuagccuuucaccucacuuccagagauggggaaccccguaugaucgugggcaaaaacgaaagaggaaaaucgcugcuauuuaaaacugcuagcgguaucaacaugugcacuuugauugcaauggauuugggagaaaugugcgacgauacggugacuuauaaaugcccacauauuacggaaguagaaccagaagauaucgacuguuggugcaaucuaacaagcacauggguaacuuacgggacuugcaaccaagccggugagcauagaagagauaaaaggagcguugcacuagccccacacguuggaaugggucuggacaccaggacacaaacauggaugucagcugaaggagcauggagacaaguagaaaaaguagagacaugggcgcuccgacacccaggauuuaccauauuagcccuauuccuagcgcauuauauaggaacaagucuaacacaaaaaguggugauauuuauauuguuaaugcuaguaacaccgucaaugaccaugaggugcgucggaguaggaaaucgcgacuuuguugaagggcuaaguggugccacauggguugaugucguccucgaacacggugguugcguaacaacaauggcgaaaaacaaaccuacccuugacaucgagcuucagaaaacugaggcuacucaacuugcaacguuacguaaauuguguauugaaggaaaaauaacuaauaucaccacugauucucgcugcccuacccaaggagaagcuguacucccagaagaacaagaccaaaauuauguauguaaacacaccuacguugauagggguugggguaacggguguggauuauucggaaaggguucucuaguaacuugcgcaaaauuccaaugcuuggagccuaucgaaggaaaaguggugcaauaugaaaaccugaaauauacgguaauaauuacgguacacacgggggaucaacaccagguagggaaugaaacacaaggaguaacggccgaaauaacgccacaagcaucaacaacagaagcaauccuuccggaauacggcacccuagggcuagaauguucaccaagaacgggcuuggacuuuaaugaaaugauacuauugacaaugaaaaauaaagccuggaugguucauagacaaugguucuuugaccuaccucuaccguggaccucaggagcgacuacagaaacaccaacuuggaacagaaaagaacuauuagugacauuuaaaaaugcacacgcaaagaaacaagagguaguaguuuuagggagccaagaaggggcaaugcauacagcuuugacaggcgcgacagaaauucaaaacaguggaggaacaaguauauuugcaggacauuuaaaaugucgguuaaaaauggauaaauuagagcuaaaaggaaugagcuaugcuaugugcacaaauacuuuuguuuugaaaaaggaaguuagcgaaacucagcacgggacaauacuuauaaaaguagaguauaagggagaagauguuccaugcaaaauucccuuuucuacggaagaugggcaaggaaaagcucauaauggacgcuuaaucacggcaaacccgguuguaacuaagaaggaagaaccugucaacauugaagcagagccuccguuuggcgaaagcaauauaguaauaggaauaggcgauaacgcacuaaaaauuaacugguauaagaaaggcaguuccauaggaaaaauguuugaagccacggccaggggagcacgcagaauggccauccuaggugauacagcaugggacuucggcucgguuggaggaguacuuaacucucugggaaaaaugguccaucaaauauucggauccgcuuauacagcuuuauuuucggggguaucauggguaaugaagaucggaauaggggugcuuuuaacauggaucggacuaaauaguaaaaauacaaguaugucguuuagcugcauugcaauuggaauuauaacuuuauacuuaggugcaguaguacaggcggauaugggaugugucaucaauuggaaaggaaaagaguuaaaaugcggaucaggaauauuugucacaaaugaaguucacacuuggacagaacaauauaaguuccaggcugacucuccaaaaaggcuagccacagcaauagccggugcuugggaaaauggaguguguggcauucgcucgacgacucguauggagaaucuucuauggaaacagaucgcuaaugaacucaauuacauacuuugggaaaacaacauuaaauuaacaguagugguaggagauaucauuggcguacuugaacaaggaaaaaggacacugacaccgcaaccuauggaauuaaaauauaguuggaaaacauggggaaaagcuaaaauuguuacugcagaaacucaaaacucaaguuuuauuauagacgggcccaauacaccagaauguccaucggcaucccgagcguggaacguuugggaaguagaagauuacggguucggaguauuuacaacuaacauuugguuaaaacucagagaagucuauacucaguugugugaucaccgacugaugucugcggcuguuaaagacgaaagagccguucacgcagauaugggcuacuggauagaaucacagaaaaacggcaguuggaaacuagaaaaagcgucauuaauugaaguuaaaacuuguacguggccaaaaagucauacuuuauggucgaauggaguuuuggaauccgauaugauaauuccuaaaagucucgcaggaccaauuagucaacacaauuauagacccggcuaucauacucaaacugcaggaccauggcaucuagggaaauuagaacucgauuuuaacuacugugaggguacaacgguaguaauaacugagaacuguggaacaagagguccaucgcucagaacuaccacuguaucaggaaaguuaauucacgaguggugcugcagaucauguacccuaccuccacuuagauauaugggagaggauggaugcugguaugggauggagauacgaccaguaucagaaaaggaagaaaacaugguuaaaagucuagugagcgcgggaucggguaagguagauaauuucaccauggggguacucugccuugcaauucuuuuugaagaaguuaugagaggcaaauucggaaagaaacacaugauugcgggcgucuucuuuacuuucguccuucuauugaguggacaaauaacguggagagacauggcacauacucuaauuaugaucgguucaaaugcgagcgaucgaaugggaauggggguuacauauuuagcucugauagcgacauuuaaaauacaaccguuccuagcuuuaggauuuuucuuaaggaaacuaacaagucgggaaaaucuuuuacuaggaguaggccucgccauggcaacuacauuacaacugccugaagauauugagcagauggcuaacgguaucgcacuggguuuaauggcacuuaaguuaauaacacaauuugaaacuuaucagcuauggacugcauugauaucccuuacaugcucgaacacaauauuuaccuugacgguagcauggagaacugcaacacugauacuugcaggagugucccucuuaccaguaugucagaguuccucuaugagaaaaacugauuggcucccgaugacgguagcugcgaugggcguaccaccguuaccuuuauucauauuuucguugaaagacacacuaaaaagaaggucauggccacucaacgaaggaguaauggcgguaggauuaguaucuauacuagccucuucauuacuuaggaaugauguacccauggcgggucccuuaguagcgggcggauuauugauagcguguuauguaauaacaggaaccagugccgauuuaaccguagaaaaagccgcagaugugacaugggaagaggaagccgaacaaacaggugucagucauaaccuuaugauaaccguagaugacgauggaacuaugcguaucaaggaugaugaaacggaaaauauacuaacaguucuucuaaaaaccgcccuccugauagucagcggaauuuuuccauauaguaucccugcgacauugcucguuuggcauacauggcaaaaacaaacccaaagaaguggcgucuuaugggaugucccuaguccacccgaaacgcaaaaagccgaacuugaagaagggguuuauaggauaaagcaacagggaauuuuugggaaaacacaagucggcgucgguguacagaaagagggaguauuccacacuauguggcacguuacucggggugcaguacucacauauaauggcaaaagacucgaaccgaauugggcgucugucaagaaagacuuaaucucuuaugggggcggauggcggcuuagcgcucaauggcaaaaaggggaagaaguacaaguuaucgccguugaaccaggaaagaaucccaaaaauuuccaaacaaugcccgggacuuuccaaacaacaaccggagagaucggggccauagcauuggauuuuaaaccagggaccagugggagcccgauuauaaaucgggaggggaaaguugugggccuauacggaaauggugugguaacuaaaaacggaggauauguaucaggcauugcgcaaacaaacgcagaaccggacggcccaacacccgaacuagaagaagagauguuuaaaaagagaaaucuuacaauaauggauuuacacccagggaguggaaaaacuagaaaauacuuaccugcaauaguacgugaggccaucaagcgccggcuuagaacauugauacuagcaccuacuagagugguugccgcugaaauggaagaggcauuaaaaggauuaccuauaagguaucaaaccacugcgacaaaaucggaacacaccgggcgagaaauaguggaccuaaugugccaugcuacauuuacaaugcgacuccuaagcccugucagagugccuaacuauaaccuaauuauaauggacgaagcucacuuuacagauccggcgagcaucgcagcacgcgguuauauaucgacacgaguagggaugggcgaagcugcggcuauauucaugacagcuaccccgccggguacagcagacgcuuuuccacaaagcaaugcaccuauacaggacgaagaacgagauaucccggagagaucuuggaauaguggcaaugaguggauaacugacuucgcaggcaaaacagucugguuuguaccuagcauaaaagcagggaaugauauagcaaauugucuaagaaagaaugguaagaaaguuauucaacuaucuaggaagacauuugauaccgaauaucaaaagacaaaacuaaacgacugggauuucguaguuacaacagauauaagugagaugggagcaaauuucaaagcggaccgagugauagauccacgaagaugccuaaagcccgugauauuaacagauggaccagaaaggguaauucuugcaggaccaaugccuguuaccgcagcaucugcagcccagaggcgcggaagaguagguaggaacccucagaaagagaacgaccaauauaucuuuacaggacagccccuuaauaaugaugaggaucaugcacacuggacggaagcgaagaugcuacuagauaauauaaauaccccagagggcauuaucccagcauuauuugagccggagagggaaaaaucggcagcaauugauggggaauaccguuugaaaggagaaucaaggaaaacauuuguagaauuaaugaggagaggugauuuaccaguguggcuagcucacaaaguagcgagugaaggaauuaaauauacugaucgcaaaugguguuucgacggucaaaggaacaaccagauuuuggaagaaaauauggacguugagauauggacaaaagaaggcgagaagaagaaauugcguccccgauggcuagacgcuagaacuuacuccgauccacucgccuuaaaggaauuuaaagauuucgcugcggggaggaaaucaauugccuuggaccuuguaacugagaucgggagagugccaucccaucuugcucauaggacacgaaaugcgcuugauaacuuggucauguugcacacuucugaacacggggguaaagccuauaggcaugccguugaagaacuucccgaaaccauggagacuuuguuacucuuaggguugaugauauuacucacaggaggggcaauguuauuucugauuagugguaagggcaucggaaagacuucuauaggccugaucugcguaauagcgucaagcggaauguuguggauggcugagaucccccuacaauggauugcuucagcaauuguucuggaguuuuucaugaugguguuauuaauuccugaaccagagaagcaacgaacaccgcaagauaaucaauuagcuuauguaguuauuggcauucuuacacuggcugcuauaauagcggcaaaugaaaugggccuauuagaaacaacaaaacgugaucuuggaaugucaaaagaaccaggaguugugaguccgacuucguauuuagacguagauuuacacccagcgagugcauggacgcuuuaugcggucgcgacgacuguuauaacuccaaugcuuagacauacuauugaaaacaguacggcuaacguaucauuggccgccaucgcaaaucaagcgguuguguuaaugggauuagacaagggauggcccauuucuaaaauggaucucggagugccauuacuagcacuaggaugcuacucacaagucaacccucuaacauuaacggcagccguacucuugcuuauaacgcauuaugcuauaauaggaccuggucuccaagcgaaagcaacuagagaagcacaaaagagaacagcugcaggaauuaugaagaacccuaccguugaugguauaaugaccauagauuuggauccaguuauauacgauagcaaauucgaaaaacagcugggccagguaauguuacucguacucugcgcuguacaauuauuacuuaugaggacaagcugggcucucugcgaagcucuaacccuagccacaggaccgauaacaacacucugggaggggucaccagggaaauuuuggaauacgacuauagcuguaagcauggcuaauaucuuccgaggaagcuaucucgccggcgccggauuagcguuuucgaucaugaaaagcguaggaacaggaaaacgcggaaccgguucgcaaggagaaacccucggagaaaaguggaaaaagaaguugaaccagcuaucaagaaaggaauuugauuuguauaaaaagucagguauuaccgaaguagaccgaacagaggcaaaagagggacugaagagaggcgaaauuacacaccaugccguaagcagagguagcgcaaaacugcaaugguuuguagaacgcaacaugguaauaccugaaggaagaguuauagaucuaggaugcggaagagguggcuggaguuauuacugugcagggcuaaagaaagugacagagguaagggguuacaccaaaggcggaccaggccaugaggaaccgguaccaaugaguacauacggauggaauauuguaaagcucaugucggggaaagacguauucuaccuuccuccggaaaaaugcgacacacuacuaugugacauaggagaaucauccccaucaccaacuguggaagaaucaaggacaauuaggguguugaaaaugguagagccauggcucaaaaacaaucaauuuuguaucaaaguucucaaucccuacaugccuacagugauagaacauuuagaaagacuacagagaaaacauggaggcauguuaguccgaaacccacuaagcagaaacucaacucacgaaauguauuggauaaguaaugguacuggaaacauaguagcgaguguaaauaugguaagcagauuauuauugaaccguuucaccaugacgcacagaagaccaacaauagagaaagacguagaucuaggagcagguacucgacaugucaacgcagaaccagagacaccaaacauggauguaauaggcgaaagaauaaagcguaucaaagaagaacacaacaguacauggcacuacgaugaugaaaacccauauaagacgugggccuaucaugggucuuacgagguuaaagcuacagguucagcauccucuaugauaaaugguguuguaaagcuccuaacaaaaccaugggauguuguaccuaugguaacucagauggcaaugacagauaccacuccguuuggccaacaacgagucuuuaaagaaaaaguagauacucguaccccaagauccaugccgggcacucgaagagugaugggcaucacagcugaaugguuguggcgaaccuuggggcgaaauaagaaaccgcgucuaugcacaagagaggaguucacuaagaaagugcgcacgaacgcagcaaugggagcuguuuucacagaagaaaaucaaugggacagcgccaaagcggccgucgaagacgaagauuuuuggaaacugguagaccgugaaagggaacuucacaaacuggguaaaugugguucguguguuuacaacaugaugggcaagagagagaaaaagcuaggugaauuuggaaaagcgaaaggaagccgagcaauaugguacauguggcugggggcgagauauuuagaguucgaggcucuaggauuccuuaaugaggaccauugguuuagucgugaaaacaguuauucugguguggaaggagaaggacuucacaaacugggguauauacuaagggauauaagcaaaauaccaggaggugcuauguacgcagacgauacggcagguugggauaccagaauuacugaggaugauuugcauaaugaagaaaagauuacgcaacaaauggacccagaacaucggcaguuagcaaaugcgauauucaaauugacauaucaaaauaagguaguuaaaguacaaagaccaacaccaacgggaacaguuauggacauuaucagucgcaaggaccaaagggguagcggccagguaggcacuuacggacuaaacacuuuuaccaacauggaggcacagcucauuagacaaauggaaggggaaggagucuuaucuaaagccgaccuagaaaacccacacuuaccugagaagaaaauaacacaauggcuugaaacuaaggguguagaaagacugaaacgaauggcuaucucuggagacgacuguguagugaaacccauugaugauagauuugcuaacgcauuauuagcacuaaacgacaugggaaaaguaaggaaagacaucccccaguggcaaccaucgaagggcuggcacgacuggcagcaaguaccuuuuuguucucaccacuuucaugaacuaauaaugaaggacggucgaaaauuaguuguaccuugcagaccacaagaugaauuaauaggacgugcgagaauaucacaaggugccgguuggucauuaagagaaacagccugucuaggaaaagcauaugcacaaauguggucacuaauguauuuucacagaagggaccucagacuagcuucaaaugcuauuuguagugcaguuccagugcacuggguacccacgagccggacuacauggaguauucacgcacaucaccaauggaugaccacugaggacauguuaacgguauggaauagaguguggauugaagacaauccauggauggaagacaagacuccuguaacgacaugggaaaauguuccauaccuuggaaagagagaagaccaaugguguggcucccuaauaggucuaacaagccgagcgaccugggcacaaaauauaccgacggccauucaacaagugcgaucucuaauugggaaugaagaauuucuggauuacaugccaucaaugaaaagauuccguaaggaggaagaaagugaaggugcaauaugguag

SEQ ID NO: 23363 - RNA, 9873 nt, Artificial Sequence
  derived and/or modified CDS sequence (opt6) from DENV-3__FJ547077__SS-prME
acaagucuguguuuaaugaugauauuaccagcugcauuagcauuucaucuuacgagucgagauggcgaaccgagaaugauuguuggcaaaaacgaacgaggaaaaaguuugcuauuuaaaacagcaagugguauuaacaugugcacccuuaucgcgauggaucuuggagaaaugugugacgauacgguaacuuauaaauguccccauauaaccgaaguagaaccugaagacauugacuguugguguaauuugacaucaacuugggucacguauggaacauguaaucaagcgggagaacaucgucgggacaaaagaucgguugcacuagcgccucacguuggcaugggauuagauacacgaacucaaacauggaugagcgcagaaggagcuuggagacaaguagaaaaaguagaaacuugggcacuacgacauccaggcuucacaauuuuggcacuauuuuuggcucauuauauaggaaccucacuaacacaaaaagucguuauuuuuauauugcuaaugcuagucacucccuccaugacaaugcgaugcgucggugucggaaauagagauuuuguagaaggccuaaguggugcaacauggguagauguaguccuagaacauggaggcuguguaacuacuauggccaaaaauaaaccuacuuuggauauagaacuacagaaaacggaagcuacacaacuugcuacgcuuagaaaauuguguauugaaggcaaaauaacaaacauuacuacugauucaaggugcccuacacaaggagaggcaguacucccugaagaacaagaccaaaacuacguuugcaaacauacguacguugacagaggauggggaaacggauguggacuauucgguaaagggucucucguuacaugcgcaaaauuccaaugccuugagcccauagaaggaaaagucguacaauacgagaaccucaaauauacaguuauaauuacagugcauacuggagaccaacaccaaguaggcaacgagacacaaggaguuacagcagaaauaacaccccaagcgaguacuacagaagcaauucucccugaauacgguacucuugggcuagaaugcaguccacggacaggucuugacuuuaaugagaugauauugcuaacaaugaagaauaaggcguggaugguccaucgccaaugguucuuugacuuaccucuuccauggacaucgggcgcuacaacugaaacuccuaccuggaaccgaaaggaacuccuuguaacguucaagaaugcucacgcaaagaaacaagaaguaguuguguuaggcucccaagagggugccaugcacacggcuuuaacuggagcaacagaaauucagaauagcggaggaacuuccauuuuugcagggcauuuaaaauguagauuaaaaauggauaagcuagaacuaaaaggaaugucauaugcaaugugcacaaacacauucguacugaagaaggaagugucagagacacagcauggaacaauacuaauaaaaguagaguacaaaggugaggacgcuccauguaaaauaccguuuucaaccgaagacggccaagguaaagcacacaauggacgccuaaucacagcuaauccugugguaacuaagaaagaagaaccugucaauauugaagcagaaccacccuucggagaaucaaacauaguuaucggaauaggugacaaugccuuaaagauaaauugguauaagaaaggaaguucgauuggaaaaauguucgaggccacagcuagaggagcucguagaauggcaauuuuaggagauacugcaugggauuuuggcucaguuggcggaguccuaaauucccuaggaaaaaugguacaccaaauauuuggaucugcguauacugcacuauuuagugggguaaguugggucaugaaaauuggcauaggugugcuucuuacuuggauagggcuaaauuccaaaaauacuucgaugaguuuuucguguauagcaauaggaauaauuacuuuguacuuaggagcaguuguacaagcggacaugggcugcguuaucaauuggaaagguaaagaauugaagugcggaaguggcauuuuuguaacaaacgaaguucauacuuggacagaacaauauaaauuccaggccgauucaccuaaaagauuagcaacugcuauagccggugcaugggaaaauggcguuuguggaauccggucuacgacaagaauggaaaaucuccucuggaaacaaaucgcaaacgaauuaaacuauauacucugggagaacaauauuaaacuaacagugguaguaggugauaucauagguguauuagaacaaggaaaaagaacccuaacaccucaaccaauggaacugaaauauucguggaaaacauggggaaaagcaaaaauugugacagccgaaacucaaaauucauccuucauaauagaugguccgaacaccccagaaugccccucagcgaguagagcauggaauguaugggaagucgaagacuauggguucggaguauuuacaacuaauaucuggcuaaaacuaagggaaguauacacucaguuaugugaucauagguuaaugucagcugcaguuaaagaugaaagagcaguccaugcugacauggguuauuggauagaaagucagaaaaacgguucguggaaauuagaaaaagccagcuuaauagagguuaaaacauguacguggccgaaaucucauacccuguggucaaacggcgugcucgaaucagacaugauuauacccaaauccuuagcaggccccauaagucaacacaauuaccgaccaggcuaucauacacaaacggcaggcccauggcauuuaggaaaauuggaauuggacuuuaacuauugugaagguacaacggugguuaucacggaaaacuguggaacaaggggcccaucgcuaagaacgacuacaguuucagguaaguugauacaugaaugguguuguagaucauguacacugcccccucuaagauauaugggggaagauggguguugguacggcauggaaauucgaccuauaagcgaaaaagaagaaaauaugguuaaaucacuggugucagccggaucaggaaaagucgauaacuuuacaaugggaguacuauguuuagcaauuuuguucgaagagguaaugagaggaaaauuuggcaagaagcauaugauagccgguguauucuuuacauucguacugcuacuuucaggucagauaacauggagggacauggcacacacguuaauaaugauuggcuccaaugcaucagaucguauggguaugggaguaacauaucucgcgcuaauagcuacauucaagauucaaccguuuuuggcucugggguuuuucuuaaggaaacuuaccucacgggaaaaccuccuucuggguguuggcuuggcuauggccacuacacuccagcuuccggaagauauagagcagauggcuaauggcauagcacucgguuuaauggcuuuaaaacugauaacacaguuugaaacauaucaacuauggacagccuuaauaucauugacuuguuccaacacaaucuuuacccugacgguggcuuggagaacugcaacgcuaaucuuggcaggaguuucacuuuuaccaguaugccaguccucaucaaugagaaagacagauugguugccuaugacuguggcggcaaugggaguuccaccguuaccgcuguuuaucuucucgcugaaagauacacuuaaacgucggucuuggccacuuaacgaagggguaauggcugucgggcuugugaguauccucgcaagcucucuuuuacguaaugauguaccgauggcaggaccauuggucgccgguggacugcuaauugcgugcuauguaauuacagguacaucugcggauuuaacagucgaaaaagcagcagacgugacaugggaagaagaagccgagcaaacaggaguuucucacaacuuaaugauaaccgucgacgacgauggaacuaugcguauuaaagaugaugagacggaaaauauauuaacagugcuuuuaaaaacggcucuccuuauagugucuggaaucuucccuuacucaauaccugcaacacuccuaguauggcauacauggcagaaacaaacucagcguagcgggguacugugggacguaccaucucccccugagacacaaaaagccgaacuggaagaagguguauaccguauaaaacaacaaggcauuuuugguaaaacacaaguuggaguuggcguacaaaaagaaggcguauuucacacgauguggcaugugacgcgaggcgcaguauuaacuuauaaugggaaacgacuugaaccaaauugggccucugugaaaaaggauuuaauuagcuacggaggagguuggagauugagugcccaauggcaaaagggcgaagaaguccaaguuauagcuguugaaccugggaaaaaucccaaaaauuuccaaacgaugcccggaaccuuccaaacgaccacaggugaaauaggugcaauagcucuugacuuuaaaccagguacuucuggcucuccaauaauuaaucgcgaaggaaaaguaguaggauuauacggaaacggaguagugacuaaaaacggaggguaugugagcggcauagcgcaaacgaacgcugaacccgauggcccaacaccugaauuggaagaagaaauguuuaaaaagcgaaaucugacaauaauggaccuccauccaggaaguggaaagacucgaaaauaccuacccgccauuguucgugaagcgauaaaaaggcguuuaaggaccuuaauuuuggcgccuacacgaguaguggcagcugaaauggaagaagcacuuaaagguuugccaauuagauaccaaaccacugcaacaaaguccgaacacaccggacgugaaauagucgauuuaaugugccacgcgacuuucacaaugagauuacucucaccagugcgcguuccaaacuauaauuuaaucauaauggaugaggcucauuuuacugauccggcaucaaucgcugcuagaggauauauaucaacccggguaggaaugggggaagcagccgccaucuucaugaccgcuacaccaccagggacggcagaugcauucccucaguccaacgcuccaauucaagaugaagaaagagauauaccagagaggucguggaacuccggcaaugaauggauaacggacuuugcgggcaaaaccguuugguuugucccaucaaucaaagcuggcaacgauaucgcuaacugcuuaaggaaaaauggcaagaagguaauacaauugucaaggaagacguuugacacagaguaccagaaaacgaaacuaaacgauugggauuuuguuguaacuacugacauuagcgaaaugggcgcaaauuuuaaggcagauagagucauugaucccagaagaugccucaaaccggugauccuuacagaugguccggaaagaguuauacuugcaggaccaaugccgguaacugcagcaagcgcagcccagcgucguggucgcgucgggcguaacccccagaaagaaaaugaccaauacauuuuuacuggucaaccauugaacaaugaugaagaucaugcucauuggacagaagcaaaaauguuguuagacaacauaaauacgccagaagguauaauuccagccuuauucgaaccagaacgagagaaaagcgcagcaauagauggugaguacagacugaaaggcgaaucccgaaaaacauuuguugaacuaaugcgucgaggcgaucuaccaguuuggcuagcacauaagguggcaucugaagguauaaaguacacagaccgaaaauggugcuucgauggacaaagaaacaaccaaauccuagaggaaaauauggauguagaaauuuggacaaaagaaggcgagaaaaagaaacuaaggccaagauggcucgacgcucgaacauauucggacccacucgcucuaaaagaguuuaaagacuucgcugcugggcguaaauccauagcauuagaccuuguaacagaaaucggacgcguccccucucauuuagcucauagaacacguaaugcucuagacaaccuugugauguuacauaccagcgagcauggcggaaaggcuuauagacacgccguggaggaacuaccagaaacaauggaaaccuuacucuuacuaggcuuaaugauauugcugacagggggagcaaugcuuuucuuaauaucaggaaaagguaucggaaaaacuuccauaggcuugauaugcguuauugcaagcagcggaauguuauggauggccgaaauaccucuacaauggauugcaucugcuauaguccuugaguucuuuaugauggucuuacucauaccagaaccagaaaaacagagaacgccacaggauaaucaacuugcauacguuguaauaggcauacuaacucuagcugcuacaauagcagccaacgaaaugggauuauuagagacaacaaaacgggaccuuggaaugucaaaagagccaggugucgugaguccgaccagcuauuuggauguagacuuacauccagcaucugcuuggacacuuuaugcaguugcaacaacgguaauaacaccgauguugcgucauacaauugaaaauaguacagcaaaugugagucuggcggcaaucgccaaccaggccguagucuugaugggguuagauaaaggauggccaauaucuaaaauggauuugggaguaccauuacuagcgcugggguguuacagccaagucaacccacuuacucuaacagccgcuguacuucugcuuauaacacauuacgcaaucaucgguccuggucuacaagcaaaagcaacacgggaagcgcagaaaagaacagccgcagggauaaugaaaaaucccacaguagauggaauaaugacgauugacuuagauccuguaauauaugauucaaaauuugaaaagcaauuaggccaggugauguuauuaguucuuugugcaguacaacuguuauuaaugcgcaccucaugggcucuaugugaagcacugacguuagccacugguccgauaaccacccugugggaaggaucaccugggaaauuuuggaacaccacuauagcaguaucgauggcgaacauauucagaggaucuuaucuagcuggagcgggauuggcauuuucaauaaugaaaucuguagguacaggaaaaagagggacugguucccaaggggagacgcugggagaaaaguggaaaaagaaauuaaaccagcuuucaagaaaagaguucgaccuuuacaaaaagucugggauaacugagguggacagaacagaagcgaaagaggggcuaaaaagaggcgaaauaacacaccacgcaguaucaagagggucugcaaaacugcaaugguucguagaacguaauaugguaaucccggaaggaagaguaauagaucuaggcugcggucgaggcggauggucauauuauugcgccggacuuaagaaaguaacagaaguacguggcuacacgaaaggaggcccuggccaugaggaacccguuccuauguccacuuauggauggaauaucguaaaguugaugucagguaaagauguauucuaccuacccccugaaaaaugcgauacauuacuuugugauaucggggagaguucaccaagcccaacgguagaagaauccagaacuauacguguccuaaaaauggucgagccuuggcucaaaaauaaccaauucugcauaaaaguucuaaacccuuauaugccaacaguuaucgaacauuuagagcgacuacaaaggaagcacggagguauguuagugagaaauccucuaagccggaacucaacucaugaaauguauuggauaucaaaugggacuggaaauaucguggcuucgguaaauaugguaucgagguuacugcuuaauagauuuacaaugacucauaggaggccgacuaucgaaaaggacguugauuuaggcgcuggaacccgucacguuaacgccgaaccggaaaccccgaacauggauguaaucggagaacgaauaaaacgaauaaaagaagaacauaauaguacauggcauuaugacgaugaaaacccguauaagacaugggcguaucacggauccuaugaagugaaagccacagguagcgcuucaucgaugauuaaugguguggugaaacuuuugaccaaacccugggauguaguuccaaugguaacccagauggccaugacugacacuaccccauuuggacagcaacgugucuuuaaggaaaaggucgacacacgaacaccucgguccaugccagguaccaggagaguaaugggaauuacagccgaaugguuauggcgcaccuugggaaggaacaagaaaccaagacuaugcacacgugaagaauuuaccaagaaagugaggacuaaugcagcgaugggagccguauucacugaggaaaaccaaugggauagugcuaaggcagcaguagaagaugaggauuucuggaaacuuguggaucgcgaaagagaauuacacaaauuggguaagugugggucauguguuuauaauaugaugggaaaacgugagaaaaagcuaggagaauuugguaaagccaaaggaucacgcgcgauaugguacauguggcuuggagccagauaucuagaauuugaagcauuaggauuccuaaaugaagaucauugguuuucgagagaaaacaguuauucaggcguagagggagaaggcuugcacaaguugggcuacauucugcgugauauaucuaaaauaccaggaggagcgauguaugccgaugacacagcuggcugggacacaagaauuacagaagacgacuuacauaaugaagagaaaauaacacaacaaauggauccagagcauagacaguuagccaaugcaauauuuaaacuaacauaccagaacaaaguugugaaaguacagcgaccgaccccaacgggaaccgugauggauauaauaagccgaaaagaccaacggggaucgggccaaguaggcaccuaugguuugaacacguucacuaacauggaggcacagcucaucaggcagauggaaggcgaaggaguauuaucaaaagcagauuuagaaaacccucaccuuccugagaagaaaauaacgcaguggcuggaaacuaaagguguggagagauuaaaacgaauggcaauaucaggcgaugacugcguaguaaaaccgauagaugaucgguucgcuaacgccuuacuugcccuuaaugacauggggaaaguuagaaaagauaucccucaauggcaacccucuaagggauggcacgauuggcagcagguaccauuuugcagccaccacuuucacgaguuaauaaugaaagauggccguaaauuaguaguaccuugccgaccacaagacgagcuaaucggacgcgcaagaauuucgcagggagcgggauggucauuaagagaaaccgcauguuuggggaaagcauacgcucagauguggaaccuaauguauuuccacagacgggaccuaagauuagccucaaaugcaauauguagugcuguuccgguucacugggucccgacuucccguacaacuuggagcauucaugcacaccaucaauggaugacaacugaggauaugcuaacugucuggaacaggguauggauagaagauaacccuuggauggaggacaaaacuccaguuacuacgugggaaaauguaccguacuugggcaagagagaagaccaauggugcggcucauuaauuggauuaacgucacgagcgacuugggcucaaaacauaccuacugcuauucaacaagucagaucacugauaggaaacgaagaauuucucgacuauaugcccuccaugaaaagauuucgaaaggaagaagaaagugaaggugcaauaugguaa

SEQ ID NO: 23364 - RNA, 9873 nt, Artificial Sequence
  derived and/or modified CDS sequence (opt6) from DENV-3__FJ547078__SS-prME
acgagucuuuguuugaugaugauuuugccagccgcacucgccuuucacuuaacuucccgagauggugaacccaggaugauugucgggaaaaacgaacgagggaaaucuuugcuauucaaaacggccucagggauaaacauguguacucuuaucgcgauggaucugggcgaaaugugugaugauacagucaccuacaaauguccgcacauuacugaaguagaaccagaagacauagauuguugguguaaucuuacaagcacuugggugaccuauggaacuugcaaucaagcuggagaacauagacgcgauaaaagauccgucgcuuuagcuccucauguaggcaugggucuugauaccagaacacaaaccuggauguccgcagagggagcauggcgucagguugaaaaaguagaaacgugggccuuacgacauccaggauuuacaauucucgcacuauuuuuagcacacuacauaggaacgucacuaacgcaaaaagugguaauauuuauacuauuaaugcuaguuacgcccucaaugacgaugagguguguaggaguaggaaauagagacuucguagagggucuauccggagcaacguggauagacguaguacuugaacauggcgguugcgugaccacuauggcuaaaaauaaaccgacgcuugacauagagcuacagaaaacugaagcgacacaauuagccacacuaagaaaacuuuguauagagggaaaaauaacaaacauuacuacugacucuagauguccgacacaaggcgaagccgucuuacccgaagaacaagaccaaaauuauguauguaaacacacguauguugaucgugggugggguaacggcuguggacuauuugguaaagguagucucgugacaugugcuaaauuucaaugucucgaacccauugaaggaaaaguugugcaauaugagaauuuaaaauacacaguaauaauaacgguucauacaggagaucaacaucaagucggaaaugagacccaagguguaacggccgaaauaacgccacaagcaagcacaaccgaagccauauuaccugaguacgguacacuagguuuagaauguucaccccggacggggcuagauuuuaaugaaaugauucuacuuacuaugaaaaauaaagccuggauggugcauaggcagugguucuucgacuuaccacuuccguggacaucgggagccacuacagaaacuccuaccuggaaucguaaagaacuuuugguaacauuuaaaaaugcacacgcuaagaaacaagaaguaguuguacuugguagucaagaaggcgcaaugcauacagcucugacaggggcgaccgagauacagaacaguggaggcaccucaauauuugcaggacaccucaaaugccgucugaaaauggacaaacuugaacuaaaaggcaugucguaugcuauguguacaaauacauuugugcuuaagaaagaaguaagugaaacacagcauggaacaauauuaauaaaaguugaauauaaaggagaagacguuccuugcaaaaucccauuuagcaccgaggaugggcaaggaaaagcacauaaugggcgucuuauaacagcgaaccccguugugaccaagaaagaggaacccgucaauaucgaagcagagccuccguuuggagaauccaauauugucaucgguaucggggauaacgcauuaaaaauuaauugguacaagaaaggaucaucgauuggaaaaauguucgaagcuaccgccagaggggcucguagaauggcgauuuugggagacacagcaugggauuucggaaguguaggagggguguugaacucccuaggaaaaaugguacaccaaauuuucgguuccgcuuauacugcacuauucucgggaguaaguugggucaugaaaauaggaauugguguuuuauugacauggauaggacuaaacucgaaaaauaccucaaugucuuuuaguuguauagcaauugguauaauuacccuauacuuaggagcgguaguucaagcugauaugggaugugucauaaacuggaaaggaaaagagcuuaaaugugguucagggauauuuguuacaaacgagguacauacuuggacugaacaauauaaauuccaagcagacucaccaaaacggcuggcaaccgcuauugcgggagcgugggaaaauggcgugugugggauucgauccacgacgagaauggaaaaccuuuuauggaaacaaauugcgaaugaauugaacuacauauugugggaaaacaacauaaaauuaacagucguuguaggagauaucauaggcgugcuggaacaagguaaacguacucuaacuccccaaccaauggaacuaaaauauaguuggaaaaccugggguaaagcuaagauugucaccgccgaaacucaaaacucuucauucauaauugaugguccaaacaccccggaauguccgucagcaucaagagcauggaacguaugggagguugaggauuauggauucggaguguucacaacaaauauauggcuaaaacuucgagaaguuuauacucaacuuugcgaccaccgcuugaugucggcggcaguaaaagaugaacgggcuguacaugcugauaugggauacuggauugaaucucagaaaaaugguucguggaaauuagaaaaagcaucucuaauugaaguaaaaacuugcacauggccgaaaucucauacauuauggucaaaugguguuuuggaaucugauaugaucaucccgaaaucguuagcggguccaaucagccagcacaauuaucgcccaggguaccacacacaaaccgcaggaccguggcaucuaggcaaacuagaauuagacuuuaacuauugcgaaggaacaacggucgugauaacggagaacugcggaacuagaggaccaucucuucggacaacgacuguaucgggcaaauugauccaugaguggugcugccgguccuguaccuuaccaccuuugagguauaugggagaagacgggugcugguauggcauggaaauccgcccaauaagugaaaaagaagagaauaugguaaaaucacuggucucugccgguagcgggaaagucgacaacuucacaaugggaguucuuuguuuagcaauauuguuugaggaaguuaugagaggaaaguucgguaagaaacacaugaucgcugggguauucuuuaccuucguguuacugcuuucaggacaaauaaccuggcgggauauggcccacacuuuaaucaugauaggauccaacgccucggaucguaugggaaugggaguuacuuaucuagccuugauugccacauucaagauacaaccuuucuuagcccuuggauucuucuugcggaaacucacuucaagagagaaccuccuucugggggugggucuagcaauggcgacuacauuacaacuaccagaagacauagaacaaauggcaaacggaauugcccuaggguuaauggcacucaaauuaauuacccaauucgaaaucuaucaauuauggaccgcgcugauaucguugacaugcucaaauaccauauucacacuaacaguagccuggaggacagcaacacuuauucuggccgggguaucgcuccucccaguaugccaaagcuccaguaugcguaagacugacuggcugcccaugacuguugccgcuaugggggugccaccucucccccuauuuauauucagcuuaaaagauacauuaaagcguagauccuggccccuaaaugaaggcguaauggcuguuggucuugucucuauccuagcauccucauuacucaggaaugaugugccaauggcaggaccuuuaguagcagggggacuguuaauagcgugcuauguaauuacagguacaucugcggaccucacaguggaaaaagcugcagauguaacuugggaagaagaagcugaacaaacaggcguuucacauaauuuaaugauaacuguagacgaugacggaacaaugagaaucaaagaugacgaaacugaaaauauacuaacaguauuauuaaaaacagcacuauugauaguaucagggauauucccauauucaauaccagcuacauugcucgucuggcacaccuggcaaaagcaaacgcagagaucggguguuuuaugggacguaccaucaccaccagaaacacagaaagcugagcuugaggaagguguauaccgaauuaaacaacaaggcauuuucgggaaaacgcaaguuggcguggggguucaaaaagaggguguauuucacacuauguggcauguaacuagaggagcaguauuaacuuacaauggcaagagauuagaacccaacugggcaucagugaagaaagaccuaauuucauacggaggaggauggagacuaucagcacaauggcaaaagggcgaagaaguacaaguuauagcaguugaaccaggaaagaacccgaaaaacuuccaaaccaugccagguacuuuucagacuaccacaggggaaauaggggcaauagcauuggauuuuaaaccggggacaaguggaucaccaauaaucaauagggaaggaaaaguaguuggucuuuauggcaauggcguggugacaaagaauggaggguacguuucgggcaucgcgcaaaccaacgcagaaccggacgguccgacucccgagcuggaagaagaaauguuuaagaagcgaaauuuaaccauuauggauuugcauccaggcucgggaaaaacgcgcaaauacuuaccagcaauuguaagagaagccauuaaacguagauugcgaaccuuaauacuagcuccgacccguguugucgcggcugaaauggaagaggcuuugaaaggguugccgaucagauaucaaacuacugcuacaaaaucagaacauacagguagagaaauuguagaccuuaugugucaugcuacauucacaaugcggcuuuuaaguccagugagaguccccaauuacaauuugauaauaauggacgaagcacauuucacggauccggcaagcauagcggcacgaggauacauuagcacaagagucgguaugggcgaagccgccgcuaucuucaugacggcgacaccaccugggacggcugaugcguuuccucaaagcaaugcaccuauacaggacgaagaacgugacauaccagaacgaagcuggaacuccggaaaugaauggauaacagauuuugcggguaaaaccguaugguucgugccauccauaaaagcuggaaaugauauagcaaacugccuuagaaagaaugguaagaaaguaauacaauuaucgagaaaaacuuuugauacagaauaucagaaaacaaaacuaaaugauugggacuucguuguaaccacugauauuucagaaaugggagcgaauuucaaagcagauaggguuauugaucccagaagaugcuugaaaccggucauuuugacagaugggccugaaagaguaauacuugcuggaccaaugccaguaacagcugcaucagcagcacaacgaagaggaagaguagguagaaauccacaaaaagaaaaugaucaauauaucuuuacuggccaacccuuaaacaaugaugaagaucacgcccauuggaccgaggccaagauguugcuagauaacauaaacacaccagaagggauaauuccagcauuauuugaaccagagagggagaaaagcgcggcaauugacggagaauauagacuaaaaggggagucaagaaaaacuuuuguggaacugaugcggagaggagaucuaccugugugguuggcucauaagguagcuagugaagguaucaaauacacugaucguaaaugguguuuugauggccaacguaacaaccagauacucgaagaaaacauggauguagaaauauggacgaaggaaggagagaaaaagaaacugcggccaagauggcuugaugcccgaacauauucugauccacuugcacucaaagaauuuaaagauuuugcggcaggacgcaagucuaucgcguuggauuuaguaacugaaauaggcagaguacccagccacuuggcucacagaacaaggaacgcucuugacaacuuaguuaugcuacacacaagcgaacaugggggaaaagccuacagacacgcaguagaagaauuacccgagacuauggaaacauuguuacuucuuggucuuaugauucuguuaacaggaggggcuaugcucuuucuaauuucagggaaaggaaucgguaagacguccauaggacuaauauguguaauugcaaguagcggcaugcuauggauggcagaaaucccauugcaauggauagccucagcgauugucuuggaguucuuuaugaugguacuauuaauaccggaacccgaaaaacaacguacgccacaggauaaucaguuagccuacguugugaucggaauuuugacucuugcagccauuaucgcugcgaacgaaaugggcuuauuggaaacaacaaagagagaucuugguaugucaaaagaaccuggcguuguaucacccacaucauaccuagacguagacuuacauccagcgagcgcauggacacuuuaugcaguagcaacaacaguaauuacaccuaugcuaagacauacuaucgaaaauucuaccgcuaauguaucacuagcugcaaucgcaaaucaagcaguagugcucaugggacucgauaagggauggcccauuaguaaaauggaucuuggugucccuuuauuagcucugggaugcuauucacaaguaaaucccuugacauugacagcagcaguccuacugcuuauuacacacuacgcuauuaucgguccagggcuucaagcgaaggccacgagagaggcucagaaaagaacugcagcggggauaaugaaaaacccgacgguugacgguauuaugaccauagauuuggacccugugaucuaugauagcaaauuugaaaaacagcuagggcaaguaauguuacuuguuuuaugugccguccaauuacuucuaaugaggaccagcugggcacuaugcgaagcucuaacauuggcuaccggcccuauaacuacucugugggaaggcucaccaggcaaguuuuggaauacuacgauagcagugucuauggccaauauuuuuagagguuccuaucuagcaggagcugggcuggccuuuucgauaaugaaguccgucggaacagggaaaagagguacagguucacaaggugaaacauugggcgaaaaguggaagaagaaacuuaaucagcuuucaagaaaggaauuugaccuauauaagaaaagcgggauaacugagguggauagaacagaagcgaaagagggacuaaaacgaggagaaauaacucaucacgcgguuagucgaggcuccgcgaaacugcaaugguuuguagagcgaaacauggucauaccagaaggucgaguaauagauuuaggaugugggcggggcggauggaguuacuacugugccggacucaaaaagguaacugaagugagaggguauacuaagggaggaccaggccaugaggaacccguaccaaugagcacauacggguggaauaucguaaaauuaaugucggguaaggacgucuucuauuuaccucccgagaaaugugauacgcugcucugugacaucggagagaguucacccucuccuacaguggaggaaucuaggacgauaagaguucugaagaugguugaaccuuggcucaaaaacaaucaguucugcauuaaaguacuaaacccguauaugccuacagucauagaacaccuagaacgucuacagagaaagcauggcggaauguugguuaggaacccguuaagccguaacagcacccacgaaauguauuggauuucuaacggaaccggaaauaucguugcuuccguaaauauggucucccgcuuauuauugaacagauucacuaugacucauagaagaccuacaauugagaaagauguggacuuaggcgcaggcacgagacauguuaacgcggaaccagaaacuccuaauauggaugucaucggggaacgaaucaaacgaauaaaagaagaacauaauuccacuuggcacuacgacgaugaaaacccuuauaagaccugggcauaucacgguagcuaugaaguaaaagccacuggaagcgccagcucaaugauaaauggaguaguuaaacuguuaacaaaaccuugggacgugguaccaaugguaacgcaaauggcgaugacagacaccacaccguuugggcaacaaagagucuuuaaggagaaagucgauacaagaacgccaaaaucaaugcccgguacuagaagaguaauggguauaacggccgaauggcucuggaggacauuagggcguaauaagaaaccaaggcuguguacgagagaagaauuuacaaagaaaguaagaacaaaugcagccaugggggcgguguuuaccgaggaaaaucaaugggacucggcaaaagccgcaguugaagacgaagauuuuuggaaauuggucgaucgcgaacgggaauuacauaaacuagguaaauguggaagcugugucuacaauaugaugggcaagagggagaagaaauuaggggaguucggaaaagcaaaaggcagccgagcuauaugguauauguggcugggagcuagauaucuagaauuugaagcucuaggauucuugaaugaggaccacugguuuucacgagagaacucauauucugggguugaaggcgaaggguuacauaaacuuggauacauuuugcgagauauuaguaaaauuccuggaggagcaauguaugcggacgauaccgcugguugggauacaagaauaaccgaagaugaccuacacaacgaagagaaaaucacccagcaaauggaucccgaacaucgacaacuugcuaaugcaauauucaagcuaaccuaucaaaacaaaguuguaaaaguacaaagaccuacaccaacagggaccgugauggauauuauaucaagaaaggaccagcgaggguccggacagguaggaacguaugggcucaauacauuuaccaauauggaggcgcagcucauccgucagauggaaggagaaggaguauuaucuaaagcggaucuagaaaauccccacuugcccgagaagaaaaucacgcaaugguuggaaaccaagggcguagaaagguuaaaacguauggcgauaucuggcgaugauugugucguaaaaccaauagaugaucgcuuugcuaaugcuuugcuagcccuuaacgauaugggaaaagugaggaaggauauaccgcaauggcaaccaucaaagggguggcaugacuggcagcaaguacccuucugcucacaucauuuucaugaacuaaucaugaaagacgguagaaaauuggucguacccuguagaccucaagaugaacugauugggcgggcaaggauuucacaaggugcaggauggucacugagagagacugcaugucucgggaaggcuuaugcacaaauguggucccugauguacuuucauagaagagauuuaagguuagcaucaaaugccauuuguucagcuguacccguucauuggguaccaacuucacggaccacauggucgauucacgcacaucaccaauggaugacaacggaggacauguuaacgguuuggaauagaguuuggauagaagacaauccuuggauggaagauaaaaccccaguuacaacaugggaaaauguaccauacuuaggcaaaagagaagaucaauggugugggucacuaaucggucuuaccagucgagcaacaugggcacagaauauaccuacugcaauacaacagguaaggucacugauuggaaacgaagaauuuuuagauuauaugccuucaaugaaacguuuucggaaagaagaagaaucugaaggugccauaugguag

SEQ ID NO: 23365 - RNA, 9873 nt, Artificial Sequence
  derived and/or modified CDS sequence (opt6) from DENV-3__FJ547079__SS-prME
accaguuuaugucuaaugaugauuuuaccugcagcuuuagcuuuccaucuuacuucccgagauggggaaccacguaugauuguaggcaaaaacgaaagaggaaaaucacuacuauucaaaacugcgucugguaucaacaugugcacgcugauagcaauggauuuaggagaaaugugugaugauaccgucacauacaaaugcccccauauaacagaaguagaaccagaagacauagauuguugguguaaccucacaucaaccuggguaacuuauggcacaugcaaucaagcaggagaacaccgccgcgacaaaaggaguguggcauuagcuccccauguuggaaugggucuugacacaagaacacagacguggaugagcgcagaaggagcguggaggcagguagaaaaaguagaaacuugggcauuacgucacccgggauuuacaauucuagcuuuguuuuuagcucauuacauaggaacaucccuaacgcaaaaaguaguuauauuuauauuauuaaugcucgugacccccucuaugaccaugcgaugcguaggaguuggaaaucgggauuuuguggaaggauugucuggggcaacuuggguagacgucguauuagaacaugggggauguguuacgacuauggccaaaaacaaaccaacgcucgauauagaacuccagaaaacagaagcgacccaauuagcuacauuaaggaaacucugcauagaaggaaaaaucacgaacauuacuacugauagucgcugccccacucaaggugaagcagucuuaccugaagaacaggaucagaacuacguguguaaacauaccuauguagacaggggauggggaaaugggugugggcuuuuuggaaaagggucucucguaacuugugccaaauuccaaugcuuggaaccaaucgaagggaaaguagugcaguacgagaauuuaaaauauacuguuauaauuacaguucauacuggagaccaacaucagguaggaaaugaaacccaaggaguaacggcagaaauuaccccucaagccucaaccacggaagccauucuaccggaguacgggacuuuaggacuugaauguaguccaaggacuggguuagacuuuaaugaaaugauucuucugacaaugaaaaauaaagcauggaugguucaucgucaaugguucuuugaucuaccauugccauggacgucaggggcgacuacagaaacgccgacauggaauagaaaagaacuauuaguuacauuuaaaaaugcucaugcuaagaaacaagagguagugguccuuggaagucaagagggcgcuaugcauaccgccuugacuggugcaacagagauacagaacucuggcgguaccaguaucuucgcuggacacuuaaaaugucgccuuaaaauggauaaauuggaacuaaaagggaugaguuaugcuauguguaccaauacauucguccucaagaaagaaguuagugagacacagcacgguacuauacuaauaaaaguagaauauaaaggugaagaugucccuugcaaaauuccauuuucaacagaagacgggcaagguaaagcacauaaugguagauuaauuacggcaaaccccguaguuacuaagaaagaagaaccuguuaauauagaagccgaaccaccuuucggagaaagcaauauuguuauaggcauaggugacaacgccuuaaaaauuaauugguauaagaaaggaaguucaauuggaaaaauguuugaggcgacggcacguggugccagacgcauggccauccuuggcgacacagcaugggauuuugguucaguaggagggguacuaaauucccuaggcaaaaugguccaccaaauauucggaucugccuacaccgcauuauuuucaggcguaucaugggucaugaaaauagguauaggcguacuucuaacuuggauaggguuaaauagcaagaacacaucaaugucuuuuucaugcauagcaauagguauuauuacacucuaucuaggggcaguaguucaagcugacauggguugcgugauaaacuggaaaggcaaagaacucaaauguggcuccgguaucuucgucacaaacgaaguccacaccuggacugaacaauacaaauuucaagcagauuccccaaaacgccuagccacagcaauagccggugcgugggaaaauggcguguguggaauccguucgacaacucguauggaaaauuuacuguggaaacaaaucgcaaacgaauuaaacuauauauuaugggagaauaauauuaaacuuacuguagugguaggagacaucauuggaguccucgagcaaggaaagagaacuuugaccccucagccaauggaacugaaguacucauggaaaacauggggaaaagcaaaaaucgucacagcagaaacgcagaacucuaguuuuauaauugaugguccgaacacgccugaauguccaagcgcgucucgagcuuggaacgugugggaaguagaagauuaugguuuuggaguuuucaccacaaauaucugguugaaacuacgugaaguauacacacaauugugugaccacaggcuuaugagugcugcgguaaaggacgaacgugcgguccaugccgacaugggauauuggauugaaucccagaaaaacggaucauggaaacuggaaaaagccagucuaaucgaagucaaaacuuguacauggccaaagagucacacacuuuggucuaaugggguuuuggaaucggauaugauaauaccuaagagcuuagcgggcccaauaucacaacauaauuaccggccgggauaccauacccaaacggcgggaccauggcaccucgggaaguuagaacuugauuucaauuacugugaaggcacgacagucgucauaacugaaaacugcggaaccagagguccaucauugagaacuacgacuguaagcggcaaguuaauccacgaaugguguuguagauccuguacucuuccaccauuaagguacaugggagaagaugguuguugguaugggauggagaucagaccuaucuccgaaaaagaagagaauaugguaaaaagucuaguauccgcugggaguggaaaagucgauaacuucacuaugggagucuuaugucuugcgauacuguuugaagaggugaugcgcgguaaguuuggaaagaagcauaugaucgcggguguguucuuuacauuuguccuacuucuuucuggacaaauaacauggcgagacauggcacauacuuuaauaaugaucggguccaaugccucugauagaaugggaaugggagucacguaucucgcauuaaucgcaaccuucaaaauucaacccuucuuggcgcuaggguucuuucuuagaaagcuaacaucacgagaaaauuuacuguuaggagucggucucgcaauggcuaccacacuucagcuuccggaggauauagaacaaauggcaaauggaauagcgcuuggcuuaauggcacuaaaacuaauaacacaauuugaaacguaucaacuauggacagcguuaaucaguuuaacguguagcaauacuauauuuacccuaacaguagccuggcguacugcaacgcuaauuuuagccggggucucguuauugccgguuugccaaagcuccagcaugagaaaaaccgauugguuaccuaugaccguggccgcuaugggaguuccaccguugccauuauuuauuuuuaguuuaaaagauacauuaaagaggagaucauggccucuuaaugagggaguaauggcuguuggacuugugaguauuuuagcauccagcuuacucaggaaugauguaccaauggcggggccucuaguagcaggagggcugcuuauugccuguuauguaauuacugggaccucagcugaccucacaguugaaaaagcagcagaugucacuugggaagaagaagccgaacaaacaggaguuagccacaaucugaugauaacuguagacgaugaugguacaaugagaauuaaagacgaugaaacagaaaauauucucacgguuuuacucaagacagcucucuugaucguaagcggaaucuucccauauucgauuccagcaacauugcuuguauggcacacauggcacaaacagacucaacggagcggaguccuuugggauguucccaguccaccugagacucagaaagcggagcuugaagagggaguuuaucgaauuaaacaacagggaauauuugggaaaacacaaguaggcguagguguacaaaaggaagguguuuuucacacaauguggcacguaacacguggugcugucuugacauacaacgggaaaagguuggaaccaaauugggcaagcgugaagaaagauuugauuucuuauggaggcgguuggcgucugucggcacaauggcaaaaaggcgaagaaguacagguuauagccguagaacccgggaaaaacccgaaaaacuuccaaacgaugccugguacguuucaaacaacgaccggugagauaggagccauagccuuagacuuuaaaccggguacaagcgggucaccaauaauaaauagagaagguaaaguagugggucuauauggaaauggcguuguuaccaaaaauggagguuacgucagugggauugcucaaacaaaugcagagccagauggaccaacucccgaacuagaagaagaaauguuuaagaaacgaaaucuaacaaucauggaucuacacccaggaucggguaagacucggaaauacuugccagcaauagugagagaagcaauuaaacguagacucagaacacuaauauuagcuccuacccguguagucgcugcggaaauggaagaagcauugaaagguuuaccaauccgauaucagacgacagcuacaaaaagugaacauacaggccgagaaauaguagaccuaaugugucaugcaacguuuacuaugcggcuuuuaucgccagugcgcguuccuaauuauaaucuaaucauuauggacgaagcucauuucaccgacccggcaucuauugcggcuaggggcuauaucagcacucguguaggaaugggugaggcggcagcaauuuuuaugacugcaacacccccugguacggccgacgcauuuccccaaagcaaugcaccuauccaagacgaagagagagacauaccagaaagaucauggaacucaggaaacgaauggauuacagacuucgcagggaaaacaguuugguuuguuccgucaauaaaagcagguaaugacauagcuaauuguuuacguaaaaacggcaagaaaguuauucaacugucgagaaagaccuuugacacugaauaucagaaaacgaaauuaaacgacugggauuuuguggugacaacugauaucucagaaaugggagcaaauuucaaagccgauagaguuauagauccacguagguguuuaaagccuguaauacuaacagacggaccagagagggugauuuuagccggaccuaugccaguaacggcggcaucagccgcacaaagacggggacgagugggaaggaacccacagaaagaaaaugaucaauacaucuucacagggcaaccauuaaacaaugaugaggaucaugcacacuggaccgaagcaaagauguuauuagauaauaucaacacuccagaggguaucauuccugcccuguucgaaccagaacgagaaaaaucagcugcuauugacggcgaauaucgacuaaaaggagagagucgaaagacauucguagaauuaaugagaagaggagaucucccuguguggcuagcgcauaaagucgcaucggaaggaaucaaauacaccgauagaaaauggugcuucgauggccagcguaauaaucagauauuggaagagaauauggaugucgagauauggaccaaagaaggagagaaaaagaaacuucguccgcgguggcuagacgcaaggacuuauucagauccacuagcguuaaaagaauuuaaagauuucgcagcgggucguaagucgauagcauuagaccuaguaacugagauaggccgugugccgagccaucuagcucaucggaccagaaaugcacuagauaauuuaguaauguuacauacuagcgagcacggaggaaaggcauacagacaugcuguagaggaacuacccgagacaauggaaacauuacuauuacuggguuuaaugauauuacuuacugggggcgcuaugcuuuuucuaauaucuggaaaaggcauaggcaaaacuagcauagguuuaauauguguuauagccucgucaggaaugcuuuggauggcugaaauuccuuuacaauggauagcaagcgcuauuguccucgaguuuuucaugaugguguuacuaauaccagaaccagaaaagcagcgcacuccgcaagauaaucaacuugcuuauguggugauuggaauccuaacccuagcugcgaucauagccgcgaacgagaugggacuauuggaaacuacaaaaagggaccuaggaaugucaaaagaaccagggguaguuucgccaaccucuuauuuggauguagaccuucauccagcuagugccuggaccuuguaugcuguugcaacaacaguuauaacuccaauguugagacauacaauagaaaauucaaccgcaaacguaagccuugcagcaauugcaaaucaagcaguaguacugaugggacuggauaagggauggccaaucucuaaaauggaucuuggaguaccacuucuugcccuuggauguuauucucaaguaaauccucuaacauuaacugcugcgguccuauugcuaauaacacacuacgcaauaauaggacccgggcuacaagcuaaggcuacaagggaagcucagaagcguacagcagcagggauuaugaaaaauccuacgguagauggaaucaugacaaucgauuuggauccaguaauauaugacaguaaauuugaaaagcaacuaggucaggucaugcugcucguacuaugcgcaguucagcuucuccuaaugcgaacuuccugggcgcugugugaagcccucacucuagccacgggaccaauaacgacccuuugggaaggaucaccaggcaaauuuuggaauacaacgauagccguuaguauggcgaauauauuccgagggucuuauuuagccggugcuggccuagcguucagcauuaugaaaucagucggaaccgguaaacgcggcaccggaucgcaaggugaaacucucggugaaaaauggaagaagaaacuuaaucaguugucaagaaaagaguucgaccuuuacaagaaaucuggcauaacagaaguagaccgaacagaggcuaaagaagggcuaaaacguggugagaucacucaucaugccguaaguagagguagugccaaauuacaaugguuuguggaacguaacauggucaucccagaaggcagaguaauugauuuaggauguggucgaggagggugguccuauuacugcgcgggacucaagaaagugacagaaguaaggggauauacaaagggcggcccuggacaugaggaaccuguaccgaugaguacuuacgguuggaacauagucaaacugaugagugguaaagauguauuuuaccuaccuccagaaaagugcgauacuuuguuaugcgauauuggcgaaagcucacccagcccgacaguagaagaaucaaggacgauccgaguuuuaaagaugguggaaccaugguugaaaaauaaccaguuuugcauuaaaguucuaaauccauauaugccuacugugauagaacaccuagagagauuacaacgaaagcaugggggaaugcuaguacgcaacccauuaagccguaacucaacacaugaaauguacuggauaucgaacggcacagguaauauaguugcaagcgucaauaugguaucacgccuauuacugaauagauuuacuaugacgcauagaagaccaaccauugaaaaagacguggaccucggcgcaggaacucgacacguuaaugcggaacccgaaacacccaauauggauguaauuggagaaaggaucaaacguaucaaagaagaacauaauucgacuuggcauuacgacgaugaaaauccauauaaaacaugggccuaucauggaucguacgaaguaaaggcuacaggaucagcuucauccaugaucaaugguguagucaaacuccugacuaaaccgugggaugucguuccaaugguuacacaaauggcaaugacagacacgacuccuuuugggcagcaacgaguauuuaaagaaaagguugacaccagaacaccgcgaucgaugccaggcacgagacgggucaugggaauaacugcggaauggcucuggagaacuuuagggagaaauaagaaaccacggcucuguacuagagaagaguucaccaagaaagugcgaacuaaugcagcaaugggagccgucuuuacagaagaaaaucaaugggauagugccaaagcggcgguagaagaugaagauuuuuggaaguugguugacagggaaagggaauuacauaaguugggcaaaugugggucauguguuuauaacaugaugggaaaacgugaaaagaaguugggugaguuuggaaaagcaaaaggcagucgcgccauuugguauaugugguuaggagcaagguaccuagaauuugaagcauuaggauuucuaaaugaagaucauugguucuccagagaaaauuccuauucuggaguugaaggagaaggacugcacaaacuaggauauauucucagagauauuaguaaaauaccaggaggagcgauguacgcagaugauacagcaggaugggauacacgaauaacggaggacgaccuucauaacgaggagaaaauaacccaacagauggacccagaacauagacaguuggcuaaugcaauauuuaagcuaacuuaccaaaauaaaguaguaaaaguucaaagaccuacaccaacuggaacgguaauggauauuaucucacggaaagaucaaaggggaaguggccaaguagguacauauggucucaacacuuucacuaacauggaggcacaauuaauacgucaaauggaaggcgaagguguccuuucaaaagccgaucuagagaauccacauuuaccggagaagaaaaucacccaauggcuugaaacaaaagguguugaacgauuaaagagaauggcaauuucgggcgaugauugugucgugaaaccuaucgacgacagauucgcaaaugcauuacuugcauuaaaugacaugggcaagguaaggaaggauauuccacaauggcagccuagcaaggguuggcaugauuggcaacaaguccccuucugcagucaucacuuucaugagcuuauaaugaaagauggaagaaaacucguugugccaugccgaccacaagaugaguugauagggcgagcacgaauuagucagggggcaggauggucacuacgggagacugcaugucuggggaaagcguaugcacaaauguggucacucauguauuuucauaggcgcgaucugcgccucgcaucaaacgcgauaugcagcgcuguaccgguccauuggguaccuacaaguaggacgacauggagcauucaugcccaccaccaguggaugacaacagaagauauguuaacgguuuggaaucgcguauggauugaggauaauccauggauggaagauaagaccccuguuacuaccugggaaaauguuccauauuuagguaaaagggaagaucaaugguguggaucccuaauaggccucaccucaagagcuacuugggcgcaaaauauaccaacugcgauucaacaggugaggagucugauaggaaacgaggaauuuuuggacuauaugccgaguaugaaaagauuuagaaaagaagaagaaucagaaggggccauuugguga

SEQ ID NO: 23366 - RNA, 9873 nt, Artificial Sequence
  derived and/or modified CDS sequence (opt6) from DENV-3__FJ547080__SS-prME
acgucuuugugccuuaugaugauauuaccagccgcauuggcguuccauuuaaccuccagagauggagaaccacggaugaucguggggaaaaaugagagggggaaaucccuacuuuuuaaaacagcuaguggaaucaacauguguacgcuaauagcuauggaucuuggagaaaugugugacgauacgguaacuuauaaauguccgcauauaacugaggucgaaccggaagacauagacuguugguguaaccuaacgagcacuugggucaccuauggaaccuguaaccaagcuggagaacaucgacgcgauaaacgaucgguggcucuugcaccucauguaggaauggggcuagacacaagaacacaaacauggaugagcgcagaaggugcuuggcggcaaguagagaaaguugagacaugggcccuuagacauccaggauuuacaauucuggcguuauuccuggcacauuacauuggcaccucacugacucaaaaagucgugauauuuauucuacuaauguuggugacccccucuaugacaaugagguguguggggguagggaauagagacuucgucgaaggauugagcggagcaacuuggguagacguugucuuggaacacggaggcuguguuacaacuauggcuaaaaauaaaccaacccuagacauagaacuacagaaaacagaagcgacacaauuagccacguuacguaaacucugcauugaaggcaaaauaacaaauauaacuaccgacagucgcugcccgacgcaaggggaagccguacuaccagaagaacaagaccaaaauuauguaugcaaacacacauacguugauagggggugggguaacggguguggacuauuugguaaaggcucgcuaguuacgugugccaaauuccaaugucuagaaccuauugagggaaaaguaguacaacacgaaaaucuaaaauacacaguaauaauaacuguacacaccggagaucaacaccaaguuggaaaugaaacucaaggagucaccgcagaaauaaccccacaggcaagcacaaccgaggcuauacuaccagaauauggaacacugggccuugaaugcagcccacgaacuggauuagauuuuaaugaaaugauucuauuaacuaugaaaaacaaggcuuggaugguacauagacaaugguuuuucgacuugccauuaccuuggacuucgggagcuaccacugaaacuccaaccuggaauaggaaagagcuucuuguaacuuucaaaaaugcacacgcuaagaaacaggagguaguuguucuagguucacaagagggagcaaugcacacugcguugacaggagcaacggaaauucaaaauucaggagggacgucaauuuuugccggccaccuaaaaugccgguugaaaauggauaaguuagaacuuaaaggaaugucauacgcgaugugcaccaauacuuucgugcuaaagaaagaagugucagaaacccaacauggaaccauacuaauaaaaguagaauacaagggagaggacguaccaugcaaaauaccauuuaguacugaggacggccaaggcaaagcucauaacggucgacugauaacagcgaaccccgucguaacgaagaaagaagaaccugucaauauagaagcggaaccacccuuuggggagagcaauaucgucaucggaauaggugacaaugcucuaaaaaucaauugguacaagaaagguaguaguaucgggaaaauguucgaagcaacagcaagaggugccagacgaauggcuaucuuaggagauaccgcgugggauuucggaucaguaggagguguacuaaauucacucggaaaaaugguucaucaaauauuuggaagugcauauacggcccuauucucaggcguaucaugggugaugaaaauugggaucgguguuuuacuuacauggaucgguuuaaauagcaaaaacacuagcaugucuuuuagcuguaucgugauugggauaaucacucuguaucuuggugcaguugugcaggccgacauggguuguguuaucaauuggaagggaaaagaauuaaaaugcggaaguggaauuuuuguaacaaaugaagugcacacguggacugagcaguauaaauuucaagcagauaguccaaaacgcuuggccacugcaauagcaggcgcuugggaaaauggugucugugguauuaggucaacaacaaggauggaaaauuuacuuuggaaacaaauugcuaaugaacuaaacuacaucuugugggaaaauaacauaaaacuaacaguagucgucggagacauaauaggaguacuugaacaagggaaaaggacguugaccccgcaaccaauggaguuaaaauacucauggaagacgugggguaaggcuaaaauaguaacggcagaaacacaaaauuccagcuucauaauagaugggccaaacacgccugaauguccauccgcaaguagagcauggaaugucugggaaguugaagauuaugguuuugggguuuucacuacgaauauaugguuaaaauugcgcgaaguuuacacccaacugugugaccaucgauuaaugagugcagcaguaaaagaugaaagagccguacaugccgacaugggauacuggaucgaaucacagaagaaugguucauggaaacucgaaaaagcaaguuuaaucgaagugaaaaccuguacuuggccaaagucacacacacuuuggagcaaugguguguuagaguccgauaugauaaucccuaaaaguuuagccgggccgauaucucagcauaacuauagacccgguuaccacacucaaacagcagggccguggcaccuuggaaaauuggaauuagauuucaacuacugcgaagguacaacuguagugauuacagaaaauugcggaacucgcggcccaaguuuaagaacuacuaccguaucagguaaacuuauccaugaaugguguuguagaaguugcacccugccaccacuacgcuauaugggagaggauggauguugguauggcauggaaauucgccccauaucugaaaaagaagagaauaugguaaaaaguuuaguaucagcaggaucagggaagguagauaauuucacaauggguguccucugcuuagcaauauuauuugaggaaguaaugcgagguaaguuugguaagaaacauaugauugcggggguauucuuuacuuuuguucuauuguuaucugggcagauuacauggcgggauauggcacacacgcuaauuaugauaggcaguaaugccuccgaucgcauggggauggggguuacguacuuagcuuuaauugcuaccuuuaaaauucaaccuuucuuagccuuaggcuucuuuuuaagaaaguuaaccucacgugaaaaccuacuucuuggagugggauuagcaauggcaacuacuuuacaguuaccagaggauauagagcaaauggcaaauggcaucgcacuugguuuaauggcccucaagcuaauuacacaauucgaaacguaucagcuuuggacagcacucauaucucuaacauguucgaacacuauauuuacuuuaacgguugccuggagaacugcuacccuaauccuggcuggggucagccuucuaccaguuugucaaaguucaucuaugaggaagacagacugguugccuaugacuguugcagcaaugggaguuccuccacuacccuuauucauauuuaguuugaaggauacccucaagagacgaaguuggccucuaaacgagggugugauggcaguaggucuuguaucuauucuugccucgucauuauuaagaaacgauguuccuauggccggaccucuuguagcuggaggcuuacuaauagcaugcuauguaauaacuggaacaucagccgaucuuacggucgaaaaagccgcagacguaacaugggaagaggaggcggagcaaacgggaguaucacauaaucuuaugauuacaguugaugaugacgguacgaugcgcauaaaagacgaugaaacugaaaauauuuuaacuguauuauugaagacagcguuauuaauaguaaguggaaucuuccccuacuccauacccgcaacucuauuaguuuggcacaccuggcagaaacaaacacaacgcucaggaguacuuugggauguuccuucgcccccagaaacccaaaaagcugaacuagaagaagggguuuacagaauaaaacaacagggaauuuucggcaagacacaaguagguguaggaguacagaaagaggguguauuucacacaauguggcacgugacuaggggagcaguauuaacauauaaugguaagcgauuagaaccaaauugggccucagucaagaaagaccuuauaaguuacggaggugguuggagauuaagugcacaauggcagaagggggaggaaguucaaguuauagcuguagaaccaggcaaaaauccgaaaaauuuucaaacgaugccagguaccuuccaaacaacaacaggagaaaucggcgcaauagcauuagauuuuaaacccgggacaucagguucuccaauaauaaacagagagggaaaaguaguggggcuuuaugguaauggaguaguaaccaaaaauggcggguacguuucagggauagcacaaaccaaugcagaaccagacggaccaacaccagaguuagaagaagagauguuuaaaaagaggaacuuaacaauaauggaccuacauccaggaagcgggaaaaccagaaaauaccugccugcaauuguuagggaagcaauaaaaagaagauuacgaacucugauauuggcaccgacaagaguaguagccgcugaaauggaagaagcucugaaaggacuacccauuagauaccaaacaacagcaacaaagagcgaacacacaggccgagaaauaguagaccuaaugugccacgcuacauuuacgaugcgauuacuuaguccugugagggugccuaacuauaacuuaauaauuauggacgaagcgcauuuuacugacccugcaucaauugcagcgagaggcuauaucucgaccagaguuggaaugggcgaggcagcggcaauuuucaugacagcgacaccaccuggaaccgcugaugccuuuccucaaucaaaugcaccuauacaagacgaagaacgcgacaucccagaacgcucauggaacucuggcaacgaauggauaaccgauuucgcaggaaaaaccguaugguucgucccuuccauaaaagcuggcaacgauauagcuaauuguuugcgcaaaaaugguaagaaagucauucaacucuccagaaaaacguuugacaccgaauaccagaaaacgaaauuaaaugacugggauuuugucguaacaaccgauauuuccgagaugggagcaaacuuuaaagccgaucgaguaauugauccaaggcguugucucaaaccgguaauacuuacagauggaccagagcgagugauacuggcagguccaaugccugucacagcggcuagugcggcgcagcgucgcggaagaguaggacguaauccaagaaaagaaaacgaucaauauauuuuuaccggacaaccuuugaacaaugaugaagaucaugcucauuggacagaggcaaaaaugcucuuagauaacauuaacacaccagaaggaauuauacccgcauuauuugaaccugaaagagagaaaucugcagcaauugauggagaguacagacuaaaaggagaaagcagaaaaaccuuuguagaguugaugagaaggggagauuuaccaguauggcucgcacauaaaguagcgucugaagggauaaaauauacugaccguaagugguguuuugacggacagcgaaauaaccagauccuagaggagaacauggauguugaaauuuggaccaaagaaggggaaaagaagaaacuacgaccgcguugguuagacgcgagaacauauagugauccguuggcauuaaaagaguuuaaagauuucgcagccggaagaaaaucaauugcccuagaccuagucaccgagauaggaagaguaccuucccaccuggcacaucgcacucgcaacgcuuuagauaaucugguaauguugcauaccucagaacacggaggaaaggcauauagacacgcaguugaagaacuaccagaaacgauggagacucuauuacuauuaggacugaugaucuuauuaacugguggcgcgaugcuguuccuuaucaguggaaaggguauagggaaaacaucuauaggucucaucugugugauagccucuucuggcaugcuauggauggcagaaauuccacuccaauggaucgccuccgcaauuguacuagaguucuuuaugaugguacuuuuaauaccagaacccgaaaaacaaagaaccccgcaagacaaucaauuagcauacguagugauaggaauacuaacucuugcagccaucauagcugcuaacgagaugggucuucucgagacuacuaaaagggaccuuggaaugaguaaggaaccuggcguugugucaccaacguccuacuuagauguggaucuucacccugcaucagcauggacauuauacgccguggcuaccacuguuauaacucccaugcuacggcauacaauagaaaauucuacagcaaauguaucacuagcugcgauagcgaaucaagcugucguuuugauggguuuagacaaaggauggccaauuuccaaaauggaccuaggugucccucuacuugcguuaggaugcuauucacaaguaaauccucugacacuuacagccgcaguacuguuauuaauuacucauuaugcuauuaucggccccggucugcaagcaaaggcaacaagggaagcccagaaaaggacggcugcaggcauuaugaaaaauccuacaguagaugguauaaugaccaucgacuuagacccaguuauauacgacaguaaauucgagaaacaauugggacaagugaugcucuuaguuuuaugugcaguucaauuauuguugaugcggaccaguugggcuuugugcgaagcauuaacgcuagcuacuggaccuauaacuacucuuugggaggguucgccaggcaaauucuggaacaccacgauagccguaucuauggcgaauauauuucgcgguaguuaccuggcgggggcaggauuagcuuuuagcauuaugaaaucgguagggacugguaagcgaggaacagguagucaaggagagacgcucggcgaaaaguggaagaagaaacuaaaccaguuaucacgaaaagaauuugaccuauauaagaaaucuggcauaacugagguagaucggacagaagcaaaagaaggccuaaagcguggcgaaauaacacaucaugcaguaucucgcggaucugccaaacuccaaugguuuguagaacggaacauggugauucccgaaggaagagucauagaucuaggauguggacgcgggggauggucguauuacugugcagggcugaaaaagguuacugaaguacgcggauacacgaaagguggaccgggacaugaggaacccgucccuaugucaacauauggcuggaacaucguuaaacugaugaguggaaaagacguauuuuauuugccaccagaaaaaugcgacacacuucugugcgacauaggugagucauccccuuccccgacgguugaagaaaguagaacuauacguguauugaaaauggucgaacccuggcucaaaaauaaucaauuuuguauaaaaguucuuaacccuuauaugcccacuguaauagaacaccucgaacgauuacaacgaaaacacggugguaugcucguacggaauccacuuucuagaaacagcacacacgaaauguauuggauaagcaauggaacugguaauauuguagcaucuguuaacauggucucacgacuacuucuaaauagguucaccaugacacaucggagaccaaccaucgaaaaggauguagaccugggugcaggaacacggcacguaaacgcagagccagaaacuccgaacauggauguaauuggugagcgcauaaaaagaauaaaagaggaacacaauaguaccuggcauuaugaugaugaaaauccguacaagacaugggcuuaucacgguucauaugaaguaaaagcgaccggaucugcaaguagcaugauuaaugguguaguaaaacuguugaccaagccaugggacguaguucccauggugacucaaauggcgaugacugacacaacaccauuuggucagcagagaguuuuuaaagaaaaaguugauacgagaacaccuaggagcaugcccgggacaaggagagucaugggaaucacagcugaauggcuauggcgaacguuaggccgcaacaagaaaccaagguuauguacaagagaagaguucacaaagaaagugcguacaaacgcagcuaugggugcgguauuuaccgaggaaaaucaaugggauagugcgaaagcugcaguugaggaugaagauuuuuggauccuuguggaucgagaaagagaacugcacaaacuaggaaaauguggaucuuguguuuacaacaugaugggaaaaagagagaagaaauuaggugaauuuggaaaagcuaaagguagucgcgccauuugguacauguggcuaggcgcccgcuaccuagaauuugaagcauuaggauuccuaaacgaagaucauugguuuucaagggaaaauucguauucgggaguagaaggugagggucuccauaaacuugguuauaucuuaagggauauuaguaaaauaccugguggagcaauguaugcagaugauacugcggguugggauacacguauuaccgaagaugaucugcauaaugaagagaaaauaacgcagcaaauggaccccgaacaccgacagcuugcuaaugcuauauuuaaacuaacauaucaaaauaaggugguuaagguccagagaccuacaccaacuggaacaguaauggacaucaucagccgaaaagaucaaagaggaucaggccaaguugguaccuacggacugaauacauuuacaaauauggaagcacaacucauuagacagauggaaggugaagguguucuuaguaaggcagaucuagaaaacccacauuuaccggaaaagaaaauaacacaauggcuugaaacgaaaggugucgaaagauuaaagagaauggcgauaucgggagaugacuguguugucaaaccuaucgaugauagauuugcaaaugcacuacuugcuuuaaacgauaugggaaaggugaggaaggauauaccucaguggcaacccucuaaagguuggcacgacuggcagcaagucccauucugcagccaucacuuccaugaauuaauaaugaaagauggccgcaaauuaguugucccaugccgaccacaagaugaauugauagguagggcgcgcaucucucaaggcgccggcuggucccuaagagagaccgcuugucucgguaaggcuuaugcucaaauguggucauugauguauuuccaucggagggaucucaggcucgcaucuaacgcuauaugcucagcagugcccgugcacuggguccccacuagcaggacaacauggucuauucacgcacaucaccaauggaugaccacugaagacauguuaacgguuuggaacaggguauggaucgaggauaacccuuggauggaagauaagacaccuguaaccacaugggaaaauguuccauauuugggaaaaagagaagaucaauggugugguuccuuaauuggacuaacaucccgggcuacaugggcccaaaacauuccuacggcgauacaacaaguaaggucacucauuggcaacgaagaguuucuagauuauaugccaucuaugaaaagguuuaggaaagaagaagaaagugaaggagccauaugguaa

SEQ ID NO: 23367 - RNA, 9873 nt, Artificial Sequence
  derived and/or modified CDS sequence (opt6) from DENV-3__FJ547081__SS-prME
acaucauuaugucuaaugaugaucuuaccggcagcuuuggcauuucauuugacaucaagggauggggaaccuaggaugauaguuggcaaaaacgaacgcggaaaaagucuuuuguuuaaaacagcuagcggaauuaauaugugcacacuuauugcuauggaucuaggugaaaugugcgaugauacaguuacguacaaaugcccucacauaacggaaguugaaccggaagacaucgacuguuggugcaaucugaccaguacuuggguaacuuauggaacuuguaaccaagcaggagaacaucggcgugacaaaaggucuguugcacuggcaccgcacguuggaaugggucuagauacucgaacucaaacauggaugucagcggaaggagcauggcgucaaguggaaaaagucgaaacgugggcacuuaggcacccgggauuuacaauucuagcuuuauuccuagcacauuauauugguacaagccuuacucaaaaaguaguuaucuuuauccuauuaaugcuugugacaccaucgaugacgaugcguugugucggggugggaaauagggacuucguugaaggauuaucaggagcgacuuggguagacguuguuuuggaacacgggggauguguaacuacaauggcuaaaaauaaaccaacgcuagauaucgaauuacagaaaacggaagcaacccaacuggcaacacugaggaaacuauguauagaaggaaaaaucacuaacauuacaacagacucccgauguccaacacaaggugaagcgguuuugccggaagaacaagaucaaaacuacgugugcaaacauacauacguagauagaggauggggcaaugggugcgggcucuuuggcaaaggaagccuaguaacgugugcaaaauuucaaugccuugagccaauagaaggcaaaguuguacaauaugagaauuuaaaauauacuguaauaauaacggugcauacaggugaccagcaucagguggggaaugaaacucaaggaguaacagcugaaauaacaccucaagcgucgacaacggaagcaauccuaccagaauauggaacucucggccuugaauguaguccuagaacuggacuagauuucaacgaaaugauacuucugacaaugaaaaauaaagcauggaugguacauagacaaugguucuuugaccuuccuuuaccauggacgaguggagccacaacggaaacaccaacuuggaacaggaaagaacuauuaguaacuuuuaaaaacgcgcaugccaagaaacaagagguuguaguuuuagggucacaagaaggagcuaugcacacggcauuaaccggagccacagaaauacaaaauaguggaggcacauccauauuuucuggacauuuaaaaugcaggcucaaaauggauaaauuagaauuaaaaggcaugucauacgcuauguguacaaauacuuuuguguugaagaaagaaguaucggaaacacaacauggcacuauucuaauaaaaguugaauacaaaggugaagauguaccauguaaaaucccguuuucaacugaagaugggcaaggcaaagcucauaauggaagguuaauuacugcuaaucccguggucacaaagaaagaggaacccguaaacauagaagcagagccuccguuuggggaaaguaauaucguuauuggaauaggugacaaugcccuuaaaauaaauugguacaagaaagguucuaguauaggaaaaauguucgaggcaacugcucguggagcacgacgaauggcaauacuuggagauacagcaugggacuucgguuccguaggaggaguucuaaauuccuuagguaaaaugguccaccaaauuuuuggaucagccuauacagcgcuauucucagggguauccugggucaugaaaauugggauaggaguauuauuaacauggauuggguuaaauagcaaaaauacuucaaugucauucucguguauugcgauaggcauaauuacauuauacuugggagcaguaguucaagcagacauggguugcguaauuaauuggaaaggcaaggaacuuaagugugggagcggaauuuuuguaacaaaugaaguacauaccuggacugaacaguacaaauuucaggcagacagcccgaaaagauuagcaacugcaauugcaggggcaugggaaaacggaguauguggaauuaggagcacuacuaggauggagaaucuacuuuggaagcaaauugcaaaugaauugaacuacauacuaugggaaaacaauaucaaacuuacaguaguaguaggggauauaauugggguauuagaacaaggaaaacgaacucuaacaccgcagcccauggaacucaaauacucguggaaaacauggggaaaagccaaaauuguuacagcagagacucaaaauuccucauucauaauugacggacccaauacaccugagugcccuagcgcuagucgugcguggaacguaugggaaguggaggauuauggauuuggaguauuuaccacaaauauuuggcugaaguuacgugaaguguacacccaacugugcgaucauagauuaaugagcgcagcaguaaaggaugaacgcgcaguucaugcggauaugggauacuggauagaaucccagaagaauggaaguuggaaacuagagaaggcuucccuuauagaaguaaaaaccugcaccuggccuaaaucacacacauuauggucaaacgggguacuagagagugacaugauuauucccaaaucauuggcagggccgauaucacaacauaacuauagaccaggcuaucauacacaaacggcuggaccauggcauuuagguaaacuugaauuagauuucaacuauugcgagggaaccaccgucguaauuacagaaaacugugguacccgaggaccaucucuacgaaccacaacaguaucuggcaaauuaauacaugaauggugcuguagaaguuguacucugccucccuuacgauauaugggugaagauggaugcugguacggaauggaaauuagacccauaucagaaaaggaagagaacaugguaaaaagccuaguuucggccgguuccggaaaaguugauaauuuuacuaugggaguccuuugucuagcuauucucuuugaagaggugaugagagguaaguuuggcaagaaacauaugauagccgguguguucuuuacguuuguuuuacuauuaaguggacagauuaccuggagagacauggcacauacucuaauaaugauagguucaaaugccagugacagaauggguauggguguaaccuaccuugcuuuaauagccacauucaaaauccaaccauucuuggcacuugguuucuuccuccguaaacugacgaguagagaaaaucuuuuacucggaguuggacuagcgauggcaacuacacugcaacucccagaagauauagaacaaauggcuaacggcauagcuuuagguuugaugacacucaaacuuaucacccaguucgaaaccuaccaacuuuggacggccuugauuaguuuaacaugcucaaacacuauuuuuacauuaaccgucgcauggcgaacggcaacucuaaucuuagcaggaguaucauugcuaccaguaugucaaucgucuaguaugagaaagacggauugguugccaaugacuguugcagcuaugggugugccuccacuaccccuguuuauauucucucucaaagauaccuugaaaaggagaucuuggccauuaaaugaaggugucauggcagucggcuuaguuucuauacuagccuccucucuacucagaaaugacgucccuauggcgggaccucuugucgcaggcgggcuccucauugcuuguuacguuauuaccggcacgagugcugaucuaacaguagaaaaagcggcagauguuacaugggaagaagaagcggagcagacugguguuucacacaauuugaugauuacaguagacgacgacgguacaaugagaauaaaagaugacgaaacagaaaauauucuaacgguacuauuaaaaacagcacuucuaauuguaucggguauuuuuccauauuccaucccagcaacccugcuugucuggcacacguggcaaaaacaaacucaaaggagugggguucuaugggauguuccuagcccuccggaaacccaaaaagccgagcuggaagaaggaguguaccggauaaagcaacaaggcauuuuuggaaaaacacaaguaggcgucggcguacaaaaagaagguguauuucauacaauguggcauguaaccagaggugcaguacuuacuuauaaugggaaaagacucgaaccaaacugggcuagcgugaaaaaggaucucauuucauacggaggaggcuggagacuaagcgcccaauggcagaagggagaagagguacaagugauugcagucgaaccagguaaaaacccuaaaaauuuucaaacaaugccuggaaccuuucaaacgacaacuggcgaaauaggugccauugcucuagacuucaaaccugguaccaguggauccccgauaauuaauagagaggggaaagugguuggacuguauggaaacgggguuguuacaaagaacgggggcuacgucucuggcauugcucaaacaaacgcggaaccagauggaccuacaccugaguuagaagaagagauguucaaaaagagaaaucucaccauuauggaucuacacccugguucagguaaaacccgaaaauaucuaccagccauugucagagaagccaucaagagaagacugcguacauuaauucuagcgccaacgcgaguaguggccgcagaaauggaagaagccuuaaagggucuacccauccguuaucaaacgacagcuacgaaaucggaacauacaggacgugagauagucgacuuaaugugccaugcaaccuucacaaugcgauuguugucacccguaagaguaccuaauuauaaccuuauaauaauggacgaagcacauuuuacugacccugccuccaucgccgcuagaggguauauaagcaccagaguagggaugggagaggcagcagcaauauuuaugacugcuacgccaccagguacugcggaugccuucccucaaaguaacgccccuauucaggaugaggaaagagauauaccagaaaggagcuggaacucuggaaaugaauggaucaccgacuuugcuggcaaaaccguuugguuuguuccuuccauaaaggcgggaaaugauauagcaaauugcuuaaggaaaaacgggaagaaaguuauacaguuaagccgaaagaccuuugauaccgaauaucaaaagaccaaauuaaaugauugggauuuugugguuacaacagauauaucugagaugggagcaaacuuuaaagcugauagaguuaucgauccacggagaugucucaagccaguaauucugacggaugggcccgagcguguuauccuagcuggaccgaugccaguuacggcagcaucagcagcccaaagaagaggaagagucggaagaaacccacaaaaagaaaaugaucaauauauauuuacgggacagccgcuuaauaaugacgaagaccaugcccacuggacggaggcuaaaaugcuacuugauaacaucaacacuccagaaggaauaaucccugcacuuuuugaaccggagagagagaaaagugccgcuauagauggugaguaucgacuuaaaggagaaagccguaagacauucguggaacugaugcgcagaggggacuuaccuguauggcuugcucacaagguagcaagugaaggaaucaaauacgcugaccgaaagugguguuucgauggccaacgaaauaaccagauccuugaggagaauauggauguagaaauauggacaaaggaaggcgagaagaagaaacugaggccacguugguuagacgcacgaacauauucggauccuuuagcacucaaggaauuuaaagacuuugccgcuggaagaaaaucaauugcuuuagacuugguaacagaaauuggaagagucccaucucaccuggcucaucgaacuagaaaugcguuagauaaucuaguuauguuacauacgagugaacacggaggaaaagcauaccgucaugccguagaagaacuaccggaaacuauggaaacgcuacuauugcuuggauuaaugaucuuacuuacagggggugcuauguuauucuuaauuuccggaaaggggauuggaaaaacauccauaggucuuauaugugucauagcuucgucuggcauguuauggauggcggagaucccacugcaauggauagccucggcuauuguauuggaauuuuucaugaugguacuucugauaccagaaccugaaaagcaacgaacaccacaagacaaucaacuugcguauguaguaaucgggauacucacuuuagcugcaauuauagcugcuaacgaaaugggccuuuuagaaacgacaaagagagauuuaggaaugucuaaagaaccaggaguagucucaucgacauccuaucuugauguagauuugcacccggcguccgcauggacguuauaugcuguagcaacuacaguuauaacaccgauguuaagacacacgauagaaaauucaacagcgaauguaucgcuagcagcuauagcuaaucaagcaguaguucuaaugggacuagauaaaggcuggccuaucaguaaaauggaccuuggaguaccauuguuagcguuaggguguuauucucagguaaacccuuugacccuaacugcugcaguucuauuacuuauuacccauuaugcgauaauaggacccgguuugcaagcaaaggccacuagagaagcacagaaaagaacagccgcuggcaucaugaagaaucccacuguagauggcauuaugacuaucgaccuggauccuguuauuuacgauucaaaauuugaaaaacaacuaggccaaguuauguuauuaguacugugugcaguucagcuguuauugaugagaacuucgugggccuuaugcgaagcauuaacguuagcaacaggcccaauuacuacuuugugggaagguucaccaggaaaauuuuggaauacaacaauugcaguaucuauggcaaacauauuucgcgguaguuaucuggccggcgccgggcuugcauuuagcauaaugaaaaguguagggacugggaagaggggaacugggagucaaggagagacacuaggagaaaaauggaagaagaaauugaaccaacuaucccgaaaagaauuugacuuguauaagaaaagcggaauaacugaaguagaccgcaccgaggccaaagaagggcuaaaacguggagaaauuacacaucaugcaguaucacgaggaucugcgaaauugcaaugguucguagaacgaaauauggucauucccgagggaagaguuauagaucugggauguggcagagggggauggucguauuauugcgcuggacuaaagaaaguaacggaagugaggggauauacgaaagguggaccugggcaugaagaacccguuccuaugagcacguaugguuggaauauuguuaaacucauguccgggaaagacguuuucuaucuaccaccggaaaaaugugauacucugcuuugugacaucggcgaauccaguccgucaccuacgguagaagagucacgaacaauacgaguacuaaaaaugguagaaccauggcugaaaaauaaccaauuuuguaucaaagugcucaauccuuauaugccaacuguuauagaacaucuggaaagauuacaacguaaacaugguggcauguuaguacguaacccacuuucaagaaacucuacacacgagauguauuggauaucuaaugguacuggaaacaucguugccucaguuaacauggugucaaggcuacuuuuaaauagauuuacaaugacacacagaagaccuacaauagagaaagauguggauuuaggcgcgggaacaaggcacguaaaugcugaaccggaaacccccaauauggacgugauuggugaaagaauuaaaaggaucaaggaagaacacaacaguacuuggcacuacgacgaugaaaaucccuauaaaacaugggcguaccaugggucauacgaaguuaaagcuaccgggucugcgagcucaaugauuaauggaguggucaaacuucuaaccaaaccgugggacguaguuccaaugguuacacaaauggcaaugacagauacuaccccuuuuggucagcagaggguauuuaaagaaaagguugacacaagaaccccaaggucaaugccgggaacgagaagaguaaugggaauaacugccgaguggcuuuggagaacauugggcagaaacaagaaaccgagacuauguaccagagaagaguucaccaagaaaguaagaacaaacgcagcgaugggagcgguauuuacggaagaaaaucaaugggacuccgcaaaagcggccguagaagaugaagauuuuuggaaguugguagaccgugagagagaacuacauaaguuagguaaguguggaucauguguauauaauaugauggguaaaagagaaaagaaacugggggaauuuggaaaagcaaagggaucgcgagcaaucugguauaugugguugggugcaagguauuuagaguucgaagcucuaggcuuucucaaugaagaucauugguuuucuagggagaauaguuauagcgguguagaaggagaaggccugcauaaauuagguuauauauuaagagauauuaguaagauaccaggcggagccauguacgccgacgacacagcgggaugggauacacguauaacggaagacgaccuacauaaugaagagaaaauaacucaacagauggaucccgagcaucgacaguuggcuaacgcaauauuuaaacucacuuaucaaaacaaagucgucaaaguacaaagaccgacgcccacagguacuguaauggacauaauaucgcgcaaagaucaaagaggaagcggccaaguggguacguacucgcuuaauaccuucaccaacauggaagcucaacuaauacgacaaauggagggagaagguguuuuaaguaaagcugaucuugaaaauccucaucuccccgagaagaaaauaacgcagugguuagaaacaaaggggguugaaagguugaaaagaauggccauaaguggagaugauugcguaguaaagccaaucgaugaccgguucgcaaacgccuuguuggcacugaaugauaugggaaagguccguaaagacaucccucaauggcaacccucgaagggauggcaugauuggcagcagguaccuuuuugcagccaccauuuucacgaguuaauaaugaaggauggcagaaagcugguagucccaugucgaccucaggacgagcucauaggucgagcuagaauaagccaaggugcgggauggucauuacgagaaacagcgugucugggaaaggcuuaugcacaaauguggucacuuauguacuuccaucgccgcgaucucagacuugcuaguaaugccaucugcagugccgucccaguacacuggguaccaacaucacgaacgacauggagcauacaugcacaucaucaauggaugacuacagaggacauguugacaguuuggaauagaguauggauugaagacaacccauggauggaagauaaaaccccuguaacgacgugggaaaacguaccauauuuaggaaaaagggaagaucaaugguguggcagcuuaauuggauuaacaucucgagcgacaugggcgcaaaauauacccacagcgauccagcaaguccggagucuuauaggaaacgaggaauuucuugacuacaugccuucuaugaaacgauuccgcaaagaagaagaaagugaaggggccauaugguaa

SEQ ID NO: 23368 - RNA, 9873 nt, Artificial Sequence
  derived and/or modified CDS sequence (opt6) from DENV-3__FJ547082__SS-prME
acaagccucugucucaugaugauuuugccagcagcauuagcauuucauuugacuagccgagauggagaacccagaaugaucguugguaaaaaugaaagagggaaaucgcuguuauuuaaaacggcaagcgguauaaauauguguacgcuaauugcuauggauuuaggagaaaugugugacgauacaguuacauacaaauguccgcacauugccgaaguggaaccagaagacaucgauugcuggugcaauuuaacaucaacauggguaacauacggaacauguaaucaggcaggagaacaucgacgggauaaacgauccguugcauuagcaccccacguggggauggguuuagauacacgaacccagaccuggaugagugcugaaggggcauggcgccaaguagaaaaaguggaaacaugggcuuuacgacauccuggcuuuacaauauuagcccuauuuuuggcgcacuauauagggaccucuuuaacccaaaaaguagugaucuuuauacuacuaaugcuaguaacaccaaguaugacuaugagaugugugggcgugggaaaucgcgacuuuguagaaggcuuaucuggagccaccuggguggacguaguguuggaacacggcggaugugucacaacaauggcgaaaaacaaaccgacuuuagauauagaauuacagaaaacugaagcuacccaacuagccacauuaaggaaacuuugcauugaggguaaaauaacaaacauuacuacagauagccgauguccgacacaaggugaagcaguuuuaccagaagaacaggaucagaacuacguauguaaacacacauacguugaucgagguugggguaacggauguggacuauuuggcaaaggaucacuuguaaccugugcuaaauuucaaugccucgaaccaauagaggggaaagucgugcaauaugaaaaucuuaaauauacaguaaucaucacugugcacacuggggaccaacaucagguagguaaugagacccaaggcgucacggcggaaauaacaccucaagcaucuacaacugaggccaucuuaccagaauacgguacacuuggauuagaauguaguccccguacuggacuagacuuuaacgaaaugauacucuuaacaaugaaaaauaaagcauggauggugcacagacagugguucuuugacuugccccuaccauggaccaguggcgcuacaacugagaccccaacauggaacagaaaagagcuucucguaacuuuuaaaaacgcucacgcuaagaaacaagaaguaguaguuuugggaagucaggaaggugcgaugcauacagccuuaacuggcgccacugaaauacaaaauagugguggaacuucaauauuugcaggacaucucaaaugcagacugaaaauggauaaacuagagcuaaaagggauguccuacgcaaugugcacaaauacguucguucuaaagaaagaaguuucagaaacacagcacgguacaauauugauaaaaguagaauacaaaggggaagacguuccauguaaaaucccuuuuucaacugaagauggccaaggaaaagcucauaauggcagacugauaaccgcuaacccuguugugaccaagaaagaagaaccaguuaauauagaagcggaaccuccguuuggagagagcaauauaguaauuggcaucggagauaaugcauugaaaauuaacugguacaagaaaggaaguagcauagggaaaauguuugaagcgacugcucgaggugcucgaagaauggcaaucuuaggagauacggcuugggauuucggaagcgucggugguguacuuaauucucuugguaaaaugguucaccaaauauucggauccgcauauacugcucuuuucucaggugugucgugggugaugaaaaucggaauaggcguuuuauuaacguggauaggccucaacaguaaaaauacguccaugaguuuuucuugcauugcaauugguauaauaacgcuauaccuaggcgcuguuguacaagcagauacaggguguguuauaaauuggaaaggaaaagaacuuaaauguggaucaggaaucuuuguaaccaacgaaguacauacauggacggaacaguacaaauuucaagcugacucgccaaaaagauuggcuacugcgaucgcuggagccugggaaaauggaguaugcggcauaaggucuaccaccagaauggaaaaccuuuuguggaaacaaaucgcuaaugagcuaaacuacauacuaugggaaaauaacauuaaacugacaguuguuguaggugauauaauaggaguuuuagaacagggaaaacguacauuaaccccucaaccaauggaacucaaauauucuuggaaaauguggggcaaagcaaaaauagugacagcugaaacacaaaauucuucguuuauaauagauggacccaacacuccugaaugcccgucagcaucacgugcuuggaauguaugggaaguugaagacuaugguuuuggcguguucacaacaaauaucuggcuuaaauuaagagaaguuuauacucaacuaugcgaucaucgacuuaugucagcagcuguuaaagaugaacgagccguccaugcagauaugggauacuggauagaaagccagaaaaauggaucauggaaauuggaaaaagccucucuaauagaaguaaaaacaugcacauggccaaaaagccacacauuauggucgaauggagugcuagaaagcgacaugauuauaccuaaaagccuagcagggccuauuucacaacacaauuaucguccaggguaucauacucaaacggcagguccuuggcaucuagguaaacuagaauuagauuucaacuauugugaaggcacaaccguagugaucacggaaaauugcgguacaagggguccaaguuuaaggacaacaaccguuagcggaaaacucauccaugaaugguguugcagauccugcacccuuccaccuuugcgauauaugggcgaggacgguuguugguauggaauggaaauaagaccgauaucugaaaaagaagaaaauauggugaaaagccuagucucugcagggagcgguaaagucgacaauuuuacaaugggcguucucugcuuggcgauauuguucgaagaaguuaugagaggcaaauuugggaagaaacauaugauugcggguguauucuuuacauuuguccuacuucuuucuggacagaucacuuggcgugacauggcccacacccuuauaaugauaggcucuaacgcaucagauagaauggguaugggcgugacuuaucuugcucuaauagcaacguuuaaaauucaacccuuucuagcacuuggauucuuuuuacgaaaauuaaccucucgugaaaauuuguugcuaggugucggauuagcgauggcgacgacguuacaauuaccggaggauauagagcaaauggcaaauggaauugcauuaggacugauggcuuugaaacucauaacacaauuugaaacauaucaacucuggaccgcauugauaucccuaacguguucaaacacaauauuuacuuuaaccguagccuggaggacagcuacauuaauauuagccggugucagccuacuaccuguaugucagucaucaucuaugaggaaguccgauuggcuaccaaugacaguggccgcaauggguguuccaccgcugccacucuucauuuuuagcuuaaaagauacccuuaaaaggaggaguuggccauugaaugaaggaguaauggcgguaggauuagugagcauacuagcaucaucgcuacuucggaacgauguaccgauggcaggacccuuaguugcaggcggauuacuaauagcaugcuauguaauaacgggaacuagcgcggauuuaacuguggaaaaagcagcagacguaacuugggaagaagaggcagaacagacaggcguaucccauaaucuaaugauuacagucgaugacgaugguacaaugcgaauaaaagacgaugaaacugagaauauucucaccgucuuacugaagacagcuuugcuaauaguaagcgguaucuucccuuacucaaucccagcaacccuauuaguauggcauacauggcaaaagcagacccguaggucaggaguacuaugggauguuccaucaccaccugaaacacaaaaagcagaauuggaggaaggagucuacagaauaaaacagcaagggauauuuggaaaaacccagguaggcguaggcguacaaaaagaaggcgucuuucacacaauguggcaugucacuaggggugcuguauuaacguauaauggaaaacguuuagaaccgaauugggcaucagucaagaaagaucugauaucauauggcggagguuggagacuaagugcacaauggcaaaaaggagaagaaguacaaguaauagccguugaaccaggaaagaaucccaaaaauuuccaaacuaugccaggcaccuuucaaacaaccacaggggaaaucggugcuauagcacucgacuucaaaccagguacgucugguagcccuaucauaaauagagaagguaaaguagugggacuauacgguaacggagucguuaccaagaauggaggcuauguuaguggaauugcacaaacaaaugcagaaccagauggucccaccccugaacuagaagaagagauguuuaagaaaagaaacuuaacgauuauggauuuacauccaggaucuggaaaaacccgaaaauaucuucccgccauuguacgagaggcaaucaaaagacgauuaagaacacuuauauuagcaccgacacgaguggucgcagccgaaauggaagaggcuuugaaaggacuaccaauuagguaucagacuacugccaccaaaucagaacacacaggcagagaaauuguggacuuaaugugucacgcgacauuuacuaugaggcuguuaucaccggucagggugccuaauuacaaucuaauuauaauggacgaagcucacuucacugaucccgcuaguauagcagcgagggguuacaucaguacgcgaguuggaaugggagaagccgcagcaauuuuuaugaccgcuacgccuccuggaacugccgaugcuuuuccccagucaaacgcaccaauccaggaugaagaaagggacauuccagaaagaaguuggaacucuggaaaugaguggaucacggauuuugccggaaaaacuguaugguuuguuccaaguauaaaagccgguaaugauauagccaauugccuaagaaagaacgguaagaaaguaauacaacugagucgcaaaacauuugauacugaauaucagaaaacuaagcuaaacgauugggauuucguaguaacaacugauauaucagaaaugggagccaauuucaaagcggacaggguaaucgauccgagaagguguuuaaaacccguaauauuaacugacgggcccgaaaggguaauauuggcaggaccuaugccaguuaccgcagcaagugcagcccagaggcgagggcgcgucgguaggaauccacaaaaagaaaacgaucaauauauuuucacaggccaaccuuuaaacaaugacgaagaucacgcacacuggacagaagcuaagaugcuccuggacaauauaaauacgccggaggggauaauaccagcauuauuugagccggaaagagagaagucagccgcaauagauggagaguauagacuaaaaggcgaaucuaggaagacguucguugaguugaugcgaagaggugauuuaccagucugguuagcacacaaaguagcuucagagggcauuaaauacacagacagaaaguggugcuucgacgggcaaagaaacaaccagauccuagaagaaaauauggacguugaaauauggacaaaagaaggugagaagaagaaacuuaggccuagauggcuagaugcucgaacauacucugacccguuagcucucaaagaauuuaaagauuuugccgcuggucgaaaaaguauagcacuagacuuaguaacagaaauagggcgugugcccagucaucuagcgcaucguacaagaaacgcgcuagauaacuuggucaugcuucauacaagcgagcacggaggcaaagcauauagacacgcuguggaagaacucccagaaacaauggagacacuauuauuacucggccugaugauauuacugacugggggugcaaugcucuuuuuaauauccgggaaaggcauaggcaaaacguccauaggauuaauaugcguaauagcaucaucuggaauguuauggauggccgaaauaccccuccaguggauugcgagugcaauaguucuagaguucuuuaugaugguucuauuaauuccggaaccagagaagcagcguacaccacaagacaaccaacuagcauacguugucauuggaauacuaacacuggcagccauaauagccgcaaaugaaaugggccuacuggaaaccacaaaaagggacuuggggaugucaaaagaaccggggguaguuucaccuacaaguuaccuagacguggacuugcauccugcuagugcuuggaccuuauaugcgguugcaacaacaguuauaacaccgaugcuucgccauacgaucgaaaacaguaccgcaaaugucagcuuagcagccauagccaaucaagcuguggucuuaaugggguuggacaaaggauggccuauaucaaaaauggaccugggggugcccuuacucgcccugggcuguuacagucaagucaacccguuaacccuuacggcugcggucuuauuauuaaucacacacuaugcaauuauagggccuggacuacaagcuaaagccacucgagaggcccaaaaacgaacggcugcagguauaaugaaaaacccuacgguagacggaauaaugacuauugauuuagacccaguuauauacgacaguaaguuugaaaagcaauuaggccaaguaauguugcuuguguugugcgcgguucagcucuuacuaaugagaaccuccugggcgcucugugaggcuuuaacccuugccaccgggccuauaacgacguuaugggagggaucuccgggaaaauuuuggaacacaacaauagcgguaaguauggcaaacaucuuuagggguucguauuuagcuggagcuggccucgcguuuaguauuaugaagucuguagggaccggaaaacgugguacagguagucagggugaaacacugggagagaaauggaagaagaaauuaaaucagcucagccggaaagaauuugaccucuauaagaaaaguggaauaaccgaaguugauagaacagaagcaaaagagggacuaaaaaggggagaaauaacccaucaugcgguuucgagaggaucugcgaagcuccaaugguucguugaacgaaauaugguaauuccugagggaagggugauugacuuaggcugcggucggggaggauggucuuacuauugcgcgggucuuaagaaaguuacagaagucagagguuauacgaaagggggaccugggcacgaggaaccggucccgaugucaacauacgguuggaacauagucaaacuuaugucagguaaagaugucuuuuaccuuccuccagaaaagugcgauacccuauuaugugacauaggcgaauccucgccuagcccuaccguugaagagucccguacgauacgaguauuaaaaaugguagagcccugguugaaaaacaaucaauuuugcauaaaaguacuaaacccauauaugccgaccguuauagaacaucuagaacgucugcaacgcaagcacgggggcaugcuugucagaaauccgcuaagccgcaacucuacucacgaaauguauuggauaaguaauggcaccgguaacaucgucgccucagucaacaugguuucuagacuguuacuaaauagguuuacuaugacccaccgacggccuacuauagagaaagacgucgaucuaggcgccggaacccgucauguaaacgcugaaccagagacaccaaauauggauguuauaggugagcgaauaaaaaggauaaaagaagaacacaacuccaccuggcauuacgaugacgagaauccauauaaaacaugggcguaucacgguucauaugaaguaaaggccacuggaagugcaaguagcaugauuaauggaguaguaaaauugcuaacaaaacccugggacguuguuccuaugguuacgcaaauggcuaugacggauacuacaccuuuugggcaacaacgagucuucaaagaaaaaguugacaccaggacaccucguucuaugccaggcacaagaagaguaauggggaucacggcggaauggcuauggagaaccuuagggcgaaacaagaagccucguuugugcacucgugaggaguucaccaagaaaguaagaacgaaugcagcaaugggcgccguuuucacagaagaaaaccaaugggacuccgcgaaggcggcaguagaagacgaagauuuuuggaaauuagucgacagggaacgugaauuacacaaauuggggaaauguggcucuugugucuacaauaugauggguaagcgugagaagaaacuaggggaguucggcaaagccaaaggaucucgggcgauuugguauaugugguuaggagcacgauaccuugaguucgaagcacucgguuuucuaaaugaagaucacugguucagucgugaaaacucuuauuccgguguagagggggaagguuuacauaaacuaggguauaucuuacgagauaucucgaaaaucccaggaggagccauguacgcugaugauacagcugguugggacacaaggaucacagaagacgaucuacauaaugaagaaaagauuacacaacagauggauccagaacauagacaauuagcuaacgccauuuucaagcucacuuaucaaaauaaggugguuaaaguacagcgaccaacgccaaccggcacaguuauggauaucaucagccgcaaagaucaacgcgguagcggacaaguggguacguauggauuaaacacuuuuacuaacauggaagcucaauuaauaagacagauggaaggagaggguguuuuaucgaaagcugaccuggaaaacccacauuuaucugagaagaaaaucacucaguggcuggaaacgaaaggaguagaaagauuaaaaagaauggcuauuuccggcgaugacuguguagugaaaccuauagacgaccguuuugcuaacgcacuuuuagccuuaaacgauaugggcaaaguacgaaaagacauuccacaauggcaaccauccaagggauggcacgauuggcaacaagugccauucuguucucaucacuuucaugaguuaauuaugaaggauggaagaaaauuagugguaccuugucggccccaagaugaacuaaucgguagagcccgaauaagucagggcgcaggcuggucacuaagagagacagcaugucuagggaaggcuuaugcacaaauguggucucuaauguauuuucauagaagggaucuccgcuuagccucaaaugcaauauguucagcugugccuguacauuggguaccaaccagcaggacuacguggaguauacaugcacaccaccaauggaugacuacggaagauaugcugacaguuuggaaccgaguuuggauagaggacaauccauggauggaagacaaaaccccaguuacgacaugggaaaacguacccuauuuaggcaaaagagaggaucaaugguguggcagcuuaauuggauugacuagcagggccacuugggcacaaaauauaccaacggcaauacaacaaguccgaucacuaaucggaaaugaggaauuucuagacuauaugccauccaugaaacguuuccggaaagaagaagaaucagaaggcgccauaugguaa

SEQ ID NO: 23369 - RNA, 9873 nt, Artificial Sequence
  derived and/or modified CDS sequence (opt6) from DENV-3__FJ547083__SS-prME
acuagccucuguuuaaugaugauauuaccggcagcacuagcguuccaccucacuagcagagauggagaaccucggaugauaguugggaaaaaugaacguggaaaaucgcugcuauuuaaaaccgcaaguggaauaaauauguguacacucauagcgauggaucuaggagaaaugugugacgauacaguuacguacaaaugcccucauauuacagaaguggaaccagaagacauagauugcugguguaacuuaacuucuaccuggguaacuuacgguacauguaaucaagcaggagaaagaagacgagauaaacgcucgguagcauuagcuccacauguaggaaugggccucgauacacgcacacaaacguggaugucggcagaaggagcguggagacaaguggaaaaagucgaaacgugggcacucaggcaccccggguuuacuauccucgcacuguuuuuagcucauuacauagguaccuccuugacacaaaaaguagucauauucauacuucucauguuaguuacaccaucuaugacuaugagaugcgucggugucggaaaucgagauuuuguagaagguuuaagcggcgcaacuuggguagauguuguauuagaacacgguggguguguaacaacuauggcuaaaaauaaaccuacacuagacauagaauuacagaaaacagaagcuacacaguuagcuacgcuaaggaaacuaugcauugaaggaaaaauuacuaauauaacuacugacagccgguguccaacccaaggugaagccgugcucccugaagaacaagaccagagcuacguaugcaaacauacauacguugacaggggcuggggaaauggguguggcuuauucggcaaagguaguuugguuaccugugcuaaauuccaguguuuagagccuauagaaggaaaaguaguccaauaugaaaaucuuaaauauacuguaauuauuaccguucacacaggagaccagcaccaaguaggcaacgagacacaaggaguaacugcugaaaucacaccucaagcaaguacuacggaggccauauugccugaguacgguacacuugguuuagaauguucuccaagaacuggacuugacuuuaacgagaugauauugcuaacuaugaaaaacaaagcauggauggugcaccgucaaugguucuucgauuuaccuuuacccuggacaagcggggcuacaacagagacuccuacauggaacaggaaagaacuuuuaguuacauucaaaaaugcgcacgccaagaaacaagaaguuguuguccuagguucucaagaaggggcaaugcauaccgcauuaacgggcgcuaccgaaauccagaacuccggggguaccucuauauucgcuggucaucucaaaugccguuuaaaaauggacaaacuagaacuaaaaggaaugaguuacgcaaugugcacgaauacuuuuguacuaaagaaagagguaucagaaacccaacaugguacgauccuuauaaaaguagaguacaaaggcgaagacgcaccguguaaaauacccuuuucaacggaagauggacaaggaaaagcacauaacggccgucuuauuacagcaaacccugugguaaccaagaaagaagaaccaguaaacauagaggcugaaccuccauuuggagaaucgaauauugugauaggaauaggagauaaugcguuaaaaaucaauugguacaagaaagguaguaguauaggaaaaauguucgaagcuacagcucgaggagcgagacgaauggcaauauuaggggauacagcaugggauuuuggaagcguaggaggggugcuuaacucguuagggaaaauggugcaucagaucuucggaagugcauauacagcacuauuuagcggagugucauggguaaugaaaaucggaaucggaguauuguugacuuggauugggcugaacagcaaaaacacgagcaugucuuucucuuguaucgcgauaggaauaauuacuuuauaccuuggugcuguuguccaagcagacaugggauguguaauaaauuggaaaggcaaagaacucaaaugcgguucugguauauucguuaccaaugaaguucacacauggacugagcaauacaaauuccaagcagacucgccuaaaagacuagcaacagcaauagccggagcaugggaaaaugguguaugcggcauucguucuacaacgaggauggaaaaucuucuguggaagcagauugcgaacgaacuuaacuacauacuuugggaaaauaacauuaaacuaacagucguaguaggugacaccauagguguguuggagcaaggaaaaagaacauuaacaccacaaccuauggaauuaaaauauagcuggaagacaugggguaaagcgaaaauagugacagcggaaacucaaaacucaucauuuaucauugacggaccaaacacaccggaaugcccuucugcguccagagcauggaaugucugggaaguagaggauuacggauucggugucuucacaacgaauaucuggcuuaaguugagggaaguauacacgcaauuaugcgaucaucgauuaaugucagcggcaguuaaagaugaaagagcuguacacgcggauaugggauauuggauagaaagccagaagaaugggaguuggaaacucgaaaaggccagucuuaucgaaguaaaaacgugcacuuggcccaaaucucacacacucuggucgaauggaguauuagaaagcgauaugauuauuccuaaaagccuagcggguccuauaagucaacauaaucacagaccuggcuaucauacgcaaacggcuggcccuuggcauuuaggaaaacuagaguuggauuucaauuauugcgaggggacuaccgugguaauuacagaaaauuguggcacucgaggaccaucauugaggacgacuaccguaucaggaaaacuaauacaugaauggugcuguagaucuuguacucuucccccguuaagauacaugggagaggacggauguugguaugggauggaaauccggccgaucucugaaaaagaggaaaauaugguuaaaucacugguaucagcugguucaggaaaaguagacaacuuuacaaugggaguauuauguuuagcuauauuauucgaggaaguaaugcgugguaaguucggcaaaaagcauaugaucgcaggaguguucuuuacuuucguccuguuauugucggggcaaauaacauggcgagacauggcgcauacucuaauuaugauuggaucuucagcgagugaccgaauggguauggggguaacguaucucgcacuuauagcaacauuuaaaauacaaccauuucuugcccuaggcuucuuuuuaagaaaacuaacgaguagagaaaaccuucuacuggguguugguuuagcuauggcgaccacgcuacaauuaccagaagacaucgaacaaauggcaaacgggaucgcauugggcuugauggcacucaaacuaauaacccaauucgagacauaucaguuauggacagcucugauaagucugacauguucaaauacgauguuuacguuaaccgucgcuuggagaacugcaacauuaauuuuagccggugugagucuguugccaguaugccaaucuagcucaaugagaaaaaccgauugguuaccaauggcaguagcggcaaugggaguuccaccacuaccccuauuuauauucucacuaaaagauacccuuaaacggagaaguuggccguuaaacgagggcgugauggccguaggccucguuagcauccucgcaucaaguuuacuucgcaacgacguuccgauggcaggaccucugguagcaggaggauuauuaauugccugcuacgugaucacaggcacaucagcagaccucacgguugagaaagcagcagacauaacgugggaagaagaagcagaacaaacaggaguuucacauaauuuaaugaucaccguagaugaugacggaacaaugagaauuaaagacgaugaaacggaaaacaucuugaccguuuuauugaaaacugcuuuacuaauaguaagcggaguauuuccauauaguauaccagcgacguuacucgucuggcacacuuggcaaaaacaaacacaacggucgggaguucuuugggacguaccaucaccacccgaaacucagaaagcagaauuagaggagggaguuuaccgaauuaaacaacaagggauauucggaaagacucaagucgggguggggguacaaaaagaaggaguuuuucacacaauguggcacguuaccagaggggcgguucuuacauacaauggcaaacgauuagaaccuaauugggcaagcguuaagaaagaucucauaucauauggagggggauggagauuaagcgcucaauggcaaaaaggugaggaaguacaggugauugccguagagccuggcaaaaaccccaaaaacuuccaaacgaugccggggaccuuucaaacaacaacaggagaaaucggugccaucgcauuagauuuuaaacccggaacuuccggaaguccuauaauaaaccgagagggaaagguagucggucuauauggaaauggggucguaacuaaaaacggaggauacguuagcgguauugcacagacaaaugcagagccagaugguccaaccccagagcuugaggaagaaauguuuaaaaagagaaaccucacgauaauggauuuacacccuggcucgggaaaaacacgaaaauaucuaccagccaucguacgugaagcaauuaaaagacgacuaagaacccuaauauuagcuccaacacgcguaguugcagccgaaauggaagaggcucuaaaaggcuuacccauacgguaucaaacaacugccacaaaaagugaacauacgggcagagaaauagucgauuugaugugccacgccaccuucacaaugagauuacuaucaccuguacgagugccgaauuauaacuuaaucaucauggaugaagcucauuuuacggauccugccaguaucgcagcccguggcuauauuuccacucggguaggaaugggcgaggcggcagcuauauucaugacagccacacccccgggcacagcagacgcauuuccgcaaaguaaugcaccaauccaagacgaagaacgagauauuccagaaagaucuuggaauaguggaaacgaauggaucacagauuucgcuggaaaaacuguuugguucguaccaaguaucaaggcaggaaaugauauagcuaacugucucaggaaaaaugguaagaaaguaauucaguuaucaagaaaaacguucgauacagaguaucagaaaacgaagcugaacgacugggauuuuguuguuacaaccgacauuagcgagaugggagcaaacuuuaaagcggacagaguaauugauccucguagaugccuaaagccgguaauuuuaacugacggaccggaaagaguuaucuuagcggguccuaugcccguaacugcggcguccgcagcacaaagaaggggucgggucggaagaaauccacaaaaagaaaacgaccaauacauauucaccggucaacccuugaacaacgaugaagaucaugcucauuggacggaagcaaagaugcuucuagacaauaucaauaccccagaaggcauuauuccagcacucuuugaaccggaaagagagaaaagcgcugcaauagauggagaauaccggcucaagggagaaucucgaaaaacguuuguggagcuuaugagacgcggagaccuccccgugugguuagcacacaagguagcaucagaagguauaaaauauacugacagaaaaugguguuuugaugggcaaagaaauaaucagauuuuggaagaaaauauggacguagaaaucuggacaaaagagggagagaagaagaaauugagaccucgcugguuagacgcaagaacguacuccgauccuuuagcuuugaaagaauuuaaagacuuugcggcuggcagaaagucaaucgcgcuggauuuagugacagagauagguaggguaccaagucacuuggcgcaucggacccggaacgcuuuagauaaucuaguuauguuacauacaucugaacauggaggcagagcuuaucgacacgccguagaggaacuuccugaaacaauggaaaccuuacuauuauuaggauugaugauacuuuugacaggaggcgcgauguuguucuuaaucuccggcaaaggaauaggcaaaacuuccauaggucuaaucugcgucauagccuccagcggaauguuauggauggcagaaauaccucuucaauggauagcgagcgcuauaguacucgaguucuuuaugaugguacucuuaauaccagaaccugagaaacaacgaacgccacaagacaaucagcuugcuuacguugugaucgggauacuuacacuagccgcgauuauagcagcuaacgaaaugggcuuacuggaaacuacgaaacgggaccuggguaugaguaaagaaccaggagucguuagcccaacaaguuacuuggauguagaccuucauccagcuucggccuggaccuuauaugcuguggcgaccacugugauuacaccaaugcuaaggcacacuauagaaaacucgacugcgaaugucucauuagcugcaauagcgaaucaggcaguuguauugaugggguuagauaaaggauggccgaucuccaaaauggacuugggaguaccgcuauuagcacuaggcuguuauucucagguaaauccauuaaccuugaccgcagccguucuauuacuaauaacucauuacgcaauaauaggcccgggacuacaagcaaaagcaacucgggaagcacaaaaacgaacagcagccggcauaaugaagaacccaacaguagauggcauaaugacuauugaccuagacccaguuauauaugacucaaaauucgagaagcaguuaggccaaguaaugcuauugguucuuugcgcaguacaguuauuauuaaugagaacaaguugggcccucugugaagcgcucacgcuagcaaccggaccaauuacaacuuugugggaaggcucgccuggcaaauuuuggaacacaaccaucgcaguauccauggcaaacauuuucaggggaucauaucuugcaggcgcaggcuuagcguucucaaucaugaaaaguguagguacgggaaaacgaggaaccggaucacaaggagaaacccuuggugaaaaauggaagaagaaauugaaccaacuaagcagaaaagaguuugauuuguauaagaaaucagguauuacagagguagacagaacagaagcuaaagagggauuaaagagaggagaaauaacccaucacgcaguaucuagagguucagcaaaauuacagugguucguagaacguaacaugguaaucccagagggacgaguaauagauuuagggugcgguagagguggcugguccuauuacugcgcggggcugaagaaagugacugaggucaggggcuauaccaaagggggcccaggacacgaagaaccagucccuaugagcacguacgguuggaauaucgugaaguuaaugaguggcaaagauguauuuuacuuaccaccagaaaaaugcgacacacuauuaugcgauauaggggaaaguaguccuagccccacaguagaagaaagcaggaccauuagaguucucaagaugguagagccauggcugaagaauaaccaguucugcauaaaaguccuaaacccauauaugccgaccguaauugaacauuuagagcgacuucaacgaaagcauggcggcaugcuagucaggaacccuuuaucuaggaauagcacgcacgaaauguauuggaucuccaauggaacagguaauauaguugcgagcguuaacaugguuucgcguuuacuauugaauagauuuacaaugacacacagaaggccaaccaucgaaaaggacguagaucucggugcugggacgagacacguaaacgcugagccagaaacccccaauauggacguaauuggagagcggauaaaacgaauuaaagaagaacacaacucaacuuggcacuacgaugacgaaaauccuuauaagacgugggcuuaccauggcagcuaugagguuaaagcuacggggagugcuucaagcaugauuaauggaguaguaaaauuacucacaaagccaugggauguugugccaauggucacacaaauggcuaugacugauacaacuccauuuggacaacaaaggguauucaaggagaaaguagacacucgaacaccacgaucgaugccugguacuagacgagucaugggcauaacggcggaaugguuauggagaacacuagggcgaaacaagaaaccgagauuauguacaagggaagaauuuacaaagaaagugcgaacgaacgcagcgaugggagccgucuucacagaggaaaaccagugggacucagcaaaagcggcaguggaagacgaagauuucuggaaauugguagacagagaacgagaacuacauaaacuaggaaaaugugguagcugcgucuauaauaugaugggcaaacgugagaagaaacucggcgaauuuggaaaagccaaagguaguagagccauaugguacauguggcuuggagccagauaucuagaguucgaagcauugggguuuuuaaaugaagaucauugguuuucacgagaaaauaguuauucagggguugaaggcgaaggcuugcacaaacuagguuacauacuacgagauauuucuaaaaucccgggaggcgcuauguaugcggaugauacagcgggaugggacacccgaauuaccgaagaugaucuccauaacgaagagaaaauuacacaacagauggaucccgaacacaggcaauuagccaacgcaauauuuaaacugacauaucagaauaaaguaguuaagguucagagaccuacuccuacagguacggucauggauaucaucagucguaaggaccaacggggguccggucaaguuggaacauacggauugaacacauucacaaauauggaagcacaacuuauacgacagauggaaggagaaggaguccuaucgaaagcagacuuagaaaacccucauuugccagagaagaaaauuacacaauggcuagagacuaaagguguagaaagguuaaaacgaauggcuaucagcggagaugauuguguaguuaaaccaauugacgaucgcuuugccaacgcguuacuggcauugaaugauauggguaaaguccggaaagacaucccucaauggcaacccaguaaggguuggcaugauuggcagcaaguccccuucugcagucaccauuuucaugaauuaauaaugaaggaugggcgcaaguuaguugugccgugcagaccccaagaugaauuaauugggagggcuagaaucucacagggugcuggcuggagucuaagggagaccgcaugcuugggaaaggcuuacgcccagauguggucucucauguauuuccauagacgugaccuaagacucgcaaguaaugcuauauguucugcuguucccguccauugggugccaacguccagaaccacauggucuauacaugcacaucaccaauggaugacuacggaggauaugcuaacuguuuggaaccguguuuggauagaagacaaucccuggauggaagauaaaacuccaguuacuacaugggaaaauguacccuauuuaggcaaacgagaagaccaguggugugggucacucauaggauuaaccaguagggcgacaugggcacaaaauauacccaccgcgauucaacaggugcgaucauuaauaggaaacgaggaguucuuagacuacaugccaucaaugaagagguuucguaaagaagaggaaagcgaaggugcaaucugguag

SEQ ID NO: 23370 - RNA, 9873 nt, Artificial Sequence
  derived and/or modified CDS sequence (opt6) from DENV-3__FJ547084__SS-prME
acuucucuaugccuaaugaugauacuaccugcugcgcuugccuuucacuuaacaagucgagauggagaaccaaggaugauugugggcaaaaacgaaagaggaaaaagucuguuauuuaaaacggcaucuggaauaaacaugugcacuuuaaucgcgauggaccuaggagaaaugugcgaugacacagugacauauaaaugcccccacauaaccgagguagaaccggaggauauagacuguugguguaaccuuacaucgacguggguaacauaugguacauguaaccaagccggagagcauaggagggauaaaagaucaguagcuuuagcaccccauguugggaugggucuugacacacgcacucaaacauggauguccgcagaaggggcuuggcgacaagucgagaaaguagagaccugggcucuaagacauccuggguuuacaauacuagcuuuguuuuuagcucauuauauaggcacaucacuaacucaaaaaguaguuauauuuauucuacuuaugcucguaacuccuaguaugacuaugagaugugugggugucggaaauagagauuuuguggaaggucuuaguggagcgaccuggguggauguaguguuagaacacggcggguguguuacgacaauggcgaaaaacaaaccaacucuagacauagagcuucagaaaacagaggcuacacaacuagcuacacuucgaaaauuguguauugaaggcaaaauuacuaauauaacgacugacucuagaugcccuacgcaaggugaagcaguacuaccggaagaacaagaucaaaauuauguuuguaaacauacauacguagaccgagguuggggaaacgguuguggccucuucgguaaaggaucccuggugacaugugcgaaauuucaaugucuggaacccauagagggaaaaguaguacaauaugaaaauuuaaaauacacggugauuauaacagugcacacaggagaucaacaccaaguaggaaaugaaacccaaggaguaacagccgaaauaacuccucaagccucuacaacagaagcaauacugcccgaguacgggacacuaggucuagagugcagcccaaggaccggcuuagacuuuaaugaaaugauccucuuaacgaugaaaaacaaagcguggaugguacaccgacaaugguucuuugauuuaccacucccuuggacgaguggagcaacuacagaaacgccaacauggaaccguaaagagcuauuagugacauuuaaaaaugcucacgcgaagaaacaagagguaguggucuugggaucucaagaaggcgcaaugcacacugccuuaacuggcgcaacagaaauccaaaauaguggagggacgucuauuuuugcaggccaucuaaaaugucguuuaaaaauggauaaauuagaauuaaaaggaaugucuuaugcuauguguacaaacacauucguacucaagaaagagguaucagaaacacagcacgguacuauacuuauaaaaguagaauacaaaggugaagauguaccuugcaaaauuccuuuuagcaccgaagacgggcaaggcaaggcgcauaauggcaggcugauaacagcaaauccugucguaacuaagaaagaagaaccagucaauauugaagcugaaccgccauuuggugaaaguaacaucgucauugguauaggugacaaugcauuaaaaauaaacugguacaaaagagggaguagcauagguaagauguuugaagcgacagcaaggggugcaagacguauggcaauccucggcgauacggcaugggauuucgggucggucggagguguacuuaacaguuuaggaaagaugguacaucaaauauuuggaucagcuuauacagcuuuauucucaggcgugucgugggugaugaaaauuggaauaggaguuuuauuaaccuggauaggacuuaacaguaagaauaccagcaugaguuucaguuguauugcaauagguaucauaacccuguauuugggcgcaguugugcaagcggacauggguuguguaauuaacuggaaaggaaaagaacugaaauguggcaguggaauauucguaacuaaugaaguacauacauggacagaacaauauaaauuucaagcagauagcccaaaaagguuggcaacagcaauagccggagcaugggaaaauggaguaugcgggauucguucuacaacuagaauggagaaccucuuauggaagcaaauagcuaaugaacuaaauuacauauuaugggaaaauaauaucaaacuuacaguuguaguaggugacacaaucggugugcuggagcaaggaaaaagaacucuaacgccacaaccgauggaauugaaguacuccuggaaaacauggggaaaagcaaagauaguaacugcggaaacccagaauagcaguuucauuauagacggccccaacaccccagaauguccaagcgccagucgggccuggaauguuugggaagucgaagauuacggcuucggaguguucaccacaaauauauggcuuaaauuacgugaaguuuauacacaacuuugugaucauagauuaaugagcgcagccguaaaagacgaaagagcgguacacgcugauaugggcuauuggauugaaucacagaaaaacggaagcuggaaauuagaaaaggcgucccuuaucgagguuaaaacuugcacguggcccaaaucacacacccuauggucgaaugguguccucgaauccgacaugauaauaccaaaaucgcucgcugguccgauuagucagcauaacuacaggcccggcuaucauacgcaaacagcuggcccauggcauuugggaaagcuagaacucgacuucaauuauugcgaaggcacgacuguuguaauuacagaaaauuguggaacucgugguccuucgcuaagaacgacgacuguaaguggcaaauuaauccaugaaugguguugucgaucuuguaccuuaccgccacuucgauacaugggagaagacgguugcugguacgguauggagauuagaccgauaucggaaaaggaagaaaauaugguuaaaucucuagucagcgcuggaaguggaaaaguagacaauuucacaaugggcguauuaugucucgcuauauuauuugaagagguuaugcggggaaaauuuggcaagaaacauaugauuguugguguauucuucacguucgugcuccuccuuuccggacaaauaacauggagagacauggcacacacacuaauuaugaucggaucaaaugccucagauagaaugggcaugggaguuacuuaucuagcccuuauagcgacuuucaaaauucaacccuucuuggcucugggauucuuuuugaggaaauuaaccuccagagaaaaucucuuacucggcguagguuuggcuauggcuacaacucuacaguuacccgaagauauagaacagauggccaauggaauugccuugggacugauggcgcuaaaacuaaccacgcaauuugagacguaccaauuauggaccgcgcucaucucgcuuacuugcucaaauacaaucuuuacccuaacgguugccuggagaacagcaacgcuuauauuagcugggguaagccuacuaccuguaugucaaucaaguucaaugcggaagacagauugguugcccaugacgguagcagcaaugggcgugccuccauuacccuuauucauauucagucugaaagacacccuuaagagacgcucuuggccacugaaugaagggguaauggcuguuggauuaguuucuaucuuggcuucaucucuauuacgcaacgauguaccaauggcagggccguuaguugcugguggcuuauuaauagcuuguuauguaaucacggggacaagugcugaucuuacuguugaaaaagccgcagauguaacaugggaggaggaagcggaacaaacgggaguaagucauaacuuaaugauaacaguggaugacgacggaacuaugagaauaaaagaugaugaaacagaaaacauacuuacaguacuuuuaaaaacagcgcuacucaucguguccggaaucuuccccuacagcauaccggcuacgcuccugguauggcauacauggcagaaacaaacacaacggucaggagugcuuugggauguuccgucaccuccggagacucagaaagcggaacuagaggaagguguauacagaauaaaacaacaagguauuuucggcaagacgcaaguaggugucggcguacaaaaggaaggagucuuucacacuauguggcacgucacuagaggcgcagucuugacuuauaacggaaaacgucuagagccaaauugggcaagugucaagaaagauuuaauaucuuauggaggggguuggaggcuuagugcccaauggcagaaaggggaggagguucagguuauugcgguagaaccaggcaaaaauccaaagaacuuccaaacaaugccggguaccuuucaaacuacgacuggcgaaauaggggcaauagcccuugauuucaaaccuggcacuucggguucgccuauaauaaaucgggaaggcaaaguaguuggguuauacgguaacgggguaguaaccaagaaugguggcuacguaagcggaauugcacagacuaaugcagagccagaugggccaacgccagaguuggaagaagaaauguucaaaaagcggaacuuaacaauuauggaucuccauccagggucaggaaaaacucguaaguaucuaccugcaaucguaagagaggcaauaaagcguaggcuuagaacuuuaauucucgcacccaccagagucguagcggcagaaauggaagaagcacuaaaaggacuaccaauaagauaccagaccacggccacuaagagugagcacacaggaagggaaauugucgaucuuaugugucaugcaacauuuacuaugcgauuauuaucaccaguccgagugccuaauuacaaucuaauaauuauggaugaagcccacuucacggauccagcauccauugcugccagaggguauauaucgacgagaguaggaaugggagaagccgcggcaauauuuaugacagccacaccgcccggcacugccgacgcguuuccucaaaguaaugcacccauacaggacgaagaacgcgauauaccagaacgcucauggaacaguggcaaugaauggauaacugauuuugcgggaaaaacuguaugguuuguucccaguaucaaagcaggaaaugauaucgccaauugcuugagaaagaaugguaagaaagugauccaauuaagccggaaaacuuuugacaccgaguaccagaaaacaaaguuaaacgauugggauuucgucguaacgacugacauuucagaaaugggagcuaacuuuaaagccgaucgagucauagauccccggcguugucucaaacccguaauauuaacggauggaccagaacgcguaauauuagccgggccgaugcccguuacugcggcaagugcugcucaaagaaggggaagaguaggcagaaauccucagaaagaaaaugaccaauacauauuuacggggcagccucuuaauaaugacgaagaucaugcacauuggacggaagcaaaaauguugcuugauaauauaaauaccccagaaggaaucauucccgccuuguuugaaccagaaagagagaaaucagccgcaaucgauggagaauauagauuaaagggggaaagcagaaaaacguucguggaauuaaugagaagaggcgacuuacccguguggcucgcucacaaggucgcgucugaagguaucaaauauacugacagaaagugguguuucgauggacaacgcaauaaucaaauucuugaagagaauauggauguagaaauauggacaaaggagggcgaaaagaagaaauuaagaccaagaugguuagaugcaagaacuuacuccgauccacuagcccuaaaagaauuuaaagauuuugcagcuggaaggaaaaguauagcacucgaccuagucacagaaauaggucguguaccaucccaucuagcacaccgaacaagaaacgcuuuagacaaccugguuaugcuacacacguccgaacauggcggcaaagcauaucggcacgccguagaggaacucccagaaacaauggaaacccuacuuuuguuaggccucaugauuuugcucacaggaggagccaugcuauucuuaaucucaggcaaggguauugggaaaaccaguaucggauuaaucugugugauagcuaguagcggaaugcuuuggauggcggagauaccacuucaauggauagcuagugccauuguauuagaguucuuuaugaugguacuccugauaccagaacccgaaaaacagcguaccccacaagacaaccaacuggcuuacguuguaauaggaauacuuacacuggcagcaauuauagcagcuaacgaaauggggcuuuuagaaaccacgaagagagacuuaggaaugucaaaggagccuggugugguaucuccuacaucuuaucuugacgucgaucuccauccugcuucugcuuggacauuauacgccguugcaacuacaguaauaaccccaauguuaagacacacaauagaaaauaguacugcuaaugucucacuagcagcaaucgcaaaucaagcgguuguuuuaaugggucuagauaaaggauggccgauauccaaaauggacuuaggagucccuuuauuagcucuaggcuguuacucccagguaaacccccucacacuaacggcugccgugcuacucuuaauaacacauuacgcaauaauaggacccggcuugcaagcuaaggccacccgggaagcacagaaacgcacagcagcgggaauaaugaaaaauccaacaguagacggaauaaugacaauugaucuagauccaguuaucuaugauucgaaguuugagaaacaacuaggacaaguaaugcuauugguguuaugcgcaguucaacuauugcuaaugagaacaagcugggcacuaugugaagcauuaacccuugcaacgggacccauuacuacccuaugggaagguucaccggguaaauucuggaauacaaccauagcaguuucgauggccaacauuuuucgugggucguaucuagcuggugcaggacuagcauuuaguauaaugaaaucgguuggcacugggaaacgaggaacagggagucagggcgaaacauuaggagaaaaguggaagaagaaauugaaucagcuuuccagaaaagaauuugaucuuuacaagaaaucaggaaucaccgaaguagaucguacagaagccaaagaggguuuaaaaagaggagaaauaacucaucaugcagugagcaggggaagugcaaaacuucaaugguuugucgagaggaauaugguaauuccugaaggccgcguaauagaucuuggcuguggucgagguggauggucauauuauugugcuggacucaagaaaguaacagaagucaggggcuauaccaaaggaggaccuggacacgaggaaccgguucccauguccacauaugguuggaauaucguuaaacuaaugucaggcaaagauguuuucuauuuaccaccggaaaagugugauacacuucuaugcgacauaggagaaaguagcccaucacccacuguagaagaaucgagaacgauaagaguauuaaaaaugguugaaccauggcugaaaaauaaccaauucugcauaaaaguauuaaacccauacaugccaacgguaauugagcacuuagaacgucuacaacguaaacacggagggaugcugguaagaaaucccuuaucuagaaauucaacgcacgaaauguacuggaucaguaacggaacaggcaauauaguagcaucugugaauaugguaucacguuuacuacuuaauagauucacgaugacucaccggagacccacaauugaaaaagacguagauuugggugcggguacuaggcacguaaacgcagaaccagagacaccuaauauggaugucauuggugaacguauaaaaagaauuaaggaagaacauaacucuacuuggcacuacgaugacgaaaacccuuacaaaacaugggccuaucacggaagcuaugaggucaaagcgacuggaucagcuaguagcaugauaaauggagugguaaaguuauuaacaaaaccuugggacguuguuccaauggugacucaaauggcaaugacagacacuacgccguuuggacagcagaggguauuuaaagaaaaaguagauacaagaacgccccgguccaugccagguaccagacgggugaugggaaucaccgcagaaugguuauggagaacccugggucgaaauaagaaaccuagauugugcacacgggaagaguuuacaaagaaagugcguacuaaugcggcaaugggugcaguuuucaccgaggaaaaccaaugggacagugcaaaagccgcgguugaagaugaggauuucuggaaauuagucgaucgcgaaagagaguuacacaaacuaggaaaaugugggaguuguguauauaauaugaugggcaagagagaaaagaaacuuggcgaauuuggcaaagcgaaagggucaagagcgauaugguacauguggcuaggugcccguuaucuagaguucgaagcccuaggcuuucuuaaugaagaucacugguucuccagagagaacucauacagcggaguugagggagagggauuacauaaauuagguuacauacuucgagauauuucaaaaauaccaggcggugccauguaugcagaugacacagcugguugggauacacggauuacagaagacgaucuucacaaugaagagaaaauaacucaacaaauggauccagaacacagacaacuugcaaaugcaauauuuaaacugacauaucagaacaaaguagucaaaguccaacgcccgaccccaacaggcacagugauggacauaauaucuagaaaggaucagagaggaaguggacaaguugggacuuacgggcucaauacauuuacaaacauggaagcacaauugauacgucaaauggagggggagggaguguugaguaaagcagaccuugaaaauccccaucugccggagaagaaaauaacccaauggcuagaaacaaaaggagucgaacgacuaaaacgaauggcaauaucaggagaugauugcguuguaaaaccaauagacgaucgcuuugcaaacgcacuacuugcuuugaaugacauggguaaggugagaaaagauaucccucaauggcaaccaagcaaaggcuggcacgacuggcaacaaguaccauuuuguagucaccauuuccacgaauuaauaaugaaggacggucgcaaauugguaguaccuugcagaccucaagaugagcuaauugguagagcccggauaagucaaggagcaggauggucguuaagggaaacagcaugucuaggcaaggcauaugcccagauguggagccucauguauuuccaccggcgggaucuucgucuggcaaguaaugccauauguucagcuguuccggugcacuggguaccaacgucaaggacuacaugguccauacaugcgcaucaccaauggaugacgacugaggauauguuaaccguauggaauagagucuggaucgaagacaauccauggauggaggauaaaaccccggucacaacaugggaaaacguaccuuauuuaggcaagcgugaagaucaauggugcggaucuuugauaggucucacuucuagggcaacuugggcacagaauauuccaacggcuauucaacaaguuaggucacuuaucgggaaugaagaguuuuuagauuauaugccuagcaugaaacgauucagaaaggaggaggagagcgaaggcgcaauuugguaa
